United States Patent 10,718,023 (GENETIC POLYMORPHISMS ASSOCIATED WITH LIVER FIBROSIS, METHODS OF DETECTION AND USES THEREOF) - sequence listing, part 3

SEQ ID NO: 5097 - DNA, 95604 bp, Homo sapiens
  misc_feature (354)..(557): n is a, c, g, or t
  misc_feature (89347)..(89457): n is a, c, g, or t
ggcccttgcagtcggcgcccagcgcggggttgaacgcgtgcaggacgggttccttggggccgccgggcccaggtacgcttctttgaagacgtggaactcgtcctcctcgtacttcacggggccttcaggccgatgttctccgaagcgaacggaccctcggggcttaagagctccgtcccatcgcatcctcggggctgggcagcccgcccggcagagggccctcctccatggcgcaggcggcggggcgggatggcgggggccgcgcacctgcaacacgcggccaggtgagaggcagcagaggagaggacgaggggaggggcggccagaaaggggacagccaagggaggggcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgtcattcctcctcggaggacgcacctgggccgccggggctgccgcatcgtggatcgagcgggatggggcgtgggccgggcctcatgcgatgcggccgttggcggttggagaagggggaagggtgagggacaggaacctggggggagggaagaggcgcccgggcagtgggcggggcctgggcgtggggcggagtcgaggtcggggcgggaggtaaaggcggggccagggaggtgtggtgggcgtggtctggggcgggaggagacaggtcgcgaggggcggggcctggactgccgctgttgccagagcgggtcaggggaggcactccaggttcagccgatccaggctcaggtggggaaactgaggtccccatcaactcgggcagcctaagtgggactgcctagcttggcttctgaccttgggcttcagttatatttttctggccggcgtggttgctcacgcctgtagtcccagcactttgggaggccgaggcaggcggattactgaggtcaggagttcaaaaccagcctgggcaacatggtgaaaccccgtctctactaaaatacaaaaattagctggccgtggtggcacgcgcctgtaatcccagctacttggaaggctgggcaggagaatcgcttgagcccgggaggtggaggttgcagtgagccgagatcccgccacgcactccagcctgtgccacagagctagactccgtctcaaaaaaataaataaaataaaataaacatttttctacactcgagctctcaagacagatcccggcctgggacgctgcgggtggcagagggcaggggcttgcaccgcacgttcccagccttgcacccactcccggtccttggtacgcagcttacaggtgcaactgatggagttggtcccgaaatagaagtaacaaatacggcgggcgtggtggctcacgtctgtaatcccagcactttgggaggccgaggcgggtggatcactgaggtcaggagttcgagaccagcctggccaacatatagtgaaactccgtctctactaaaaatacaaaaactagctgggcgtagtggcgcacgcctgtagtcccagctacatagaagctgaggcttgaacctgggagatgggggttgcagtgagctgagattgtgtcactgtactcagcctgaccaacagagaaaggctccctctcagaaaaaaaaaaaaaaactcacaaatacatgaaagtctcaaattttgggtggggaatgagctatttcatctttaaggagtcaatagattcactgtttaatcaagaggaggtgaaagtttaattcaagtgatggcgaaaactgcaaaggtgtagagggactggtgggagtgggtgctggggagacagcctcaggtactgtctactcagtactgttttggtaaaaataaagaatgtaaaacatcagctttctaatctcacttttaaaattaaatacttttctaaatttttaaagggtagtacccaaggcacagcaacaccgtgtacatttagttgtacatttaacattcaaaaatcaagaaaattttgcctggggctgggcgtggggctcatgcctgtaatcccagcactctgggaggccaaggtggtcagatcacttgaagtcggagttcaagaccagcctgactaacatggtgaaaccctgtctctactaaaaatacaaaatagctaggcatggtggtgcacacctgcaatcccagctatttgtgaggctgaggcaggagattgcttgaacctgggaggcggaggttgcagtgagctgagattgcaccattgtactttacctgggcaaaaagattgaaactccatctcaaaaatcaaacaaacaaaaacaacaacaacaaaaacactcacagaagcagaaaaaataataaaaataataaatcgaagagcccaagaatatgcatagcttgagtggcccaagcgagagagtaacccacaaggttgcaccgttcattcgttactaatcagaatcagacgtctactgagtagcatcatgccaggcatacacagccaccttgggggtcacccacgggttgcaatcaagcctggaggctctgcacctgctgctcctagatcttgctgccctgctgcactggccgggctggctccgtcgagtctctcaggtctcagctcacccactctaagtgggtcaacctccctgccagctaccaccccctcccaatgatcctcttattgcctcagaacacttaaaatccttcaactggttggcttgttctctttttcctctgtgaatggtttggctctgtgtccccacccaaatctcatcttgaattgtaatccctctgtgtcagggaggggcctggtgggaggtgattggatcaaggaggcggttcccctacgctgttcttgaataagaagtgagttctcacaagatctgatggcttaaaagtgttcggcaattccccctcctctctctcctctgctgccatgtaacaggtttcttgcttccccttcaccttctgccatgttataagtttcctgaggcctccccagccatgctgaactgtgagtcaattgactgtctttctttatacttacccagtctcaagaagttctttacagcaatgtaaaaatggactaatgagcagccagaacctggtggggtcactgctgtctccccagtgcctagaacaggcgctgatatgtttggatgtgtgtccccacccaaatctcaggttcagtggtaatccctaatgttggaggggggcctgatgggaagtgactggatcatgggcgtgcatttctcatgaacagcaccatcctcttgctactgtcctcaccatagagtgcgtgagttcctgtgagatctggttgttcgcaatgtgtaagagagcacctcctctctctctctcagatctggttgtttgcaaatgtgtaagaagcacctcctctctttctctctctgtctcctttcaccatgtagaatgcctgctcccccttgccttccaccatgagtaaaaagctgtttgaggcctccccagaagcagatgcctccatgttcctgtatagcctgcagaactgagagccaattaaacctcttataaattacccagtctcgctatttctttacagcaatgtgagaatggcctaatacaggtgctcaagaaaaacagaaaatggaattcatgcattacttttaacatatttattgagcatcttttatgtgtcaggcactttctcagcattgaggcaatggaatggatgaataaatgcacagcaagtgaaaatcaacagcttttctttccagcccagcacatgaacttggtgatgtccatggtctcctccaaggcctttttccatatgctgagactttccactttgtctcaagtatctgaacttggtccttgacttaaatccccttaatataacaaaagagacagaaacaaatcttgtagtagactggggttaatgtttattaatgataacctacattcacactgcatttctaagatttacatccaaagagcatatgtatttacatgcaccggtcagcccaagataacaaattcaaaccatggctgcgttaagaaatggtttgttccaattaaattaaacagataatactcttatcaccccccttggacatgtcaataagacccctctttctcccctcaaggaatataaaattgcattgataactgcactgagagcaacaattacatttgaaacatttaaaacctgagagagaaacccaaatatgtttaagactcacgtctacactcaaaatgccctgtgaactctagtgtaacacagattgctcagtggcaacagtgcatgatctagctggctctgatagggactgacgccggctgctggcttttaacggaagtgctattcttgcccagggcagagagagctacatccccgctgcctgcttgacggaagtcaggggcttttgttgttggtttgtttttgcttttttttttagacggagtctcgctcgtcgcccaggctggagtgcagtggagcgatctcggctcactgcaagctccgcctcccggttcacgccattctcctgcctcagcctcctgagtagctgggactacaggcgcccgccacccgcccggctcattttttgaatttttagtagagacggggtttcaccgtgttagccaggatgtctccatctcctgacctcgtgatccgcccgccttggcctcccaaagtgctgggattaccgcatgagccaccgcgcctggacgcttttttttttttttttgtcttttgttttcatttttcttgctttcaggagaaaaaaaatctttggcccataaaggtgggatttttacatcatgagtatacatacataaaacatgcatgtgggccgcgcatggtggctcatgcctgtaatcccacactttgggaggctgaggcaggtggatcacctgaggtcaggagttcgagaccagcctgacaatatgatgaaaccccgtctctactaaaaatacaaaaattagcagggcatggtgttggcgtgtaatcccagctacttgggaggctgagacaggagaatcgcttgaacctgcaaggcaatgctgcagtgagccgagattgcaccactgcactccagcctgggcaacaagagtgaaacccatctcaaaaaaaaaaaaaaaaaaaaaaggcacgtgttctccggcaagcaccttccatgactccaacagttcagccatcgctgttgtactatcggggtgcagcactctgaaggagtcggcccaactagaaccaagtggtcaaaaaaataaatacacaatttaaaacaatggacagcaagcttgtcatgacagacagtgggaatttcattccatgatgcttcatttttgcattaaaactgaagatgactcagtgcataattgctttgtggtccatgagacgctttcgtgaaggcatcctatctgaaggacaggctgggtgaacacctagcactgtcacttgagacatcttggctgtcaccaaggtgagccggcatactgtctccatcaccctctggtgagtctttcccctcacgggtgggaggagaaggccatcccttggggtcgtggagccactctctcctcaccacggtggctgccctccccttcctcacttgctagtccccgcttggtggccgatgccctgccctcctgctgtcactttgggaaagagatcctcctgaggcacgtgtcatgttttattcttgagtgattatctgaccatcacggcccttgctccccttttatgacatgtgcctgttatttcttttgtgcttatgatgacaagaaggcagtcccgggaggggagtctggcacagctgcccttgggaggaactggtgtttctgagggggagggggctggtggggtgtagcaaatgcttatgtacggtatccatactcagtcaattgtgaagggaacagtatacccacaattccacccaaagactcacaaaataaatctttctctccatctcccttacatttagggcctttcatttttaaggcacgggttgtgaagacttgaagacatacaaggtcagtaaaactgaagaccttgcatcctgctgcttcaaatgtggagaggcaaacacaggctactggaccagacgggaacggttacccacgtgacaaaagcaggtctccaaagcacagcattttggttagtgcattccagatgtgttagcacaactggggacaccaacttgaataacacatttttcttttaacaaaacaaaagtttacctgcttggatgatgctaaatgcccttaagcactaggccttcggttgccactgagaaagcaaccatttccattccactgtgtgtgaagccacaaccctactaattccttcattaactcaaaagatttgcatcccttaataaatccaagccgatgcggagacatcaggggagactttatcgatgtcccccaagggagggcaagtctggaagtagtggggttatgcttcacaggggagagtactgttctaggaaaaaaaaacacccacattttctggaaggaaaactgagtttttttaaagcagtgtttcatcccgagctaaggtcaggattaatgcctatttttcatttggtttgcacagaagagctcgttttccttcccagcagctccagtggaattactttttggaattagaacgagaccaaacaaagtgatgatgtcagtcattgcttctttcaggtgccttccaaagcgatagaatcctttcatgtaaaaacaaaaaccaaaaacctattaaaacgtggccatccccacattcaagctttttcatttgcaatctgacccaatgtttcattgaaattcctttctgccagtctctaagatctgaccaacgtcttaaagcttaacttagacattccagagaaatgctgaggtaaagagatgacagctgatgtgtttgtgcgggtgtgttgtcgatctaagccttcccctatgccaatgcgtttatcccacggaaaacacaatgaccatcctgagcatggtggctcatgctgtaatcccagcactttggaatcgcttgagcccaggagttcaagaccagcctgggaaactggtgaaaccacatttctacaaaaaatacaaaaatcagccaggtgtggtggcactccccatagtcccagctactcaggaggctgaagtaggaggatcccctgagcccaggaggctgaactgcagtgagccgagatcacaccactgcactctagcctgggtggcagagtgagaccctgctaaaacaaacaaacaaacaaacaacaaaagaaaaccgcagtgaacaaataaaccccaattcctctgttaacagcgacagtggcatgggttgccaggctatgtacgacaaggaaagcaaatataaataagggcaatgtgccatgctagggaggaggtcccttgttccatccacagagaagccgggggtcccctgctctgtatgcagatttcttagtgtgtacccattatttttagtcatcttccaagtgctaaagagtctgaaagttacagcagcactccaacgttaagcttcaaaccattgctgccaacagaggtaaacatgttaaaccaaattagatacatttcctttttttttttttttttctgagacggagtctcactccatcacccaggctggagtgcagtggcatgacctggctcactacaacctccacctcccgggttcaagcgattctcctacctcagcctcctagtagctgggattacaggcgtgtgccaccacaccagctaagttttgtatttttagtagagcggggtttcaccatgttggccaggatggtttcaaactcctcacctcaagtgattggccgcctcagcctcccaaagtgctgagattataggtgtgagccaccgtgcctggctgagataatttgtttaaaactaggtaaagagaattttgaaattcacttatggctgggcacagtggcgaagcctgtaatcccaacactgggaggctgaggtaagaggatcgcgtgagcccaggagtcaagacttgcctgggaaatgtggggagaccctgtctgtacaaacaattttttaattaaaaaatttaggccaggcgcggtggctcatgcctgtaatctcagcactttgggaggtcgaggaggtggatcatctgaggtcaggagtttgagaccagcctgcccaacatggtgaaaccctgctctactaaaaatacaaaaaaattagccggggtagtggcgggtgcctgtagtcccagctcttgggaggctgaggcaggagaatcacttgagcccgggaggcagaggttacagtgagccagatctcgcccctgcactccagcctgggcgacagagtgagactgtgtctccaaaaaaaaaaaatttttttttaaaagcagtccatttatgtgaaaattcccgaaatcaagtaaaagcagcagttgaattgactttttctgtcaaattaaagatgtgtttccttaaaaagaataaagcaaaataccccatcttcagaaaaaggaacttcttttcatacataccgtctcagggcaagaaacttggaagaaatgtggaaattgatgaggttctctcccacaaggatgtacgacacacctagccgtcatcagcaacctggaggacaagggaatttgaatttgttgctgggaaatgagaaacgtgaaaaagggactttctaatgttctaaatgcaacactggcggggctcggtggctttccttgtaatcccagcattttgggaggctgaggcaggcgggtcacttgagcccaggggtcgagaccagcccggacaacatggtgaaaccctgtctctacaaaaaaatacacacacacaacaaattagctgggcatggtggcatgcatctgtagtcccagctactcaggaggtggagggggaggatcacctgagatgggggagattcaggctgccatgagccatgatcatgcttactcactccagcctgggtgacagagcgagaccttgtctcaaaaaaataaaaaataagtgcaaactgccaaggacatccatagcaatgatcagcagtaattcctttacggcggtagaaccgcaggtaacaggggcacccagcacggagatgggcccatcacaccccattacccatcccatcccacgccccactgcgcctcgcccagccccgccgcactcaccggtccaaagccccctccgtggacacgtactctgggttattctccaagtcaaacagctccacttgctgctgaggggtcggcttgttgataatctccaaggctcagataaaacctattgagtgaaacagggaaatgttcctaatcccctcctctaccgtccctcaggagtcgctttgggaagacgagaaaagcctggttggtcttttgattgttccacacaccacaagtctatgtctccaaaggcctcactggcttggcagcgtatctgcagagagcatgcggggtgggtggggcccccagactggggcagggaggcagggtgggggtgggggcataccagcaaatagcatctcagacagtgaaggtaacagattatggagtaagattcggaacggggacagaggtgtcagacttgtaccaactcccacgagcagctgccatattttcagagaattttcaagctggctgttaaatacagccactattaaaaataaatttgccaggcgcaatggttcatgtctgtaatctcagcactttgggaacccgacgcggtggattgcctgagctcaggagttcgagaccagcctgggcaacacggtgaaaccccgttctactaaaatacaacaacaaaaaaaattagccaggcatggcagcgtgtgcctgtaatccagctacttgggaggctgaggcaggagaatagcttgaacccgggaggcggaggtttcaggagccaagatggcgccactgcactccagcctgggtgacagagcgagactccatctccaaaaataaaaaataaataaataaataaataaaacttaaattaaatttgagctgggcacagtgtgcacatcagctactcagcaggctaaggacgaagaattgcttgtgtctaggagtttgacccagcctgggcaacactgtaagaccctgtctcaaaaaacaataataatatatttcataacttacaataaaataaaggatttttaaaacaaaggtggtacgcgctcacagctcatcacccctagttacttccgtgcgtcttactgtgacgtaagctctcgaggtcttcgggtctattagtcaggggctacatgtgacagcgaagtttttgaagaaatgcagtactaaacgcgctgccacattttccattttatgacagctacacccacagacccgtttttttcaaatgcccattcgacattaaaatatgttcatgcaaggctgtagtaatttactaagttttggtctagccaatcaactgacggaagaagtggaagagacttacttccttaaggaaaggggactccacagcgaatatttagacaccacgtaaaggcagaagaggtgacgatcgatcccagagccggtcatgggaggcgatacatatgctgatgcttctcagacgccaacttgaacaacttcagcctctgttcacctgagtgacaaaaggtgggaaggacatatgttgcatgtctcaagttgagcagttacgatctaagttagccaccgcacccggctaatattttttgttatttttagtagagacggggttcaacatgttgcccagggtggtttcgaactcctgagctcaggcaatccgcccacctcacctcccaaagtactgggattacaggtgtgagtcaccgcgcccggtgtgacagcctttccgaatgaagtttgtctcggaaaaaaagagccctggccagtgtctcctctggggatcagcgaaagcacctgcacgctctggggatcagcagaaagcacctgcacgctggagtcaggcggaccagtggcctgggtctgacctcggccattagtgagcagaatggcccagcagctgctgaatcatctaggcctctgtttctttatctatggaaatgaactgatgacacttctcaggaccatgctaagaaaatttaaaggacaatgtacagaaaacccccaggccccagcctggcacttgggcccagcgtggcaatggctctaataaccaatggaaggtcccgtgcgacagtcacagctacctaccctgacaccaaccacctgttcagttccaaagcagccacctgctatgcctttcccattgtgtgtcctggcctaatttaaagactctcaggaagtagaatatgatttggagaagatcatttgtaacatgcgtctctgtccttgtccctacctttaccttttaatattttaatacttctgtacccttgaaaggggcagaggaaagaagctgaattgagcacccctaaagaagaggtacaggaatgatgagatcagagaagctggagtgatggcctccagaagccttttagggagtgtgacaagcacgttgtgtcctcagcctgatggcacattaccgtctgggccgggtccccatggcccgcacgaagtcgcatgactcagtggtgcaggagcgcacggtctccgtcctccctctcggaagagccgggtcatggaggcctcgtatgtgaggcaaaacttgcccatgtccggggaaagagaagtacttcagtgcacggcagggcatgctgatatgtctaaaacgtaaggaggattgggtaagattggcaaggagaagtggacttcattgtcaacatttttttgagacgggtcttgctgttgcccaggctggcatgcagtagcatgatcacagctcactgcagcttcacctccccctgctccggtgatccccccacctcagcctcctgagtagctgggactacaggtcatgctaatttttttaaaattttttttgtagagacagggtttcaccacattgcccaggcggtcttaaactcctggctcaagcgatccacccgccttggcttcccaaagtgctgggattcaggtgtgagccactgtgcccagcctattgtcgaatcatattttcagtctctggccgctttacatgtgggtagtgacgtggcagcagacaggtgtcactggcttcaggaagggcctggggaggtgggtcagtttctaggttaaccaggtttctgtttcaagatgcaactgatactatacaccccccccacccccgagtccaacacacctctgctgcattcccttcaggctaaggtgagcctgcagcagtgtacagaaggaatgccgtgcacagcaggggatctgtgtttgaaatgtttaaagacacaacgtattgcctggagcaattccactgcgtctggaagatggtgagaatatctgggagagactgtgctggggtgcaggaagaatgtctagcaggagggcgggaagtggtggggccggagcctgaagcacagccactgccccattagacaggaagcctcgggtgggctgcagatgcacagggaaggtctcttccaaaagctcctgttttctgggtgaagcagaagaagcgggcctgctgagggccaggctggagaggaggtgctggcagcgggagaggggtgtgattggcattcaggggcatggaaacatggtgcctggcccactgcggtcagcgctcactcgtgggaggggagacgagccagctgttgaatgctttttttccagctaggctggtgccttgggacagaatcacagcagctggagagctgggctgaacccgggagcctctgcaggctccccaggaagttcagggggaccagggagtcaaggtaagggatgatcccaaagaaccatggaacccaacccagagaatagaaaagggagggcagggagggacaaggggatggggtcaaggaacgtggcatctgggcctagagaggacagcacggcaggaggggctgatgcccctgaggctgagcctggtggagatgacgggatagtgcagcaagggcccctgctgggaatagcagatggtggataggacagagactgagtccaaggcagcacgcggctgtgggaggaacagcatctgcgtgctccccaagaaggggcccggggccaccaggccagctcaaagaggaccaggttccaagtgggacgagaaggtgataagcagcagtttatggacccaaatgattcctgaccagacacatcccgcacattagtgtgcaccctggcacaggccctggtggccccagggtggcagacccacccactgcaaaggacaccatgtggcaggctgatactgtcaaatgaacccagaagagggtgccaaggcaaggctgggctgagcacagggcctgctcagcctggggaaggggaagccggacagacacaggacccactcagctggggaacggggagccggacagagcacaggacccactcagctgggaacggagagtcagacagagcacaggacccgctcagccggggaaggcctggcacctgacacaggcccagctgaagtcaggctcctcacagtgcagccaagatctctggaggagaggggcccctgaaaggcagaaggtagcgtccaggaccagggcccctgaaaggcagaaggaaggtccagaaccagtgaaatgagagtgcatcagccagcagaaaaaggaaactgaaggcgtcacaagagcagcggctttgcagagggaagcgtctagagaccgtgggagcacgctggacacagcgctaagcagcacttgcagtgaggacctggctgagcccccaggatccccccaacatactggccgccttggggagctctcttccccaacccacagatgccaccaaccctggtggcatacacgacactcaagattcccttgggagcgggggtcacaggcctggggcctgccatgaggcacggggcctcctgcttcccatgctgatagcaaacgcgcctttcagagcccttcccgcactcctcactacagagcacttcataggcgctcacgatgaagaagtggggagagggagagagcagataaaagggaaagcggaaatgtggcattttagttatttaataaaggtaaacttgactatatgatgcaatgattcatttgaaatcaatgttccaatatcaaactttaattgtgtagttatgagaacagtcatgccttgtgcccacagtttaaaagacagccatctaaaaaacttttggcaaatgcattgaatattagtgtgcaagccccactggagctcagacgccatcaaaggccaaaccaggttacaactgcagcacccttgacccactgtgaccagccgccatcaggagatggcccttcgctgccaccaaaacatctccagtttctaagaagcaggattcaaagacagctatagatatactgacatatatggcatcacacactagcactgttactatggggctaatgttcaggttggtagggcttccaaagcaggaggcaaataactgctgcagactagaattaatccactgtctagtgtcagcattcaatccatattcaatattcaatactgatttactgatgccccggcacaggcaatactgttgtaagacagatcatgcctttgccctcaatgagcaaacatctagcaggagacagggatgaacaaaaaaattctatcacatcaagtcaggccactgaatgaaataacacaggaacagggaactagggaacagaacaatgcgggaggggctaccttttttttttttggagacagtctcactctgtcgcccaggctggagtgcagtggtgtgatcttggttactgcaacctctgcctaccgggttcaagcaattctcatgcctcagcctcctgagtagtgggattagagatgcgtgctgccatacctggataatttttgtatttttagtagagacgctttccccatgttggccaggctggtcacaaactcctgacctcaagtgatccacctgtctcgcctcccaaagtgctggggttatgctttataaaatgaaatacacaaggttattgtgcataccttgaaggaccccttcaaggggtcaatataacacaaggttatattgtgtataaccttaaggacccctgagaaggggtccccaggctctcctaggctgcccaaggggtccagggcagaaaaaggttcagaagcttagaagagacccacagggccacagcaaggttctggatttatgaaaaccacagggaggctctgcagctcccagctgggttgagatcggtctgaatgttaattttgaatgaataaatctgatgtatacttttaatagatcactttaatggatctgtcattttattttattttttatttttttgagacagagtctcactctatcgcccatgccggagtgcagggtgcgatctcagctcactataacctccgcctcccaggttcaagggattctcctgcctcgcctcccaagcagctgggattacaggtacctgccaccacgcccagctaattttttgcatttttggtagaggcagggtttcaccatgatggccaggctggtttcgaacttctgacctcagtgatccatccgcctcggcctcccaaactgctgggattacaggcgtcaactaccacgccggcactccagcctgggtgacagagtgacactctatcaaggaggaaaaaaaaaaaaaagaaagaaaaaggaaacttcacaacatcacctgctaatattttgcatttatcctttctagacttgcatgtaacaaagcaagagttgggaaacttctgtaaaatgcagaacaggctgtgcggccaggtgctctctgtggcgactactccgctctcccactggagtgagaacagcacagacacatgtgaaagccgggcatggccgtgcccagaacgcttcactgatgaacactgagacttccgtaattttcacatgtcacaaagtattggtcgcctgttgactgcttttcaactactaaaatgtgaagccattcttagctttctaagccatgaaaacaaaaatgaaaacaaaaacattgagggccaggtttggcctatgagccacagtctgcagatcattgtaagaaacacctgacttcacaaactgttttatgactaaatatttttccgtataatatgccatagatggctgggcgtgtggctcacacctgtaatcccagcactttgggaggccaaggattgcttgagcctaggagttgagaccagcctgggaaacaaggtgaaaccccatctctacaaaaaacataaaaattagcgggcctggtggtaaatgcctatagtcccagctacctgggagactgaggtgggaggatcccagcacccagggaggtcgaggatgcagtaagccgtgattgtgctactgcattccagccgggcaagagtaagaccctgtctcaaaaatatatatacacatatatatgccttagacatccttaatagctatataatattccgctgtgtgaaaataccctattttaatttagtatcatgaaggaagattcactctgccgaaaggaaaggattacactgaaagcttcgtgcaagaagctcctttttcttttgttcccaagcacagagtgacggataaaaggcgaaatgtctccactctggttcaccgggttttgtgtaacaaatatgtaactgacgattcccctaccgccccttttccttgcatcatgggaattccgtaacgtggccacgccctcccttccttcccctcctgcctgttttccttttaaatactgaagccctcaaaaccacctttggaggaaggcacaggcctgtccccaggcacgcatctttaaccttggcaaaatcaacttctaaataaattgagacctgtctagacactttctagtttccagtcttttttttttttttttttttttttttttgagagggagctcgctctgtcacccaggctggagtgcagtggtgcgatctcggctcactggaagctccgctcccgggttcacgccattctcctgcctcagcctcccgagtagctgggagtacaggcgcccccaccgcgcccggctaattttttgtatttttagtagagacggggtttcatcgtgttaccaggatggtctcgatcttctgacctcatgatccgcccacctcagcctcccaaagtgctggattacaggcatgacccactgtgcccggcctgccagcattaacttttaagatttcttctcttctttttttattttttgagacggagttttgttcttattgctcaggttggagtgcagggcgtggtcttggcggctcactgcaacctccacctcccacgttcaagtgattctcccgctcagcctctcaagtagctgggattacaggtgtgcaccaccacccagctaatcttgtattttagcagagatggggttttaccatgttgtccaggctggtctcgaactcctgacctcaaggatccacctgcctaggcctcccaaagtgctgggtttacaggcacgagccactgcgcctgccagatttcctcacatttttacagtaagcttgctcacacgtgttttttgtgtacctacctttttcatggatcatgtgcagggtcaaagttattcttccccgatgcatgtttccaactggtggtctgtgctgctcccagtcctgccatggggcccctaaatttattaaaactattcccgctgctctatgaacatccctgcctcagtccaccctcaccaacatgaaaaaaagcctttacaaccccgtaggcaaaaatctagtcttgtttaagttgtacttgttagattcttggtaagttaagcttattacctacactcattgaccgtatttttcctctcttgtgaaccacagtttcggtctgactccttatttctcttggattatttttttccaaaggcaaccacttagccagattcccagctccatttactcaccagctccccgtcccctactgatgtcaaatgctccctccatacacgttatttcccaggcctgcttttgtacgaggactgcagcattttatttttattaaaacaatttttttaaagatagggtctcactgtcatccaggctgtagtgcagtggcacgatacggctcactgcagcctccacctccggggctcaagtgatcctcccaccttagcctccgggtaccttggactacaggcatgcgccaccatgctgggctaattttttttttttttttttttattttttgtacagatagagtctccccatattgcccagtctggtctcaaactcctggaccaagtgatccacctgcctcagccacccaaagtgctaggattataggactgagaccacttaatcacaacagtcttctaactcctacactttaagttttaggatttgaaaaagtacatgtcacctccccgtgtcctgcctccgcctgattgcttttcttttcaaaaatgttacaggtgatctcaaatgttagccttttcaagcctcaagatcaactgggcaagctcctctcctgaagccctgcctgacctctcactgtgttcatattaaatgtgtgaactaagccaggcatggtggccaggcttgtaatcccagcactttgggaggctgaggcaggcggatcacttgaggtcaggactcgagaccagcctggccaacgtggtgaaactccgtctctactaaagatacaaaaattaccaggtgtggtggcaggcacctgtagtttcagctactcgaggggctgaggcaggagaatacttgaacctgggagccgagtgagcagccgaggctgcagtgagccgagatcgtgccactcactccagcctgggcaacagagtaaggctccgtctcaaaaaaaaaaaaaacagtgtgaatgggaacatcccttcctctatggttctgaagttttttttcatccaaaatcatggcttttctccctctccctggggaggagttggggggcgagtgctcctcggccttcttcccagagtcagtctgctttatacacgtatgcctggaaggtggggccccagattctcgtttctattacatctcttattatatttcccacttggccatcatccttgtgcaagaaagctggtggtctttggcaactctgcgctgggccggctcactgggtgtgcctcttaatcgtcaaagcctttctgcgttccatctcctgaacagacataaatgttcttcctgcccaattaccctgtcatctgctaaggcatcctcatctttcttgttttaaggggactgcctcccacacttttactttgaagcatagctagctattaatacacgatgccacttatcctgttaaggaaagagccctattactaaccccttgaccaagagctcttatcaggaatggatgttaaacgtgaaacgtcttcttaggactgtgaaactcactatctaggctcttctctgacccaacagtatggtttagtgtatgactgatttactgacacaaaaccagcctctcaccgctggtgtacgccactgtgggtgactattttttcctacagtgctggattctagttgctaagattttatggagggtctctgcacttccatcatgcgggaagctggtctgtgcttcctttttctgcgtttagctgcagcacagtgatgaagccacaggttctcgaacaagcctgcctgcttccgatctcagtcctgctgcgtacgagcggagccctcaggcaagatgcttcacctccgagtgtggagggcagagatgaagagatgcctcctcggggccgtcctgaagtttcgctcgctcctgccaagtacatggcacagtggctgggccccttgcagctcattcccacacctgggccacgtgggttctggggagcagatggggtgcttcctttgtggagtctctgagctgcaagctctttggagtcacaagggtggctccctgaaacctctcactttggtccctggaccagagaccttttcaggttttctaccttgagtcaactcaccaatttgtactgcttgcagaatagtcatttcagcatgtttcaaaatgtactaaacggagcgtggcatttccttactaaactcctaagtcctgcgcttacttgcagggaattctttaaaaaagaaaaaaatttaaaaagataaaataacatcctttctgtaggtaaggtatcaatgcttgcatgccctcatactgcacgtttacgggcaaaatctgctcatcaattctcaaaaccagctcattgattctgagatgcgatgcctctattccatgtcaccttttaatcacatgactttagtcaatgatctgtcacagacaggagcttgtcactgtgctcctggtactctgcccgctgcttctggtttacgcatagtgagcatgttacttgggaaagcaaggcttcataactggacagtctttacagactgtattagcatgcattttaaatacgattttggcccattcattcagttcatctgatattaacactgcctcttacttctctgtaactgttttcttaactttaggggagagagcatagactctggagccgctggcccgctttatccctgcctagtgccaccctgcaagcacctggcctctctgcacctgtttcctcacctgtaaaatgggaaaacaagatttttgaggcataatggggacttgtaaatttttaaaaatgggataacaagagtgcctcccagggcagagacagtgaagcatgaggtacatgatgcaccaagcaaaattcaacaatggcacaacgttaccaaggttgggggggcagtgccacacgctgcatatgtgtacagcactcaagtttaatacaaggctgggcacggtggctcacgcctataatcccagcactttgggaggccaagggggtggatcacctgaagccaggagctcgagaccagcctgctcaacatggtgaaaccccactctactaaaaatacaaaaaattagctgggcatgggggcgcacacctgtaatcccagctctcgggaggctgaggcaggagaactgcttgaacccgggaggtggaggttgcagtgagccagatcatgccattacactccagcctgggtaacaagagtgagattctgtctcaaaaaaaagttgggaatatctcaagccaatgccacgatgacttgtgttgcccccagaaaccaagggcccctgtctgggatggaatgctccctccaatggacaagaagacccatttatgtccctgctggggtgcaggctgctcctccaaaaggggttggccaggtgcaagccaaaatatggccagtctcagaaaagggagatggaaatgccatgtgtatacaggggatccagcccatggcacctcaagtggctggagtttctccttttatggaaggagatgtcaaaggccagagacgttaagtatttgcccaaagacatcacttaatagctatataatattccactgtatgaaaataccaaaattaatttagtatggtgaaaggaagatttactctgccaaaaggaaaggattaagctgaaactaagtcatgcaagaagctttttattttgttcccaagcagagagcgacagatgaaacgtgaccatgttcacctgacctgtgtgaagtgcagatttaccgagcgccagacgaatacgtactgactattcccctacctgcccacactatttccactttagcaaatgctaggattcggggttattatggggcttaactctccctctgtagagtgatgagatctcactttgtcctcatccccagactctccctctcccgtgtcagctgggaatctacgcctgctggagggggatttgcgactttgcccgcgtgcgtggtgaaacacccaacgccacccggcccccggagaccggggtcgggggagctgtgcttctcctatgccgggtttcgggccttccctccccactgggtgaacatcttgggcaggtgtaggaacccccaaagtgctcacgacaaaaccctaggcggtcagttctaccttgtagtgcgccagctggagggccagctgcacaaaggcgtctgggctcgtgcgactttcttgatgattcctttaccaaaggctacgaatgggaaggaatggaaatccacgtcgttgccagaagatttgcggtgttcagggaggtctctataacctcttgacacttgagagaaaaagaaaaaggttttacggaacgaggggagaaaagtactgacgcacacccagaaggaaatggaggctggtttttagtgcagctataaactcggtactgggaagtacacaaacgttttccgacccagaagccctagtaagttaggggcatggctccctgaccccggaggagcagctgcatgttatagcaggtagcgggtctgacatgagcaggccaggagagggcttcctccgacacaactgggaatatcacgcgaccatcagtgatggtcaggtggttgtgaactgtctctctaaataataataggtcacagccggtgccagggaaaggcagtctctcagtagatagaaatggagtggtgaccagcagcttcccgataagatctcaagcgttgggcgagtgggctgaagcatgccactgagaggcaaaatggcggcgtctaactggactatgagcttcctccagcagtgctagcaggcaagggcagaacacctcaagtgagcatgcgcacaactccagtaaacatactgcgctgctcccttcccaagcgctggagccactgtgcatgcggacagcccacaacaagggaggattgggagaagtaacacaagaccctggacgcatgccaatgtataaaacctcaagtcaagagtcaaacctcgcacttaatctcccaagttggccgcttggccctcttccaaatgtactttcttcctttcgttcctaaagtttttaaaataaactttcccgcttttaaacttggtctctctgccttctgccccacagtcaaattcgttctgagaaggcaagaattgaggttgctgcagaccgtacagatatgttctgacgctaacaggaacatgggtaggggacgggggcaccctggctccagtgagaccccaaagggtgtttcaaatagtcacacgtcatcttatgatgacgtcatacacagtggcaatcaagaaacacatttttttactttttattattaatttttatttatttagatagggtgtccctctgttgcccaggctggagtgcagtggcaccatcgctgctcactgaccttctgcctccctggttcaagccattctcctgcctcagcctccggagtagctgggacacaggcacttaccactatgcccggctaatttttgtatttttagtagagacggggtttcacatggtggcaggcacctgtaatcctagctacttgggaggctgaagcaggagaatcgtttaacctgggaggcagaggttgcagtgagctgagatcgcgccattgcactccagcctgggtacagtgcgagactacatctcaaaaaaaaaaaaaaaaaagaaaaagaaaatggtatcttgactccagggaatttctccttggattaagtgaactaggatttggtatttgcaaccctaaattccttcccaaaagggctcctgtgaatgggctgcctctgagcatgtttaagaggtgccaaatgaattaaactttgagaagtataaatgagcaatttagaggctttcagctctaacctagtgattttggcttttagtttttgattatgagcattctgtagatgtctagttaagtttaactggaaatagcgctgacagtcttagccaggagcttcaaacagaagaagaaatatttaccaggcttccgaggcaacaggagctgtgacagccccgcagacccacggaactccctgagcaacaactttcagcctcagtggtcttcaactgagctcatgatagggcaggaactacggttgaaaattcatctgtaagacttcaaatgtgtttcccatcccaggtaagtaacaatggttggtaatccggacttacttcccccgggatgtcccactgcagcctggtggggtacggaatgttggattgatgtcgcctttgcagtgcccatcctccgcatagcccagctggaggctgtcaatgacatgacgtactgtcaaaaatagaacaaaattattaaaactaacagtggtacataaaaacattaacctccaacatgaagagagggttgttctttgcagagatgttacaaagtttgaacacagctgttaaggcttccagtatgctcagcacctaatgaggtggatctgatctccatgcagatgtgacagagagaggacagacgagggctaagggcttgctcaagtttgtgacgctccctttcactggcaagtaaacctaagccaatttattcaacggtgtttattgggcacctacatgggttggaaccactgtagcatcagcggcatccaagccctggtgacagcgcagacaagactgtgttttgtgaacaaaacagacaagaattcttgcccttccttaaaaagtgaaatatcctgtatgacccagcagttccactcctaggtacatactcactgaaatgaaatgaatagagctcacacaaaaacttgtacagaatgttcagagcagcattattcataatagccaaagagggaaacaacacaaatgcccatcaactgatgaagagataaacaaagtgtggtcaatccatcaatgagatattatccagccctagaaaggaatgaattccaggtatgtgttacaacgtacgaaccttgaaaacattatgctgagtgaaaagaagcaggcaggcgcgctgcctcacttcataatcccagcactttgggaggccaaggtgggaggattgctggaggccaggagttccaaacagctgggcaacatagtgagatcttatctctacaagaaattttaaaaattagccaggtgggtggcacatggctgtagtcccagttactgaggaggctgaggtgggaagatcacctgagccaggaggtcatggtttcaatgagtcatgactgtgccactgcactccagcctgagcgacgagcaagaccctgtctctagaaaagaaagaaaagaaagcgaaagaaaagaaaaaagaagcagacatagaagaccacatattgtatgattctatctatataagatgtccaaaataggcaatacatacacacagaaagattagtggtcatcaggaacctgggggagaaaggaatgagggtttcttttggaggtgataaaaatagtacagaattaggctgggctctgtgactcacgacttaatcctagcacgttgggaggccaaggcgggtagatcactttaggtcaggagttcgagacaagctggccaacaaggggaaaccccgcctctaccaaaaatacaaaaattaggtgggtgggcgatgcacgcctgtaatcccagctactcgggaggctaagcagtgactgttgcacaagacctcgtgaatatactaaaaaccactgaattgtacacttttaaagggtggattttaaggatgtgacttatatctcaactaaaaaaattaagtttttttaaaagaggaatccctgtgctaggaagcttacattctagtgagggaggtaaaaacaacaacacaaggtcggggtgactgtggctggcgaggcggcggggcgggtggaaggtgccgctaatacgtgggggtcacaatccagctgacctgagccagcgaacgaacagacttgatcaggttccacctgctctgggtcagagtccagaagagcctgacacagaaacatcagaaataaatcaagagcaagaccgggtgtggtgctcatgttagtaatcccagcatgttgggaggctgaggcaggcagattgtttgaagccagagttcgagaccagcctgggcaatgtggcaaaaccccgtctctacaaaaaatacaaaaacagctgggcgtggtggcgcacacctgtggtcccagctactcgggaggctgaggtgggaaattacttgaacccaggagttggaggttgcagtgagctgagattgcaccactgccctccacctgggtggcagagcaagaccctgtctcaaaaaataaaaaataaaaatagaacaagaacagaacaaacagactcaagtttgactagatctgtctttaagggactgcactgggcccccagtgagactaggtcagtccccatctgtgtatggatcacataagcccccagccaggggtcctggagtcaggccatcctgtctgctggacgctaacaactaaacaccactacttctacgtgccaccctggtctaagataaaatccctttatccttatccagagaactttaaaaaacaagctgatcttgtaaatatccagtagatttctctacttgataaatgtaccctgtgtgatccagtgcctatggtcccgactctttttcttttgccaaacaacagctcttaggcatataggactgggaagtccttggcctggggtataacaagcccgggctattatgctgtgcagagatttataaagcgtgccttcttgctacgtccagagacactgaaggcagcttgatcttcaatgcgcttgtagctaaaaggctctctcagcttttgtcgacatcgccaaagaaccctggtggtggtgaaagcccttttaatattggctgctttttatcaggtattaatgtcctagggtcatactgggtcttaaagcctagagcactatgtttttttttttcctttttatcctttttcctacatagaaacctcccttggctgaaggagtggctggaggttttgccaagactccaaccagaagtaaacaattaaaagaggtagaggaagatgagacaggagcccctaacctagtcttgggagaggtagcagggcagtgccattcctaggggaagtgaggtcagctgagacctaaggaagacctgcggggccaggagccaggggaagccagggggaaaagccttccaggcagagaggagagtgatgcgaagactttgcaagaaaaaactggcaccagaatttgtttatctctaggggaaaaaaagacagacacaatattataaaaagaaacgtcaaggccaggcgtggtggctcatgccatatcccagcactttgagaggccaaggcgggtggatcacttgaggtcaggtttatatatataaaaaattatccgggcatggtggcatgtgcctataatcccagctactcgggaggctgaggaggagaatcacttgaaccggggaggcagaggtggcagtgagctgaaatcgcaccactgccaccagcctgggtgacagaacaagacgccatctcaaaaaaaaaagtcaaaattcaaaacttcacagaagtttaaagaaaaaagaaggtcatacattatgatgtcttcacaagtttactctaatttctttcttttttttttgagatggagtctcactctttcgtccaggctggagtgcgtggcgtgatctcggctcactgcaagctctgcctcccgggttcacgccattctcctgcccagcctcctgagtagctgggactacaggtgccagccaccacgcccggctaatttttgtattttagtagagacggggtttcaccgtgttagccaggatggtctcgttctcctgacctcggatccgcctgcctcggcctcccaaagggctgggattacaggcgtgagccaccgcgcctgccactactaatttctaatttcagacacacaaacccggctccatgccctatcaagaacaggaggtgctcagcctgcagctgggccctgtctcccacacacgccgtgactttcaggtcatttattccacttcatttattaggccagcaggaaaatttaaaacactgcaaaaagatggtcttatagtcaatgtgaatctcaaaggggcttgttgctttaaaagaaaaagatctcaagtccatcacaacaagtgaccacagtattttctgtgtcaagtctacggatgatgatcctagaattagcaactttaaacaagaacctgaccggtgagttaaggaaacaaaactttcatttaattctcatgccaaacacggaacaggtcaaacagttcagagtaacgaattattaaaaaaaaaaaaaaaaaaaaaaaggctgagtgtggtggctcccatctgtaatcccagcactttgggagcccaggcaggcagatcccctgtgcccaggagttcaagaccagcctgggcaacatggggaaccttgtttctacaaaaaatacaaaaattagctgggcatggtggcacacacctgtagtccagctacttgggaggctggggtgggagaatgtcttgagcctgggcggtcaaggctacaggagctatgattgtgccactgcactccagtctgggtgacagagtaagaccctgtctcaaaaaaaaaaaaaaaaacaatggtagaggccaatccacaggtgcaggcagggggacaggggttgtggttttcaaataacctggtaattttaagaattaaaatgatgtcttaggtaaaagaccgctgcatgtttataaacccagattttcacatgcttgcttctatttggcctaaaaaatgggtaggtaggaaacactaggaaatccagcacataagggatagtttattccaggaaaaacgagcttcacttctgctgtgaagctgcggcctgagagtcaactgccatttcactcttttgtccctaaggagatggcaggagatgcactgctgttcaagggacctaagttatgggaaaggagacagggatgcctttaatctagtgatttaacttcatgtgcattactagtacaagtgaaaattcatattctataatcacgcaaatattacaaaactaaattgactgtggggtttggatatcttttttgttttttctttttgagacagagtctcgctctgtcgcccaggccggagtgcgtggcacgatctcggctcactgcaacctctgtctcccgggttcaatcgatttcttctgctcagcctcccaagtagctggggctacaggcatgcaccaccatgcccggctaatttttgttttttagtagagacggggtttcaccatgttggccaggctggtcttgaactcctgacctcggtgatctgcccgcctcggcctcccaaagtgctgggattacaggtgtgcgccactgcgctggccaggtttggattttcaaaagcaacttccacattcaagtgaaaagtgtgaaaactccctcccaaaggtgggccacgatcggcgcatctgcccaggagtgttcagcgttgaggccctcttcccgtttttgaagacaacaaacgtgaacgacttgtcaaaccacctacgtgaaacaacatgtgtggaacttaagtgtttaaagaggcaaaaatgaggagacattgcacctctctgttcatcctggatggactaattcactttgcacctgtccctctaacagtgagcagacactcgtctctgtggagtgagggtgaaagtacaaacaggacactgaatcactcatttcttcccttcccagacacaaagatgagcgcttatatcctggcagcctgaagtcaggacctgttgttacgcaaggcaactggggagaggtgggaggctcttcccgtgggcacatgaccccttcatcaccaatccttggctccaccctgcagggggcggggctggccaacactttacagataagaaaagaggacttgagatagccacatgccaacaccctggcctaaccctgtgcctagccctgttgccactctcccctgcctgagtccagggacctggcagccctgcatctcatgagcatctccaacaaaggtggtcatgtacagaggagggaagaatctcagatttgcagctcaggctgtgttgtgtgatagttttggcagagggaagaaaactgaaggttggccaggcgcagtggctcactctgtaatctcagcactttgagaggctgaggtgggtggatcacttgagatcaggagttctaaccagcctggccaacatggtgaaatcctgtctctactaaaaatacaaaaattagccagcgtggtggcacacgcctgtaatcccagctacttgggaggctgaaggaggagaatcgctgaacctgggaggcggaggttgcagtgagccgagatcaagccactgcactccagcctggggacagagcaagactccatttcaaaaaataaaataaaataaaactgaaggttatattttttgccaccttctttcttagcattatagatacttaggggtgagtgtcaggcacacagggtattcttccaagctcatgggcaaactcctgtctctcagaaggtaaggacggtacctgtcgtacatcggccgtgtagtagagatttggcgtagctgtccattgacgtatccgggtcttcactctgtatccttcttcagtttcatctaacgtcacgaagaacgctgctttctccacagcataagagactgcttatttttcccacgtccaaaataggcctgacgacacctggcccagggaatctgcagtgaagatgaaatacgattaaaggcagcccgacctgcagcgatggagcgtgattttgaaatgacacaatcaaacctttgcagtttttcagaatttctcgaaggaaaactccagttgatgatgttccccatctgagactgtttgctggaaggactctcacctgctcctggtcccagaccacagcatggggagcggtgggtattttttgttcaataaatgctgactaaatgacggccagattgcaggctggccccgtgggcaaagccgccaggaagcagcagacccagatcccctgttccacgctccctgacacaccctccctcccctctacaggaaccaccctaggtaattccggcagcccaggtcacagtaagtgcgtaagagtgcgtccctcatgccaggctctgcccaaaccttttctgtgtaccaacttactgatcttctcaatgctactgtacctatttttcgatgagaaaactgaagcacggaaagattaggtcacagctattttgaggcagagtcggaaccaggccatcagcccccaggtgcattccacagatgcccatgtgacccctccacaaggagtctccgtgcccgtcttatttgaatacacagaactggtgtgatgcccacttccttcttggagacccaccagctgggcttcctcgagtgctcccgggtccctctcactccagctcctccaggccctctgccactgcccacccttccagatcggggccatctggctctctccccaccttctctctctaggagtgcttggctatggcggcccgcagggcgaataagcctagaaacacgctggcctcagtgcaccccgctcggggaacaaaggtgacggtgacggtggccggcacgtacgagcccttcctgtgaatgactcccatgggtaagatgctgatctggccctatccagaggggcatcgggaccgaggcgcctacagacccacagggagcccaggccccgcggcgccggctcagctccccacgtctcctccgctggggattccaggctctgagaggagggcatcggatgagccatcttcacccgagatgcatctcctgccgccgctctttccagccttgtcaacaccacagagataccgaacaacgccggcttgcccgcacacatcctcctccatcccgctcctgctcccggcctggccctctttcaggccctcactacttgggccaccgaaaagcatccctgtgtccaggcccctcctccctgcccaaccagaagaatctcccacattaacctactcatgcacccccgccccaccccaccctacaccacctgaagcggcacccagttgcagaatcaagctcaaatagattgggtgcctgggaccctccccagcttggcaccgtggcccagctgcccagcccactcacggctcctgcctgctctgctaccccggggcatgcggctccaccccctggacacccacttcctcctggtctgctcccaccctctgcaagacacagcccacctgcggcccctccacgcacacagaacctctcctgatctttgcagaaggggccccaacacctgcccctcccgccttaccccagcgatagcgtagcagttgtcacactgctggaacgcagcagctctcagctggggacacagtgtccccctgatgctgggcaatgtctgcgacacttctggttgtcacacaggttgcgctggcagtcggtgggcagaggccagggctgctgctcagcatccaacgctacacagggcgtgccccccacaaagaggtacccggccctgagtgtgcacagctctgaggtgagaaaccccctatacaatacacaccacacctgcgagaaaaccaagctcgggctgattcgctttctttttatgttttgagacacagtctcactctgtcacccaggctggagtgcagtgccttgatcaggcttactgcaacctcaacttcctgggctcaagcaatcctcctgccttagcctcctgaaagcttggactacaggcacgcaccaccaagcctggctaattttttggtagagatggggtccactctgttgcccaggcacatctcaaacccctaggctcaagtgaccctcctgccttggttcctaaagcaatggaattataggcgtgagccactgcgcccggcctgattctttttcactaggcaaggaaatgtaaccctaacacaggggccttggtttccatttgttctgtttcctaattaataaatatgcccacagccccgtaagaaaggctaatcctggccaggcatatggttcagcctgtaatcccagaactttgggaggccaaggtgggtggatcacttgaggtcaggagttgagaccagcctggccaacatggtgaaaccctgtctctactaggcatggtggcgcactccagctactggagaggttgaggcaggagaactgcttgaacctgggaggcggaggttgctgtagctgagacagtgccattgcattccagcctgggtgacagagcgagacttcgtctcaaaaaaaaaagcctaattctaatcctcacttctccctgtcctggactctggagtgtttccacaacatttgcctgacacacacacaggggtggccagggaccccccaccatgtccccattgctttgagacctgccaagccgggagaccccagagaaaaacagagccgaggtggggagtcccggccaggattcccacaggccctggtggggatgggccccagtgaggaagagcgcctccaccccccccaaaacaggacaagggacctaggctgcgcacctgtctcctgcggtgagggctgcagcctggcctccccgggctgaggctccgaggtattgtccaggatcctctgcatctgctgtccatctcccggggcttcagcagccgcccatcatggtagagccagaccttgaagtagcgcctcgatggtacacgacgatgtgcttgctgtctctcatgtgctggatggtgtctgagccgccgcaggttggagacacaaaaccaagagtcccaagttcagcacgtgctgagacgaccgaccctgactctgcaaagggcatgggagtccctgctctgcgtctctccaggcagcctcagaacctattcctcaagacgttttaaatgattaaggacagcttggagttaaagctctggatggagaggcctgacttctgagctcagcttagtcactcattagattatgacctcaaacaaatacccgaggccaggcgcagtgggaggctgggagtggtggctcacgcctgtaatcccagccattgggtgaggtgagaggatcgtttgaggtcaggagttcgagaccagcctggtcaacaggtgaaatcttgcctctactaaaaatacaaaaattagccaggtgtggtgacatgcaccttagtcccagctactcgggaggctgaggcaggagaatcgcttgaaaccaggaggtggaggtgcagtgagccgagatcacaccactgcactccagcctgggtaacagagtgatactccattcaggaaaaaaaaaaaaaaaaagcatgcttagcaaaatggaatattatcattaaaaaaaaaaaaacaaattacccaaccctccctaagcctctcctcagtaaaatggaggtcatatgtccccatatgcactgtgcaagaattaagagacgatatccgtaaagcccatgtaaataggcttcgatccgtatagtaactttttattaattaatgacaatagggcaacttagaaaatatgtgagaaacattccgataattgtttctgagaacccgagaaatgttctgagaaagaaagtgaaaattacgaaaccaagccattccgtaaaaactactaaaacagagtaatttaagctcctagtaagcttaaacatcacagaaatgtgatgaagtacgttcactccacgaatatttatcagtcctcttaagcactgctcagtggggatgcacagtgacagctgatcaaggcagatcgtcagtgaggaagacaaataaatgcatgattaaaaataggacaagctaccaggagcagtggccaccctgtattcccagcacttcaggaggccaaggagggaggattgcttgagcccaggagttgggatcagcctgggcaacatggcaaaaccctatctctacaaaaaatacaaaaattagtgggtgtggtggtgtgcacctgtagtcccagttattctggagctgagatgggaggatcattgagcctggggagcagaggctgcagtgaactgaaattgcaccactgcactccagcctggtgacagagcaagatcctatctcaaacaaacaaacaaaaacaaaataggacaagtgtcaaaaaggctagaaagtgtaggactaggaccaacctagcctggagatgtgagaaagcccttcacccccactaaggaagtgatgtttaagaagaacccggccagatgaagaacagaattaacaatattatgcccgatctcatgttttttttgagacggagtctcgctcttattgcccaggtggagtgcagtggcgcgatctcggctcactgcaacctccgcctcccgggttcaagcttccctgcctcagcttcctaagtaggtggcattacaggcacctgccaccacacctggctaattttgtacttttagtagagatggggtttcaccgtgttggccaggctggtctcaaactcctacctcaggtgatccacccgcctcggcctcccaaagtgctgggattacaggcatgagacatgcacctggcctcctgctctgatttttaaaatgtttaccaaaccaaggatgcaggagactgctttggtttgctgaagggttcctaccagaaacttggaccaaacggcatttgaagcctcgctttaaagtcacaaacaagacaagaatgcacaccatgactatgtatattccacattaactcaggatgctggccgggcaataaaataagaaacaaataaaagataaaggattgaaaggaaatatcaaaggtgtcatttgcagctatgattagcatgtggaaaatccaagaaaaccttcagctgtttaagccaataagaatacagctgggtagtggctgggtgcagtgactcacactgtaaacccagcactttgggaggccgaggaaggcggatcacgaggtcaggagatcaagacatcctagctaatatggtgaaaccccatctctactaaaaatacaaaaaattagccgggctggtggcatgtgcctgtagtcccagctactcaggatgctgaggcaggagaagcttgaaccgggaggcagaggttgcagtaagctgagatcctgccactgcactccagcctgggcgacacaagactctgtctcaaaaaaaaaaaaaaaagaatacagctgggtagaaacacagtttataaaacctttcatgttcctataccccagggcacaggctgaactgtgtccccccattcataattgaaatcctaacccccagcacctcagaatgtggcctcatttggagatggggtctttatgaggtcattagggtgggccctaatcctatgtgactgtgtccttttaagaagaggagttagggttgggtgcggtggctcacgtctataatcccagcactttgggaggccgaggtgggcgatcgcctgaggtcaggagttcgaggccagcctggcctacatggtgaaaactcgtctctctaaaaaattacaaaaattagccaggcgtggtggcggacacctgtagtcccagctacttggagtctggagcaggagaatcacttgaacccaggaggtggaggttgcagtgagccgagatgtgcactgcattccagcctgggtgacagaatgagactcagtctcaaaaaaaaaaaaaaaaaaagggagactttaggacacgcacagagggatgaccacgtaaggacacagggaagagtggttatccaaggagaggggcctacagaaggaaccacctctgccaacaccttgatgttgagttccagcctgcagaattgtgagaaaatcgctgtcttgcttaagccgtgcagtctgtgtatttgttatggtggcctgggcaaacttacacgctgcataaccaacaccttgaaaatatcttgaaaaggaacaaaacaataaaagtgcttagaaacagctcgaacaaatgatgtgctgaaggacttcatggagaaaagtatgacattttattaaaatcgcctaaaaaacaaaaaagggccaggcacagtggctcatgcctgtaatcccagcactttgggaggccgaggcaggcggacacttgaggccaagagtttgagatcagcctggccaacatggcaaaaccccgtctctattaaaatacaaaagtaagctgggtgtggtggtgcatgcctgtaatcccagctactagggagctgaggcaggacaatcgcttgaaactggaaggtgcggtttgcagtgagccaagattgcacactgcactccagcctcggcaacagagtgagactcagtttcaaaaaaacaaaaacaaacaacaaacaaaagtaaaaaaaaaaaaaaaaaaaaaaaaaagcagaatgtctggaatatataatactttctacaaatcaataaggaaaagatacacatccattttttaaaaatatacaaatataagaacaatattctcaacagaagaaacccaaatgtccagttaacattttaaaagttctaacccttttggcaaaaatgaagggaaaagggtattttatagattgctggggacgtgaagttggtaaaatcactttgagggtaatttgtccatgccagtaagactggaaatgtccacagggcagccggcaagccaattctaggtgcctgctctacagactgtttgaccaatgcatgaggggagaaacatacacagaattcactgagcgtcacttagaaaggaaaacaggaaagaagaaaagcgttcacatactggaattgttttgatactataacgaagtacatcataaatgtcataatgattgtactggagtggtaagattagggctgtatcttctgctaaaagattttctaattttggtagtaattccattttatagcaatatatattattaaatagaaaaatgccagaattaagacccttaagataagtctatacctctttccctttttttattttggggaatttgaaggtctaattagtgaggattgtgactgatgggatcctccggtggggatgtctgagaaagtggtggggctttgcccgatgatcaccaacgaatggcattgcacgtgctcatatacatttactttctttattttttttttttgacagggtcttgctctgtcacccaggctggagtgcagtgtgcgatctcagcttactgcaagctcctcctcccaggttcaagtgattctcctgcctcacctcctgagtagcagggattacagacatctgctatcacgcctggttaatttttgtgggttcttttagtagaggtggggtttcaccatgttggccaggatggtctcgaactcctgacctaagtgatccacccgcctcggcctcccaaagtgctgggattacaggcgtgagccaccactccaggctttgtatttacatttctttcattcccagtgatgttgaatgcttttctataactcttaaacatttctccttccaggggtgcccatcatttcctttccaattaggatcttcatgttttctggcagatttataagaactctttacatattaaccctgttctctgttgtgagcactaccctcaatttgttatctaccttttaaaacagtttgaagtatttttgaaatatagaaactaaaatctttacatgacaatatttggatttttccgttgttgtaatgagttgagctgttctacccaaaagatatgtccatgttctagccctggtacctgtgaaaaccttatttcttaacggaagtagggtcttttttttctttttttgagacagggtctcattctgtcacccaggctagtgcagtggtgtgatcacagctcagctcactacagtctccacctcccaggctcaagtgtcctccctcctcagcctcctgagtagctgggaccacaggtacacaccactatgtccgacaatttttgtattttttgtagagatggggttttgccatgttgcccaggctgctctcaaaccctgggctcaggtgatccacccacctcagcctcccaatgtgctgggattacaggcatgaccaccacatctggcctggaaatagggtctttgctgatataattcaatattaagatgaggcatactggactagggtggaccccaaatccaatgactgttgtccttgtaagagagacacaacacacagaggtgagagccaaggtgacatggaggcagagatcagagtgatatgcctacagccaaggagcacctggacccccccagaagctggaagaggcataaaggcctcccccagagctttgaaaagagcacggccctgctgacaccttgatctcggactctggcctccagagctgggcagaagaaacttcttttgtcttaagacatccagtttgtggtcatttattccagcagcccaagaaactgactcaggtatcatgctcagaatggctgtccaggtacactaagtaactagttttatcccagcatttcccttgtttattgatttattttatttttatttcatatacatattttttgagatggagtctcactctgtcactcaagctggagtgcagtggcatgatcttggtcactgcaacctccacctcccaggttcaagcaatcctcctacctctgcctcctgagtagcgggattacaggtatgcaccaccacacctggctaatttttgtattttcagtagagatgggtttcaccatgttggccaggctggtgtcgaactcctgacctcaggtgatccacctgcctggcctcccaaagtgctgggattacaggaatgagcctttgtgcctggcctcccttgtttattttttaaacacatacatatttacctcctggaatcactgtcagtgtaggccgcatgtctaaacttaaatgatcttaaggatgtccccataccacggtgctgactgacagcaggtgacacctccccaggacaccctgacccacttccctttggggacactgcctgccctggtcagtgaggggcaactgcccctccaatcagggagacactgtgagaggatggagagaaccaacttcatttcctccacctcgttgcccaactgccccaggactgctgttggccaacacatctgttttcacatgttgagctacagtacaatggacgacagtgtgtggcaggaagagaggaggggtttgccagaaacactgtgaaatccgtgaacacacatggagtgggttcttttttgtttttttggatgaagtttcactcttgttgcccgggctggagtgcagtggcacaatctcagttcactgaacctccacctcccatgttcaagtgattcgcctgccttagcctcccaagtagctgggatacgggtgcccaccaccatacctggctaattttgtatttttagtagagatggggttttgtgaccagtagtaggctggtcttgaactcctgacctcaggtgatctgcccacttcggcctccaaaatgctgggattacaggcgtgagccaccgcgcctggccagaatgggtttttagagacctctgaaggcaggatcagaggaaaggggagaatctgcttaggaaagcccactcagaggcagcttttgtgcaaggatacagcaaaggctccccaatgaccaccacagtgcacactactactagggcttggtctggaatattgactagggcttggtctggaaggaccgggctgcaacagacactcaaaactgcaggtcaggccaggcatggtggctcacatctgtaattccagcacttggaaggccgaggtgggacgatcacgaggtcaggagatgagaccatcctggctaacacgtgaaactccgtctctactaaaaatataaaaaattagccgggcgtggtggcaggcacctaagtcccagctactcgggaggctgaggcaggagaatggcgtgaactcgggaggtggaggtgcagtgagccgagatcgcgccactgcactccagcctgggcaacagagcgagactccctcaaaaaaaaataaataaataaaattgcaggtcagctctggccctttccagccagcttcccagcagccccgaggcccgcccgtcatacaggcctgccatgatggtcttgggctctagctcccaagtgtctctgggtagttccccatccacaggcacctggggaaatggaggccatggacgcacagcctgggcctgggcctggcctggatgttccccacggtgcctgttctccctcccttcattctcaaggacgtcctggtttggacggtggcttacgtggccaccctgcccaggtcagcagctgataaaggagtggctggaacacaaatccacctttccgagcacgacccagtgtggttccatcacaaacgctgactgtgagccggagtaaaatgcccctgaggaatccagactcggaaaaaaacactcagctgtgtgtgactcacgcctgtaatcccagcacttcgggaggccaagcgggcggatcacttgagtccaggagtttgagatcagcctgggcaacacggcaaaactcatctctataaaaaatgcaaaaattagccaggcatgatgcatgtgcctgtggtctcagtactggggaggctaagatgggaggattccttgagctcaggaggtggaggctgaagtgagcgtgatcatgtcactgcactccagcctgggtggcagagagagacctcatgtcaaaataataaataaataaatcaaacactctatgagacagttggcagtcttcaaccaaagagaaattaaatctggaaataagtcaacaacagtgtccaggcctaagacagacaaaggaaattcagcgaaggaatgttcaccagcctacaatctcaggaagggtcagcaaaaatcaatttggccccttgacacttcctaattctgagcatagggatggaaagtgccgattctccagggggccctgagaagcttgactcacctgtctcctctcctgggatccgggaagtattaaacatccgctccactgagcggagcagagtggaatcgtggatcccaaaagacgaatctgtaacaaaaatatattcaaaccaacaacgaaaatcccacagaagaaaagcagcaagttggccgggtgcggtggtcacgcctgtaatcccaacactttgggaggctgaggcgggcggatcacgaggtcagtagtggagaccatcctggctaacacagtgaaaccccgtctctactaaaaatacaaaaaaattgccgggcatggtgtcgggtgcctgtagtcccagctacttgggaggttgaggcaggagaaggcatgaacccgggaggcagagcctgcagtgagctgagatcgtgccactacactccagctcggcaacagagcgagactctgtctcaaaaaaaaaaaaaaaaagaaaacaaaagcagcagcagcaagcaagttaagaccacatggaaatgctgaatgtgttttctgtgcgaattgcttgtttgacttcctcttttccagtggctccctggaatgattcgttgggggactcattaaacatgccagggtgcaacttcctgcacagttaaatcctaaataacacattctaattgattatgataactgacacttacaaccaaagaaatattccaggaagaaaagtcttgtttcttatgacaactaagcagctagtattagttcaaaaacatcaagggcttctccaaagggcagattacgaattaaagtacaacagatgtatattcatttaggagacacaaggagaattacatctcagataattaggctgggtgaaagaaactagaattccgaaaaaaagagtgcatactgttatgatccacttacacaaagctttaaaaattgcaaactaatctagagtgacagatagtagaccaggggtccaggaccaggtgggagggagagatgacaaagggcagaggggttttcgggttgatgatgtattcaccatcctgactgcagtgatgatggtttctcagatgcatcaatatataccatcagaagttagcaaactctacactttattttttaatttttttttttgagatggagtttgctcttataacccaggctagagtgcaatggtgttatcttggctcgctgcaacctccactcctgggttcaagtgattctcctgcatcggcctcccgagtagctgggattacaggcgcggccagcacgcccagctaatttttctatttttagtagagacagggtttcactatgttggcaggctggtcttgaactgctaacctcagatgatccgcctgctttggcctcccaaagtgccagattacaggcgtgagaccctgtgcccggccacaaactgtatattttaaacatgtgcaaatgtcaattatacctctgtaaagctgtttgaaaataatttttttaaagcaatttgtttgctactggtttgatttcctcccggtccagtttgcgcctgtaaagcaggatggcatggatgcgttgccggctcttgctgcctgaatgtgagttggaaggatatacagcagatcctgaaaacgacaaaggtggagagaatttgcatagggaaagataagcaaatttaaataatcacagcaatcctgcacactgtcacaatatttctagagatgcatcaatatacatacatattcggttaatctgcaatgctacaaaataaatggtaatttgattttctccactttgactttgtaaatgtttatgagaacataagtcctctaaaacttctgcgctattaaagataactatttgcaccaataccctcacgtaacacagagaaaggaaagcaaaaattagtcggggagcaattagacaacaggaagttttctggatgagacacaatgaaaggttaaaatagttgtttatatagagctggcctgcagctttctaaattttgagaccctgttccaaatgtctgcattttccacaattggagaaaaggccaaggaacacaggtctaacctacattttggaagagtctatgtacacaccagtccccattgatgtagaaagtgcctctgtttgtgggaaataaacaaaggtctcctggcggaagggcatcagataaatagctcacttccaaatagagcaggaaaagaagttctatggacacactaacggtttttctttcagtttgagattatttcagatgggaaaaaaaaagttaagaaaaaagaaaggacaattttgaaacgaagaaaaacagaaagaaaaagcaaatgataggccggtgctcatgtctgtaatccagcactttgggagaccgaggcgcacggatcacctgaagtaggagtttgagactagcctggccaacatggtgaaaccccgtttctactaaaaatacaaaattagccgggcgttgtggcaggtgcctgtaatcccagctactcgggaggctgaggcagggaattgctggaacccaggaggcagaggctgcagtgagatgaattgcaccagtgcactccgcctcagcgacagagcaagactctatctcaaaaaaaaaaagaaaagaaaaagtaaatgataaaaaataaacgagggaaaaaaataaaaggaagtgaaggaatggaaggaaaaggaaaggaagagttctatttgccagttattaaagcagtggtcaagaacccaaactgagaggcctttaaccatccatgctttgaaagacaaagcccaggaaaccagaaactaccgtcgatgcacaccctctggcgtctcagaaaacagtagggtgaagcgcagcgcactggtggcaggatcttgccaacccactgtccctgagctctaggggttctgcagggatcttaaggccgctgtggcacaagttccagtgctaagccataaaaacagcaggacaggccgggcacggtggctcacaccttaatcccagcacttagggaggctgaggcaagtggatcacctgaggtcaggagttcgagacagcctggataacatggtcaaaccccgtctctactaaaatacaaaaattagctgggcgtgtggtgggcacctgtaatcccagctactttggaggctgaggcaggagaatcacttgaactgggaggcggaggctgcagtgagccgagatcgtgccattgcactccagcctgggggacagagcaaagctccatctcaaaacaaaacaaaacaaaaaaacagcaggacaggtacagcacgtgaggaattcctgtttgccagaaacttatttttgcaacccaaatccccctgcagtagcgagcaccctgggctactaggctaacactgaagggtactcatagggttctccggcctggagcaggacagagaggagcatgagccaatccccagagttttcccaggccgtccacaggccttgaagacgccacctctgtggacagacccgccgccccaccgtcctcgtcagacagcagccgggcgggtggactcaccatggcataatagttgctgttcaccatgagcggccctcgtcctggaggtagatgtactcctcccaccagtcgctcacctagtgggcgcaaacaccagacaaaccgcaggctcagcaggggccaggcaggctccctggcagcagcccagagccgcggggaaggcaggcagtgcttttggcagacatttcggcgtctaacaggggccattccagaacagggacgcagtcctaactagatggaatgcgacaccgtgggaaatgaaaagtgttctttttaagtgagacaggcagaaagaaggtacatcaccttcattttgtagatggttcaaaagggaaataaaagccgaagtgggaggattgcttgagaccaggagttcgagaccaggctaggcaacatacaaggctctagccctacattaaaaataaaaataataaataaaataaaaatttaaaaatgttaagagaccaaatggaaagtaaatcataaatgtctgactgctaacatgttttaaaaacaaaactatgggctggccatggtggctcacacctgtaatctcagcactttgggaggttgaacaggaagatcgcttgatgccaggagtttgaagccagcctgggcaacatagcaaggttcatctctccaaaaaattttaagaaattagccaggtgtggtggctcacgcctgtagtctcactacttgggaggctaagacaggagggttacttgagcccaggggttccaggcaacagtgactatgatcgtgccactgcattcccacctgggcaacagagcaagaccctttctcaaataaagaaaacagaaacaaaggccaggagcggtggctcacgcctgtcatcccagcactttggggactgaggcgggctgatcacttgaggttaggagttccggacctgcctggccaacatgataaaccccgtctgtactaaaaatgcaaaaattagccgggtgtggtggcgggcgcctgtaacccagctactcaggaggctgaggcaggagaattgcttgaacctgggaggcggagcttgcgtgagccgagatcgctccactgcactccagcctgggtgacgagcgagactttgtctcagaactaaagaaaataaaagaaaacaaagaaaaaaccaatgttatgcaaaattgctccacaactgcttcccaggtctgcctgaagaagccaccgtcccagtccgtggcactaacctggtgtccgcaggtgttgtctctattccctggcacatgtgtcctgaggccacccagaggcagtgcccccaaccacctcacagctgctgtcccttcacagcctgctggacccagggatcgcttctttcagctttgtgctgaaacacacgtacctacagaacagtgcccatgcaagggcctcgttgcggagagctgtgcagagagctgacgtttaccagtccagcacaccggtgcagccagcgatatgcccggccccctgaggctagagagacccctccaggcactgcccatccacccaccagccacgtctagcgccacctgctggttctgtcagggtcgctttggacaccttctcttccggttagttgttcctcaaagctagactccctcccttgctttgtctgccggaggcctgctctgccctcccagtacgtggaagcccagccagctccccgcacacagggtgccagctaagacgttcgttggaggagatgctcctgggaccaccgagccacactcaaccccagggaggggcgacagcaccgccctatcccacaccatccctgcatccaccagcgagctcgggaaggatgccctggaatcaagataaaccaaagaggaggatgggagcaggtctctggggcagcatggcactctgcaggagaaacagctcacaggaggactctccggggaagagggagagggagaagcctctgcgtgcaaaacacagcatcgtgctggtgtacctgcactcagggtaaaactgtcactgtggctgggtgtggtggctcatgcctatgatcccagcactttgggaggccgaggtgggaggtcacttgagcccaggagtttgagaccagcctggtcaacatagtgagactctgtctctacaaaaaatccaaaaaccaagaaactgtcactgtaactacacgtcagtcctaacacacacaactccactctgcacagaggtaaaactatagctggaacttcctagggtgtgattttggctatccaaactgtcatttcagccctgttatccctgcccctcaaaattagcgtcttcatacgacgctatttcatcaagaaaaactgtgtatacagacttacgtaatttgtagcccaccaggttttaacttcaaataccactgtaatcttggtccaagaccgacagcaaaatcttgagcaatgctgtcatccgtttgaagtcttcttccttcataagaggcctcaccgactgtagatactggattattggggaaaaaaaaaatcacccaagttaaaacatattaatcaaagcctatgttgcctcacttgtgccttaggaaaagttctaacacattgaaaaggttttaggctgggcatgtggctcatgcttgtaatcccagcactttgggaggtcaaggccagtggattgcttgagctaggagttcaagaccagcctaaacaacatggtgaaaccccatctctacaaaaaaaaacaaacaaaaattagctggacatggtggtgcatgtctgtggtcccagctacctggggggctgagttgggaggatcgcttgagcccagaaggttgcggctgcagtgagccatgatcatgccacgcaccccagcctgggcaacagagtgagaccctatctcaaaaaaaaaaaagaaaaagtttgactcttcccccaagttggtcttggcagtccttagacaggtaaactcccttcaatgctaatggtgtcatagggtaatgataatttaacaattaaactttttcttcctttattagctttaaagtgtcccaaatcctgcatcaccagaaaatcaccattaaatttttagaatttaaaataattctagagttgacaagaaaagttaacaaggaaatttcaagaatgtctcttatctatttttggcccttaataaaagatctgttctgacctaagtaagttttgatgacctgcgatggtaccatgagatggggcagagtcatgctgagagctgggtgctggggctgggcaggtgctcagcagcaggatgggaacgaggggctggaataggtcacggaaccaggctaaggccagtgcccaggttcagggtttccagcccccaccccgcctcgtccttttacatgtgctactttggttaacaaatgctcagaggtggaaacacagagagcaattgtttaaaaagacactcaaaagctctgctacacacctaagcaagctcttacagaaagtaacagtggtcaggtgtggtagctcaacctgtaatcccagcactttgagaggctgaggtatgaagagtgcttgagcccaagcaatttgaccagttcaagaccaccctgggcaacagagtgagaccccccatctctgcaaaaaaaaaaaaaaaaatacaaaaattagctgggtgcggtggcatgtgcctgtgatcccagctactggaaggttgaggtgtgaggatcacttgggcccaggagttcaaagctgcagtgagccatgtcacaccactgcattccagcctgggtgagatgctgtttcccccagcaacaaaaagtaaactgttgctaaccccacaatttgtcatgacatattttaatccgacaagttgtttgtctgcgtaaaaaacaaagcttggtgcaacagtaatctctctatagtccctccctgtacattgaaagtaagaccccactcccttaaaagggccagctgtagctgggcacggtggcttatgcctgaaccccagcactttgggaggctgaatcaggaggactgcttgagcccaggagttcaagacagcctgggcaacatggcaagaccctgtctctacaagaaagtatttgcaggcatagtggtcacacctgtggccccaactacttgggaggctaaggcaggaggatcactcgggcccaggattcaaggttgcagtgagctaggacggtgccactgcattccagcctgggcaagagagtgaactctgtctccaaaaaaaagggggagggggcaggtgtcaagcatcttgaggcttattcaagtaaaatgcccgtgaatgagacagaaaatcatgccctgaatgagctgaagtggaacccgagctacgcaacacagacagaggtcactgaaggtcaagcatctcttgctcaccccatccgccagtggaacaggggccgtcatcagccctgatttgcaagcgtgggcacagaagaggaggatggggtgggccaggtatggtagcttgtgcctgtaatcccagtactttgggaggccaagtgggcagatcacttgaggtcaggagctcgagaccagcctggccaacatagtaaaatccgtctctactaaaaatacaaaaattagccgggtgtggtggtgcacatctgtaatcccagcactcaggaggctgaggcaagataattgtttgaacttgggagatagaggctgcagtgagcgagatcatgccactgcaccctagcctgggtgacagagcaagactctgtctgaaaaaaaaaaaaagagcagagatgggaagaccttaccaaggccaacagggactcagtaaccaagcctgattcaaacccttaacccgagaagtttttgcttattattatagttttaaaattggagtccaggatgtggaaaaactaaagcacccatgcactgctggttagaatgcaaaatggtgcagtgcgtgagagtctcatggttcctcaatgagttaccacggaattcccatgagccagcaatccactcctggatacgtccccaacagcggatgaacaggtggataaactgtggtccttccaacaatggaacactattcagccacaaaaagggatgaagttcatccatcctacaacacggggaactctaaagacatgctagtcacaaaaggccacgtgattccatttatgcgaaatgtccgaagaggcaaatccatacagacagacaggagattagtggttctgaggggctgggagaggaggtagaaggatggggagtgactgcttagtggctatgagcttttgggggatgaaaggtctggaacgagacagcagtgagggctgcgcaacattataaatgtacttagtgcccctgaacgtacacttgaaaatggttaacagtacaattcatgttgtgtacattttaccataattttttaaaaacaaagaaatggagctgctccctctccttttgttcaattaaagaaaaaaaaagacgaagcaggtagatcacttgagctcaggggttcaacacgagcctggacaagacagtgaactccgtctctggaaaaaaaaaaaaaatagggccaggcgtggtggctcacacctgtaatccagtactttcggaggccgaggcaggcagatcacgaggtcaggcgatggagaccatcctgctacagtgaaaccccgtctccactaaaaatacaaaaaaaaaatattagccaggcgtggtgcaggggcctgtagtcttagctactcaggaggctgaggcaggagaatggtgtgaacccagaggtggagcttgcagtgagccaagatcacgccactgcactccagcctgggtgacagaggagattctgtctcaaaaaaaaaaaaatattgccatatgtagtggcatgcacctgtagtccagctactcaggaggctgaagtgggaggatcatttgagcccaggaagttgaggctgtgggagccaagatcgcgccactgcactctagcctgaacaacagggtgagaccctgtctcaaaaaaaaaaaaaaaaaaaaaaagaaaatgaaaaagaaatgagtagctttgaggatgaaatgcaggctttctaggtagtgccttgcccctgggggcctggctttgaagtgcggctgctgtgcaagaagcaccctgtcctcagaccggctagaagctgactatcaccccaccctcagctgggaccctcaccaatcagatcaaaaacattcgccacccagcaacagatgaacggataaataaatatggtctagccatgcaatggaatactattcagccataagaaggagggaaattctgaacaggctgctatgtgtatgaactttgaagacattttgctgagtgaaagaagccagtcacaaaggacaaatatgatatgatgccacttatatgaggtccctcagattggcaaatccagagcagaaagtagaagagaagttactaggtggggggagggaagaatggggagtgactgcaacatttaatacaatgttgtatttagtaattatgtaaagtagcaaaaactggcctggtgcatggctcatgcctgtaatcccagaactttgggaggctgaggcgggtggatcacttgaggtaggagttcgagaccagcctggccaacatggtgaaaccctgtctctactaaaaatacaaaattagccgggcgtggtggcaggtgcctgtaatcccagctactcgggaggctggggcagggaatcacttgaacctgggaggcggaggttgcagtgagctgagattgcaccactgcattcagcctgggtgacagagggagagtccatcacaaaaaataaaataaaataaaataaaataaataaaataaaataaaataaagctttaaaaaattcacaagcagtttctctatgaaacctgcactttttaaaaaacacctaagatgcagcagtgatgcattggagaaaaaaaaaaaaaaggttcctatgagaaccctaccaggcacaccgctgaaggctacttgagccaaatggcggtgcctagttcatcataattaagacctaagccttaatccacagatggctggcatttcagtgtaggcctaagccacacctaccctgttcacagtgtctttgacagccgggaccggcaggcgagcagcgatgtctggaagctgtacaacatgggttttcggcctgaaaagatcttgaccatacctgaagagagagaattatattttcagactactgccatactactctgaaggcacctgtttcgtctgatctcgtgaagctaagcagggtcagtcctggttagtacttggatgggagaataccatttcaaagacaaggctatgttaaagatccgaagccacttttcccgtgcgcacaattgccaaccacttactgattttctgtgtcaatttatttttcatctggtccatcttttaccgccccatacttacaggttctagcaaataagcatataaccctgccctccatgccaataaagcctgggcaacatggcaaaaccccacctctacaaaaaattagccaggcatggtggcatggcctgttgtctcagctacttgggaggctgaggtgaaaggattgattgagcctgggaggggatgctgcagtgagccatgatcataccactgcactccagcctgggcaacatagtgagacctatgtcaaaaagcaaaacaaaaacaaacaaaccaaaaaaccaggtagaatcaaagccagcctgacagaggccgtgagatgtcgctgccagcgtcgtgactggccaggaccctgaccggcttctgcacctagggtgagtctcaccccacctccttccgcaaggcccttagtttcgggtgggctccaggctctaggaacagtgaggagggtcaacgtgcctggccctgagccaagccaggggaagcagtgtctttccttcagtcattgccaagtctcccagaggacacatctgtggccttggttttaggctggatgatcaagcctgtataataaccagtcacctcaatggcaaccaaacaaaggcagtccttgggcccaggcggggagtcttggtactgcagggcattgggactagctgaacctcagctgtgaacccactggagggagtgccctttagcctgctttgccaagttgggagccacccctgagtctcttctaggtgttaaattctgcttctctagaaatcagaaatttatatccaaatggtagaaaattgatttgagagaaaaaattggtttggctgggtgtggggctcacgcctgttgatcccagcactttgggaggccgaggagggtggatcgtttgagccaggagctcgagaccacctggccaacatggcgaaaccctgtctctattaaaaatacaaaaattagctgggcgtggtggtgtgtgcctgtggtcccagctactgtggaggctgaggtgaggaatcgcttgagcccgggaggcggaggttgtaatgagccgagattgcaccactgcactcagcctgggtgacagagcaagatgctgtctcaaaaaaaaaaaaaaatttgtttggcaaaggtggagtcccggtgtgtggtgggcactgcagtgactcccatgcttctctcacaagcaggtcccccagaggttgggacagcagcccagtccaggcaggcaccactgtgggggccatcccaggcgaccaagcagaagggcaccggggccaaggtcggggcagacaagaaaccaaagcagcccacggcttcgtatacaccggcagacccacggatcagccccattcgagaaagattctgagaaaatgtttccatgatgacctggtccattacaaccatttaggccacttggcaagacagggtgaataaagcagatgtttctttacacacatctggccccagaaacccaggttgggctgaggtgccgagcaaagcccaaggcccagggccatgactacaatgggcagatggtacacgggcacacacccgcctgcagggggtcacaggggccccagccccccagacggaggcctcgaagtccagagacgatgcccatcttggagggttgattttcagaaaaactaagcccataaattttttttttttttttttgagacagggtctggctctgtcccctaggagtgcagtgacacaccacagctcactgcagccttgacctcctgggctcaagcattcctcccacctcagcctctaagtagctaggattacaggcatgcaccaccacgcctggctaatttgcctggctaattttgtatttttagtagagacgtgtttttgccatgttccccaggctggtctcaaactcctgagtcaggtggttcactgggcttggcctcccaaagtgctgggattacagccatgagtagccagcccagcccccataaaaacatttaaattgagaccgggtgtgatggctcatgcctgtaatccaacactttgggaggtcaaggtgggccgatcacttgagctcaaaagtttgagaccagctggccaacaaaaccccgtctctattaaaaatataaaaattagtcagccatggtggtgtaacctatagttccagctactcaggatgctcaggtgggaaaatcacttgagcctaggaagtgaggctgcagtgagacgtgatggtgccactatactccagcctgggcaatggaacaagacctgtctcaaaaagaaaaaaaaaaaaaaaaaagctgggtacagtggttcacacctgtaatccagcactttgagaggccaaggcaggatcacctgatgtcaggagttcaagaccagcctgccaacatggtaaaaccccgtctctactaaaaatacaaaactagccaggcatggtggtgctgcctgtaatcccagaaacttgggaggctgaggcaaaagaattgcttgaacctggaaggcagagtttgcagtgagctgagatcacaccactgcactccagtctgggcaacaagagtgaactccatctcaaaaaaaactaaaatgaaaaaatataaatataaataaaaaagaaaaacattaaatcatgaaatttggacaagcatccacatatatggcaaagccattaccttaaataaggacccttgggctgagggccaaagcaagctggaggaacattccagaagctaagtctgagcacgggagcctgtctgaggggtcagctaaggtaaccatttaatgcctgacaacaagtgatcaagaacactacaaagaaccggatggacagcacttttatttgatgaatgacctgaactcaaaccgagcagacctcaatataaaatgctgcaggtctcactaatgtcacaaaagagaacactctttggcccctgcttttgtgtcatggtgactcaaacctctccagccattcaaggtgaggcccaagtcaccaaccaagcatagagggagaaaaggtcgcaggggtgtccttccgcggggtgtccttcttcccaaagcccaaactgtccaccccctccacagccagagggacacgaattaccatccagatcttggtggcacgactcatcttgccgtgctcagtgaacatccaccgtggtaggagagcagcactttcagggagtagcgcatggtgacgatgagggccacccacagccggtgccaaacagcacgccgctgaccacgttcttcgtctggctggacatgcagttgcgtggagacagacccagacaagggaggctgtgcgtgaggccacacggtgccaccaacaccccggtgacgccacagacaccacgtgctgcagggtccagcagcctgccccaggtacagccggaaagtcagagggagagcacttgcaggaactgagctcttaaaacactcacgggcactccctcctcaccccaaaaccaatcacgccgaaagtagctggcagacccaggcgcccggggcggcctgtttgctctcttcccagaggtcccttcagcccgatctgctcgggtggcctcgaaccaaccagggctaatttgtgtcttctggaaaaagatacagcttcctccaggacctcaggccaacggcagaggggatgctgtgaggccaggacctggccaccgtgagagccatgccctgcgacctgtgcgtccccggcaggtgcgcaggagattctgggccactttcttcagctcttgtgaatttttttctctcaaacttacttttagatgtaatcgtaatctcaaattatttgttaaactgttacctccagtatttatatcaaaagagcttgtttttgacttaggtgtatttaaccaaataaagaaacggactgtgtaaaacggtcatgtaaatattcaacttaaatacaggaatgtttttgtttgtgaaggaaggtagtatatattatggtaaagatgggactttaaaaatggatgaaattcagcttttttttttttttcgagacaagagtctcgctctgctgcccaggctgagtgcaatggtgtgaccttggttcactgcaacctccgcctcccaggtttaaatgattccccatctcagcctcctgagtagctgggattacaggtgcgcaccaccacatccaactaattttgtattttttgtagagatggggtcttgccatgttgcccaggctggtttcaaactccttcaggtgatccacccgcctcggcctcccaaagtgctgggattataggtgtgtgccactggcctggccagaaatgcagctattttgtggtttgttttagttttggttgttttgggaactcaaaatattttttaaatgaaaactatttaagcatgcttcaaatgattaaaacaccaataatataacctaaaggtgtccctaatatttgaaaagcactaatttggccaggtgcagtggccaagtctataatcccagcactttgggaggctgagatgggtggatcacttgggtccaggattcgagaccagcctggacaacatggcaaaaccccatcaatacaaaaataaaatttaaaaagaaaataaaataagaaataaaaaataataaaaataaaaaataataaatatttcttcaaataagaaataaaaaaagaaaaccactaatttaacactgcataatatttaagtggacaaaacaaattatcttcaaggttatatactctttgctccaaaatgtatatctttctataaccctgaaatctagcactggagtttcactgtagtctcttctttaaacctatacactcttttctgtcatctaacctataaacaaacttgggtttagggatttaagaagctatcttttagataactacattttagattactgaaagaaaaagacctatatacttacttgatttgcaaaaataaaatattttagcataaacaaataaatgacacattcaagatttttaaaagtatagacatagggcactcagataaaaaacgttagcaaaaagctttctttgaaaggacatgctccttacaagctgtcggggacaaactcagagacaaacctcacatgacacggatgactccacttttttatctttcttttttttaagagatagggtctcactatgttgctcaggctgatcttgaactccgggctcaagcaatcctcctgcctcggcctcccaaagtgctggaattacaggccaccgcaccagcctgactccacttttgaaggcagcagcccagagatactgcagatcccctccaggaaggaaatggcccatgaggctggaagacgttggcccttaacccggcctttctaaatttagccagggatggcccagtttaccaaaataggtttaagaggtacaaagaaacaaatcttacaagacccagattattaagggctttaaacagtcaacacttctatatataatccagttttaaagagcgcctacactagagagtaaattaaagaactggcctgggtgcagtggctcacgccttaatcccagcactttgggaggacaaggcgggtggatcacttgaggtcaggagttcaagacagcctggccaacacggcgaaaccccatctctatcaaaaatacaaaaattggttgggcaggtggcatgtgcctgcagtcccaggtactcaagaggctgaggcaggagaatcacttgaactgggaagcggagcttgcagtgtgccgagatcgcaccactgcactccagcctgggtgacgagtgagactctatctcaaaaagaaaaaaaagaagatattcattagccccatgagagaagaaaagtacgtaggaacagctccagacacaaggctcggaggcagctacccaccgcaggctgtgggtcctgggacctcaaggaagagagcagccaggcctgccctgagcacccaggtctccagctgctttctgagtgacagcaatgacagcagtacccaggcagacaaggaacctggcggcgtcccagccaggcatgcttctgctaaaatgactgggaacttttattatgtttcttgagactcttatagaggcctgagccagcgttcctgagctacctcaaggttgcaagcaactcgctggacgctcgatgactctggagggtccaggggcttcctggagaaggaacaggatgtgaggggtcctctgcagacccttcgcaaaaagaggttcaggaatcagggcacttgctcaagtgtcatcaggagactcagaccattaatctgcttaatcttttatttctagtcatcagaataaggctgggcatggtggctcacacctgtaatcccaggactttgggaggccgaggcgagtgaccacctgaggtcaatagttcgagatcagcctggccaacatggtgaaacctcatctctcaaaacatacaaaaattagccaggcatggtggcggacacctgtaatcccagctactcagaggctgaggcaggagaattgcttgaacccgggaggcggaggttgcagtgagccgagatccaccatcgcactccagcctgggcaacggagcaaaaactccatttccaaaaaaaaatcaattcagccgttaactgtgagtgagttttcgtttacgtctctttttctgccggtttattttttatttctttctgattaaacaatatttatatgcaaacaacctggaaggcgtgactataagatccagagcttcgttttttagcttagcccagacccggcattgtgccttccacctgcaatcctggccccaaaacaaagcccaattatgaggagttggtggctattattgacctcaggtatcgacccacctcggtctcccaaagtcctgggattacaggtgtgaaccaccgtgtccaatggcaaaaatgccattggtgtaaacaagcagcacagaaatcgaatcaaacgtctggcacgggcagcagggacacttccgagacactgtggagctttcagacccgaaagtaaaatgtgttccaagcccaagggtcacggctgcacgaggaagctgagttgccctgcgttccactgtctgacgttcaaatggtggtaaagcagcggtgttcactcgcatttgtctcacagaagcttctgggcagggggtggggggacctcagtgctacactgaagaaagcacagatttcagagctgccagagctgggtttgaactctagcttccccgctccctcttcctgtgacttgggcagacactgcacctgtctgaatgctttctcactggtaaaagggaccctaatgagaggtcactgcaggcaggctctgaccttcctagatgggagtctgggccatctccagaactggatggaataacgacatcacaggtgtgcaataaacatgtgctatcaacaggcggcaggtggttagaaaaaaaaataaaatgaacatgtgctgaatgttacctaaggtgtctctgggcttatctcttggtacaagaaataagccccaggaaaatccaaaaccctagaggtaggagggacgggggggtcccggagatttctaaaccattctgacagagttaagtgggtgaggtccctgcagaggaccccaagcagtcagttcaagggtcacagaactctggaatgaacagactccaagtgcaaagaaatactacatggggaatcagccctttgagcagaaattccatttcagagccctattggccaggtaagggcactgtcattattgaccaaaccctcgggccctgacaccttccaaggggtgcccagggccactaccactcttctcaccctggtctacagaggaaaggccgcaggggaccgcaactcctagggggaccttaacagcacccaggagacaggaagaaagctgacgtgagaacagctcaggagcttcatatggaatccagaacagtgacaatcatcacatttgaagagacataaaacagcaataaaatcggtaacttcccagacaattggagatttcacaggattacttacgcctttccagagtccgattgatttttgcaattattcctaacgaggggtcgatcttggcgtactcgttgtcatcacgcccaccaccacgataagccaactggaggggcttgccgggtacacgcagtgatgatgccgttctaaagacagacacccgggccgtgagcggtgtcctcccacaaccacagggcaatgacgcttcatggcccctggcagcagggctgctgggacagcaggcagtggaagagggtgtggacagcgtgcgtgcactgagaaaccacaccccactagctgggactctcccagagtttacagcctgcagtgattccagtttcctcccttccactacttccgagccaaacccaccctgaaagcttccccaagagtcgacgccccgggccatgataatcagcccaggcctagtttagctggtgaaggacgtcactgagccaccatgacgtcctgtccccagcctgctctgtctagaatgccccgagaccccggttccaaaactgctcctcttgccgcccctgtgtcgaagggctgcttaaccctgaagatttcatgggagacctcaccccatgtcgagaatttgcgtaaaatactccagcccaaaaaaaaaaaggattatatcaaacaaaattggcaaaattgtgaaacaaggaagggaatggtggggatctttaatcagtcctcttcactcttgtgtatgttgacaactccaattaaaaaaaattcttcctaaaccatcctaataagatattgatttcaccagataatggattaaaaatgaccaaagcaggccaggtgcggtggctcacacctgtaacccagcactttgggaggctgaggcaggccgatcacttgaggtaaggagtttgaaaccagcctaccaacatggtgaaatcctgtttctactaaaaatacaaaaaattagccaggtgtggtgggggcgcctatagtcccagctactcaggaggctgaagcagaagaatcactgagcccaggagcggaggttgcagtgagccaaggttgtgccattgcactccaacctgggcaacagagtgagctctgtccaaaaaaaaaaaaaaaaaaaaaattagccgggcattgtggtgtgcacctatgtcccaactacttgggtggatgagacaggaggattgcctgagcccagtgaggctacagtagccgtgatcgcaccactgcactccaccctgagcaacagagcaagaccctgtctcaaaaaaaaaaaagaggggaggggaggggagagggagaacaacattcccactgggttgaatatgtggccaagcctctgcatccaagtttctattttcccagattccaaggtgaaaaagagcagtctcggcgagccgagctagtgcctcagtgaaatctcggatgtcaccttggtgggttattatctgggcccaagaacccacaggctgagccccagggacacccgtgcagctgtactggctccaggggcttgcccgccatgctgtccctgctgccacctgctcttgagcttaggcctttccagtggcccacttcagtgccgccctcggagaaggagcaccgggaagtgcacaaactgaatgagttaccgctggggctggcaggggggtcagcggggggggatttccacttttgacttgtgaactttcacctagtttgcatgttttcaaacatgcacttgttccttctatgatgtttaaataaattaaaatacatggaaaaacaagacacttacttaaaaaagaacaaagttctactctttagataaacagaattgagaacatgtggactcaactgtatttgaacttgtggagagttctttttttttgtttgtttgttttgagacagagtctcgctctctcacccaggctggagtcagtggcgcgatctcggctcactgcaagctccgcctcccgggttcgtgccattctcctgctcagcctcccgagtagctgggactacaggcgcccgccaccacgcccggctaatttttttattttttagtagagacgggggtttcaccatgttagccaggatggtctcgatctcctgactcgtgattcacccgcctcggcctcccaaagtgctgggattacaggtgtgagccactgccccggaccttatgcagagagtttctaatgtgtgaatgttttataaacaaagtagttattcatccacttgctgaagtttggaaaaaatatttttttgtttttttgagacaaagtctcgcctgttgcccaggctggagtgtggtggctcaatcatggctcactgcagtctctgcctcccggttcaagtgatcctcccacctcagcctcctgagtagctgggactacaggtgcatgccacatacctgcctaatttttctattttttgtagagatggggttttgtcgtgtcacccaggcggtcttaaactcctgagctcaagcaatccgcccacctcagcttcccaaagtgcagggatataggtgtgagccactgcacctggcctggaaaaatcctatttgaacaaggtgtaaaggatctgactcagagcagaagatgtgaattctagtctttactctgcctcctattaagtaggtgctggccctttaagcctcgatttcccagcctgctttaacgcatgccaagtccctccaccgcctaatggaactgctccaagcatccagtgagctaaagtctatgtgacggtgtccccaaccttaagtaccatggaaacaggtaagtgatatgcagtcgccagtctgaaacacgtagactcaatagcagccagagccccgttcttagatattaaaaggcatactgtgtagatttcaacaatctcagaaaaccttgaatctgatgaacttctttttccaggaatgaagtccagagagaagatttgtctaagagcttcatggctcagccgcaggtcaatcccgtccggagtgaccgtgactgaaaggccacagcttggtgagcttctgccatcttcagagagtacctggaaggagaagagaaaatgtaacacagtggaacgtgtgaccagacactaaaaaaccctcatacagaagtccattccttctgaacttaagttcttcctcgccacttaacagatttaatacttttcatcacagaccaattccatcaccacagctggcacccccttgcctgtccaccgctacaaagacagcgccacctctgcttagagccccaagatgatcatcaggagtcaggcccgtggtaccccaacctggccctggacattccctggaaccacgcctccaagccagcatccaggcccgtggtactcaactctggccctggacgtcccccagaaccacgcctccaagccagcatccaggcccgtgtaccccaaccctggccctggacgtcccccggaaccatgcctccaagccagcatccaggccgtggtaccccaaccctggccctggacattcccgggaaccacgcctccaagccagcatcaggcccgtggtaccccaaccctggccctggacgtcccccggaaccacgcctccaagccgcatccaggccacacctactgacgtaaagcccacggcgcttcagcaactcgcacagcacgacaaatctcaatcttgcagccaggcccttggaggctggcattagaagaggcccagagttccacgcaggagtccacgaaggagcccacgacagccctagactctgaacttcgagcgcaatcaatcccaaatgcctctgcctctggtgtctgtgtggctgctctttcgagaaactgtttagggtttcggagagacccacgaagactccatgagtcatatgcgcagacacctcaagaagggtgtccacagacggagcgggccttcttccttggaggcagcggctgaaacggaacgtgcttggcggccccacgggctaaacggatcccggggcgctgcagtccagacccaagcacagccctggggagagcatcccctggccggctgcagaaaactgcttccggatctgctacattctcctgtacccttcatcctggctccggccgccttccttcaggctccttggcacagccgctagcacaacacagcccacccccatcccctcctggaccccccggggtggtggctcctgccctctcacggtgcctcctccacctcctcccaagctgcctgccacaaagtactaaatggataaagagaagctaagaggaaaaaactttcaaggaccataataaaaatccaaaaactcgtgttgtgtgtgtggtgtgtgtgtgtatacgtgtgtgtggtatgtgtgtgtggtgtgtgtggttatgtgtgtggtgtgtgcgtgtgtggtgtgtgtgtgtggtgtacatgtgtatatgtgtggtggtgtgtgtgggtgtgtgtgtggtgtgtgtggttgtgtgtgtggggtgagtgtgtgtgtgtgtatggtgtgtgtgtggtgtgggggggtgcgtgggtgtgtgtgtggtatgtgtgggggtgggtgtgtgtgtgggtgtgtggtgatgtgtggttgtgtgggggtgggtgtgtgtggtgcgtgtgtgtggttgtgtgtgtgtggtgtgtgtgtgtgggtgtgtggtgatgtgtggtgtgtgggggtgtgtgtgtctgtgtgtgtgtgtgtggtgtgtgtgtgtgggtgtgtgtggtgttctcaccacaggatgattttcctgttttcgcccactgatgccctctgaaggtgagtcaaaatcagtggctatcacagtttcaaagatcccctgttacagaaatcagcctgactcgtcctccaccagccaaaacacagaaccatccgctggcaggccctagaaaggcacccgactcagacatctgtccatattacaaatatttgttgactgcctccaacgtgccagccgaggaaagagctgcacaccagcagaaaaggtccctctgccctcccacagcttagaccgggctaaaagcaacgcaggagcagtgctctggtgcaggaaggggagaagccgaggggacctctcagagacagggaagccaggagaaggagcaaccatgggaagagcaggcaagagctggaggcagaagggcaggaggatggggtcaagggcaggaagctggggtcaagggcaggaggctgggggcaagggcaggtgtctggggtcaagggcaggtggctggggtcaagggcagggtggctggggtcaaggacaggctgttgggggggggtcagtggcgggacagctaaggtcaagagcaggcagcggggtcaagggcagggtgtcgggtcaaaagcaggtgtctggggtcaaaggcagggtgctggggtcaagggtagggtgtctagggtcaagcgcaggtggctggggtcgacagggtgctgggttcaaggacagggggcctagtttggagaggaaggcagaggcagccggtgggaggggcagggttttgtgctagcaatggagaagcatccaagggcccagagaaaggggaacctgcactgtttcttttctaaagaccactctggctgctgtatggagtatggatggggatggggagcaggaccagttaagaagctgaggctgtcttccaggaaggtgcatgggcctggcccacctgtcagtgacagggacagtgacagtgtggacaatgacccacacaagacagtctgcagagcaccttgagctgcacttgctggtgaaatgggccctcgggctcctgtcttgagccacccctcagtgaagccaggtactgacaagggacagtctcagggagggaaggaggcaggctgggcagaagctgagaattcatgcctggacctgccacatgtgaaatgtcaccaggacatccggtggagatgccccacatcgccagagcaagggaggagctgggcaagacgacacacccgggagtatcagcacagaacctgccagctctgcctcaatgactcggaaagagtaatttggcaaactacattccaccagctataacttcagcttagagcaatttgcaaagcaatcgacaatatgatgggccaggcatgatggctcatacctgtaatcccagcactttgggaggctgacgtgggggatcgcttgagtccaggaactcaagaccagcctgggcaacatggcgaaaccccgtctcgaaaaaaataaaaaattagccaggtgtggtggcatgggcctgtagtcccagctacttggaagctgaggcaggaggatcccttgagctcaggaggtagaggctacagtgagccatgatccgccattatactccagccagggcgacagagtgagaccctatctcaacaacaacaacaacaaacaacagtatttacatattatttagtaggcacgcagccaactcccacggcctggccattttaaaggaatggatcccatttttgaaagcagcaagatcaccaagcagatgtttgccagggttgaagagggcatcaaagcaagcagctctgaaccatttctcaaaaagctatctaagagctgtaagactcccgtggagtctcaaggttaactttttttttgagacggagtctcacttgtcgcccaggctggagtgcagcggcgccatctcagctcactgcaacttccacctcccggttcaagcgattctcatgcttcagcctcccgagtagctgggcttacaagtgcctgccacacgcctggctaattttttctatttttagtggagacagggtttcaccatgttggccaggcgttcccgaactgctgagctcaaatgatccgcccacctcggcctcccaaagtgccgggatactgctatgagccaccacgccccgcctcaaggttaactcttagcccccttccccatcaagccttcgcagtaaccatgaggaaggcatcccagaagaggactctgcaaagcatgcacggggcaaataaagtgacgtgactggctacctctgcacgattgataagatctcctgggcttctacagaacacaaaggcattattcatggcagtggattaaatatagcgtctgtagccaagtcctccaaagttatgtatccaacacttgctcagaaatctaacctctgataggaagagtcaactggaggtaattatagtgtcctttctaggagtgaaacgccctcgcagagcgatctgagttaatgaaggacttgtttatttggactggttcagggtaaccctaagagttctaaatgccctaaggtgcacaatttgtttttctacttctgcaggagctgagatgggctgtcctgacctgcctctccctctttgagccatgagcagaaatgagtgaatccaacaagggccagaggagcccctgtgcaaatgtaatgagcgcaaatcccaccctgggttctggcctggatcagtggcctatgcttaaaaacactgatatagccgcacctacagcagtcccctctcagctacagtttgacgtttgtttgtttgtttgtttgtttgtttgtttgagacagggtctcgctgtattgcccggctggagtgcagtggcacgatcatggctcactgcagcctctactccccaagctcaggtatcctcccacctcagcctcctgagtagctgggactataggcatgcaccaccatgctcagtaatttatgtatttttttgtagagacagcgtttcaccaccttgcccagactggtctcgactcctggactcaagcgatccacccatctcagcctcccaaagtaccgggattacaggtgtagccaccatgtctagtgattttgctttttgaagtctcagttatccatggtcaaccaccactgaaaatattaaatggaaaactccaggcttggtgcggtggctcatgcctgtaatcccacactttgggaggcccaggtgggtggatcacttgaggtcaggggttcgagaccagcctggcaacatggcgaaaccctgtctttactaaaaatacaaaaattagctgggcatgttggtgctgcctgtaatcccagctacttgggaagctgaggcaggagaattgcctgaactgggaggcgaggtttcagtgagctgagattgcaccactgcacttcagcctggggtacagagtgagacccatctcaaaaaagaaaaaaaatcatagttttcgattgtgcagcattctgagcagtatgtgaaaactcccaccgtcccactccctccttccagggacgtgaatcacccctttgcccagctacccatgctgtcaacactccctgcctacagggagttactacacagtagtactacacagaaaacacctcgtatacacatctgtcccccggaatctgagggggactagttgcaggaccccatgcttaccaaaacccatgaatgtgcagtcccttatagaaaatagtgtagtatttgcaataacctacacacatcctcctgtatatatatttttttgagacacagtctcgctctgtccccaggtgggagttcagtggtgcaatctcgggttcaagtgattctcctgccttaacctcagagtagctgggactacaggcatgtgccaccacgtctggctaatttttgtatttttatttatttatttatttttgagacggagttttgctcttgttgcccaggttggagtgcaatggccggtctcggctcactgcaccctctgcctcctgggttcaagtgattctcctgcctcagcccctgagtagctgggattacaggcccccaccaccacgactggctaatttttgtatttttatagagacagggtttcagtacgttggccaggctggccttgaactcctgacctcaggtgatcacccgcctcagcctcccaaagtgctgggattacaggcgtgagccaccgcgcccggcctcatttttgtattttgagtagagacctggtttccccacgttggccaggctggtctcaaaccctgactttaggtgatccacccacctcggcctcccaaagtgctgggattaacaggtgtggccaccgcacccaaccctcctgtatactttaagtcatctctagattacttacaataatgataccttataaatgctatgtaaacagttgttatgctgtatttttattttgtattatttttgttattatttaggttttttctttttccccaaatgttttcaatccttggttggttaaatcacagaagcagagcctgaggatacaaagctgaccatataggtttggttctgtccgcaaatcaggcacccaccaggggtcttggaatgtatccccccaaggataaggggggaccactgcagtgtaagactgcctcctgtggccaatagggagtgcagatctaaaccataggaaaacacacttcacactcaggaggatggctagtatcacaaagatggatgatagcaagtgttggtgagatgtggagaaatcagaattctcatgcatggctggtcaaatggtgcagccacgttggcaacagtctgtccgttcctcaaaagcttaaatacagagttactggcctggcaccgtggctccacctgcaatcccagcattttgggaggccaaagcagaaagactgctttaggccaggagtccagaccagcctgcgcaacatggcaagcccctgtctctgtataataaacaaaaataaaaaaaaaataaaaattgggccaggtgcagtggctcacccctgtaatcccagcacttcgcaagccaagacaggagggttgctttggctcaggagttcgagaccagcctggggaacatggcagacctcatctctattaaaaatcaaagaaattacccaggcatggtagtgcattgctgtaacctagcaacttgggaggctgaggcaggaggatcgcttgagcccaggaagtggaggctgcatgagctgtgattgcaccactgcactccagcctgggcaacaggggagatcctgtcttaaaaaaaaaaagaaaattgtagaaaaatagacttaccatacgacccagcaattccatttctcatatatacccaagagaactgaaaacatgtccatacaaaagtctgcacacgaacactcaaacatcattcatgatagccaaaaagtggcaatacattctgctgatgaatggataaatatatgtggtccatccatactgtggaatagtattcagcaatgaaaaggaatggacctccgaccctgctgcaacatggatggaccctgaagacgtgatgctgagtgaaagaagccatacagaggtcatatattgctgattctatttattctaaatgtctggaacaagcaaatctacagagaagaaagtacactagtggttgccgggggcttggagcagatgggaagatagggaggtcatggtaaggagttgggggtatcttcttagggtgatgaaaacattccaaaattgattgtggtgtagttgcacaactctgtgaatatactaaaaaccactgaaagcctgggcaacatggcgaaccctgtctctgcaaaaactacaaaaattagatgggtgcggtgatgtgtgcctgtagtccagctactaaggaggctgaggtgggaggatcacttgagcctggaagttcgaagctgcagtagccgtgactgcaccactgcattccagcctgggcaacagagcaagaccctgtctcaaaaaaacccaaactcaccgaagtgtacattttagatgggtgaattttatggtatatgaatcttcaataaagctgttaccaaaaaatactgtctgaagaagtgttatctatttaatgtctatcacctaaccattctctcctcaaatatatgatggtgggggtggatatgttattattttctccatatcctgtccaccataatgctctggtcacattaaggactcattcagcagccataaaaagaatgaaattggccgggcacggtggttcacgcctgtaatcccagcactttgggaggcgaggcgggaggatcaactgaggtcaggagttcgagaacagcctgaccgacatggagaaacccatctctcctaaaaaatacaaaattagccgggcatggtggtgcatgcctgtaatcccgctactcgggaggccaaggcaggagaatcacttgaacccaggaggcagaggttgcagtggctgagatcatgccattgcactccagcctgggcaacaagaacaaaactctgtctcaaaaaaagaaagaaagaaagaaagaaatcatgtcccttgcagtaatatggatgcaactggaggctttatcctaagtgaactcactcagaaacagaaaaccaaataccgcatgttctcacctaaagtggcagctaaacaatgggtacccatagacataaagatggaagtgacaggccgggtgggtggctcacgcctgtaatcccagcactttgggaggccgaggtgggcagatcacctgagtcaggagtttgagaccagcctggacaacatggtgaaaccccatctctactaaaaataccaaaattagccaggcgtggtggcagacgcctgtaatcccagctacttgggaggctgaagcggagaatcgcttgaacctgggaggcggaggttgcagtgagctgagatcgggccactgcatccagcctgggggacaagagcaaagctccatctcaaaaaaaaaaaaaaaaagagaaaaagatggaaataacagacattggggattccaaaagggaagggaggcagcagggcaagggctaaaaattacctatcaggtacaatgttcactctcttccctttcatggagggcactctgggacaccagaaacccaaccccaccagtatgcaaaatgcctgtgtaacaaacaggcacgtgtcccccaaatctaaaattaaattaaatttaaaaaaagactcattcaaaacaactgttacccatggcattaaggaatttctgtgaattatcttttaggtattacaagatattgtggttatttttttaagagacagagtctcgctctgctgcccaggctggagtgcagtggcacaatcacgctcactgcagctctgggttcaagcaatcctcctgcctcagcctcctgagtagttgagacgtgggtgtgagccatggcactcaggcagtggttatttttaaaaagggttcccatctttattgatacatcctaacatattgctacatgcaattgtatcttttttttttttttttttttagactgttgagtcttgctctgtcgcctaggctggaatgcagtagcacgatctaggctcagttaacctttgcctcccgggttcaagcaattctcctgcctcagcctccccagtagctgaactacagacacccgacactgcacccagctgatttttgtattttcaatatagcccagattcaccgtgttggccaggctggtcttgaactcctgacctcaggtgatctgcccaactcggctcccaaagtgctgtgagccactgtgcccagcctaattttatcttttatcatatctgggattgcttcaaaatcacttggggtgggaaaaatggagggacgggtaggaaggagccatgtggagaacgggtgaagggcagggctgtgcaagcccggtaggtaagtgtctcttctacgcactttgagatctcctgatgttttagaatgtgttgaatgaaatgaaacattcatctgctgcattggagctcaaaaatctcatgtttggagagctcctcagatactccaagtgccccaggtgccacctcccaggaagggaagcacacacttctcaccccatagcccacccaatacaacaggctggcagcagagaaacggcgtaacccatccggagccagggaagataaaaccaggaggagaaaggtttccggggccagagcatgtggaaagttggccatgcccaagcccccttaccccgccccactacccacaatctggaaatacctgaacagtcaccacctgcttgcccaacccaacggatttttatgaccctggtgtaaaaaggatgagaaaggaaaagcagggcctccccccaggcccgcctccccgagtgcccgcctccctccagtgcctgccccccacctcacccagccagctcttccaggtgcttcctcttcaggcaggaggccacactcctggcccacgcagggacttacctctccccagaagagggcacacctgctccctgcctttcacccagctgggagtggatgagagtggcagcttctcccacctctgagtcaccggaaacaaagccgggggactgcagaagcacgggcaccatggcttcacagaggccaacccaccccagtgagtgccacccagctcctggccagcctcactcactccagacacagggcagagggttcctaatgtctctaaaaccgaggactcataagaatggtaaccagataaagccattcgcaccacacccgccttccctccctggcctggagagtagagggccccagaccagagtctgagagtggtcagcacgtttcctgccttatgtacccccgcactgaaagccaacctgaggccgggcactgtggctcaggcctgtaatccagcactttgggaggccaaggtgggaggatcactgtaggtcaggagttcgagaccagccggccaacatggtgaaaccctgtcactactaaaaatacaaaaattagccggatctggtgggcacgcctgtattcccagctaactgggaggctgaggcaggagaattgcttgaacccgggggcagaggttgcagtgagccgagaccaggccactgcactcctaggtgagagagtgagacccgtctcaaaaaaaaaaaggtcaggcgcggtggctcacgcctgtaatcccagcactttggaggccgaggggggcagatcatgaggtcaggaggtagagaccatcgtcgctaacacggtaaaccccatctctactaaaaatacaaaaaaaaaattagccgggcgtggtggcgggcgccgtagtcccagctactcgggaggctgagggaggagaatggcgtgaacccgggagccggagttgcagtgagctgagatcaggctactgcactactgggtgagagagtgagactccctgtcaaaaaaaaaaaaagaaaaccaacctggccctcagcgtgactttctgtaacatactttactagcacaaacgggattcctcaaagtaaatcgggtctgcggcctcaccacactggcataacaggactgggactacaggtggctaacctcaccttcctggaaacagacagcagccaggtgggcaggtgagcagctgagactgggatgggcagacgacaagcccagggccaagggcgcaagctcttccaaggacctggtgcttagggaggaggagtgggggtgaggtggggtgtccaggggaagaacgccagtcactaataaattcctggacctcagataagcctcacaaaaactttggaggccaaggcgggcagatcgcttgagcccaggagtttgagaccagcctgagcaatgtgaaaatctcatctctactaaaaatacaaaaataaaccaggcgcggtggtgagcacctgtatcccagctacttgggaggctgaagggcgaggctcacacaagcccgggaggttgaggctaagtgagccatgatcacaccactgcactccagcctgggcgacagaacgagatcttgtctcaaacatacacatacacaagctccagtgaactttactatattatacagcaagactgtttttgtcttaaatgctttaaatcataagataaccgcaaacacacaggcaagcagagaataaccctgtgtaccctcctggaatcaacaaatttaacattttgctgtattgatttagaatgtccccctaccccaccccacccccaccagtttgtttgtttatttttgtttttgtagagatggatctcactatgttgcccaggctggtcttgaactcctggactcaagcagtccttcctcttggcctcccaagctgctgagattacaggtgcccagccctgcaaaaatttctaagatgcaaagatacaacctcctctccctgtccccagaatgcggggctcatctttccctacgtatttggtatctacaagtgcatacagtgccaccacacacgtgcgaggcacacacaaatgctgcctctctgtgcgcggtcctgcaacttgcttctcgtccacattgagttccaagctgccccacgccacctacacagccctggccctgctgtcctgcacccccctgctggcaggaaccagtctgtcttgtgtccctgctggggctcagggaacttctctgttcactttttcactgttgcaaacaagaagcagacagtggccttgtccatgttgcagcatcgtattttaatgggagtagaaaagagcatagtgttcgtgggcacccctggcctctggggcagacttccttatgcctgccctgcctgcctgctctaccaaagttccagctccttcttgatgtggtcatcctgccctctttgccttgctgaagtcccaccagctgctcgacaccccatctccctgtgtctcccaagtcagcttcccaaggcgtctgagtgccctgcccacctcgccatcgctgccacatcggccccagccagggcttcttggagaggggggcatactccaccactttgcagcctgtgttccttccgcttcgtgtgtccagaatgggccacctgtccgctacagccaggcctgggtcagggccccccacccccacctgcgtgggagtccctcaccaggctcactgcgtcttcccctccccagcacctttatcgagggcaggaggccagggcacccatgtgttacaactccccttcccggaagccttcctggggtcttgggcacaccctgccagactgggcactgtggctgggagccccagcacgctggagaagggcccttaggccagctggcagccaggcctgcgtctggatccaggccaccaacatgggcagcctctttgctcaccccttcagccttcctgaggctgtagtgaggagggtggcagggcatggcatggcctgaggcttgggcaagcgtccgcctcctctggctggtgggggctcgccacatcccactcacggtgtacaactaaaccgttagtctctgtgggccagccccacttccgttccttcttcctcctgggggaggccaccaggcacgcaagctggccccggtccatctctgctgccttgggcccctctggcttctgaactagtaggtggctccccctgcaccctggggtcagccagccccccaggactttagcttcaacctgagcacactgcacctgaccttccaacacgtcttcacccagccaaaacttcaccagctgacaatgaatctcaccacctgtccacggcccgcatcctccccagggtttctcttactgagaacgccggcacctgccctgcctgggagaagcagggatggactaggggtgttcactccagtccccagaacctgctgatgtgaaggtcccgggccgcgtgtcccaccagcaacacgtccgctctacagcccagccttcctttctccagccacccccatacagagacttcccagagagacctgcccaacggctctttaatccacgtaccccaggggccggcctatctgcagcccctctccttctgtgattttcttccatgcccagtatcggagacatatcacagccctggtgggaaaaggtggtgtcccgggggacaaagtttaacagcgtgaccattgggatccaagctgcacggcagggcgtgcacctgtgccccaagttcaggatggctagaggagagaacgcttttactggaaaggcagaaaagaggaggaagaaaagtaaaaggaagaaatgagaaaatacagaaaaatacagatggatgaaaagggaacttaaccctcccctgtcactcactcgttcccacaaatcatcgcggagccctcggacgggaatcccgactagccctgggaatggactcgtggaggaggcagctctgggtaagtaaaacaggaggaccttgggtgctgttcctgagctaagacccctccttgctgtgtgcccctgggccagctatgagtaaatcggaggtggcggcaacaccccggcggcctccaccacaccaaaaacaacacatgtctggcattgtcatggggccgcggatgtgtctattttcactgaaagtacagaaatcactctgagaagctggcatggtggctggggcctggcctgtacctctgccccaagtggacacggccctgaaaggctgagtgggaggccaggtgcagtggctcacacctgaaatcccagcacttgggagggcaagatgggaagattgcttgagtccaggagttcaagaccagcctggccaactggcaaaactccttctctgccaaaaatacaaaaaattagctggatgtggtggcgcacacggtggtcctagccattctgggggctgaggtgggaagatttcttgtgtctgggaggtcgagctgcagcaagcccggactgtgccactgcactccagcctgggcaacagagtgagacccttctcaaaaaaaataaaagaaaggctgagtggggttgggggattgggggtggagatcgccacctggagcccacctgctgggagctcacacagacctccttgcccggagcacacggggtgccaccaactcccaggtggagcatgggagccaggccacatgccatcctggaggctatgatggactcatcactgaggtctgtgccatagcacttaagcaccttatgctaatctgctctcgaaccacacagagatgcagaataagaggccccagccaaggctgcaaccccttcatcacaatgtcacaaatccgctgtcccgtctccagctcacctattccatggttgttcctaccacctccaagctcagctctccctgtcacctgcccctccgccaggcccaccagccttgacctatgcactaactggctcgcagctgggaagtcttcagctctttttccatttctgttttctccttcttcatacttagcttaaagctcccagcactttagggggcagcccacgaatccaaactcccaagaaattctacaagagacatttagcaatgtcacctgcaccagctggcaaatgaccttacttgtgagttatgtgtccagtcttccaaatacacttctcaaggacatgaatccttgtgcatccgaattgaatcctgaagactatggacagttctccaacgctgaatgctacatcaacatcgtgggggggaaggtgataacacatcttcaattttgcttacgattaacttcattttacaactttgctcaatatcccccaaatccttggccaataaactgctctggtactttgtttttgaaagtgttcactttgttccctttctccataatcaattccttttaaccaaaacctttccctctttcgaagtcattggcctatgaatcctaacactggccacgtaatcaagaagacaccaacacaggtccctatgccctttgagcaaacctccccactcctgcacccccagtcctgcgagctgagacaggcaggtggctgaggaaagcaggtgaaaggtcagcttgatgcaccgtgattgccaggtttcaaaacacgcccaaggaaaatggagatatgggacttgcctctgtaattaaaacaaacaataaaacttgatacgtgacaacggacttccaagaaaatggtctttatacaactgaaatatgtaaataatttctgagtggggcagaagtctttcaacacagccttgcatcaacacgtatggagatactaatagataggtgtgtgggaaggtaggtaggtaagacataagattcctttttgtgcttttaataatgaagttacagcacattccttttttttttttttggacgaagttttgctccatcacccaggctggagtgcaatgacatgatctcggctcacagcacctctgcctcctgggttcaagtgattctcctgcctcagccttcccaggagctggaattcaggcacgcaccaccacgcctggctaattttgtatttttagtagagatgggtttttacctgttgaccaggctggtctcgaactcctgaccccaagcgatccgtctgccttggcctcctaagtgctgggattacaggcatgagccactgtgcccgacccagaacattctttttaccaaccctttggcatatgctagacaatgtgacccatatatatttttatattgatgtatttgacagcattagatcatttaattcccactagcaccctaggaaatgggtactagggctatctcctgtactaatgagaaaaccagggcttagatgtcaagaaacttgcccagtgtcacagccagaaatagcagggctggaaatcaaacccaggcccaggccaggtgcggtggctcacgcctctatcccagcactttggcaggccaaggcggacagatcacctgagctcaagagttcgagaccgcctgaccaatatggtgaaaccctgtctctactaaaaatacaaaaaattagctgggcttgtggcatgcacccgtagtcccagatactagggaaactgagacaggagaatttcttgaactggcaggtggaggttgcagtgagccaagattgcaccactgcactccagcctgggtgacaagcgagactctgtctcaaaaacaaacaaacaaacaaacaaacaaacaaaaacccaggtcaactccaaaacttatactcttaactcccaaagtaaagtggtaggtactacacaaaaagtctacttaggattcctaaagttacaacacagatataaaattaggtcactgttgtaaccaaatgatgagattgcagccagcaataaaactccagtaagtataaacaccatcagtgccaacgtaaaattattcacatgctgcagtcttcccactagcattgcacagtgcccatgcacacagagcaggctctgctttctattcaaacctagctaacagctgcccatctcctccagcggtaacaactatgttggaaatcctctgagaaaatgttacccatgggaagcgacagcttagctcgcaggaataccaggcagggcctctaggaacagagaaagtgtgaggctggatgacatgggctcatccctggaaaaactggagaaggcgctgtaggcagggtcagaagcagtgtctctgggaagggcagggcagttatctcatcatctacaacacattcttggatgcccgggtgaccaagcctgggaagattctgcttcgctagaaagctagtgccagcctccgggactggctccagccggggaaaccaccttcacaacatgcatgatttccaaggtggcaaaaatctggcctggcccctcactgctgcccaaagaacttcaagggaagtaccaggaaggctctggaaggacagcacagcccagggggttccctagaactagcacacatgtgcagtaaagttcatggctcttctgactgagatgcaggcaaaaattagcaataatgggaaggaagaaaagcagcagctcctctttccaggcaagtgtgggtgtgcgctctctgcactgtatgagccacatcgttattcaattgagatatgcacatctgtaatggtgcccttgtacttttccagtaaatgtgtatacacacaacagaagttgtttcccaaacttggctgggcgtgttggctcacgcctgtaatcccagcacttgggaggccaaggtgggcggatcacctgaggccaggagttcaaaaccagcctggccaactggtgaaaccccatctctactaaaaatacaaaacattagctgggtgtggtggtgggcactgtagcaggagaattgcttgaacctggttggtggaggttgcagtgagccaaggtcccacaccgcactccagcctgggcaacaagagcgaaactccatctcaaaaaagaaaaaaaaaaaaaattgtttcccaaacctgatggaagcaccttagaagtgagaatgtaagactcaccttagtttttcggagggtttcatgtacaagaaaggtgaaggattttcattattatttttttttataagacagggtcttgttctgttgccgagcgtgaccttgaactcctggctcaagagatctcttgcctcagcctaagctgggactacaggtgtgctccactacacccagcctggagcttcattatgaaaggttgcgtcttgaattcatgactgatcattcaatattcacattatttaattggccacacagtggatttcctgtactgaagtttatcataatggactattcacatttatgggtcaatataatgggtcgtcaggttataaaaggaattctgggctgggcacggtggctctgcctataatcccagcactttgggaggctgaggcgtgtggatcacctgaggtcaggagtcaagaccagcctggccaacgtggcaaaacctcatctctagtaaaaatacaaaaattagcaggtgtggtggtgggcacttgtaatccagctattcgggaggctgaggcaggagaatcgctgaacccgggaggcagaggttgcagtgagccgagatcatgccactgcaccccagcctggtgacagagggagacttcgtctcaaaaaataaaaataataaaataaaaggaattctggacgggtatggtggctcatgcctgtaatcccaatactttggcaggcgaaggcaggaagttcgttgagcccaggtatttgagaccaatctgggcaatgtagcaagaccccatctctacaaaaatacaaaaattagccaaggtgtgggtagtgcatgcctgtggtcccagctacttgcgagttcactcgagcccaggagtttgaggttatagtgagctatgatcacgccactgcactctagctggatgacagagcgagaccctgtcttaccaagtactgtaaaaattaagccaattctggtggatcacttgaggtcaggagtttgagaccagcctggccaacatgatgaaaccctgtcttactaacaaacaaaaactacctgggcatggtggtgcatgcctgtaatctcagctactcggaggctgaggcaggagaattgcttgaactggggaggcggaggttgcagtgagccatgatgcgccactgcactccagcccgggcgatagggcgagactccatctcaaaaaaaaaaaaaataagccaattcaaatttagaccttatagtgcaccacgtcaataagtaatggttagataatacagacaaatatgatcttagaaaaaaaatttggaaaagccacaaagattcacaatttttaaagaagatagccaacgtattgacagacccagttatctgacctagctattcagaagccaccagaagtttaacagctgctacttctttcccactgtgcctgccctgcctctagccagctcggcactcgggcaggagctcagactgcaaggaggagacctgcacctgcccaaaggacacctaaacctcctcttcgtaccagtatattgttcccacaaatgtccctaagacaacaggacggtgtcccctgtatctcccatgcatattcttcacctttgcacagaatataacaacttgacttctaattcaaactgaacttgaactgaacttctaatgtggggactgcaaaatacattgtgtccctaaatgccgcctgcagccaggacattgtttgctagagcctgtatttactttaacactcaaaactctcttcacatctgacctctgattggatcctcacaaaactcgtgtgactggaatgacaggttcagacccaccaccttacagatgaggaaatggaaacccagaaacccagaggcggattcagtgccacacccagtctgcatggggtagggagtgggggcctccaaaaccaggccctctggctgcccagtggtctgggaagcagcctgggaaagggaaagaaaacaccagatctgggttcaaatcccagctctaccaattactcagacctgtgaccttgagcaagttttgcctcacataaagtatgcaggatgcccttacctcctccggcaaactgcaggaggactggcagccagctctgacacctgttaggtctttactgcaggaacacgttctttgtcccttccaactgtagccctgtggtgccaatgcaaaccctctaggaatgtggatttctcttcctactgttgcacccccaccccatgccaaatctcaatgccagcatttgataccttctgacttcatgtataccttttagcaatctgtggttgtattttgtgcaaactgtactggacatcacatgagccactgtgtgtatttgaagaagtataaagaaaccaggaagcccggcgtggtggctctgcctggaatcccaacgctttgcaaggccaaggtgaaagggtcacttaaggccaggagtcaagaccagcctgggcaacatagtgaggcctgtctctacaaaaaaatataaaaaattagtaggtgtggtggcatatgcctgtggtcctagctatgtaagaggctgaagaaggaggatccttgagcccaaatgggagattacgttgagctatgatggcaccacggcactgcactccagttgggcaccaaggcaagatcctgcctcggaaaaaaaaactcctggcgcagtggctcatgctgtaatccccgcactttgggagggtgagtcaggcagatcacctgaggtcaggaattcagaccagcctggccaacatggtgaaactcatctctactaaaaatacaaaaattaggcaggatggtggcatgcccctgtagtcccagctgcttgggaggctgaggcaggagaatcacttgacccagaaggcagaggctgcagtgagccgagatcataccgctacactccagcctgggcacagagtgagatttcctcaaaagaaagaaaagaaaagaaaataagaaaagaaaagagagaagaaagaaaaatgaaacaaaatctccaagaaaagaaagggaaggaaggaaggaaggaagaaggaatgaaggaaataaagaaaaaggaaagcaaacctccatgtattaaatctttttcaggcaccagaggagatgacagttggcaaatcagggataaatgcttttataaatgaagaatattttataaaaagtcaaatttcagtgatagcatatgacagttttgtctcttctcttctctttcttttcttttttgagacggagtcttgctctgtcaaccaggctggagtgcagtggtggatctcagctcactgcaacctccaactcctgggttcaagcgattcccctgcctcagcctccgagtagctgggattacaggcgtgcatcaccatgcccagctacctttttgtattttagaaagacgaggtttcactgtgttggccaggctggtctcgatctcctgacctcatgttccgccatcgtggcctccagaagtgctgggattacaggcgtgagccactgcgcttagctgacatttctccagggcatcagaacacagcgttaggaaagctgtctgtggtgactcaatgtgactgatgaccacaggaccccctgagtgagccagggctggtgggcgaagcagacatcactgcgagagctagcagcttgctgtggggagagaatagggacgtggtctcgggtccagatgtcccagccacagtagcagcatgaaggaaggtgcattgaggggggacccaaatgctcctctgcccctgcctccctcacaggaacttcccataacacaaacaggaataacagtgcccctcgtcggcggttatggcaatccagagtggaaaaagggtgcttcgggcagggcgagggggcttatcctgtaatcccagtgctttgggaggctgaggtgggaggatcgcttgaggccaagagtgcctatgattgcgccacggcactccagcctggacaacagagcaagaccttgtcactaaagaaaaaaaagaaaggatgtctcaaatgttctgtcattccttcaacacatatctgaatgtctctctgggccactgaaataatgaggaaggtgaatgtaagggtgagttaggaagaagtagcgcacttagccccggctgcatgtgggggcttagggaacaggaagaatgcaggctggctctcggctcctgggctgggtaccacaaaccacccgcatcaggagtatgaagccttcctttctaacataaaggacttggtgtccaatgcctaacctatatccctcaggaagcagagcggtaccaccctactgcccaaccctccaaggtgacggtgaccctcctgcacaccctggagagggccgcctcactcagcagcatgatttctttcattgttaacttccaaagacgttcctggaccgagaacaatcctcaccaaaaaaaaggcaaaggcagacacttctgaggccgtcaagataccaaatagggtagctggcctcagcccagggcctgctggagatccaaccttcacctgacattggatggggtaaaagttgaaatttacacaaggtaacaaatatttgaagctagcaagcagaaaaagtccttacttgtgttaagcaatcaatttgtttaaaaaacatatcctgtacatgtctcaaagaaactggtaatagtggtggcatctggagaggggaaccaagtgagaaggactctctctgtatctgcaccttttaaaaaaaaaaaaaaaaaaaaaaaaaaaaaaccagagacaggtctggctgtcaccgaggctggagcgcagtggtgcaatcatagctcactgcagtctccactcctgggctgaagccatcctcccacctcagcctcctgagtagctgggaccacagatgcctccaccaggccctactaattgtttgtagagacaggggtctggctctgttgcccaggttgtctcgaattcctggcctcaaagcaatcctcccaccttggcctcccaaagcattgagatacaggcgtgagccacggggccgggcccatctgtgcctctttaactttgcatcgtatgctatatcgcttatttgtaaaaacaaaacaaaacaaaagtcttcacaagaaaagctcaagacggcagaagacaagtgaggcctctttaaagtgtgttggagagattctcgagagattctctcaacacactttaaacaaacaatctcgaacagccattttaattcttaaagcaccaattctccggaattcaagttcaggcttccaccagcaacagaattctggcctgccaataataaccagcagagtgactaaacattttttccaacaaaggaaaaaatgcaaacgatcaaagtgcagagcagcccttggcccgcgcaggctccggtttccgcctcccgccgccgctgccaccgccccgcgcctttagatttcgggcagcaagtttaattgctcgcttggaaagcgtcctcggaaggcaccgccagcaactgcggcttcgcgccccgccccttcccccaagccccgggcggcgtcagtgacggctgagaaaagtaggggaaaggtcagcagcagccccgcccccaggctggcgcgcccaggcgctcggatcctgttccacccgccgtgcccacagagaccttccggagcgagttgcgcgcgtccctgtggccaccccagcgacagcgggagaaatgcaacgcacctctccgtggaaggtcgagccctgcggtgcccagctgtggggacagctcggtgctcagtgcttctgatacagatgctgcatccaacgagccagaaacgcaggcaccgcgctcaagagcccagggcgctctaaaaggggctcactgtgaagcctcagtgaaaactgacggtgtttttatgaatgagcctcggggccagggttgggtaagggcaggccctcgttccagggctccccggaggcccaactgaccgctcggtgaccactggtccggggccggggccaaacgcagcagccgcagcagtatggaagggacccagtttaattctcttcccctccagggtaggcggcttgtttttagtaccactcgaaacgttattttggcctgtgcatgatgccaacttctgccactttgaaacaaagtggtgcactcccaaacctggccctttttattgtttgattccaactgttaagatagggttcagtgcaaggtctaggctagcaatgcttcacaggaaggaaaccagtaatttacatgcgaaagcagtccacaggctcttggtattgaggcaaaaccaatccaaagaaccagctgcgaatgcgatagtccccagaccaactgacagctggatgttcgctggcctcagcggtgtgcattctcgcgacacttatgtcctcaatttattgctacgttcactcggtcagagtcgccttaaagaattggaaaggcccgggggtgggggtgcttcctggcataaatagaagaccagtgctcagccttttttattcacttggtttgtggcttagaatgaaataaacatgcttgcatatctggaataccagaaaccggacacctgtggaagaaaatggtgtaacaaaatacaacgttgcaaaaggaaaaccgattttcattttattcggtaacttacaaagttaccagcttcctactaaaatctcccttaaatattttataacacacggagccgagaggaaccgaaagcctgtgccgagttggaatattaactttgttatgtatttaacctggtaggtagttgggatttttaactctctgagtgttttctttttttaaagtaagatcggccctcatctttgagttctgcggctttaacgaagccaagggcggatttacattataaagacgctgacccatggcctctcctgacaaaccgaagaagccggctgttggctggccgcggcggtggctccgagaaggggctgccccgcgtggcctgaccgcaccgtcgggctcgcaggccaagttcgccagggcacggccacgtgacacccccccctcccgcggccccgccgctcccagcccggcacgaccttgggcacatgctccgcgccccccgcccttgacccagcgctgcacgggagaggctgcggggcgctcccaagcaggcactggcccggcaccctcatcctgctcacggcagcgctcggaccgcgcctggagtccctgcgccagggcgtgtcccgacggctgcaccgcgagggcgggcatggggagggggaccggggagacgacgctgggatggggtcagcggcgccctgccgaatcccgagggccgagcacccctccctagccgcactgcacctgcccgtaggtgaccaacccacgggcggacccccagacccaatccctccagagccagggtgggatgggcagggacaggagccggaggccctactggccccgggcaaggcatcctggaaagcatccagagcgtccagcatccctcccgcggccacccgcaggctaccgacccctgggcagaccctcagactcaatccagtccagggcggattaaggagtgggaacaagggagccggtggccccgctggccccgggccggaggcgtccagccaagtccggaggccgagcatccctcccgcggccgcacgggacccgcctgcggatggaccgacccccggtggccctcagacccaatcccctggggaacatggggagccccggcctctttctgggttcaggactccacaaccccgccgtccggggggaataccggggttcctctcggcgccccggttccggggcgtcccccacccggtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcgtcccccacccggtccggttcccggcagccccgcgccccgccgtccccggcccccgcagcccgcagggccccgccaccctccccaccgcgggcgaccgggctcaccgagtcagctacggaggtgcggcacggcacgacggcggcggcggcggcagcggcggtggagtgaacgagcggcgagcggaagccggggaaggagggccgcgggcgaggccgagccacccgacgccggcagcagcggattggctgaggcgggtccggctgcggcgcctgcaggcggtgactcccggcgcgcggaggggggcccggggcctcggcggggcggggcgtccgcgggctaggaggggagggaaactgaggctcgagcgggtgctcgcgtcctcgacctctgccggatggggtctaggacgagattcctcaccctccgagcctcagtttcctcatccgtaaaacgaccatctcgtggaggccgtgcgcataaaatcgcttagctccgtgcctggctgatcctcgcacttatctatcggcattgccccgtgtaatgctccaggcaccccctgatggtattcaccctgactctttcatgcagacaagggtcgcgggccaggaaataagttaccccacatcaccgactgagaagcaaccgatccacagggagtggtggggcgcgcctgtaatcccagctactcggaggcgggaagtcgcttgaagccaggagttcgaggccagcctgggcaacgtagcgagacccgtctctaaaaaaaaaagcgcggggaagtgatagatcggacattgggtccagatctgatccacagcccatgccccaaatcagaccttataccacgagtggcagtcatcgcgatccagagcagcgtggctcctcctcatctagctaggataaaaatgcctcacttggggggctttggtagatttactaaaataattcttccagcgtcaagaacataataggtgctgggagaggagtactggaggccagggcagagcgaccgagagacccttgtgctggagctcgggagaggggccggagcgggaactgaacatccaccggtcccaggagtctagggcgagcgcagctgcaggggaccagggggttgagggggagggagaggggccccaagcgtaacaggagggccaagggggtctcctgaccgggagccacccctcccctatctttgcccgcaatgcttccaggcgcgagctgcggctctgcatacagcaggtgctccataaatgcaccgatgttatgaacaaagactctttaaacctcttttatgaaccctgctctttttaagttcgaccacttcttctagttatgaaaaatccatgtttgcaaccatccttctttctgtatcatttagttgttaccgcagaagaatttgaagagaaaatgaaagttctcctttgatcccgccccccaccaccgctgcagttaactctcctgcggttcccgggctcgctgttttaaaggaaggctaggatgcaagctgtctgtaaggtgttttgttttcacttggcttacgtcgtagacaggtctctgctgggggacggagatgacaccggccttcccaaggctgcataagatttcctttgactatgctgtgatccatttacgcgcccccattggacaattagggcctcctccccgccccccaccccaccattgcaggtataaaaaaagctgcgttggccgtcgatgtacctcctggagctcctgattatcctgtaggatagaccctggaggggaagcaaccaggcacgtgcgacattttggtgacacaggccaagctaccagccgaaaagtttaccaacttccactgccacccgcgcgtgcaagcggggccctgtctccgttatggattattttaatctttgccaatcctaaaaggaggggtgggggagggaagaatcttcatctctccttttaatttgcatttctttgaggttagaagttgggggtttgtccccctgttgcgcttgtctggaccaccagtgagcccaggcactcgacccccgcagatttcaccgcccaagaggccagtgggctgggccagggcacacgttcctgacgcgcggctgcaccccacgacccgggcggctctcgcgcgtgaggctctccttgcacgtgggccttcgcggtttgcactaggaagctggactgtcattctcaccgcaaatgcccttccctcctttccctggaacctcagcaccgacaggtccccgctccaaggtcatttcctccctcgctcagcgccccggtgcgcgccagctgggattggccccgcgccctgtctgttcccagggctcttcggccttgaccgtgcgccttccctgcgcgccgcctaggtgccacctgcaggccgggcggggcagggacagggaccagtctgtggggacgccgaggcgccacgctcacctgtgccatggtggccgggctctcggcgctgcaacgagcccgcgccggcctgcaactgcagccgcactggggaggccttattcccccccgccgaccacgctgcagctctcctgcccgggtctgcggctcccgcggctgcgtagctagtctattaataaagaagcagagaacgaggcctcccggggagctccgggcctgagcctcgttccctggggccaaaaacgtctccatgtctgcctctgaaactagagtaatctttctcagccttgttttttacagattctgccccagtttgaatactgtagcaattgcctaccatagcacaagaaaaattttctttttaatgcaggtaatgtttttatttaccgctaagatttctcttttactcaaaaaatacttttttatggaaaaatccaaacctttttattcattcgttcattattcattcatttttgaaacaggatctctctctgttgcccatgctgcagggcagtagcaaatgacagctcactgcagtgttgacatcctaggctcaagcaatcctcctaccccagcttctgagtagctgggaccacaggcaagtcccgccatgcctggctaatattttgaaaaatccaacctttgaaaaaaattaaccagaatagtataataaaggcctatacaaccaaaactcaactcaaccattatggagctagggccaaggtgtatgcctgtgttcctacccactcctgcccatcctactgtttattttaaagcaaattcagaaatcctaccgttatgtccacaaattccttttttttttttgacatggagtcttgctctgtcccccaggttggagtgcagtggcgcaatccacctcactgcaacctctgcctccagggctcaagcgattctcatacctcagcctcccgatagctgagattacagacgtgcatcaccatgctcggtaatttttgtatttttagtagagaagggtttcaccatgttgggccaggctagtctccaactcctgatctctggtgatccatctcctcagcctcccaaagtgctgggattacgggtgtgagccactgcgcccagccctcaaatctcgagtacaaacctctaaaagataaatattcttaactaaaaaatatgaccatactatcttgtcccacctaaaatagatgaacaattgttacagaaaatggtaaaccctgttgcctgcaagagcacagctgagtccccactcgatctcgccagcctcatttcttgctggcagctcccgcagattctgatccagaagtgtgtacgacttttttggaactcagctctggtatccccatggaaacagtgttgaaatctcagtgtggtgtgcttccctctcctctccgaagcctgtagtcctctgaccttgcaccttgggcctctaggtgttgagtaaatatggtcagttccactttgtgagcctgcatcaccagggtttcatgaggacagaacagggtgatgcagacgaaagcaccgcacgcagcaagaggacgtgcacggaaaggactcagagcaacaagtgcactgttttcttacggaacacgtctgctctgaacacgggatcagaacacattcttttgttgttgtttgtttagatagagtctctcttcgtcacccagtctggagtgcaatggcgtgatctcggctcactgaacgtctgcctcccaggttcaagcgattctcctgcctctgcctcccgagtagctgggatacaggcacgtgccaccacggctgatttttgtatttttactagagacagggtttcaccagttggccaggctgatctcaaactcctgacctcaagtgatctgcccgcctcagcctttcaagtgctgggattacaaacatgagccactgcacccagcccagaacacgttctatcccactgtcctggacgctttgctgcccatctgtgcctcagtttcctcacttaaaagaggaccagctggtgcagaggctcacgcctgtaaacctagcacttcggggctgaggcgggtggatcacctaggtcaggagttggagaccagcctgaccaacgtggtgaaaccccatctctacaaaaaatcaataattagctgggcgtggtggcaggtgcctataatcccagctactctggaggctgagcaggagaatcgcttgaacctgggaggcagaggtcgcagtgagccgagatcgcgtcactgactccagcctgggcaacaagattgaaactcagtctaaaaacaaaaaaacaaaacaacaaaaaaaagaggaccttgacccagggcactaatgagcaaacctttcaccactctccgtcgtccttcagagccggactccgctctgtttcttctgcacctctcagtccctggcacctggttgcccattgaggcacaaggaaggtcggcagggggttgccttgtggggaggcagcacagtgagaagcaagaatggaggtcaggagagggtgcagcaggccacagggcacagagctgagtcggctggctgcatgggtgcctcactgctcatctggcctcagtttcctcacttcaaaaaaaaggatggccaggtgcggtggctcacaccttaatcctagcactttgagaggctgaggcggtggacctcttgaggtcaggagttcgagaccagcctggccaacatggtgaaaccccatcttactaaaaatacaaaaaaaaaaaatttgccaggcatagtggttggcgcctgtaatcccactacttgggaggctgaggtgggagaatcacttgaacccaaaaggcagaggttgcagtgaccaagattgtaccactgcactccagcctgggcaacagagtgagaatccatctcaaaaaaagagaggacattgaccctgggcactaataagcaaccttttcatcactcttttctttctatattattctgattagttcatttatttggagaagcagtcatattctggtgttgggagtgtaactccagaaccactcagcctgggttcaaatcctgtctctgccacttactagccgagtgtcttaaacctccctgcacctcagtttcctcatctgtaacatgggaaagaaatggaagctccttggagagttgtaatgaagatgagtaactgccgggagtgcttagagcattccctggtcacagtaggtgccacataagctttagctgtgattattattcccccgcatcctgtcatgatccatgttttaaaagctgttgccctcccagatcagagaatgctggaaaaaaaggaaaaatgtctaaacgaataaacaaaaacactgttgcctataaacagtacgtttaatgggggaataataatttccctgagcatacagcagaaatatgcaaaactgccacctggagcctacaaccgcataaaatttgctcattcctttaaaagatgcttatcaataagcacagtggctgccaggcaccgtgtactgccagccaagaaccaaaaagctgggcattttgatctatacaggttaattcagatagatgaggggcctctttaaggccatttgaagtggtcagaatagttcaaaggtcctattactccctcctcagtttccccagtcatctctgaggcccccatctacctagcctactagagagtatgcgttcaggccaggacctgagcttcttcatgggatcagagcagcgtgctggcccagtgcaggcaatgccttaa

SEQ ID NO: 5098 - DNA, 89008 bp, Homo sapiens
tattttactaggctgccctttccctcattatttggttaaagagggcaggattttgtttgctatgcttgttaggttttcgggtttaatggctcctccagctccaaatctaggatatatgggcaaaaaaaccaaaacaaacaaaacaaaccacagaactcacctctatgtcaattccaagtcctgaggtccctagccgttctacctactcctatccacctttcagagtcttctcatgttgtttcatatagtaatataatgaccagggcttttagttctacttagccatagaaataggaaaagtatgttcaactccatctttcccctgtaacatatttttgtcgcaattttttgccattttaatctctgttgtttgtgccttgctaattacacactgaatttgtgctgtagttaactgaaaaatgtaattaatgcagatgcctttggtaagttatttctgagaataaatacatttattaccttgccaaatggaaatataaataattggctcatgggcttctaatatgagtctgttaagtcagatagcacataagaagatatatgaaaaagtagtaattattattagcctaatgaaaaccagggtgcagtgacaggttcctgctaactcagaaaagactgccattgcccgaactagcaattgtcagtgttgacacttctaggaatcactcattagaatgttcgtcttgggagaacctgttgggtgactattgatttgggacctttctctagatcctgcttggagggtgtagtcttgttataataaatagttctctatatttctgggcccatcttgtgtgatatgattacctcatgtgttcataaaagttgaagataatttccagtttttttctgtattttattttacattcttttatattcctagttagatttcatctgatgttaagcaagagtaaatatgcatatttattcttttaagagtcaagttctagtgaactcttataacttctttgcaaatttacttccctggctatattcccaaagaaagtttacttgaatttatataagaccataatgtttgtcttgaagatctcaagtctttgtagaactgctaagaacagatacactgaatttccctcaagaggactaactctaggtaaaattcctaaaccaaaagactcaaatctttcctcttagttcatttctctggaggaagccttctaacttttttccaactggaagactttcagagatgaagtttatgcagtgcatcctcttggcaaatatcagtgtcttggcacataaccttcctgcagatagattcatcagacctaatgagaagatgaatgtgtttacctctgaatccagagctgcgccttaaaaaattggtgtcatttggacacaagtcaaagggtaaaactggaccatggacagatttgaggtaaccaggatgcaattttattaattatgtcttctataattaaaatgagatgtcaggaaatatctcaggctgatactagaatagacaacctctccaaactgcaatttattttctgtgtattagctgtatctcaggcataaatggattggtgattttactagttgcataaaaagcttgagtagaaaaagtggtagatattttttgagctttgttcaaggtacatggtagcccacacactaatgacatggtgtattagccataataagatttattgatgataacttaaaagcagagattagcagaaagtatgatatactctgggtccagggagttgttcaatcaagaatgttgccgtagcaggttggatgtgctacaaggagctcttcagtggggggaaacttcacctctgaacaacttacatatatttaggctagtccaagtgtgtgaggaggacatagtttactaagtaaataaaacaaaactgttgtggggcatctctaggcgtataaaacagtattaggggaagttggagctcatcttgggagtttgcacaccaaaggcactgacattaaccagaggccttactaccttctctagctgtccagtccagctggaccaacagttccagacttcaagaaaggaaaacagagggaggccttacaacttctcttctgagaccaaagtttcatgtcttttagtggataaaatcataatccacaatggagactcagaaaatctcaggtttccgacaggttggacctacttctccttgacacttgaaaggtactctcacagcatctttctctgagtatcaggctaatgtccatcaatctccacttttaatgagctctcacatcagatatgaaatatctttatataacacattcatttatttttttgttttaaagaagtcattatatgataagcacttatttgtgagacatcctagatactttatatggattaactactttaagtctcataattctataatgaaggtataatttacccagtttacatatggaggaactgtgacccacagtggttaaacacttgcccaagtcagaaggctagtaacaacaacatgccctgatttcatctagtgacatggagatgaagagatgaataaatttagaaattaaaagtgctatgaaggaaataaagcagggtgatgtgctattttactttgggtggtcagggaaagtctcattaagaaatgtcagaggatctgagacttgaaaataaaaagcaacaagccaaaaagagggttgggtgctaatgattacaggaaggacagaggttcaaggcctcaagaaggaaatgagccaaatgtgcttgagaaagacgaaggagaccgatcattggaggaatggaatagtggtaagagacgtagtggaagaggagggagagggtcaacctggtaaggggtttacatttgagttgtaaacaacagcaactctgctctgcgtggcatgcctatgtgccaagcactattctgatagttttacctatcttcattttatcttcatagctttgtatgaagtagtatcattattagtctcattttacagatgataaaactgaagtgtagaggtgaagtaactagtaattgaaatgcaattggaaatgatttgaagacttagggtagtaaaacctgatttacatttaagaagtggcacaggagctgagatttgggaaagaaacttcttttggttgtgtggaaaaaggattaggggctatgaaagaacaaactagagaaccaggcaggaatcatagtagcctcttcaggatattactgataaatgggaaaattggactaaaggattttgtatattttgtactgatgctggagtagatgtaggaggtgaaattaaataagaaatcaagtatattcctaggtttcttgtttggacatctgggtggatggcaatgtcatatgtaacagtaataatagggaagacaagaggacagagttagaacacagtgatttggccatattaagttatgacacttactagacatccgaggagagataagtagaaagatggatatatggagtttaagctcagtggagaggttacatattgttttagtgaaaacaagaaaaaggatttggaaaaggttatttccataaataaatctggaaccaaagtttgtttttgtggtagaaacctaagcagggatttctcctttttgtttaaagctttgtttgggatttatatctttcttcttagataaaaaaagtttaggttcctaataaaatgtccttcccagtgtcagaagaagtctattctttttttttcttttggatttttttcagatataggataccctattccaagaccccattgcctctgactcagtcagtgcatgtctatagaagtgcaaggggaatgctcttctaaaagcatgttcagctagtctgcccatgggaacaggaagggtacaaagtgaatatgaacttctaaaagatgacactgcccaaacacatgtggtattttcaaagaaagttcaaactgagcatatttaaaatggaagtgctatattggagatttttttgtgctctgcagcatgagtagttcaatgattattttcttaggtcctagttgattgcttgtttatttatgcctggacggttttttccttgatctgaattgtttttcaaacatttagcaaaatcccagcatagtaaagataggatgtgttgggtttgcttacattacctactcttttctatgaaaagcagaaatcagattaacatctctttctgaatccaaaataggagttcactttgatatgagaaatagcaagaaaatgtcaactactgaactcatcatattcccttagctgcttgcttccaatatactgctctgtaaagatttagagatttccttgaaatcttctgccaaatcaattgtgagatgtaccttttatactactgtaatattttgaaatcaaaatgcttcttacaattataattagtagtgttttgttttttagcggtacataaataacaatgtgttttacttttattattatatactttaagttctagggtacatgtgcacacctgcaggtttcttacatatgtatacatgtgctatgttgatgtgctgcacccattaatcgtcatttacattaggtatatctcctaatgctatccctcgccactctccccaccccatacaggagccggtgtgtgatgttcctcatcctgtgtccaagtgttctcattgttcaattccacctatgagtgagaacatgcagtatttgattttttgtccttgtgatagtttgctgagatgatggtttccagcttcatccatgtccctactaaggacatgaactcatccttttttatgctgcatagtattccatggtgtatatgtgctacattttctgaatccagtctatcattgatgacatttgggctgattccaagtctttgctattgtgaatagtgccacaataaacatacattgcatgtgtttttatagcagcatgatttataatcctttgggtatatacccagtaatgggtggctgcgtcaaatggtatttctagttttagatccttgaggaatcgccacactgtcttcataatggttgaactagtttacagtcccaccaacagtgtaaaagtgttcctatttctccaatcctctccagcacctgttgtttcctgactttttaatgatcgccattctaactggtgtggatggtatctcattgtggttttgatctgcatttctctgatggccagtgatgatgagcatttttcatgtgtcttttggctgcataaatgtcttcttttgagaagtgtctgttcatatcctcacccactttttgatggggttgtttgtttttttcttgtaaatttgtttgagttctttgagattctggatattagccctttgtcagatgagtagatggcaaaaattttcttccattcttaggttgcctgttcaccctgatggtagtttcttttgctgtgcagaagcgtggataaggaaaccgatgttctagtgcaaatattggaattagggttataaaatgagaattgttggctgcggatattctttgattctgatgcttttttgagagataccttattacctttttttagggagccccaagtaatgtttttacaatggcataaatataattttcttaaaatatttatattaaattgaattctaagaagatgtttttcaagctatgattctgttacatattttttatagtttatctatgttactagctcactttgacaagtgaaacaaaaggtacaaataaaaagttccaacttcaaaatctgtagatctagaatgacctctgcttattagtcagtcaagaattattagcaactttggcaaacaatgaagagagaatcttcttataacaatttataatactcaagtgttcttaacattttctttattaaactatgagctcagtaactggcttctcagaacttgtcaattttttccatattctgtgctgcacaagtatgacttcataaaggcaatttaacaaatagaaatctggattggctagaacatttgtcaatactggatttatggtttatagtgtctgccccagcatgctactgttctaaaaccttgacacttagtccatcaatctgcctataaaaggaaaaacctatttctaaagtgacagaatctatttgtagtagtgcagtcagttagcaaagctgccttgaaatacaccagagaggaaaaggtgagagggaggggtatacatttgttaagattctcaaagatctcagtttgctgaacagagatattatcctacctattaagacaataaaaatacttcaggagacaatccttttcttccttctccatcaaatcaaaagcaacttggtaatttatttcaaatgtacgcctgtcatcacttgacgagagaaaaacttttcagggagcagtaggccaagtgttgttactcccacattgattttatggtgtgtttgatggattttgcatatgttgctttagtgtggtgagactcatattttctctataccccttccttcctggatcaagacacttttcaccgttctcctggagtcacagttcacatcaacatatggagctgttgctataaagaaaaaaatagattctttaagcaaaatataccagagtcctacagaaattgatagacaatattagaatcaaatattagcttctgtagtagctatttcaccctgggtttaggcctagaagaacaattttccttcatttcctcctcctgtaggtggaaactgactggcggactatctcgtccctatagcagcactaaaatggtgatgtctgctagccactactcccaaagccacaataaaccacacacacgcaaaaaaaaaagaaaaaaaaaggaaacaaacaaaaaaaaactgttcattaacaaatgctcactcaataaatgaagttttaatctatctcctagcctccacttcccacttcactcatttgacagattattgctcctaaatgctatctgtgtagaaattctggaacaactcctctcctgccatttccatggggcaaaaacacagcgctaatggtagcctgggacaataacctgaacaaaaagcaagaggactctccgggctgggtagagaagtgatcagtctgagagtacttataggaaacacaggttgggaagtgagatctgagagaaacaacttttatgtatgttaagcaggcttaacataaggtataaggtatggctctgtatagacagagccataactccataatggaaagaaaaatatgtcctttgcagggacacggatggacctggaagccattatcctcactaacttatgcaggaacagaaagccagacactgcatgttctcattcataagtggagctgacaatgagaacacatgaacatagagtggggagcaacacacactgggacctgtcatgggcgggggtagcagggcaagggagagcatcaggataaattgctaatgcatgctgggcttaattttaggtgatgggccgatgggtgcagcaaaccactatggcacatggttacctatgtaacaacttgcacatcttgcacatgtgtcttggaacttagaaaatgtggtatatatacatcatgaatactatgcagccatgaagaacaagatcatgttctttgcaggaacatggatggagctgaagccattatttttaggaaactacctcaggaacaaaaaaccaaatacctcatgctatccttataagtgggagccaaatgatgagaacatatggacacatagaggggaccaacagacatggggcctacttgagggtagagggtaggaagagggagaggattaggatataaaattaatgatactaggcttaatacctgggtgacaaaataatctatataacaggcacccatggcatagtttacctgtataacaaacctgtacatgtacccctgaactcaataaaatttcaaaaaaaaaaaaaggaaaaataaaaactgttttgcacatccctcaaaattctgtgtatgcttcacctttaatggcaataattgttaaatagtgggctaacccatcttacttttctaaatggtaattcatgactaaggggttacatcatcttagtaaatgaacttgactccaaacaaatcagtttctttggttgttatgatggcctcattgttttttgaattacttagtgctatattctgaatgttatgccctccccagtgtcctgccacagattcatatgttgaaacctaatcggtaatgtatggtattagaggtggggactttgggaggtgagtcggtcatggggcagaaccctcatgaagcaattagtgcctttatagaaaagactctaggtcaagcgcagtggctcacacctgtaatccagcactttgggaggctgaggcaggcagatcatgatgtcaagagttcgagaccggcctaccaacatcgcgaaaccccgtctctactaaaaatacaaaaaaaaaaaaaaaatagccagcatggtggtgggcgcctgtaatcccagctacttgggaggctgaggcaggagaatcacttaacccagggggcagaggttgcagtgagctgagattgcaccattgcactccagctcgggtacagtgcgagactccatatcaaaacaaacaaacaaacaaacaaaaaaacaaaaagacctagactgttcttttgccctttcctccatttggggacacagggagaagttggcgttttgaacaggaaatgggccctcgcattaaatctgtcagtgccttgattatggacttcccagcctcagagctgtgagaagtaaatctgtgttattaataagctacccagttatggtattttgtttagtagacccaatggactaaaagggttactatacttaaaaatggagagattgcaaacagatatagatttctgcctgctccttaaaaagcatcctcatggccactctctgttggtgccaaccatgacttccctgtgaacagtatttgtggtctgaggacagttacagtttctactactcctggtgtttcttagttgtctttgctctgttgcccttttttagttgcccttgctctattgtattcttacaactggatcatttcagtctactcatctatattacctacttagctcccatggcatttatgttttcatcatcaccaaaaatggcttatctattttttatgttcatttttggagattctttcatgcttaattttttttgtgtctcttcattaaaatattgggtgatggttgtgttcagtgatgcatgcattttaaagaagaagaggcgggtcttagaagaataactaatgcacaaattcagatgagcatcctttgggcattaccaatatttttctctaaaccaatcctatgtatgcatagctttatcaagtcccatttaagtgactcaaactccagaatgcttttaaaattcaattgtctatattagcttaaagatcttgggacaggaattttattgttagcatgccacacattcgtccttctaactgggatgaatgaagtaaccagggagcacgttataggtagcagaaagagaaacaatacttaggggcatagtttctggtgtgaatagagtttcagtgtatcactaatcaatccatagacatgtgcccaatggctaatctgtagctaaccctgttatgcactaataatatggtataataaaggagaatgtgttatcttttgattattaaaaaaggagaataatgaaattagattgtttgtttttttaaccagatattttgaaataccaaatgacaaaggaataattcccatgaaatatttttattataaaatcagatttattttttacttgttaatagtttagaccttccatagtactttatcttcagcaggggtatagttttagctttcaaaaatagttttattagttttctagtaaaggacaactgtcctttcatttttctactttacaaatgaaaaaacaaagtgaagttctatggaagccaatttattggcttagtcagttttgacacatagggtctgagcagagtttgtgcttcagagaaaaaacaaaaccgtaagaaaacctatcccggtgtcacctccatcagatagtgctttcttgctttatgttattccatattggtcaattggtctttaaaatgtcatcaataactgctacaagggtactaatctattttaactggtctcttggtagtcatttcaatcttgggttcatgttacttttttttttatccctccattcatttcactctgaatttatagttatcaggtttataaaagtgacccagaggcctggggtttggtattagttcatcatcagctctttctctataaatatttcacaactctgatcttaaatacatttactacaagtattaaatattaaaaattcatttggctacaggcaaaattaaaggtagggtaatggttcttcatacataaactaagcatttttatatagagaaatatttcctaataataattctttaccccatactatctcaaagaaaagcaagcataaacagaggcccaggtagataatatttaaggagaacaagtataaaaaatgcagctagggagataatatcaatctctcttattcccattctaattttaggtttctttgagatagtgatagatccattctttcatcctactcttcttcaaacagcttttcatgcctcaccctgactgcaatggtaccattggaatctcaagtttaggactcaggtttcctccaatattgtcttggcatcagaagagaagaaattctacagtcattatagcttccctgacatatacacacattaccctcacacaaagtgtttgatttaactcttataaacaacgagagaacaagaacaagaatcttgcattttacttggtaaagcagtgtgctttagatgcttataattatgtctaacaatgttcatcttaagaaagggaaactatttggagagaacatcaaagtgaaaaaaaaataagtgacaagtatcttgttcatgaggatagtgtaacaattcattgtggatatctgtaaaatagttaagaagcatctagaaaaaaatagggttcatctggtctaaataataatcagcattcatgaatatgcagccaatctccagcatgtggatccactgggcaccagcatattttcttcactcagtctagttccttcagtgttctacagtctgctggagaccagatttaggtaaaatccagagaaggttcagtttctaccataagagggtcaatcttatttattgatattggctacaatcttatttattggtattggctatattatatcttcttggtttactacatgttacaaaaattatcctaaaacttgacgtgattgtgatacaaaagagaacagcatttttgcattgtgtagtcttagggagaaaaggttcctgaggctcagatcactgtgttgcacaagtccacatggcttcattcacatggtattctacctattagcattcgtagagaggagttcgtctcagggaatgatgaaggaccactcatgatgcatctgcaggaatcttttgaatagggaccccttagggattattttctttaaacacacacacacacacacaacacacacacacacacacacacaaatcactgctatttctaaaatacctgaaaattaaacctaaatagtgtcagaaccaagtagtcagcggtcttcaatattgttaataattagggcatttttgttcatgtaaagaaaaacataaccttatataagaggagtcgttgtaatttaaatatcactaattgagattttatttaattataaaggcagctcagtaaactcttactttaatacacttatatgtgtaaaatattataggggttacacacacagttcatttcatggctgcttgatttctctgtggttttccaaaggttcaggatccacaggttggtaactgttgagataaaattcacataaaagcagagggtccttcacaggcataattgtgtttcatttattttcattgtgagaaaatctaaatctgaaactcacttatataatattatttaatggattaagaaagcatagaagcagaacatattgaaactctgtctgtaaatgtaccaggtctgatgaaagaataaattcacttaaaaaaagaacaatggaaatttatgtgatatgaatcacatgctgaagaatacatttctgcaatgtttgtacaaggggagcagtcactagtagttataagatagaagtgcccaaatcaataaattaaaaacagttttttatcatggtatttttcaaacaaaagtagaaaataataacacaataaactgtgtgtccatcatctagcttcaataattattaacatcttgcaatttatttcatctatcttccccatttttctaaagtatttaaaaaatcagaaactataaattttcaaaatatatttctaatggcgaatgactttttcatatttacatgatcattattacaataatattaacaatatcgtctagtatccagtccatgctcaaatttgccaaattatctttaagttgttcaaattacaatttcaccaaggtctatacatgtactttgttaatgtttgtaaatctttttctctatagcagtttcttctctcctttttttccccttgacatttatttattgcaatgaaactaggtctggcgggattttttcacattctagatttctctggttgcttctttgggcatcatttactgatttacctaatttattcattctccatatttcttgtaaaatttcaactgaagcattcgattaagcttcacttttttttgaagcaaaaaaccctcaaaagacacttaggaagtgctgtgaaacatcaagtgcatcatatcaggaggaagcctcacttttagtcagtgggttcggagctgtaagccccatcaatctattccagggtttctcctaagactttcacaaatggttgcccattggcaatcagtgctaagatgtttgtttccattagagatcacagtatgtgattttaaattttttattctttctgcatttgtagctgaaatacttctataaagaatattttcctttcatcagtattgttccctccaaacataatttgtaaaatgatggtaaaggttgattatttgcctttattcattaatttgcagaatgagttgatattttagcaacttcacagtaaccaatgatttttaaagaaatgctcactgtgttctgatcaattgcaaatattattcttctggtgctcaaattactcaatttgtaaccaatcagagtttattggctcttgtacctttttttttaaaatacaactgcaatagtctgaaatctttcttgtttttttggtacaagatgtccaggctcattttgaatattccaagacctggaatcacccattgctccaaaaagccttcgtcatttagcagaaaatgacaatttgattccaaaacaagtactctacagttgactattgtactgaattaccatttatttttgacctttcagaacttgaaaattcatacttctttatataagaaaatatttcatgacttcatagggatattggaaactcagatttcagattatagggtatcatttaaattgttttatgttcacatctctttctctttatctgaaaatcttggttcctatgcagttaacaaaattacttatttcttttgtcctacaatatactcataatagtttcaaataacaatgccagaattttaatttatgattaaatcactgagtacaatataagatttctttttgttctttttgtccttaggatatatcccacaaggattataatgaaaatattgttttttaatctgtcaacataactatttttatgtagctatgccaccaacttaatatacagttagatcattttcttgaattacttttcaaaatatagggttgccttttgttatttatctttattttgtttattaaaaatgtaaaacatttacaaggctccaaagccaaagctcaagatgagtttactttcatctctatgtctgcctcctttaataggtgactttttttgctattcttagtttattttctgtttttttgtaatatatatgtatatacacatatgcatgtacctatatatgtaaggtatatatacatgagtgtatatcaatacctacatatgtaagtgtatttgtgcttacataacacatacacacatacttctatctcttctttttatgtaatagtaataaaactgttttgtccttgtttttttaagcctaataatttatcctcgtgatcactataccacagtagactgagttgtcctcgttcaattttacagctgcagagtactccattaaagtttattcaagcagtacgtaattatgcacattgatttttcccagtattttcttattacaaatactgttatgataaatatttttgtgtatcacattttgtactattgccagtgtatttttgggaaagttcctagtatgggattgctgagataaagggtaattgtgtatgtaattttgctagatatcaaattccctgggttgagtcattttacattcccaccagcaatgtatgagaatgattgactccccacaagcaactacagagtatgctgtcaaactttcagatgtttgccaattggatagatgagaaatgtatctgataataggtttaatttgcattttttattatgagtgagagagtgagagcgagcactttatatgttatttatgtttctttgtaaatttttcattgggcaattggtcttttggtctgaaatattaaattttctttgtatttcttagggtatgaacttcttatttgtaatatagtttgataatttttttctagtttacaatttgtctttttactcgtctgtgtctgtgtttgcctaaggattttttttaatgtacaaaaatgtgtctgccactttctttattacttcttggtttgaatcataattaggaaagtgttttctactctgatttatagtgaaattttcccattttgcctactacctgtatggtgatatttttaatgttccaacctctgatgcatttgaaatttatctgataaattatgtgaggaatgattcaaaattacactattccatatgactatgtagtttcatagcactgatctgagatgctgtgctaattatattccaaatttcccaatgctctagtaccattttctgaatttcctactctcttctactagtatgtctggtcattgatacgtccatacatatagtttaattatagagactttataatatattttagtatctggatgaagtagttccccatacattgtaagatttctctggatattgctttatggttagttttctaaatgaagtttaaatgaacttgtataatgctacaaacaattcttatgatatttgtattgggattatatcaatgtattatgtagcttggaggaaattgtaatttttagaatgctgtgtcttcttatgcaaaatatagcatgtattttcacttcttcaagtctatttttgtgtctttcagaaacgtttcaaaaaaaatcatttaataaaacatggtatattatgggcacacactttagttataatggcagtaggctaaactttctaacttgaaatatgtactttggttaatatggagttgatgaatgttttgtcatggtaagtttttgctgaaaaatatacataagtcagtaaacctatccctattatttataaatatttgtttatattctttttatcagacaattttaaatgaagctgataatacttcatttgactctactgaatctattacctcataataaaatacttctagtcataaattctatttacaaataaggtggtcttagggtcaggtaagccttagcctttgtattacaatctcctatttcagttttaattgacctgtatatacagttaaataaaagcagacacagattctctataattgaaaagcatctgaatccaagaaaaaaattgatacttagctttattttctttacctttgtttgtgtctgcatgattctttttgactttttgatcaaggtaaataaattgtagattaataatgcaaaaggcagtccatacatcctatacaacagaaaaattgtctaaaacacatcaggtcctttggttgaactcagtatttattttttatttttatttttttgagatagagtctgcgctgtcacccaggctggagtacagtggcccagtcttggctcactgcaacttctgcctctgggttcaagtaattctcctgcctcagcctgccgaatagctgggactaccggtgcgcccaccatgcctggctaatttttgtattctttttagtagagacgaggtttcaccatattgccagcctggtcttgaactcctgacctcatgatttgcccgccttggcttcccaaagtgctggattacaggcatgagccactgcacctggcctgaactcagtatttaatgtgtaacagaatgtctttgtctctttggagttctaggtttgtcgaatttccaagccaatattgtgtgtgcgtggttctcaaatggaggttgtcagtatcttgccatccatgtggtatgtgggagtggttgggatatttttttttctgaccttttaactgaggggaaagacattattggcattctgtaggaggaccaggaaagcaaatgccttgttacaaaggcagaatcctctgtggtgaagaattgcttggccaagttctgggttaggtattggaactctcctgggatatctgaaacccttattttgtttttcatggttagaactccattaattttgcattcagaattcctactgattcagattctattgagggaggacataatatttagggctgcaggggagattagaatcagaccagttgctatttgtcatattatttatgtgtgaccgggagcaaaattgtgtgcctttttatagtagatccataaattaaaagacatcatataatatgacagaataaaatttgatatgttgatacaaatattaatttatattaacaaagctatatttgtgaaggcctgttttacttgtgctgatgctgtatattcctgtcctgagcttttaagttgtatagaaattaattagaatattttccccacacatctccctacgagagaaaaaaggcataatcaagggaaactgaggcactgggaagactaattatttttggttattacagtgccatagttatatgatggaaaaatgtacttttattacaatgccagtcaatatttcattttttgcataagattgcacttttcacacctttgatttacagagcatcctaaatatccaagctatgttgtggcaaaattgtcctaccttttctgaacagaattatttatctaagcttaagctcatggatctaatgagctgaaatgaatgcttctctttccaaaagtcatttccagaaacaggtttattaaattacaattgagagagtagatcttatattttagtggtaatgcttggcaagatgttctttcaaaaacataaataaatttcattgtttcatgagtactagctttggggaaaaacaaacaataaaaaccaaagaaaatattaggtaacttttaactcttctaaaggaaaaatgttaacttcaaaggtaaatggagtcattaatataaaaacaaatgtaagaaaatcaatgctaagtatcaatggaaactttttcctttaaattccaccaccagagtgtaccccaactaaaaagcctgcagtcctgcaaatcattaccacaatctgcttaaatatgtcagaagcgggcacagggaataagagctggcagttttcctgcctgttaaaaaaagacggaagcccatcatgaatgaaagcatacaacactacatttgccatctgcatgcttccaaatctcttgtattttatagcagtagcttgccaaaactctggcaagccaaaacagaataagactcccaatctgaaagagagaatatggcaaataataaaatcatccagacagagagaagtagaattgcagaaaatcaaactaaaataacaaaactgtcaagcagtgttgaggagctaagaaatgcctacaaaagaggatttagaggaaaaccaaaggctcaggataatggaaccattgttcagttgaaaggtttttccaaagcaaatatactcactggtaataaaatgtaagcctttccagaaaatgttgcttctttctcatttccaaagttctagctatgtttgtttagataaagcaaaccttatgtctttgagcagttgggtccctttctattttgatagaagaaagactcataagagggactcaaaccctggctattaagccagggtttaatagctcttaattgtcatttgggatatattcaaaattacaagccaaataaacacagctttgcaacatttaaactgataacatttaagacattttttaggcagttgctgaggggatttgtgactttgatttttgtaagtccagtgcaactctagcaaccaaaatatatcacatgcttacaacatatattcaaaattaattaggaagaaagaattatatagatttttgaaatttgtattgacacaatgtatttacatatttatggggtacatgtatttgctacatgcatagaatgtgtaataatcaagctgggtatttgaggtatccatcaccttgagtatttgtcatttttatgtgttggtaacattcaagtcttctggtttagctactttgaaatataaagtatactgttgctaactatagtcatctactctgttattgattattgggacttgtttcttctatctaattatatatttgatatattgtactcactaatcaacctctcttgatcctcattcccattcacacatcctacccaccctcggtatctataatttgattctctgtctcaattagattgacttttttagcttccatgtggagaacatgtggtatctgtctttctgtcactcaacataatgacctccagttccatccgtgtgctgaaaatgacatgatttcattcgtttttatgactggatagtatttcattgtgtgtattaccatattgtctttctgtttgtccactgatggtcaactaggttgattccatatctttgcattgtgaatagtgctccaataaacataggagttcaggtatctttttgaaaaatatattctttttctttggataaatacccagtagtggaattgctggattgtatggcagttcaatattgtttttttgagaaatctctgtaccattttccagagcggttttactaatttacactgccctggcagtgtatgagttactttttctccacatcctgaccagcacttgctattattttgttttgcaataatagccattctaactggggtgagattatacctcattgtgattttgatttggtttccccagtgcttagcaatgttgagcacttcttcatattcctgacggtcatttatattcttcttttgagaaatgtttgattgtatcttttgtccacttgttaatgggattatttattttttagtgtgagttgtttgagttcctcatatattctggatattagtcacttgtccctaatacattgtttgcaaatatattctctcattcaacgggttgtcatttcactttgttgacttttcctttgatgtctttacttttgaggtcttagccatgatatctttgcctagactgaagcttgaagtcttttttcctatatttttttctagaagttttatgcaaacactgatttaaatttattaactttaatgattaacattaagaagacttaatgattaagtctttaatccatattagttgaattttgtttatgaggagtagtaggggtccagttttattcttctgcatatggtttcttaattttcccagcaccacttagtgaagagggcgtcctctgcccagtgaatgttgctcctttgtcaaaaatcagttgactgtgaatacatggatttattgaatcactattctgttgattggtctatgcatatattttatgccaacaccatgctgttttgtttactatagctttgtatatattttggagtccgatagtaggatgcccccagcttcattctttttttatcagcattctttggccattctagttcttttttggttctatatgaattttaggattgttttctctattctatgaaaaatggtattggtattttgatgggggattacaatgaacttgtagattgctttggcaataggatcactttaatgtaattcttctaacccatgagcatgagatatctttccattgtttgtatactcttcaattttagtgttttgaggtgttttttgtttgtttgttttttggagaggtattttacctttttggttaaaatttatttttaggtattttattttttgtcactatatatatgggattaacttttttgtttctcagctaattcattattgatatataaaaactataatttttgtacgttgagtttgtatcatgcaaacttactgaatttatttatgaaatctagagttttttcagagtctttccgttttgcttgatgtaagattatgttgtaagcaaaaaagacaactcgacttattctttttcagtttggatgcctttaattttcttttcttgcatttagggaaaggctttcagctttcccccattcagtatgttaactgtgggtttgtcctgtgtggctttattattttgagtatgtttcttcgattcctaatttgttgagagtttttatcatacaagatattggattttatcaagtaaattttctgtatcaacaagatgatcatatgatttctgatttatttgtcatctttccttttttctcagtcttgctagcaatttattatttttatttttataaccaactttttgttatattgatgttttgtgttgttttttagtatctgtttcatttactctgctctgatctttttctttcctcctgctacattggggtttgttttgtacctgctttctagttccttgatgtgcattatattatttctgttgtctgatatctttctactttttgagtagatgtttattgttataaatttccatttagcactgcttttgctgtttcctaccagtttggtatgttgtgtttcattttcatttgtttgaagaaattttttaatttccttctgaagttttcaaagactaagtgcttgttcaggagcatgttgtttaattttcatgtatagttttcaagttctacttgttattgatttctagttttatttcattatgttcagaaaagatgtttgataaatttcaattctattttttgaatttttttgagacttgttttgtagtcaaacatatgggcgtcctgggaaatgtttcatgtgctgaggagaagaatgtgtattctgcagctattgaataaatgttctataaatgtctagtaggtctatttggtctacagtataaactaagtctgatgttctttgttgactttctgtccagatgatctgtcaaaatctgaaagcggggtgttgaagtccaagctattattgtattggggtctttctctttaggtcttgtaatatttccttcatatactgggtgctccggtgttggatgcatatatatttgcaatactatatcctcttgctgaattgtccctttatcattacataatgatcttctttgtatcttcttaaagtttttgtctaaaaattattttatctgaattatataagtatagctactcctgcttacttgtagtttctgtttgtaggaatatatttttctcttactttactttgagtctatatgtgtctttacagctaaaatgctttcttgcaggcaacatataggtggatcatgttttttttttaatccatttatccagtgttatcttttaagtcgaaagttcaacccatttatactcaaggttatttactgatatgcgacttctgtttctgtcatattgctagttgttttctggctattttgttgttctttccttttctttattctttgtcattgtggttttgtggtttcctgtagtggtaccatttgatctctttctttcctcatttgtatatttgatttactagtgagctttatattttcatgtgctttggggatgtaaatgtacttttgcttctagttgtagaactcccttgagcaatttttgtaggattggttaatgctgatgaattctctcattatttgcttgtctggaactttaattcttttttatttcgaaggataattttgctggatatagtattcttgggtggcatttttattgtttcagctcttaaaaatgtcattccatcttttgctggcttgtaaggcttttgctgagaaacttgctattatctgatggaggttccttgatagttcctgttgctatttttagaaatttttttttctttgttactttagactgtttgactataatctgccctgaagaataccttttttcattgtatctgttggaaatctctgggcctcctgtatttggatatctcatccctgttctacttgggaaatttcacttgttattttgttaaatagattttctaactcttttcttctctcttcactcttgggacactgataatttgagtatctggtcactttatgttgttccaaatgtcatggaggcttcaacattttttaaattcttttttctttatctttgtctgattggactatttcaaaagacttgtttcaagttctgagattgtttcatctgcttgatctagtctgttgtttatgctttaaatgtctttgtattttcttcaatgaattctttagttccagaatatcttccctggttcattcttaaatctttttggtaaatttctcattcgtgttctgaaatgatttcctgatttcttttcctttttctttttttttttttttttttagcattttcttgtatctcactgagcttatttaaaatagtgttttgaattctttatccagatttcacaagtctttttgatggggatatactggaaattgtttttcttttgagtggattgtttttcattttcttgctttttcttgtttcctgtgtcttacattgatatctctgcatccagtgtaacagttactttttctaatttttaaaatttgcttcataggggagtactttttctaaagctctatctatgatgttggttgtttagtcctcttgacttctattttggttgtatgcagtagtgtagtctcagcatgatttcttcagctgtataagcatccatggtatctgtgatttttttcagtggcttagagtgcagttattaatggaggcatggtgaagttttgctggggactggaatgccagatgggccagtctttgggcctcatgttgcagcagtgagcaagcctgtccctgagccctggagcagtgtgtgctggctctagtgttatgggtccaggcaggctgattgttaggcctccaggaggcttgcttggctgctcatagtggagtggtgaaccaagtgtcttggtggttccttgggctcctgggcagtgagcatgatatgacaatggcagtagcagtggtggaactatgtactggaacctaagagctttcagctggtgctgcagtagctgcaatggcgtgggtgggccagggagcaggtggcacaggcaggtgggtgccgttgtggtgatattacaggttgggtcagcctgacctcagattccagaagtgcttacatgtaagggtggtggactagactggccaatctccaggcccctggacagcatgttcaaatattgggtgacaggaccaggcaggtggacttgtcctcaggcctctggtggtgtgtgcaagtgcggttgtgataggcaggagtggggcagttcccaggctgctagcagaatgctcaggtagagcagcagcaactgcacagcaggcctgccctgggggtagggcggggccactttcggtgccacagtgtaggcaggcggctaagggacatgtggtttgctcactccttagttacacagcaaccacagcagcagcactgggttttcccttggagtgtgtaaaagtgcctggcctttcctctcctccttggcctggtagcagcagtggtgttgtcagtcccagggcgggaagcagttctgtggagctggactttctgaatggtgccgtgctccagctgttcaagggcaggggcctatgggtacagtgtgggctccttctctgaagcaatgcctctgtgcaatctctagccagctccctatttagtcttgagaccccgagtgctgaggggttttctagtagctaggattataaaagatcaggtgggaatgtggaagcttagatgtcttccacttactctctccctgcatcctatagaatttaaaacgtgacataaacttcacctaagggaataaagacgaaaatttgaatcaattctttttaggatatagactgcctctactcctatttccagccatctgtaaatactctttatatttaaaagaaatattaattgcctaccccattaccctgaaaagtagaacagaaaaacatgaaagtaagatatttgccattataacagattgaaaatatgtgtgtgtgtgtgtgtgtgtgtggtgtgtgtgtgtatgtttactgcggcactattcacaatagcaaagacttggaatcaaccaaatgtccatcaatgatacactggattaagaaaatgtggcacatatacaccatggaatataggcagccataaaaaaggatgagttcaagtcctttatagggacatggatgaagctggaaccatcattctgagcaaactattgcaaggatagaaaaccaaacaccgcttgttctcactataggtgggaattgaacaataagaacacttggacacagggcggggaacatcacacactgggcatgtcgtggggtggaaggaggggggagggatagcagtaggaggtatacctaatgtaatgactagttaatgtgtgcagcacaccaacatggcacatgtatacatatgtaacaaaccgcacgttgtgcacatgtaccctagaacttaaagtataaaaaataaaaaataaaagtgtggtgtgtgtatgtgtgtatgtcttatcaaatactcagttgatgtcatcttttcctagtctttgttaaggcatttcttcttctaaccttcagatgaagataacatgagataatttggcttctatccaattaataactgtacttcagggaaatgttctatggaaatcaaccctggtaacgtcatctaaaacttgaagcacctttatattttatcactagcccctgaggcctggatattcttatgctcagtgttcaaacctatggacaagtcttacttgcggcccagagaaatggctcaaacactctggggcataaactaatttcagcatgcagtaagaagctccctcacagtggagggatgcgtaagctttgcaatgctagaaaacaaaatagcttgtctacttttgaattcctgaaataagggcagtttgtttcatgttttagcacatcaagaagaatgaaagtaaggaatggtggaatgcattgttatagacaaagagaaggtaaaagagaagaaagctatgaggaggtattctcaactcttgcctgtaagagcttcagtaggcaaggagaaggggagctctacctttcctggtgtcgtgaactctccctggtaaaagaaagaacatattggaatgcctctgctcctgagatacatccaaggtgcccaaggtcaatgaaggaaacttgaggattaagacactgggtctggcttcctcctgggtcagtggaagcatcttcatgataggaccttctcttagctgttgtttcagacagccctgtgctgggctcctacttgtaccggaataatccttgttgcaaagaggatcagtggagaatagggaccagtttaaatggtccttatgaggaggaactcaaagtgtacctgtggagcagaaaccagtgcaggaagtaaaaaaggtaggcaaaggttattgcatatcaacgggaagctcactgtctcctcacccagcctaagagtccccaggctccttatagatagtgatattgcatcactagttttaactatagtctttgatacctggtgagtgcttaataaatgcttttgaataaattactatatgagcataatatggttttgaagtttttcataatagggtttggagctgtttatttatttatttattaggtgtgtaacctaagaccagttaataatatggtggtaacattggacaaaaaagtttatttgcctaaaccttagtttacacatctttaaaattagctaataatactcagattttgtgaatattaagggaaagtgtaagtggaaagcagacagtgcacgcctgtctgtacttttctctcttccatcttttttcccaatgctgactcctttcctagaatacttttctatctttgctttttgctttttgttcatttgttaaggctgatttcaaaacaaatttccctgtgaagataattctgcatccctgcttcttccctcttctcccacttaataggtataaactctatttcctttgagcccatgaactactttacttgccttataagtatattcaaagtcagcgtggctgtgttttattcaatgactcatatttgatgtataggttgcatttttttattaaaatatcttttgcctgtgaaagaatatgtaaggaaaagtaacaggaattttataaaaatcacttggtttttataagaaaagtttaatcaggaaaaatgtcctgcctagtggaaatatcttcatcctaagtaagtcatttcactgtctgagatgaacgaggacaatgacaatttaaaaggattggcatataaaatgcattgattctttttctgctgcttacctggagttatgtcaatacgtttttgtatagtgtatgatttgacaagtcacaggaaacagaattataaaattcttattcaaatgcataaattagaagagtagatggagtttttagttcagtaaatagtcaacctgattctcctttttttggctagtaagatgatattctaacagctttttctgaagaatatcttctattcatatttagaaagagctcctttattgaaagggtccttacaaatgtctaatccagtgctcacaattgtttaaagggacgggatcagttctagagaagagatttgttaaatcacaaagccagtatttagcaaagagcagaatagattccaattctggctctctgacccaatatagcctaacattatttttatttttagttgctttactacttctcttacttaaaagttattaccccagctgtgttttaagctgtgcccatctgatgccaagacaaaaggctaagaatagattattcagataatatttattattatagtggtctcggtcagtttatgtcttagtcttgtttatgatgctataacaaatcaccatagatttggtggcttacatagcaagcatttttttctctctctcacagttctagatactggaagtccaagtttaggataccagcatggtaggttctggtgagggccctcttcctggcttgtagatggtcagcatctccttgtatcctacatggaagagagaagaagagaaagcaagttctctgtgtcttttacaataaaggccctattctatcattagatttccacactcatgacgtaattacctcccaaaggccccatctccaataccatacatcaccttggggataccaatcacaaagggtttcaaaatatgaatttggtagaatatggggtacaaacatgcagtccataacaggaaaaaatagttaatcgtggttagtgaatgggtttactgttaaaatattatttgggacagggaactaatagattcaacacttccacttcaaagaaagtgcatgaggaagcatttgaagagtcagtacgtttgtataaattccttaaatggatatattcagcagaaaggttgttattactctatcatgaaatagaaatgtgaggatatagagtatttaaattgcaaataaaatatccattttctaaaatattgcataattcagtattactatactcctatgaggaagagagtcttagcatttatttattagctttagttttaataatcagtaattacataataaagaggtgaaattgagtgttgagcacaaaaatatgtaagctgccacattcctctgttgtaatcagctcttgtttgtgatttcaacagaggggaaggttgaatgccatccttctggaacaccctgagaagtccaggtgagtgggaggtggaatatgcattctactccttgtttttctttttctaatgtagtgaaattgatagaattatattaactcctattgtcagtaattatgccacacaattatttgagcttaccaacctacatccttgactatcaggacatactctagtttacaaaaaatgagcacactttaatctcccttttcatgaggcaataactaaaggtttcaaaggtacaaaaaatttgaacatgactgaatatttgataataagaattactgacatttttaaaagaagtgatagcggtattgtgggttaaaaatatttttaaaagagttcttttaacatttagatgtaactataaaaatacttatgaataaaataatatgactctctaatttgcttcaaaataacttgaaaatggggagtaagtagaaatatgtgtgagacaaattgggctatgagttggtaatgaagaaggacatttattataattttctcattgctttttaatgattgaaatttttacaataaaaattcaaaaaataaaacaggtaaaacacttccttttctcctgccttagaaaaggttaccaaagtggttggtcaggctctacaagttaatacagataggatcacaaattcaaagctcaagtaaatccaatgaagtcaaaagtgaataccacaaaggttgggaggtgaaggagggaggaagattaaaaatacaaaacaaaacctacctataattctagatacacattaacttcattattatttgatagtataggagagcaaatattaattcataagaatgtagatggaactctatgtgccaagcaccatgataaatgctagggatacaaaatgcttagacaccatttaaaactataataacatgttttacagagtatagtagagttagataaattgctttgggaacccaagtgaaaggacaattaattctgcaagggttgataataggacatgaaaaggtaataattgaactagactttgaataagcaggcgtttgctatgtgaaaatgagtctatttctaaataggtttgtcaagtcatatttgatacagtatctctaaagccatgttctcaaagaagcattctttaccttcctcaatggctcaggtagtctccattgaaccaagctgatagggacctcaggttgtttgttcacaaccagaatgattgctttgggagaaatagtagaaaaaacaacacggaatggccttttagatgggcaaaatgaaattatcagaaattcaagggtgacctgttaatggcactggttgaagttctgtatggtcagaacacagggagcagggtgtgtggcagggggcaaggatggcaggtaaaatgtgaccagactgtgaaggatcacataggaataggagtttgatattttatgtacggcaaaatagtaaccattgaagatttttaagaaaggattgatgcagaggttttcatcttatattaagaaaactctgacatcattcttctacatcattctgagtgattggaaggagaaatactttgaaacaaggagaataatcaacaagtattttaattgacctaagcaagagtgataaaatgagtgtctttggggataaagaagaaaaaccgatggaagacagcatttggaattagaattgataagacttagtcactatatggacacggcggagtggtaaaaaaaaaaaaaaattcaaaacaaaacccatgtactaccctactctaccagggtggcatgatcagatcaaggtttgggtttcaaagtatcagcatcaactagtcacgttgaatagttcaaaatgcttctcaatgtttggttgtcttaatctgtcatagattccttagcaaggactaggggatgcattactgtttattcttgccatagtttttcagactccttccgctgaggactcaacctattcttcaaatgatgggtttttggattgagaactgcctgagaatgcaatatgtgccgggatcttgattttctatctgggacaaaagactgagactgggcctcttcttctctttgttcattcttgatttctttggattatatattatattaaacaacattatattggctgttgatctatctcattggctgtggtattagccagttgcatagctccctgcagtgagatttccctgcctgttattctgaccttgttacttgttgaactttacttctagcaataaatgctgccacatttcctttgctgttcaaggatcacatcatcttgattgctgttgagctgctaatagcaggctaatatttttgaatgtcatcagcccagactgtagaggacagccacatgagattttcaatgatactgttgcctccttcatcagcttattccattttggtaaatgggggtcctttagatcttttcaaggaatatagttggaatgtaggtcttttggtcttaggtattggtctattctaacatgctcctatcaatgagtcttttgatctctttctctatggcctgcagaacaattcagacatctttatgttttttcaaatttctgagtcgtcctaatagcacatagaactgtcctgcagggttttgtcaggtattaaattaaataaaataatttccctgaaatgacaaaaatctttgttatccagctttaccttcactcatgatctggcatcccggagatccatcatggggctactctcctggttcctgttggtggatgataattaggttctgtgggttctcaacacgtaatttttctcccttcttagcagactcggcttttccgtgttgtgccatgttgtagttgaccgtcttgattgatctaatggccaggaggggacaatagggcaaatcctgcagggatgaacattgtctcatgagcaaccttgcctcacttgaggcatctgcatagtcttcaacaaggatgagatgggagaggatgctgtcctctaacaggagtgatggtctacttttgcagaccaggggattcaagggaatccacggcttaagtttctcaagggcattttcttatataacctttcctaaatttcagagtccaatttctttattaccagggccctgatagccctcaagataaagaagtgagggaagtatatgacatagcatggcaagtggctaaacacagatgaagtttatttggaatctcgctttagctagataccttggggtgctctgggcataagtcacaccttatgttgttgttacctatgagcacaagggccaagccctggctgtaggctgtcctggggtggagaagtaacttcttgagtgaggtggctcccatttagtcaaagttaatttcttgaaaagagaagttgtgagctataagcaaccaagatttacagcagctgagagttgggcgcactggctggtaaagatagtctggctaggacacaacatcatccatcatccacaatgcttgtcctctgagaactggccccatcttccactccagtgctgactatcaggtcacagaagagggttaagtacaacatggcccaactcagaagaggtagaccagctatgaaagaagaaaaattgcatattgatgttgaaaaccacattctaggcttcattttttcctgcccttattctttccattgcccaattattttatccatttcatatttacattatttctaacactttactattacaaagagtatgtcatgaatatttttgaacatatgcatgtgtgtatctttgtaggtacatttgtgagatcattcctagaaatgaaatgttggatcaaatttaaaattcataacattttgccaaagagccttcatactttgtaacaatgtatatactccacaaacagggtatgagaatacctttttctaaatcttaactaacagtgttatcatcagattttttaatgacagaagattgatgatcagattttccaatctgaattagatatatattacatagtatattattttaattagaatctgtaaattatgaatgattggagtacatttttataggtttaaaagccatatatatttcagaagaggtacttttcagagatttagaaggtagactcacactatcaaatgacatcgctggtgttaaaagaggatcagatctgaatccccgtttccaaaatcataaaccaatgtaagatgcatttcgtatttttctcaatatttagctcaaaggccaccccctctatggtaacttctctggctgcctggaaaagtgaccggccccttgcgtgtgctggttatttctgtgcacatctctcctcaatcctcactacagtgtgggcaggtgtgtcttgttcagtgatttgaaaattaaagcattaaacttgtaaagcaaaaaggcaaatagtataggaacatcaaatgtaaacagataattttcatttaattttctaatcccacctcataatggaatcccttaggcatttatttgtatgaatccaaaacttccattactatattctttgtttatacaaataaaaaacatatttatacatatagtaataacaataatgtgacatacacacacacacacacacacacacacacacacactattaggatcctgtttttttaaataatatattatttttttcttaatccagtctatcattgttggcatttgggttggttccaatctggattaagaaaatgtggcacatatacaccatggaatacatgcagccataaaaaatgatgagttcatgtccttcgtagggacatggatgaagctggaaccatcattctcagcaaactaacacaaggacacaaaaccaaacaccgcatgttctcactctaggtgggaattgaacgatgagaacacttggacacaggaaggggaacatcacacaccgggcctgttgtggggtggggggaggggggagggatagcactaggagatatacctaatgtaatgacgagttaatgggtgtagcacagcaacatggcacaggtatacatatgtcacaaacctcacgttgtgcacatgtaccctagaacataaagtataattttaaaaacttaaaaaaatatatttttttcgaagttaacacatatacatatgtttcattctttttaggagttcatagagagtctcttgaatggatataacataagtgataaaaacatttctttatatatggacatttcagctgttccatgtatttttttttctgctacacataatgctgccatacataaatctatctaatatgtcctgaagtacatgtacttttattttagttggttacattcccagagtaagatttgaggtcaaagttaatgtgatttaaagtttaataaatatttccagattactctttccaaatttgtcataatttatactcttaccaactgtgtatgagaagaaatgttttcctatgcctttcagtgggacatacagtcagtctttaaagattttgtcaaattaatgacaaaagtttggtctttctcatttttataatttgcgtatttttctggctaatattgacattgtgtttcttctcattttctgatgtggggaacaccttttcacagtctttgttcattttataatgggtagttatcagtttcagagctttactgaaaatttggggtattgtatgtttttcaaatgttttctccaatcttttatgtatcttttgacttttttggggggtctctatggtcatatagttgttttgttttcgttttggaattgactatgtcaacatattttttggcttataagtatacactctttttaagatcttcctaagcacaaggttaaaaaatattctcctatattctaaaaattttatatttttcttttaacatttcgttctttgatacatctgtagtaaatattttgatgtattttttaatagcaattttcccatttaatgatgccttttatctaaaataatttccaaattctaaattaagaaaactgagagttagtgaagcaaaattacttgcccaagatcatgcaaattaatgcttgtgtgtttttctgttctttcctccctagtgtttaagctcaagcaagtaaagacctccttgtattgtctacttctgtatcattgacacctgacattcctaataagaatgaataaataatcattagacatgactgtattcatgtttatcttgaataaattttgtcaatgtggtgggccaagttattacattgtatacagaaaggcttcccactatggggatatccaagtaagaaaaagcatagatgtttcagaacacgatctcatgtcattattgcttgcaaagagtatctcaatttcctaaaggaaaaaagagagtctaatggatacagagaatagaagaagtgatactggcatgagactactgtcttgacttagtaagaatagcaccagtcccacatcatttgaattaccacacacacacacacacacacacattcacacccacactcagaaacatattatttccataactgcaaagaggactataccccatttaaggagctgagattttgctctggttccgcggttacagtctctcacatgttttcagtggctctcaatttcctcatttctataattaacctaacgtaggtaacatataatacctactattatttacctgaaattcattgagtgcttgtttgtgaggatggtttcactaactctagtttcagaatccctatctcacataaattttaaaacaacccatgagggaggtgttcatgtacaatttatgagtgagaaaactacatcttttgttagctatatgcttgggatcactcaaccagtaagtagcagcttgaggtttgtcttccaaggtgtgctgactctccaagacctgcagtctctgtagctctaatacaggaagttgaaaccagatgaataaactgcaaagacattccttgtctccatgtaggcaagagtcccttagatttatcaattctttagactcttaagcacagtcactgcatagtaaacttttcatagtttaactgtcccaaatatgattctctttcaggcttctctgcttgtggtcttgggaaactggaaactactaacctaataccattgagatgttggcagctaaagaaaataatggtttgttagcaagtaccttcaagtagtaattctccttttacttctttattaaagcaggcaatagaatagccatacatagtgagagggttgggcatcactgtttattaccacaaaacttgaagccaaacacagcaatcacaacctaaaagtattgaacctacaaataccttcaccagagacttactaatgtttttggttatagcgaggaagggagaagatccaagtgcataacctcacacctggtcattttgatactagatttaattttgtcattattaaaataatgaatcctgaagcactgggaagcttgtacgtcccccatcagggtcttctctgccttctgatgttgctgcccttttcgtctacacttaacttgaattgtggtattgtattaggtagttctagtagaaaaccaaatccaactgtgtaagttccatcaacttctactctgaaatgctgtgatttaaaacagcagctggcagatcatcagtctctatcccaatggacacactgaaacaaattaatatgcttaatttctttagtttacagctcagctttggtgttctcagacatgctgctaaagcatcattgtcaaatcctactcatttgcttctgcttaatcagagatcacctgcttattttgattttgagtaattaagtagaaaatctcacttttgactggtactttatctttgttctgaatatgagacagaagacatttttttctaagtgttcagatatatttagctaaaattgttttagttatctcacaagcattgttgacaactcctctgccccagacttcctcaaacaccttgtctggccgtcactctttgtttctagttgcctatgcagatactaaaagccacaagagcaaatcgtatgtcactccaaagactcacattaaaatactcaaaccttctgagacagaatttaattttttttttttagttttacattcacttgattagcctcgatttttcttctcattgtccctcctgctagaatccaatggcctgattagaaatacgtaagcgagagagcagccagaatggatagataactaagttaggtatgatatttgattttttttccactgaaagtgattctctgcttacaaacctttcatctaatgaacttgaaaataaccaccaagaaatattaactgttttcttaaaagacattctgaggcaactagtgtgggtgaagggtttgagcaaattcgccaagtgtcacatgatgccagctagagtcctcggtaagggtgtatgagattcccagtctcacagacaggggcctgggggtttgcgtgctggatcatcctgcttgtgttataatctgactcttcatagcatgggcattaggaggaggcctttgcagcatgagagcgctcttgcgagcagagacagaccttgtacatgctgactgttgcccggagagttgcgtgtagggctgccagtgtctggagatcttgtgggaagttgaggccactgtcgcccctgttgctgcatcaattgcagtggaccgcagtggctccctgggattaccctgtggcattcccctctccacatggtgaaaatacaattcccatttagtaagaaagataaattaagaactagtttctgtcctggatggttaagggaaatagggacaatttatgaaatgcatcttggctacttagtatctgaaccttctctttgctaaccatctttcactcactacctcttatgagtatgccgtgattttaactcaatatattaaaaagaaaaaccaaatgggtttctttgagctatgtaaatttattacttgaacatacaagtatacacacaaaaggcctattctttctcaaacacctgagtaattcccattaatgtcaactggagttgcggatgtatgtcaaggagtaaaaaaatacatttaaaaatcctccaactgatcattcacacaaactctttttgtgtgtgtgttcgtaacataatgaaatttggtctttttcttttctctaagttgaagcaatatgcgtctggttcatttgtttaaatgccatgattgtacatttcctgcattcaaaaaattaatcagagaatagatgtagccaaaagtatgtgctattcctggccaagttttgtggtgtaggaaaagtgactacttatggtattttcattgccgcatttgtggtcatgactttaaaaaaaacccgcaatttaaggttgagaatgcatcatcataatcctctttttatgcaggaaacacccacttcaatagttttcttttttctgtgagttcccgtaggcagacaatttccacaatcaagttgcataaaacccttcattcataaaggataacatctgagctatatcaatgaaacattcatgacctcgtttttctaagcagcaggcagtgactttgaaactgcccatttcctttctttgaaaaagacaaaagcacctgcctcaaggggtgtgtgtgtgtatatgtgtgtgtgcatgtgtgcacactacatgcatgtacataagataatgcaaagtcagtcagtgatggcctaaaatttttgaggaagaggccatgtcagtttattcagcaaagtagtcttgctgccacacctgggattggcatggtataaggtcctacgaatattcgaaaaatacatttgtgaatgatagtctagaattctcaggctgtctatatatgcaatgtcagcttacctgtaaatttgccacagtttgtgttttaagacaaaatgttaatgtcttttaatacctgatttgccaataatatcctgatgcagtcaaacaaataatggatgtttgccttgtggatttcaagtcatttatatttctacttattagaagaatattgctaaactgaataatgacgggcactgttgctttaacagtatactaagaatgttgggtaaaacaaaaagaactaaagtggaaaatattttgctatccagacaatactttgcaattattttaaaaatgaatcttgtaacattatagataattttatataaaattaacatggagttgtttacaatctagctatttaccaattgatatccacacaaatgtgcatcagctacttgtatatctatagaatgatgtcttccttgaccccttttttttcagcgaggaaaatctattaaaattctacttgtgagagaaaaagcagcagcacccactgactgaggaggttgcataacgttagcgaatctgggtatttaaaattctatctcagttctaacatcttcagatgtttctgttctcttttgaaacatgctttatgagagcttgacattttacaatcacagaagtttcctaagtatttgcacaaaactttttatttagatggggtgagatataatacagacttattattgtaaagttagaatataggaaaacagcaatttaacaagtaacacattatatatgtatactatctatttccctgtttttttaagtagacatagattaggatggaaaacatacaacttaatttttttttattaccttaactataaggagtcataatagagtagaagattagatgaacatttttacaagttacataggattaggaaatgcttcctataagaggatttggggatttaaatgcagatttcctcctgaatatttcaatatcttttagtaaatgcacaatttgctaaaaaataaggttaggtcacaaacacggttgttttaaatacagatgagaaaaactttataatttggaaaataagagcttgggctcaggaaaaagtaagatgtgttgtcaaatgaaccttcagtcatcaaccccattggaaaccccagaaatgtttacagtagttatgaatggtttctcccagagcagaagtaattgtgaacgtaaaaatgtggaagcattcttctaattttgagcatgttgggtccgaaagcctataaatctatattttaagttcatttcttcctatgcatagtgactaagatgacttcaacttgcagtccctctatacattacattcagcactcatgccttcaataaatattctcagtacctactctgtacctggtgcagttatggccacaggggatacagcaataaagtatggaatagatccatctatagcataatgttaggaaatgagaagggctataaataaaaaagtgagaaggacataaagaatgacaaggactgtaagtttccatttgacggtaagaaaatcctctctggccgagtgtggtggctcgtgcctgtaatttcagcactttgggaggctgagacaacagatcatctgaggtcaggagttcaagaccagcctggccaacaaggagaaaccctcatcctactaaaaatacaaaaattagctgggcatggtagcaggtgcctataatcccagctactaggaggcttgaagcagggagaattgctcgaacctgggaggcggaggttgcagtgagctggatcatgccactgtactccagcctgggtgacaaagcaagactccatcacaaaaaaataaaaagaaaaaaagaaagaaaaggcttctctgaggagctgacatttgaacaaaaataggaagaggtagtgaatgaagtaaggatgtggacgacctgcatatctggagaattaatgttcctttccaggacgtgggtacagagaacctgaggcatgggtttgcttgacttaatgaacagcaaaagaccatcatggccagagcatatgagggagaggaaaaagttaggaaatgaggtcagtgtgtagctgggctgcagatcatgtagcgtattataagttgtggtgaagacttaggaattattctaaatttgaagatcactctggctgctatgagtcagcaaggccagaggggcacaaagtagaagcacagactctatttaggagtctcatatggatctcagctagagttgatagtggttggactggtgggataatggtggagttgggaagtagtcagatttgttggtgaattggattgagttagagagaatgtcatcaaagataatctgagaatttctatgcctggagtttatgctttcaacctgaatattttcagatattcttattattgagtaaatatattttattaggcttaaaatttttaattaactagttttatctactttggaaatccattaagtttgttaaattcctcctggatgagctctgtagttctttcatctttgccatgtggcctgctcttcagtagacttcttctcttgaattgacattaagctaacagatacccatatggatcttgatcttttaggtgacacttaaagcccagttcacaagtcactttgcttcattgcagacatagtcatcctttatcttcattaatcaattcactaaatactcatttctttaacaaaggttttttgggtacctatatgtactaggtatccaggactaaacacaacagacaaaatttcctgccctcgagaaactatttcaaatagaagaagacagaaatcaatagatgagtaaatacatatagtttgccacatctagtaagcactgtgcagaagtctaaagcagggagggggaaagggtgcactgaattagacagaaaaggagggagtgttacagtttaagtagggtgtcaaggaaggtttccttggaaagtgacatcagaggaaatacttgagggaaaggaaaagagtcttgtgtattgggaaggaaatggtccaaagaatggaaatactaggcacaaaggcacaggggtgggagagtgctaatgagtcttagaattgcaaggaagctgcgtgtaaggaacatcttgagcaaaaaggagaggcaaacagatgaggcaagaagggcaactggggttgcggaaagattaatagatctttgaggaaaaaacagattggaagattttgagtagggaagtaacatgatgttacttgtgttttagtgggatattctgctcctgtgtttggaatcagaatgaaacatggggtcggagtggcggggggggcacaaatgtaaaggaagacaagttgggaggctgtgttaatattgttagtatttattacacaacagagtgatacacacctgctgcaagatttgtgtgtggtttttcagagtcattttcacttggaatgatttatgcgatatacacggaaggtatttttttgttttctcaccacttttaattacgtgcatgttttaaattactttgcttttgtttcagctgtgattgttagctctcttagagaaatttaaatgttttcttaaaccaagagttaccaaagatacagcaaataaggctggtaaacatctcaaaactaagccaacctcactaactagtctgcagatagagaccaacataaatatcacagggtctaaaattacaaggcactaatgctaatgccaactctagatagtgggcagttgatctactttttctgtggagtaaagtcaatgtaattttgtatgtgtctataaatattataagttgaaaacatttaagtagaacagcccctatccacattttcattaacctgcatggtataactatgtctatatttatgtgtacagatatattcactttgaagtacatttgctgtccaaaattatagctagcccgttttaaaaaactgactatgtattgtggctgtctctaatccataacaatgccaaatttcccaaggcctcatttcatattgtgttcctgcatgtctgactaagggtttatttcatacttctatactaaagtgcaatgaaagctaaaaccgtaacaggggcagttctttcgcttattctcaaaggatttatctgaagtcaaaaggatagaaacagattctaagcaactttcaggctataattttttttgccagaaaaacctaactagagcatttagtaagaaagaagaatgagaaatactacatgaacccccaaaaatgagtctatgaggaaaaaaaagaaacaaaagatatagcccaattttgatatccacagataataaaaggaatatgtcttagtgcccagaaattattaggatttacatcctagagattggatgacctcattgctccaaggatccaggctaactgtaagtgagcaatcagagaactactgacaagcccatcacttcttccgggcaagaatttctaaactacagttcgcttagcaattcccctccatgggcataggggaattccccttgtgtgtgctgtcctgtgggagagctgtgtttgttcttgtctgaatcattgtgcagttgctgtcttgttctgccaaggacagtgctcagcacagggagatagagtagaagataaaatctgcttagaaacaaatctagttagaaacaagggacgtaattcaggaatctcagaaatggagagtgcttgatgataatgagaagccatataagggaaatacattctaatacttggtgacatgcacgcaaagagaataagagtaagaagctgttgtacaagccatctttcaatgttcctggattcaatttctcattaggttatttgccttgtgtcctctcccactagtaatgttttcaaaatggagaaatactttaaattataaaggtatacagatctgatataaaagttgaacaaaaagtgtgtgaaatagaaaattatcttccaattctataaatccactcctcagagtaaccattacacacatacatatatatgtatcacacacacacacatatatctctcacacaatatatctcacacatatatatatcgctcacacacacacacttatatatttggcttaccagacaattaatatataaacataccttagagtacaaatacgaaactacaaataatttttttacttttattttaggttgagggatacaagtaaaggtttgttatataggtaaactcatgtctgggggtttgttgtagagattatttcatcacccaggtattaagcctagtacctgcaggtattttttctgttgctttctctcctctcaccctctatactccattctgaagtaggccccatgtctgttgttcccctctttatgcccatgtgttctcatcatttagctcccatttacaaggagaacatgcagtattttattttctgttcctgcattagtttgctaaggttggtggcctcagctccatccatgttcctgcaaaggacatgatcttgttctttcctatgtagtactctatatatacatgtaccacattttctttacccagtcaactgttgatgggcatttagattgattcatgtctttgctattgtgactagtgctgcaatgagcatttgtgtgcatgtgtctttacgtaaaacagtttatattcttttgggtatatatacccagtaatggtagtgttgggccaaatgtagttccacttttagctctttgaggaattgtcacattgatttccacaatggttgaactatttacacccccatcaacaatgtataatcattcccttttctctgcaacctcatcggcactgttattttttgactttttgatagtaactattcagactggtgtaagatggtatctcatttggttttatgtgtatttctataatgatcagtgatactgagctttttttcatatgctattgccacatgtatattttctttagaaaagtgtctgttcatgtcccttgcccacttttagtggcttttaggggttgttttttcttgtaaatttgtttgagttccttaaagatgctaggtatagacctttgtaagatgcatattttgcaaatattttctccaattctgcaacttatctgttacccttaaacagatagtttactcaataacaattcatttccatgttcgtatcttatttatgtattggctgcaatgatatccattatataaaactattatttttttaacctagtaagttgaacccaatttttatatatatgtaaaatatatatgtatatacacacacatatatatatataattaggttgcatatatatacataatatataaattgggttgcgacttactaggttaaaaatatagcacttttgtataagtataatgtgtatatatatttacatgtatatatcaggttgatatgtatctttgcctatgtctatgttttttttagattaaattcagagaatatacatatgtaatttggatacatgctttcatattgcccactagaaaagtgatataatttgtagtcttccagaagagagtttacaaaagtgccattttttaatataaaagtcaacattaaaatttatattatatgctatattttcataataaaaattggtctggctttttttttgggtttatactgcttgtcaaaatagaaagctagaagccatactactgatgtctgaataatattgtcatagaatctatggcagtgttgaggggagaggaagatgaagttttcattaacgaaggaaatgaacataggtgaagattccacatgggaatgtgttgtgtgttgattaagggcaatttgggggcacaggaaatacaggtaacttctcttggagctgttagaaatgatatctcatgtgagaggagaaggctggggaagaaaaaggggacagccctcagaaagtacatgctgcgctaaatatcctcataaggtgtttgaagagaaaaacttctaaaggactcagcaactcattatttctaagatctgccacagtagttcattttaggaaatatgtgtgtggctagaaaagcagaataaaaattggagtacctaagaaaatttttcctcccaaatatattttccatcacatagtagtcatctattcactgtatctctaccttgaaaaactgcaaacacttttggaagaggtctactttagccaagttcatgaaaagttactcgctacgcatggcttattatcctactgagcatgagtacaacttagaatcattcttaactgactggtatgggtgaatattagcaacagatcagtcagccctttagtaagcatacgtatttattccttttatctatattttatacatttttttatcaacgccatatcaactctcattctgagtgtcgatttgtgacagaaggcaaaggaaagaaaaacaattacataaaggagtctgtaagtgtcaacaataaactttttcataattttgtgaaggatttaaccatgaattacatctggtttcaggagtcctgaagaacaacatttttattctagaaatatattagaagaaaagtattcccaatatgtcctatagctaaacttacatattatcgaacagaaaagaaaaaattagacggagaaggagagacatatggaaaaccatgagaaatatgaactgtctgtactcatgtgaaaaggcagaaatcaaatagaaaagaaggtttcctctagcattgttaagaaatacatggaaatgaaaaattcaaagtgaaaatgcctctaaaaataaaattttctttctaaattataagacctatattcatgcttttaaagtatttccaatcagtggtatattctagatcaatttttatattagaaaaccaaaattactcacttttcaatatagttcctagcgttttaataactattattttttataacaactaaagacatattaggtattgtcacaccattttataaaatatacacacatatatatatgtatttacacccatacgtctgtgtgtaactacatctctctctctctacctatcgaatgaacgattgattgatctaacatcaatgaattctaagccctgagtatattaatagcagaagcaaaatgaaaactcacgtctatcattttagactatgttgcagaatgaatatcaactcatctaattctcattattagagaaaaacagtcaaggggattagagagttagtgttactagcaatgtcaggttgcatgtcagatgtattgatttcagtccattttttgtttcttttactgacagaagaatccttcttgaaagtaagtaactcatgaacaccaagctagtgacttgagaagcttatttactcttcctgacctgattagaaagtagtatctgagtgagaacatagtttaaatgcagcaattcttgcctatcccactctccgagtcatctcccatctgtggtttctgggcccatctctggaaaataacgttcaatacataatagaccctgaatggatggggagaagcacagcacaatcatttcctgtggttagtgagtcacactcttaaatgatttctttgatattaagaaaaaagtgaaaggaaaattcctgctatcatgaaaacttcatgctcagcggaaaagaaatggctctttcaggtcccaaaatatagatgatcattgattaggtcccttcttccctttctctctctcacctgtgtggttcttacccaagaattataaattaatatatcttaatattcattatattgtgtgtgttttttaaaatctatttctatggggaaataggtacatgtaaaatacacatgtattgtaagaaagaggaagagcaattatagtagccaaagacagttatttcataggattcaattagtatacaaatgaaggtaaatttatgtagagaagacactattcttattttttaaaattttgtattgatacataacatttacatatttatggggtacatgtgatactttcttacatgcctggtatgtgtaatgatcaggtagggtatttggggtttccatcacctggagtatttatcatttctatgtgttgggaacaacaggttatctcttctagctactacgaaatgtataatacattgcagttaactctagtcacctattctgatgccaaacattagaacttatgccttctatgtttattccctgatatggtttgctctgtgtccccatccaaatatcatctcaaattgtaatccccatgtgtcgagggaagtgggagggacctttggaaggtgattggatcatggggtaagtttccccctatactgttgtctgatggtgagggagttctcaaaagagctgacggttttaaaaatgtttggaagttgccccttacatttatctctgccactgtgtaaggcattcgttgtttctgcttcatcttttgccatactgtaactttcctgaggcttccacagtcataaagaactgtgagtcaattaaacctcttcttccataaattatctggtctctgttatttctttatagcattgtgaaaacagactaataagagaactggtaccactagagtggagtactgctataaagataacctgaaaatatggaagaactttggaactgaataataagcagaagttggaacagtttacagggctcagaagaagacggaggaatatgttgggaactggaataaaggtgactcttgttacgctgtagcaaagagtcggcagtattttgcccctgccctagagctatgtggaactttaaatttgagacagatgattggggtatctaatggaacaaatttttaagcagcaaagcattcaagaggtgacctggattatctgaaaatgttcagttttatgcatccatgaagagatgatgggaaattggaactcattttaaaaggaaagcagagcataaaggtttggaggcaagccccaagctcagcgcttcaatgtgtgttgggcctttcagtgcacagaagtcaagaattgaggtttgggaacctccacctagattcagagaaggtatggaaatgcctggatgtccaggcccagaagtccaggtccaggagtgagccctcatggaaaatctctgccagggcagtgcagaagggaaatgtgggttggagtccccgcctccggcaacacagagtccctactgtggcactgcctagtggacctgtgagaagaggtcaccatcctctataacccagaattgtagatacactgacagcttgcactgtgcacctggaaggccacagccactcagtgccaaccagtgtgagcattctatggggtatatactcagaatacagttgttgaattgatttgtgtgacatacatatacttaaattaactggatattgccaattgttcccagagcagttgtatcaacttatgcttctactagttgtatttgagaataccattttccccaaattctaatacttgacattatcagaatataaatttttaccaatttggcaattaagtggaaaattgttgtttcaataatttatttattcaataatttaatgagattgaaaactttttataatttatctgttctggctttcactttctaatttatgattaacatttttctactgatttatacatgttctttataaattctggaatatgcatactaatcctttgactgcttacatgttgtaatactgtagtcacttgtatttttgccttgctcataataaactttgatattaaaattgtttcattttgatataataaaatgtattattgtttcccataaggtatataattcaaaatcttatttaagaaattcttttccacctgacttcttataaattgtctgctttatagatttaaagttttttatttatgtttgtattttagttcagtgggattttatttttgtgtatttggtaagaaaactatttttcaaaaatattctatattgagaaaaaattgttgctaatattcactagttcattctaatttttattcatttgccattccaaaactgtcatttatgtagagcctggttctcaactctatcccatttcactgatatttgctctttgctttttccttttaaatttctattgaaacatatttcccaagtatccattgagagataaatagatttaaaaaatgtggtgtatacatacaatgaaatattgttcagccttaaaaaaggaggaaatcctaccattgcagtaaatgataaggatggacctggaagatgctatgctatgtgaaataatccagttccattctctcatgtctttctccctctcctcaggtctcctttccctgagatacaaaaatataaaattaagataattaataactttacagtgacctctaagtattcaagcgaaaagaaaatcatttagcttttaagtcaaaagctagaaataattaagtttagtgaggaaggcatgtcaaagctgagacagcccaaaaagtaggcctcctacactaaacagtcaagtggcgaatgcaaggaaaagttattgaaggaaatttaaaaggctactccagtgtacacattaatgataagaagaaaatcagtcttattgctcatgtggagaacgttttagtggtctggatagaagaggaaacagccacaacattcccttaatccaaagcctaatccagagcaaggccctaattatgtgaagctgagagaggtgcagaagctgcagaagaaaaatgggaagttagcagaggttggttcataggtttgaggaaagaaaccatctccataacataacagtgcaaggtaaagtagcaagtacgatatggaagactgtagcaggttatccagaagacttagctatgataattgatgaagtagctacactatacaacagattttcagtgtagatgaaacagccttatcgtggaagaagactcatcgaggcttttcatagagagaagtcaatggctggcatcaaatgacagctgactcttgtatagaggctaatgcagctggtgacttttaagttgaagtcaatgttcatttaccactctgaaattttagtgcacctaagaattatcttaaatctgctctgcctgtgctctcaaaatggacaataaagtctggatgacagcacatgaatttatagtgtggtttcctgaatattttaaaccactgttgagatttacttcttagaaaaaaagatttctgtcaaaacattactacttattgcagtgcacttggtcacccaagggttctgatggagatgtacaaggaaattaatatttttgggctgctaacacaatatcctttctccagcccatggatcaaagagtaattttgacattcatccttattttttttaagaaatacattttgtaaggctatagctgccatagatagtgattctttaatggatctgggcagagtaaactgaaatccatctggaaatgattctagatgccgttagaactttcatgactcatgggagggggtgaaaataaccactttaacaggagtttggaagtattgattccaactctcatgaatgattttaagggattcaaggcttcagtgaaggaagtactgccgatttggtagaaatagcaagagaactataattagaaatggagcctgaagatttgctgaattgctgtcatttcatgacaaaacttgaaatcaacttttatatttctaaggtgtctgagagttaataattttttctttctcttgaggaagtcaaatttgcttctaaactgtctctattgtttattatttttatctagaattttaagccatctttaaaatacataagttttgctatttatattttaagatcacttaaatttaccaaccatatttaccaaggtgtttttttagataatagactttggtttttaaagaagtttcaggtttacagaaaaattgggcagcaggcaggtttccatatatactatccttttctcttgtagttttctctattattaacatcgtgcattgcggtgcatttgttaccaatgatgaactagtaccgatatattattatccacagaggctctagcttgcgttagctttgtgaagttctatgggtctggataaatgcataatgttttgaatcaccgtcgactactatacagaagagttttaccacccgaaaaatcccctgttttcccttctttcttctattttagtccctggaaaccacttacctttatgctgtctctatagttttcccttttcagtaggacttacagttggaggcatgtaatattagctttttcagattggctccttcatttagaaatagaaatttaagatacctccatgtctattcatggcttgatagcacattttttttatcactgaataatattccattgtataaatgtaccatagtttgtttatccattcaatactgaagaacatcttgcctgcttccaagttttggcaattatgcatagactaatataatatccatgtgtatgttttgtcgaaatgttttcacctcatttgggtaaataccaaggagctggtttctgaattagagagtaaatcaatgcttagcttggtaagaaatgccaaactatctataaagtttttatactactttattcccattaacaatcgagagatttcctgttgttctattccttgtcagcatttattttgttaatgtttcatattttagtcattctaataggcatgtaaagtatctcattgttttaatttataattccctaatggcatgtgatattaagaaccttttatatgcttatctgccatctgtatagctttttgtgaggtgtcttttcagatttttgtcaattgttgttggattgttttcttactgttgtaagagtttttgtgtatattttagatcatagcctttatcagatatgcaccttgtaaatatgttcttgctgtggtttgcctcttcattctagaaaagtgtctttggcagagcagaagttttcaattttaatgtagttcaacttattaaatttcttttatggctctggtgtcatatctaaaaagttatcaaactcaaggacacctaaatctatcctctgttattttctatatttctatggttttgtattagtcagtttttaccttgctaaaaagaatagctgagactgggtaatttgtaaagaaaagaggtttattttggctcacagtcttcatgctgtacaagaagtatagtgccagcatctgcttctgctgagagcctcaggaagttacaatcatggtgaaaggcaaaggaggagcaggcacatcacatcgctaaagagggcacagagacaatgagaaccggaggtcccagactctctcaaacagatattttataaactcagaaactcactcataaccgtgagatggcatcaagctattaatgagatctgatctaaccccatacccaaatgccttccaccaggtcccacctcccacactggggattacatttcaacatgagtttagaggagacaaacatccaaaccatatcaggttttatgttttacattttgatgtatgtccattatgagttaatttttctgatacatgtaatgatatatgtaatgtaatatgtaatgataatgtataatgtaatgatatatgtaatgtctgtgtccagattattattttttcttttttgcgtatgtttcccaacttgtgttccagcacgtttcctgaaagactgtctttttctatgaattccctttgcttctttgtcaaagatcgactgactatatttacgtggatttattttgggttgtctatcctgtttaattggtctatttgtccatttttcaccactaccacaatgtctgattactgtagatatatggtaaatcttaaagtgggttagtgccagtcttgcaactttatcttcttcgatattatgttggctattctgagtcttttgcctttccatgtaaacattagaacagcttgttgatactcacaaaataatcttctggaatttttattggaattgcaataaatagaatttgggaagaactgacatcttaacaatattaaatcttcctatcgatgaatatggacatctctttatttagatcttctttgctttcttccatcagtatattttagtttcatttgtgagaccttatacatatttttctagtttactaagtattttttatttgtatgtttggtgctatgtaaatggcattgtgtttttaatttcaaattttaattcattgctgttgtacaagaaagaattgactttcatatattaaacttatatcttcctacctttctataataatcagtttcaggtattttttcttggagattttctacatagacaatgatattatccatgatctaaggtaatttatttccttcctccaaatttgtatatatttatttacttttctttttttattgcattagcaggtctttcagtataatgatgaacaggagtagtgagagacgtatcatcttatccccaatttatggagaaagtatctagtttctcaccatgaaataggatattatctgtcagttcctttagatgttctttatcaagttgaggaacttcctctcaattccttgttttcagtttgtttttaatttttatcattaatgggtattggattccatccagtgctttttctgtatctactgataaattatatgatttttcttcttcagtcaatttatctgatgaattacattaattgattttgaaagtggacctagccttgcatacctgggataaatcccacattgtcacagtgtataatttgtttatacattgttagatttaatttactcatattttgttgaggatttctgtatttacgtcatgaacgataaccgtctgtagttttttcttacaatgtctttgtctcttttgggtattgggtaatgctggcctcatagaatgagttaggaagtaatgattctgcttctattttctggagaaatcgtgaagaatttgtgtaattcctttcttaaatgtttgatataattaaaaattttattgtcttcctattttttttttttttttttagatgaagtcttactctatcacccaggcggagtgcagtggcttgatcttggttcactgcaacatccacctcccaagttcaagcaatttcatgcctcagcttcccaactagctgggattcccggcgtgtgccaccatgcctggctaattttgtatttttagtagagatggggtttcaccatgtttgccaggctagtcttgaacccctacctcaagcgatccaccttcctttggcctcccgaactgttgggattacagatgtgatcagcatgcccagacaaaaacgttattttcatatacttacttcttttcgtcccaatcctcctttgtggaatcatttttattattcaagaaatacatcctttagtaatcccttcagtgcaccttgtgtgtagaaattcttttgaaaatcttatgtccaaacatgtttttatttcattttttgcttgtttgtgaaattttagtttggtaaatatatttccttgatactttggtgattttatacactattttcatctcattttttgtttttattgttgttggtaagtagtttgctatccatctgattggatttgtgttcattctgatgggtctcgtcctaggtacaagtttctgagtacgatttttttcccctatttggaaaacgttaagaagttttgctaattttcatgtctgggtaaatttctaaaaatcatccttggaattctggaaacacttgtaggctgaagaattatacctcaactacggaaaattttcattctgtactaaatatttctttttcattctctcttaccatagaaagtaatacttcttaccttctgtttcatactttttgtctctatacagctttctgttcactttgagacttgatttgatctcctattgtagtaagttactctttagcatctctacagtttagttattattttatttcaaatactttgttttatatgtaacttttattcttttctgattgtttctgtgtctgcctgtcgttctttcatagcatcttctttttatggatttcatttttccctcttgaaacgtatttattttaaaaaattccttgtgaattgtactgtggtctggttcttgtaaattccctagtttattgattctgtggacactattttatggaattaataggtatttttctcatatgtattctggggaattcttcactttctcttcaggtgacactataggtttctcagaactgaatcaacacttagatttatttctcagttcagtagttttgtaactaaaggggggatcagttcagacccccacagtaatcaatacatgtgcttgtgattcttatagtatggtattctctgttttcacatatgtcctgggtaagcattttgtttgtggctgctacaagttgctgctgaaatttcaagtcactgttcacataagtaatagcccttgtttaggctcaagctcatgcagggagcccagtgctttttcactgactagtgatagcacctcctgaatctactcttccgacactggcttaaagcctgggtccctgaggcatacatccagtctcatttccccatagcacatgggtttaaatcttactgggttttctcttggttccaaacaaccttaactgagacggataaacatacctgtgtatgctcaatttaacatcttgactggaagccccagaaactattttttctggataaaaacctttctaagtgaagcttaagtgcctaattggctgctactgaagtctcagccataatttgaagtgaatgtctttatgattccttgttgggctttgttaagagttttttttttttttttctctttctaataattactgtttctgtacttacgtgcttagctcatagtaaaaaagaaaagattcttagttgctccttcagttttcctgataggtgaaaatagatactggagcatggtttttctctttagttctcattctcctttaaactcttgttttgtttagggatcttatgaacaagtagagactccctcactaattgcttaaatttctgtgctttgagttgtctgagactgtcaagcatatcaagagcaaatctgaataatgactggatcatctaaggtaatctcctttgtcaaacaattgctttcttgaggcttagaagcacagatgaaaaaataatacatatgcaccctcacaactgattaatattgatccaaaatcttgttcatttattgacctcattcatctaataaatatgtactgaatgcttattgtgtgccaaatattgcagtggaactgaaatacaacagtgaaaaattcaaatatgctcagtgccttcatggattttataatctataacagaatggacaaactatgacccagaggctgcaggaacacaaatacacaaatttgtaacttagtgtctgtggatgctttttcacaagagccaagttgagtagttttaacagagacatttgcctgggaaagcctgaaatatttactaactggtcttttacagaagaggtttgctgccactggtctaacaaatgacagagacactaaacaattaaatgtaaaacctcaagtaaagagagttactgagaaggaagaatagagagtcttggcataaacatgagagccatgtcttgttgaggatacaaggcaatggcaattggtctaatggtcacttaagaatgtataagacttaccacaagctaaccgggagaaaatagagtcactaaatcctttgggacaaggagacagcatggggaagcacaatacaaaacagaacagcacaatacaagacagcacaatacaaaaacagaagattgtttatctgaaagagtaagtcagagtggcaagaagtgagtctagagaggtaggcaggaccagttcacacaaaagcttttagtttttattagtagttcagacattttattaggaaaatgagaagcctttgagggttttttaagcacaaagggacatctagaagtccactgtaatttctagatgagagaatggtgagctggacttgagtgatgagaaagatgatatagtaggtgattgaacttgatgtgggtgttttgggaaatatagaaattatcatgactcccaggtttctcttcagacactgtcatttactaaggtggtggaaacagagagagggtcaaaattgggtggaaattctgagttaaatttttggggtatgttgaatgagagatgtgttttgaattcgcagcggctagaagtctagacagtctagagccaagaagagatacaggtatgggtaaaaaggtggaatttttagagagtttttttttttttccagaataaactaaaacaacagaaaatacctgtgttgcttgtgggttttaagggtagtgagctcttgtatgaaaactttctttgctgtagcctgtaatattctgtgtgggtttttgtttgtttgttttgagatggagtctccctctgtctcaggctagagtgcagtggcataatctcggctcactgcaacctctgcccctccagggtcaatgattctcctgcctcagactcccaagtagctgggactacaggtgcacaccaccgcacccgctaatttttttgtattttttttttttttagtacagacggggttttgccatgttgtccagttggtcttgatctcttgacctcatgatccacccacctcagcctcccaaagtgtcggtatacaggcatgagccactgcgcctggcccattctgtgtttttgatcagggaagcatctacgagcttcacttctatttctctggggtaactaggcaataacaaagaatggaatgggttgggatgcagaaggaaataagcattatatgaccccctacatgttacaaatttcctcaaaattaacatattctcagcccacaaaattcaaatgttacatctaggtttctcaaattgggtaaatagtgtatgttcaaaatgtgactaatataagacttatgatagaaactgataataaaaatttgtttatatagaatctttgtagtgatacagtttttctgtcctaatgcccttccaggtaaattttcaaaccacgcctctcttaggtgaaacagcttgtcagtgggtatactcctctgttccccacccttgtcagtgcccatcttgagtccctcaagaccaatagcttatcatttcataggggatataactctcgggatgatacagtactaccaatagtataaaatactaatctatggtgcttatatactttaaatgtacatttatatctccagtttaagaaaatgatgccaacccccagtgttcaagagaatattgtatcattaatatgattgtttttgatatgtgacttacttcattgtttgcataaattatggaaatttatacaatagccccaagaatcaaacacaaatctacaagaagaaaagtgttgacaggctaatttttcagcattttcttgagtttgtattgtgaaacaatattttcactcttagcactaagagcgaagtttagaaatggtcccaaagcccaaaggcctcaataaaattgccctccctaaatagaaatatctgcacttgtagacaaatctaaatagtttccacattacagggtcattgatagaaacattaaatacaaaaattaacatcttaacccaaggctagcagataagttaggttattctttaatggcaaagaagtgacaaaattctgtaaaggaaaaaggatgggacattttaactactctttaaatcaatggtcatatgaacaaagaacagccagtatctttataaatgacttgcaaaatagaatgagattttatgtgagacctctatctgtatagatgggatattagggtatagtaattttgcagttacgttggaacattttaagataagaggtaagagtaactggtgataagatatatataacattttcaaatttaaaaaactaaaactcataggtcgtaatgcaatccattagagagaaatagcagtcatgaaatattcttcaagcttaacagtgatggtttggaggcttaatcaaactgaattaactttcacaaaatgactctaaggtaggctgctgattatcatactcaattagtgggccctgtgtttttctccgtttaatggtcaaattggatacatccagtcaaggacagctgtgggtgattcctttccaactactcaattcagttcctgccaagatttccccagtgtcaattgcaatgtcaattgtaatttactgttttccaaagagtgcttgaagattaagagtattttccaaaggaagatattagactaaagattgaaggttttgtgtttgtttgaatcaactatcttatttttgagctttacacacaattttagaaaatacactggcatttcagctgtggtaccctctgggtgacaggattatgggataattttaatctttaatttttattttttgagatggagtcctattcactctatcaaaatgctggagtgcagaggtgagagaggtgagatctcggctcactgcaactcccactacaggtgcaagcgatttttctgcctcagactcccaaagtgctgggattataggtgtgagtcacatgcacagccaattttaatctttttatgcttggtcaatttctaaaattatttgcattagcttatttttatataattatgtcattaaaataagacatataagtagttaaaacttaagaagtgctaaatggcatacaattaaaaataccagttcctgctccacctctccctatttctacacttgtttgttctgctctttaccaccatatttgatgagcacatggagattcattatacattctatctattttcatataaagtattttataacagtggtaaataaaacaatactattgaaggtaaaataaatcaaataaaaaatatattgctatggctatttaaaaatttttgtatatctactgattgttacgagagagatgatactttgacatttttaccataatttatctcccatcccactgtagtagtccattttcatactctttaaacaactgaccaagacttggtaactttaatggaaagaggtttaattgactcacagttcagcatggctggggaggcctcaggaaactataatcatggcaaaagacaaaggggaagcaaggcaccttcttcacaaggtggcaggaagagaagagtgaagtaaagggggaagagcccctgataaaaccatcaggtctcatgagaacctctcactaccatgagaacagcatagggaaaaccacccctattattcaattatctccactggtctctcccttcacatgtggggattatggggattacaattcagaatgagatttgggtgtgacacaaagcctaaccatatcattctgcccctgacttcctccaaatcttctgtttctttacatttcaaaaccaatcatgccttcccaacagtcccctgagttaacccaaaagtccagtccaaagtctcatctgagacaagtcccttctgcatatgaacctggaaaaatcaaaagcagttagttacttccaagatacagtgggggtacaggcattgggtagattttcccattccaatgggagaaattggccaaaaccaagggactataggccccatgcaaatccaaaatccagcgggcagtcaaatcttaaagctccaaaatgatccctttgacttcatgtctcacatctaggcatgctgaggcaagaggtgggctcccatggtcttaggcagctctgtccctgtggctttgaagatacagcctctctcctggctgctttcatggactggtgttgagtgtctgtggcttttcaggtgcaaggttcaaggtgtcagaggatctatcaatctggggtctggaggatggtggcctcttctcacagctccattaggcagtgccccagtggggactctgtgtgggggctacaacccacattacccttctccactgccctagcagaggttctccatgagggctccgcccctgcacaaacttctgcctggacatgcaggcatttccatacctcctctgaaagctaggcagaggtcccaaacctcacttcttgacttctacatacccaaagacccaacaacacattgaagtgccaggctttgggtttacaccctctgaagctgtggcctgagctgtacattggccccttttaacacagctgggatacagggcacaagttctgagactgtacaaagcagcagggccctgggccggcccacgtttttccctgctaggcttctgggtctgtggtctgtgatgggaggggctgcctgaagccctctgacatgccatagagacattttccccattgccttggtgattaacatttgctcctggttacttatgcaaatttctgtagctggcttgaatttctcctcagaaaatgagttttcctttctatcatattgtcaggcagcaaagtttccaaacttttatgctctgctttgctttaaacataagttccaattccaaaccatttctttatgaatgcatacaactgaatgctttatgagcacccaagtcacttcttgaatactttgctgcttagaaatttcttctgccacatctgtaaattatgtctcacaagttctaagttccactaatctctagagcaggaaaaaaatgcactagtctctaaagcatagcaggagttaccattattccagttcccaacaagttcctcacttcatctaagactacctcagcctggacttcattgtccatatcaccactatcagagtttggtcaatgccattcaacaagtctctaggaagttcccaacttttccacatcttcctgtctcttagccctccacactgtcccagcctctgcctgttacccagtgccaaagtcacttccactttttgggtatctttatagcagcatcccagtctctgtagtaagaatttatttattaatcattttcatactgctataaagaactgccacaccaagcgaagtggctcatgcctgtaatctagcactttgggagactgaagtgggtggatcacctgaggtcaggagtttgagaccagcctgctaacatgatgaaaccccgtttctactaaaaataaaagaaaaaaaaaattagctgggttggtggcgtgcctgtaatcccagctactcgggaggctgaggcaggagaatcacttgaactgggaggcggaggttgcagtgagccaagatcataccactgcactccagcctgggcaacagagcaaaactccgtctgaaaatacataaaataaaataaaagaactgcctgagactgggtatttataaaggaaagagatttaattgactcacagtttcagcatggctgggaaggcctcagaaacttaacagtcatggcagaatgtgaagggcaagcaaggcaccttctttacaaggtgtagtgagaggtgacagcgtgctggcagccctcgcagccctcgctccctcttggcgcctctgggcctcagcgcccactctggctgcgcttaaggggccgttcagcccaccgctgcactggggagcctgtctctggggtggcccaggctggagctggcttcctcagcttgccgggaggttggagggagagacgtgggcgggaacccaggctgcaggcggcacttgcaggccaactgagtccgggtgggcgtgggctccgtgggccctgcactcggagcccccggccaggggcagtgagggcttagcacccgggccagcagctgtggtgggtacgccaggtcccccagcagtgctggcaccagccaccagccgccggcgcagtgctcgaattcttgtggggcctccgctgcctctcgtggggcagggctcggggactgcagcccgccatgcctgagcctccccctcctgcattggctcctgtgtgacccaagtctccccgatgagtgctgccccctgctctgcggcacccgatccatctaccgcccaagggctgaggagcgcaggcgcacagcgcagcactggcaggcagctcgcctgcagccccagtgtagtgcgggatccactaggtgaagccagctgggctcctgagtcagtggggacttggagaacctttatgtctagctaagggattgtaaatacaccaatcaacttctctaaaacagaccaatccgctctctgtaaaatggaccaatcagcaggatgtgggtgggccagataagggaatacaagcaggctgcgccagccagcagtgacaacctgcagggtccgttccacgctgtggaagctttgttctttcactctgcaataaatcttgctactgctcactgttgggtctgcactgcctttatgagctgtaacactcaccgggaaggtctgcagcttcactctgagccagcgagaccacgaacccaccagaaggaagaaactctgaacacatccgaacatagaaggaacaaactccggacacgctgcctttaagaactgtaacattcaccgcgagggtcgcggcttcattcttgaagtcagtgagaccaagaacccaccatttccggacacagtaggagggaggtgctgagtgaagggggaagagtccgttataaaatcattggatctcatgagaatcactatcagaggaatagcatgggggaaactgcctccaatgattcagttatctccacctgtttctcccttgataagtggggattatggggattacaattccagatgagatttgtgtgggacacaaagcctaaccatattacccactcccactcttaacacacacattttaccttctcaactttccctccctccagcctcccagaaattaagggattacattatgcgtatatctgtatttccaaagctcatccatgtggtctactggaatgtgttcactctgttgtgatgatttgctatatttatctttgcttatcactaattaattccagaaatcttacagagcaagaagcctttattgtggtcaagcacatcatttaaactctgtttaattttgtatttgagggactttttcaagtgtttccctctcttctgatctggaccagaatctttcgtttttggtgggttctgaacacctggaaattttcttcaccttttctttgtgcgcatgatggatcccattttctggatgcttgacttccttttgcttattgccttgttttagtcaagcacattctttagcagcttcctaaaaagattgcagggcaggttacactttttgggagcataaatgtctaaaaattctactattcattcttaatttgatggtagtctagctgagtgtagaattctagactgcatttcatttcccttgaaattttgtaggcaattacctgattgtctctgtaaactaagtgaccaatgcaaattcaattgatttataggtttatgttgccaaagttgaggacgtgctcagggaaaaagaagtcaagacacataagatttgtgtcttgtgctttttccaaagtggattttgagaacttcaattttaaaggggaaaatgggaagaaagaaaaaatggggagggtaggcaatggggcaagtggttcattcctgtgaggctttgattagcactcagtgaatttacactttacatgtgaaaagaggaagtgggaggaagtcaactatgtatacttctctttctcagtaaatctaattttacatagattaaagtcagcatgtgaagttacatctatctattcgggaacaaaaggaagttgtgttttgttttgtttttttccatgactcagttccccaccttaactttccttttggtatagttagtttggggtcttgagattttattattttacatattttagcttctatatgaaaattatatgtcatattgattactaatcttttatgtgacctagggtttttttttttccacataaacttttcagactcctgtctttatttttagtgtttctgaaaaattataatggtgtgccttgttctggtctctcttattcattgttctgtgcatttatatataatgtttattctggagactgagtcttcaatgctagcaatgtttgttgttgtatctaataatttcctctctttattttctcgatcactttttctggttttatattatttgtttgtttgactgcctggaaagagctgctgatcattcgtttttccttccatttttgcctcaacttttctgttgattttttatttgaattacaatatctcatttgtaattttctagatatttttctggtttttgaatgttctttttatgtgccttctgttctttttatttcaaaattttgattgcaataatttagattcatatgcagtttaagaaaaaatacagaaagttgtgcatacattatttaggactaatggtaacattttattatctatagtataatattacagtcattgacattgatataatccaccaaactaattccaatcagccagttttcattgtgcttgtgtatgagtgcatatgtgagtgtgtgtttggttctactaattgtatcatatgtgtaggtttgtgtttctaccaccacagtcaagtttcatcaccacagggtggctcatatattacccttttataaccaaacttacatcctcttacttctctaaccatgttgctacaatttttatctcttaaaaatgttacttaagtataatcatacaatatgtagttttccaagacttcctttgttcactaaggataatgcctttgtgattcatcggagttgtgtgtgcgtagttcatgcctttttattgctaatagtccatggtatgaatagaccaccatgccttaactgttcacctgttgaatggcacctgggctgatgccagttcttagctgttacaataaagctgttatgaacattcatacacagatttttatgtgaatgtaaggttttatttttcgatataattgtccaagagtgcaggtgctaggttgcatggtgattgcctatttagttttaaagaaactactgaactgttttcaaactgtttcttgcattcttacgtttgcaccagtaattatgtgttgattcagtttctcttcatcctcaccagaatttggtgttgtcaccatttgttttttagtcttccatagaggtatgtagtgctgtggttgtaatttgcaattccctgatggcataaagctgaacatcttcatgtgcttcttttctgtctatatgtattcttcattgcaatacttcatgtattttgcccatctgctaattgaattacttttttcttattgagtgcagatgagaagcccaagttatcaatcttttttacagattacgatttggtgtcaactctaagaacttttgcttagctctagatactgaatattttcttctatattttttctaaatgttttacagtttatatttaaaactataaaatgtacatagtccattttgagttaatttttgtttaaaggataggtttgggacaaagttcatgcacttgtctacagatgtccagttgttccagcagcatttgtaaaaatgttattcttcctccactgaatggctctacttttgtaaaatgagaaggtatgtcgtgtgggactattgtttttctgctgggtttcgttgatctacatgtctattgctttgacttttattattgtcttaaaggtccctgaggctcttttgagcattttttttagtctgttcttttccgattgtgtgaattccactgttctgttttcagattcacggatcgtatcctccatatctccactctactatggagcctatccagtgagctgtttggtgttttttagtgcatttttcaggtttataaattgcatttggttcttttttgtaacttctaattattttctgagatttctattttttcattagttcctagagatttataacagattactgaactatttttatgacagtgttttaagattcttgttagataatttcaacatctgatttactatgaagttaatatccatgatggtcatttttcattcaagttgtgatttttcttggttcttcatatgacaggtgattttgattatatgctggacacttatttattatattatgtgaccctgggtcctacttaaatctttatattaccaggtagtcaccctgtttagggttagcacacagctctctgcctattttttgggctatggtcccaatgacagtttttcagaacctttgcgatgttattttggtctgcttgtttatctggtgcaggtggggcttccactcacccctgctggtgctgcctgagggaatgtagtgtctcttgtgggtggatggggtggtggtatcctctcatgggtatcccttggctatttagtgtttctggtcagaggaggggagtctcaggcctgtgggatcaaagaggcttctcaagccagttcacttgttgagacttggtccttccttccagctctacctgcctacctcctaccccaatttcttggtagaaagggtctcaggctcattggaaaagaagatcactttccctggcgctcattgtgggtggagcgtccaatcaatcctgcttgtggtgatttagggctgacaatttgtcaaaggtactcttctcctggggaagaatcttcctatgtaggctgctttctgttgctggtttgggaattggaagtgctgcgtttgagtcatcatctcctgttgaggagggagacatggatgccctgatgctgtgttgttcctccagttttggcttcccaaatcagttcttctttctgctaccttttggaattcacctgtgttgtatcttgcattatttccaggatttacagttagctatgtgagaatgagcagggagaaaccagtttctccctagtcttgtttttattttgtattgcaatatcttacctgtgttcttatattgtaatcacaatacttctcttgtctctttgaaatcatagtttcttcttaaacattctctgtctttctgcgttttatgttttctctgttttcgtttgtttgttttcctctcagactttcatgtaagggtcattcctcatataactggtgtctttgcctacttcctataattgtgaggttccaaaatgatgaaaaacagttctgtgcaaaagactggaaagcagccttattcctaaactttctgctcagtatggcttattaccctaccttagctatgaatagtctaagttctgtttcttccctgacttaagactccagaaagctaactaccatattttgccttgttgtgagttggtgagtccattgtttgcctagtttgaaatctgtcatctaattgttctttttaaaagacatttatctcgtgttttcagctcccctttggccctggtctttagaggtatctgatgtttccacttcctgagccttttgggatttttcagtgtggaagactctacttcctcctttacaagacaggctttagtcttttctgactcacctaaatctttgccaggtgtccagtttaaaaaattttgttggcatcttattcttttatatttttccttcaatagttcgtgggtttatgatttgtctgtttatataatgtcatttcaatgggactacagaaggaagagagatgaatttatgtgttcacattttacatatgtttattcatttaaaaaaaattattagataagtaccctgactgagacactcctatagacacttggtaatcaccaaaaattacttatcaatgtgtgcaaaaaattgtaattgttattttaaaattacattactaatttgatttgttggaagcataccaggtaaggaattgctagaataaagtcatgtgcccaagcactgagagagaagagatctctaaaaaaagttaaatatatgagatctcattaagagtatcaattaggagccagaaaatctagatacaaggagagatttaggttcataactaactagcagttgaatttattgttagtagtaagtaaaatgaaatattaaagaagtaaaataaaataccaacataatgatgagataacttttatatactccttattatgagtaaggattagacactatagacatttttttgtgtttgtttctattgtggtgaaataatacataaaacttaccattttaatatttttaaatgtacatgtcagtggcatttagtacattaatgatgtgctaccatcccacgtatccatttccagaacttttttatcatcccaaacagaaactctgtgcccattaaacaaaactccccattttccctcccgtcaggccttctgctttctgtctctatgaatttgcctgtttatatttatcatataagcagaacgatacaatatttgtccttttgtatctagcttatttacttagcataatacttttttttttttttttttttttttgagatggagtctctctctgtccccaggctggagtacagtggtatgatcttggctcactgcaagctccacttcccgggttctgccattctcctgcctcagcctcctgagtagctgggactacaggcacccgccaccaggctggctaattttttgtatttttttggtagagatggggtttcatcgtgttagccaggatggctcgatctcctgacatcgtgatccacctgtctcggcctcccaaagtgctgggattatagcatgagcgacggcacttggccagcttaatactttcaagattgatctgtgccatgcatgggaggaatttcatttatttttaaggagatgaataatatttcataatatatatacaccacatttgtttatcctttcatctgtggatggacatttgggttgtttccaccttttggatatattatctgtatctatatttatatctaatacctaataccttaatgttcttacagcaacattagacacaattattatgattctcttaacatcctaaacagaagttagtcaaaacacatggccaagattgtataacaattaagtagaatggggttgaattaatgtctgtctcactccaaaatagacaaaactttacttacataatttttaaaacgtaggagccacctcaggaataaggaaaagcttgaggagactctgatactgattcttcaaacctccaactttaaccaggtcacctctcctttctgtgattgacattttgtttgaacaaaagattccgtctaaaataaacacaacttttaaaaatgaaatgaaagtccttatatctccaaatttaaaactttcaatgatatttatatgttaggaaatagatgtcttaaatgttgcaaggttattaaataacttaggagaaaaaggtaatgttttctaattaagttgaacaaactctgtcgagaaaaattgtgaaagcctgtaaaaatactagtaaaatattactaagttttatatcttatgtgttcctctgcattatatccgctttcagtgcttttgatctgttttacaactgtacattgtagaaaacataaaaatgcaaatattctcatctgtagaaatgcaaatgaaactcatttgatgaaatgcaattattacttcataaaagagagttttgctttttatttttttaattttatttatttatttgaggtttggaagtcaaactcaagacactagcatatttggtgtctagtgtgggcccattttgtcatagatggcccttctttgtgtcctcacatgttggaaggggtgaataaactcactcagacctctttttaaaaaagatatagtccttatggccaattacctcccaaaggctccactccttaacactattcattgcggattaagtttaacatatgaatggcgggggacaaaaatattcagaccctagcagtaaagtcagagagttttcatcagctgaaatgtttttgattctcattttttgttgtcttatgtgaaataggtttatatggatagctttatatgaaacttgcctcctatgttctgtactttagaaatacctttaattgtccttggttaatgtaatactccatatggaagagatcagagtttcagtcatttctagggctcttacattcttagttctttagttcttttgttagttattgtatttatatatcaagaaaaccagccctttattcataaaatgtgctgcaaatatattctcagtttatgtgtttttttttcctagagttttgctttttaaaataaatacatttcagaatttgattgacctatggatgtgagatcagtatcttactggatccctcagtagttaatcagttaacaaaatattttgcaagagatcattttatatttgtatgagtcatgatattaccttttttaaaaattatcattgaatgatttgctgacctgagatttaggtaaccagtccaaggcctgagattcactcttgaccaagccttagagaaattcctccaaaaagggaatcctctcctaggacccagaggagcttgtgaaagtactcacagactcacagaattcctgagctgcacaagctactctagagatcatgactcccctccgtactctcctcacattgtagaggatgaagcagaactcagcagacccactaatatgttcagtcttccagtaagggagttacaggcagaggcaatccagggctaagattaggtctcctaaccttacagcaagaaatctctggcttggactggcatttccacattagtggaaaatatggaactatcacaaagctatgcagagaatgtttggaatgaaaaaatgaactttattaataaaggaatgttttctgaactgtagaacacatcaatccatgcagttatcaatttgtctcattttcataaacttttaccttgacatgactcaggtaacttttgactttattatttctgttctaaattattcatgtcattgttagtatgctatgtaaatttggcatcctcagcattttagactaatggtcttgggagacaagtttattccaaatggacttgttgttaatgtaaaatattaatattttaaatttatttttgttttataaatatccaggtgggtgttaaatgttaacagagttagaaatgaacttatcaacaatgtatcaggagacttgatctggaaaatccacttaattgtgagggaaacaaatgttttttcttcgagcaaacaaagtcaccaaccttatgcatcagatcatttcttaataaatatatcatagtggcataaatgaatttcagtacaaatgaaaattttttattgtaatgtaatcatgagtgttaggcagaatacaatattaagtatgaaggaaataaatatgtcatatgcttccaaattgtttgtgttattccttaaaatagctttcattctctttctgccactcaaaaaaactttgttcaatttttaataaggtacctctccatcatgattgctgattctgagccctctctctcactttgaacctaccagatttatgcatttgcatcattgatgtagaatcatatcagctttatctttgtttctaaattattcattcagcaccatttattgagtatctttgtgaaccaaggtctgtattaggtattatactttactttggtcttgagggatgaagaaaatttttcagatagaaatgtggaaatggaagttatgaagttggaacagcatttgcaaaaacatgagatggtgaaatgacatgatatcttagaaaaatgtcaatgcttggagcatgaagtccatatactagttgaaattgaagttggaggagaggtgaggaaatctagctttactgtttggctcttctacccaactggattatgtgttctgcaacctagagattacatagtatattattaattatttgagaagttttacatttttttatttcctgggtaaagttaatacaatgcagtaaaaatgttgtggcaagtactgcgggatttctcccaatttgtattctcttctttcccttctatagactctccacatttcagcaggtaaacaagtgtgtgtatgtgtgtgggggtgtgtgggtgtgtatttacacatgtatgcatgcaaggaacatatgttttaatcagcaggttcctgccccgctggaagtctattcaagcagggattaatattttatttcctgctgttccccagagcctagacaatatcaatcatgttgtaggtttgaaaaaattcttgttgaattgatgaaccaattagtttataaaaagaagatagttggatgatatggctttgtgaagaaagaaaatattttcatttaaaagttacgctttgtaattgaaacacataattggaaatgaaacaaataagtcaataaacaggttttccttcacatctgatgaagacaagggtaaaaaatactctccaactgactcatttcttgaggaaaatgaaagagaaatgatagatggaaaaatgacacgaggaagatagaaaaacttaaatgtcaaagagaaaatagatttcaacaaagaaaactgatgaaaggactggttagttactagttggataatttataaaaaacacattgcagaaagaaaaactgtactgttaagactataaagagcaggatggctctgacacccctgagtttagggttttaaattggtatgactttgtgtttaagagagagattatcataccttcccaatgcaaagctgaggttgcagaacccgagagctgaaaatcatgcctgagtttagttttgtaggaacaattttaaaaagataaagtctaatttgtcctattttatgttttaatactgtgatgaaaatggaatttattcaaaaaacctaggatgatttgagtcttcaaataattaaaatgaaatcaccagtaagatatactttcattaagctgttcaaaaatattaataagacttaaactgtgtgcagactctatgcaggatgctaagggaaaaattggtgaatagatagtagtccttgtcctaatcaactttctattcaaggaaaaaagagactgaaacacagtatacacacacataacaaaagaaattaatagtcaattactatttcttgtgaaagaaataatgaaaagcagagagaaagtatgagacagagtgaagctatctgcttaaaaacagcatgttagagaaggttctttgagaagatggatttaggcagataccttaaagtgagaaggtaatgatatgtaaagagattgggaaagagtgttactgacaaacagaatatgcaaaaagtttctcaaaaagaaggaatttagtccagaatcacaaaaacttcaggtgtgtgaatcctagcaaaaaagaagatgggaagaatgaacctgacacattaggtaggagttagatcatgatgagcttctattctatggtgtggcagtcagctttattctcagggcagtggaaagccatgggaagagcccaaagtagggcaatgagctcttgccctcttttctttggaaatcggtgtcaggaattaattaaaatatagctacttgttcagcaacatatccactcatttgagtcggattcagaaaatacctcctggaaatttgtttccatttttgataaaccagagtaagattatttgtgcttcttatgctgaacaaaacttaaaactgtatataggttaattatgttgtatccttttttttttttttttttttttttttttactgcatgcagttatgctttaggggaaatgatttgacttttctgaatctaaatccacaggtcacttgagctgattaatattctaaaaattttcattttgagattttatacatatttatcttgatcatacttacctataatactttgccttgttatatcaaaagtggaatgacaggactaaatgaaataactactcaatctaggtggcttacctacttctgtttgtaaggcatcaagtttgggtataaagcagtgttttcccgaatttataatacttaatcactggcacaactcttatatttctaaatattatttgctttattttgagaaatgagattaacaaactgtggttctgatgtgctggttatatatttttaatacatgtaaaaatgagtgataacaacaaatttattggacatcaagcaaaaatataaaacatactttagagaaaaactgcataaacaaataagatcattttttcatagagctcaaccatgcaccaaaagtatcccttggtggacagacacagagtctgtgcctcctaaaaaatcaatagcaacagaccatgacagagcataagcaaaaaccgagccccaactctattttaataatctgtactccctgtaaactgcgaggcatgggacaactcgacagactgtgtttacaatgcatgaattactgtcgggcactccagccaaaagaagctccaactttcacttctgatctgggtcactagaaacagctcttcagctattgatttggagctcatgactagaaaagactagtgaagagcactgctatcagaggctaagcctgtctcacctctagctcctccacgtgaaacacacacatttggttacatggaagtttttgctgactagcaattaataaattggaacaattaagaaaataggaaataatttcacatcaaaagcaagactaacattgaacctaatttggatgaggcagagtcttggtcagctaaaggcaagtcagataataattgtgttgaaatttgtattagctctctcttaactctctcctcaagagcaggtatgtagtttgtcatcttaaaaggcagaaattcacttgttcagtccaattaaccttcagaaacatgctttaaaacaaactgctcagaagatcaatagtgttacaaatgaaggctgaggtaaaggttaggagtagaatttaccatgataaattctaatggggctttctataatttactgttttcttccctttttcattagaaccatatttcagagtcctctatcttcttctttccctctctccctcttcctctccctctcatattcagattatattttaaactagtaataagggaattttaaatatacactataatatagaaagaatgtcatgatcgcaaattatacgttttaaaaagtgcaaattttaagctcaaattgtgtcctctctgttcattttaacttacaaacatttgtcagtgtgtattatatgctacaatacttcctgttattttcaggataggaaatgactaacatgtaatcactaatctttaggagcttccaatctattggggagagtgatatagacgtataatgcacccacaaagagctataacataaggtagaatgtgatctgagcactaggaaatttaaaaggggtgttgtgatcactagttctggccaaaataatgtaagggacagttttttctctctctctctctcattttttttttaaagggacgggagtaggaattacacttagcctctattccactatctgcagtattttctccaacttgagtccctgatggtcagttctcattactaccacctggttcagtgtttagaaccatgtgacacacataatgattattcagtgaagaaaaactgagaaagtgaagcctgggatatatgggggaaagcctgacaactatgttgtgaacatgaatgtgatcaacactcagaattcttttcatggaactcactgttcactgtcgtaacttttggacatcaatgtcatcaagacattaaggtaatgttcctggaatgatatttgtttatagtttactactgtcccattgaaactaaatgcaaaacaaaatcttgcttgatattatttgaaataggaaataataggaaggtagtcacttcctaccttcctaggaagatagcatgatgataaaataggacttcctatgaacctagcagcttttataactcatattcattatctatttgacctcacaataacctatgcataatgcaagagtgaatcagagaggttcaggaacttccaagaaaaagagaaccagtaatgatcaaagctaggacaaggacccagattctgtctcacattcctttcataaaactacaaaaaaacctctgtgatacaaacttaatcatgaaattaagtcctgccaggattgtcctttttgggaacaaaaaagaccaacagacatcaaaaaaaaaagaaaaaaaatacttcagctagtgcagaatttctgagattcttttttgccattatttcatggggtttaagtgattcatttgattaattaggagctgagtcagctaccttcttttgacgtatttgattgccttttgctgtggcctaggatctatttttattgattgtgcttctgaactctcactattacgttgtcaaatattgttatattaaatggtttggttccacactatgactaagcttcactaaaaggaactacattagtcagaaatttgtcatgatcagatgaaaaactgaatgtttaaatgtcatcatgaacaacctctacgatctgtcatatcacatgttggcctctgtcattagcagtgaagaatgtgtactacaatatttagccttttctccacttttgaataaaggtttgcatgtgtttacatatgtattatatatgtgttatgcatgtgtgcatatattctacacactgtatccttaagctgctttgttattggtagaagatgctgtgaaatagtgcgataacagaaaagttgaatggaaaaagtagaagtcataaatgatttgagaaagaagtaacattacttttagaattattagtataaaaatggagtggtatccacataatcaacagaagagaataacaaaaaaaagaccaggaggaaaaaattatacttaatagtggtatcattgcttcctcgattcacttctagcaataaaatattcaatatctcactggtgattgtcaaaggtagttggacaactcttgccccacttgtaattgactaataccattgtgatagatgtatcttattatttactagctctatttcagccatgtttccttaactgaaaaacacattcaccacaaagatgaattatcccaatgtggcataaattttttctgaggggaaccaaaaaagcccctacacatttatgtataaagcacatagattagatatatagagagtagataaacagatatagagtgtagtgtgatatttaaatttcatgagggaagggttgactaggataacaacgcttgaaaattctcttggaaggtgataatgaaaaaaaattgattgagaactgccactctagacttagtaatcttaaggttatttatgattctttctatgattatgggcttttatgtcttaaatgttatttttttatatcattaaagacactgaggcaaagagaatcttttgagatgaacaatgcaacatcatagttgtatcagcaatgttattttgagcttaaagaagggccggatataataaggtctactggggagaaattaaaggagtataggagatttcatccttttcttatgttcagacatgattataaggtagctgggatctggaactagaatcatcgtattggggtatggtgtgagggaaaaactaaagagagctggtagaatttgtggtagaattcatttgtaaacatgccaatttctgtcatcaatattcacctttaggaacacttaattttaaatgtttgtataattactcttatttgtttctttgatatattatgtaagtagtttcaaacagtgataagattttttaaaaaagaaatgacaaactggcagccattttatattgcttttgtaatttcataatacttggtgcatagaagtaaataggcattgattttcattcctgacttgtggttcaggtcattttgaaggagttaaatgaatttcaagggcatccttttggcctttctacagagatggtattcaccagtatgtctccagccttttaggcatataactatagacacacactcttatagcaacacttttataattacagatgttttaaaaaatacagcttacaatgttaatgtacttagaaaaggctagtaaaatcagagtcctgcctccataaaatacaaccttcattacctgacttggcatactgactgttttctacttttgaatacaactttgccattcaaaacacaagttatggataatttattaattcaaaattttaggaatagatgggatacaacactttctaattagtcaatttagtgagcaaaaagtgtgctaagagtgctgaaaagcgttgtttttgtttctttattttaataggaaggggagttcaattgtaaaacaaaatccatgtgatccttaagatagaaataataaaattacagagttatatatcagaatgaatattatccttttaaaattgtttttataattctcaacaaaatggtaagagaagattttgaaactagaatgccaggtgtgaattagtagacggatgcagaagaataacaatgtaggtttggcatctgggactttgctgtttagaacaatgtttcataattattataaaaaatatattcattgaagatgaaatttaataaattccatttaaatatataagacatttgatatatacatgtataatttatttcacaaatatatatagaatacctacagtgtaatataacactcataattatttttttccagagacattgagaataaactcaataaatacaaagtgttaatttcaaattttatgccctattacatctttttgtttgtgtatttatttgtctccaacttgaggatcaatatacaacttcaacaataaaattaattttaaaagagctaacttgagagtgcacacgtatacactcatccacatactacttatatatgtactgccaaatttcaattacattttacttaactactttggtgccattccaagcacataaacaatatttgtaagccgtttattttagattgatgaagtttctaattctgcacttggaggaaggtacgcctctcaagaatgagaaattaacttttctttaataatttgacctattcttgacaccactgttaacctctgagctcttaacataaaatgccatttaccaagagtaacagtatttacagaaggattagtttgctctttttatttattttcaagttatccagctagcgtgttattgccataaagccaattataaattaacccaatttaattttgtggagttgtgatttgatccagatcatttgagctagatgttttgcaatacatcttatcctttaaaaaaaagttacattagccctactgaagtccaaaaaattcaatattccattttaaatatctgaattcttttaggatcccttcaatgcgaaaatccatcattcagatggactgtataaatgaacatttagtactttgagtggcatcctacatcctgagttgaactggcttctttcagcccctattatcaatggggagaacactgcccctcatgtgttagctctgtctgtaggcattcatcatgagcagagggtgatggtgatgggtggtttgaagccaagcaatcaaaggaagaagatgacatatacataaagacacttaggctaaatgtgtgaattctgtcctctgattaagtttttcaatcatatgtcaaatactgaccctttaattcccatgtttatgtgctatttttatggtcatcatttcttctctgtaacattgggcagacccagagaacttcctggattgttgcaaatagaccctgcagagtggtaatattgtttagagaaagcagaaaaagactgaggaggaagagttggaaagaaaaatttacccatgagtaagacatgttatttttaatctttgaagtctgttttaaaataaaagatagttaagactgtgcaaccatgacttgccatattattttatatctgattctactttaggctaaatctgtaatggaccacctgggctagaaaatgagaggccttggttgttaacgtgtgtttgacagcttaatctctttgaaaaatttcaaacagaaaggcttaggcttcctcaagggataaaaaatagtgcttaggcctgccaggacaagaagctcttatcttagttttgcatctgacttgtttcatccaccttccttctttgtgctcatttgtaaaatgtaaattgaagaattaatttacctctcaagtaatattgatggaatcaagaaaaatggttgcataacattttgaaagtataaagacctagtaaatgtcaaattataatgataaactcagtagcccaattatccatgacaacacttcccctgtttgattaaccagatgaaaaaaattagacatttttcttaaacagcacccttcaaaaatgtacagcttactctagaaggcaggcttttttttttttttttaacacaattcttaatgctcactgaaattttagcggaaaaggtggcacattttgacatctcaaggatgtgcaacctatataagttgtataattaaattataaaaagccatttaatttaaattatatcacctgggtaagattttatttttattaaaggctgaagtctatagactactctgtgccatattttgcttaatttggtgcctggagtggaactcaggtcttagttaaattttaattttgttgtgttttttattaaaaatgccaaacctgattcacttttaggaatgagatttttccaataatattgttggttacttttactcattctaggcaaataagtgatttgtttcattctctttttttttgccatgacaaatttgtatttgctaaacttgtacatatttggtagatcctatgccaggtgatcgagtttataatatatcccttttattgatacataatacttatttgtggggtacatgtgatttttctcacatgcataaaatgggtaatgatcaagtcagggtatttaggttgttcgtcacttgagtatttatcatttctacgtgttgcaaccatttcaagtcctctctcctagctatttgaaatatatattactgttaactatagtcatccgactcagctatcaaacattagaaattatctttctatctatctgtgtgtttgtacccattaaccaatctgtcttcatcactgtcctcctgtagccttcccagcctttggtatacctatgattctactctctacctttatgaagtcccgtttttagctcccacatatgagtaacaacatgcaatatttgcctttctgtgcctggatatttcacttaacataatgacagtttcagtcatgctgctgctaatgacaggattttattatttttaaggtttaatagtattccattgtgtatttgtatcacattctctttattcttttgccattggtggacacttaagttgattccatatctttgcgatagtgaatagtgctatgataacatggagctgaacatacctttttgatatactgatttcttttcctttagataaatacccgtagtggaattgatggtccatatggtaattttatttttagttttttgagaaatcaccatttgttttccatagcggttgtactaatttacattcccaccaaccgtgtatttttaacacaacttcaaagataactgaacagtaaatagttaaaaaaaaacacaaaccttccaaggtcctcaatggaccaaatctatagagaaaaattggtgagtaggaattcatctagggtactgataatctctattgaaagaaataggattctagttgtttttaaagcctattaaaagaaaataacatcttaacaggacagttaacagagcatgttcactgctaaagagctatactttgcaaatcaaatctaagggccaagccatcttctaattcagatacctgtaacaatgctgtaaacagtcatgcctcgggcttcaatggccagctcacgagacaacagtttctaatgcaacctttcctggaagagagacatagagggatgctaagaatcacaattttctttctgttcctgaaaaaatgtatctatgactgcagagcctgtggccatgagagggcactgggtacttcaggtagagagtaggagagaaaagatttaatgtattacccacttcaattttttgctctgaggtcaactctggtagattgctggagccagttcaaaatgaatcaacttggtgaaagacagtggtgaaattgcaatggtggctctgtgtcattagacgtttgccaaaacctgtagaacgtacaacacaaatgtgaaatatgtaaactaatggttttggctaacaataatgtatcaatataggctcatctatgttaacacatgtactacactaatgtaaatgttaaaataggggaaagtgggatggtgggggagagaatgtaagaatatagaaatgctatattttccacttacatttctgtaatcctaaactggtctgaaaatcagtatgttaattatatttaaaattttttaaagaaattatttatactgtcatattttcccccttctgtaatatttttaaaattatttctattaatgaaaaatttggtatgtgctaacatcttattcatacttgtgccttctgtttatcccaatcaggaacatacaccccaccatgttaaaaaaattaataaattaacatttttatgaagaatatacttagtggagatctgataaaaatagtagtcaatgacctattaggtcagagttctgacaactcttcagccttaattttgagtcatgatgtaattcctgcatagcaaatagaatccgatcacataattaccaaaaacaaacaaacaaacaaaaaccgtcatttttatatgctttagatgggacaaactaaaattattttaagaaatagtgttatgaaacacaattaagatgaactgaattcagctaaatgggagacttgacaacatgttctattagtctgctctcatgctgctaacaaagacatccagagactgcgtaatttataaaggaaagaggtttaattgactcacagttcagcaggacagggaggcctcaggaaacttaccattatggcagaaggggaagcaaggctgtcctttttctatggtggcagaaaggagaagaatgagagcccagctaagggggaagacccttataaagcatcaaatctcgtgaaaactaacttactatcaccagaacacgatggggaaaccaccctcagattcagctatctcccccgatcctggccataacacatggggattatgggaactacaattataataagatttgggtggggacacagccaaaccatatcacgtatattctctcactcctcttaaatcattggaaatataggtacaaaattatttataaaagcaactcataacccaaaataatggaatcttttaacagatgaaacatttaggaaatattagtaagtttatcctacacacatattgtatatcttattttttaaacatttaacatatctggatgatcttgccatattagtcagaaagatctaaatcatttgtagcatttctagtaaatttactaatttcctattgatggaacttattcttaggttttttttttgctaataaaaatgtttcagttagcttgaacatatcgtgtataactgaaaaaacatttataagatgaattattaaaagtgaattttgggatcaaagttgtgtgtattttaaattttgacagataataccaatttaataatgtcatatgtttaaaatctaatgaagtattctatagatttagttgacagaattatctgatcagtgaatccaaataaatagtgaaaccaatattgaaacttaaaactgtacaatgctggaacacatagagagtctaatgcaaagttaagtatataaacaattatagtaaaacactacagcataataacagcctctccacaattttcagcaagctgaaatcattttgcctttgtgattacactgaggaaaatttgcttaaattatgaaaatccttttttagattcacaggcagtatttctagtttacctataacctaaagataaccagagtttgaccctcagttggtttgatttatcttattcttatcctactgagtatttgtttattataataagaccttattagaaatcatttttataaaaaaatcaatgatatattcattttctcccctctccatttctgttgaaatgatgaatttgaaagaaaaaatgtaattttaaaaacagttggccttgttctgagaaattcctctatgtaccagtttttgcctttggccacatctttgctgttgtggatcaggggcattgtattgcatataagttctgtgagcgtaatggctagtgcagttacagcccaccaataacagcaggaagccccttcgtctgtggctctgcttacagaactttgaagtaaggagactgtgattgtaacacatacttcctaggtacaccatggagataaagttgaaaaccaccatctggattctttaagagttatgctgagcatgcctaatgatggtagctccagtaatataccccatactgtctggcaacagcatcatattgttttaaatgcacggtatgtaggtcatacagctttattcaagtgaactgtaaaggttgcattctctcactttattaaaaaaaacattgaaattgcctacattttgctggaatagtgccctgaaagcacacaaagccaaatagttaaactaaaaaacatgcttgttttatatattatgcactctcctctacaaagaaccaacccttataaagttttaagtgaactgtgaaaagttatgccattattatccaaatgctgtttaacccaaggttaaccatagtaatgtgagaacagcgccactgagccctaatgggaaacagtaaggttttgtctgcacagacgggtgttctcctgcattttcctaatgtgacagtgtgaactcacacagctcagagccctgatgtggaatcaacctcaaaggtctccgacgtaaaaagctgaaaacattctggagatgcttggagctctgcaaacctttcactacttgacttactccataatgtttaatgggccaagttctcaccttgtccttcaggctgaaggccaaatctgagagtgaggtttgaattcagtttgatctataatcccaatgagctttgtaaagcagtagagcaagagagaaatttgtttcactgtgtgcacagacacaacatttaatttcatgtttttaaacctacttcttttgggatagaatttaagctatggcagtgctgaatgctgagtagagtgcagaaacttttatcccagagatgggcggctaaagggtatctagaaaagctcataattcattgagtacaactctgttcacttattacagtgttctgttcttggggagttcataagcaaaaaactactagcaatgggcttcccatttgtactgagaattgagccatgcttcctcctcatatctattccatctgttcctagcctctccaagagaggcctttgatccgaaaatctttgagatggaagagtctttgcttaatgctgaatcactatctatcttcatattgtcttattctagaaaggagagaaggagttaaggtaaactgagtcctgggtttcaacacttactgtgtgtggcatggtttgtagtgtttttacctacactatctcatttatcctcatagctattttataagatagcattatcatctttgttttaaagatgaggacagtagttttattaatgtatttagagcacactagtaagtgggatatctagaatgtgagcccagctgtgtgacaccaaagcttgtgctttgctttatccattcagctgtactacgtcccaatttctacctgccttgaatcagtgtggaagactgagtgatggggaaaaaagccgaaggtattttttccactaataagaatatgctaaatgtacacataatataattgtagaatgaaaacctaaattacacattaaactgataagtcataatttatctctaatggtgaaattgctaagggtttctttcctttatagttttctgtacatttctgttgagtgctttgaggttatattttttagtttaaaaaatacacaacaaatgatatattaaaaatataagccatagttaatacattcaaacattccaccattcctgtgaacaacagcacaaaagtcacgtttgtagctactctaatatgtttaagaaaaattttctattatataatgttgatagctagaattaaatgataaactttcttcatgagaataatattttaatatttagatgcagcaacgttatacatacttaaaactttaaaaaatattttctggcatataaatagagggaattattttaataataataccatgtcatcattccaccgtttctgtgttgcagttactgaactaaatgctacaggtacagagaggggttcttgcagtgaattaacttttatttttccaattagcttattatagccctcaaagcatatttccaatattatctagaagagaaaatatcccaagtgtacccctagtaaataggaagtatttcccaaacttgtgcaattgcaaggaagatttccttagtagatagagattcagaatagtttcatagaaaataaattgtttgtgatttgtggatgaaaaatactgaggctcagatgtctttattgggcataaaaatgctctaattattaaaaatcatgaaataaagttatctgagtcgagcttagaaaattgctttggcttgataatgggtgaagattttagaggtactttcaagagtaatagatttgaaacgttgggcattttgagatagctaatagaaagactgaattaagaacccatccaaatgagattttcacaaacgaaatactctaccctgcaattaccatgtttcttgcatcttcagatatatgtctgggttctcagctgcactgcagctcagcttcccattgcttaatttattagaactcaatccttgggaggttaagttgatcccttgaggatgtcagtgcctctcacagttgagaagctcaagtttgtcctgcattacacagtggtgtgatgactccagacagtactgaagttaagtttaagcttacttagaaagtgaggaatgtaggactgctcatgaatgttgttgtcatgtaaaagaaaagctattcataaaaaagatctatattccactaaatgtaaatctgactggggaagcaggctggctgaattagtggttgttaaaatgatcactgatggtaactagctacaaggagtggtgtgcagacttcaaggagattaaaatagccaggcacctgttctgggctggttacctattcaccattgtgatgttggaatcattcccctgtatcttagcttttattctttctctcgtttatcttttaaacctaatctcactattttgttggtttatcttggactgtgttgctctctcattggtttgtctgctgtgtgccctagaccctggattaaataccaccctattcacttacccagagctatatagaaggaaaatccaaagtcaccaccagaacaattctttgccagggagatgagtccccgatatttttttttattaaaatactgaattcatagccccatgaaaataaaactgaaaatatacaaggttaaaaagagatttataaaatttttgtgatttggacatttttattcttatatgaattctgattaacattgattgtcctgtttttgctcactttactgttgcttctttgtttacaatgtgaataatctctaatttaatgtcttggcttatctaatattttgctgaagagttttgtgacattcgagtctggaaaagaactaagagtgttcattaatttatataaggaaaatatatttttacaattggactaaatatttgatgttaactagaaaataagttatattttctatatttgtattgagttaaatggctatttgacaccactgtttgaagtgtggcttagagtacaaatagttttgaactcttccatttatactgtcagtgtgtaatttcaccaaataatttcatgtactttattataaattttatttagttatatttagccttttttcaaatatatcttctatggggaaa

SEQ ID NO: 5099 - DNA, 18415 bp, Homo sapiens
ctcaatccatttcattccacaaagcatcaattcccattcagttaatcacataagaaatctctgcattaaaaagaaatttcatgaatctggaactgtttcaaagtacagcgttcaagctcaaatccctcattcattcactccctcattcactcaccggcaaatatttctgaagctcatctatatgccaggtactgttctaagtgctgaagacatgagtggacaggacagatgaggtcctgctctctggcagctaatagttcatgggaaggcaatactaataaattagcaatgaatgatgaatagacggatggatagacagaaaatatcagatagtgataagtgctagacagagaataaaatagagttatgggatagagaaattgtgagtagtgactttggacaggatagccaggaagactcctgtgaggtgatatcctccctacatcagaatgatactgtcatactccatttcaaatgcagttgtcaaatctcattttcatctctgatgatcctcagatggaccaataatatagtgaatttcctggtacaatttcttgtctggaatagcagtatgggccacgtgcagtggacatgtctataatccaagcactttgggaggccaaggcaggaggatcacttgaggccaggatttgagaccagcctggacaacatagcaagaccccgtatctacaaaaaatacaaaagttactgggcattgtggtgcacactttagtcccagctattcaggaggctacggtgggaggatgcttcagcctaggagttggaggctgcagtgagctatgatggcaccattgcacccaagtctggcaacatagcaagacccagtcactaaaaagaaaaaaaaaaaactgtagcagtatgagccaggtattggttggggtaatgcttgctactatgatacagtaaaagatttctcacatcaatccaaaactagttctgtatttctgatcgacaagtgactttgctctgggtggtgaactcaggaccctggctctatccagcttgcgtatggcttccaacatcatcatgcttgttcacatcagactgcaggggaaagagccgtgagggttttgcaagacaggtttttacaggtcaggttggaaggggccaacgtctcgtcttccaacagtccattggccaagactcaggcacatggctgacctaacaggcagaggctcaaaaatgcagtctaaccatgaaccaggaagaggcaaaaaagggcttgctgatgtcttggggcctctgcttatgtgaagcactaggcaaacttgtaacgaaattatctcaagcccactccctgcaaggatgaggtctcggatctcctcatattacctcacgacagcaactgccatgatcgaaatcaaaatcttttctggcaggaggtagggcaggatgcagatgtgggaagcaaaagctagggctgaaatccaaagggttaattcattaaagaaaaaacactcagacctgttgtgctctgagacaactcgagagatggaaggctaatcatccttctggatgccgagttctttgtggagccctcagaatggaccgttcgacccttcgaggtttctctgctctgatctcttgctaatggatagtgttttccaagctgatggtgttttaaagatacgcatctaaccaatgataatacgtctgacctcttgagggagaaccttgtatatcttcctcttcagcctcccttattggctaattacataacttgactagaagttggttttagagaatcaatttaccattgcctaatcacaagtaaagaccataaagttttatgagagctgaagggactgcttttacagaggggaacttaaatgagaattaaaggggacattaaatgataagaaatgaattctacaaggtgttttcccctgactgccacactaaattacagtgctggggatataatccgctggttttgtctccaacaaggcactcagggaagagcggaggagctggcatttcttgataccagcaatgcaattgacagatcccgtgttagtggctttgggtgaagacgcaggcaaaaccccttgagctgccatctactaattgtgtgaccctgggcaagttctctgaccctcagattgtcatgtgcaaaatgcagatgacagtcatcacctcccagagctggaaggatgaaataaataacacacgtaaggtgcatagcatagtgcctggcacacagtgagacttcaatgaatattcctgattacctgtgttaatgataggacatgcttcaaaacaactggggctttgttcagtcctataaataagagctagtattaattatgtgccataaagcagcaacctgtaatggcatctctccactttatacatgaggaagttgaggctcagagacactggaaaacctgtccaaagaacaagactcatgaaggccataattggactcagaacctaggtagctttgccctggaggccatatactggactactgtgtatttttctgggtaaggttcacagaccagtctgcctgttcaaatttatcttcctttataacaagcagcatccatgagtcttgcacacactaagcttgagatgatagaagctggggtgtttcgttgagtttttctttttgagatggagtcctgctctgtccccaggctggaatgcatcagcgtgatctcagctccctgcaacctccgcttcccgggttcagtgattctcctgcctcagcctcctgagtagctgagattacaggtacgcaccatcacgttggctaatttttgtacttttagtagagatggggtttaaccatgttggccaggctggtctaaactcctgacttcaagtgatctgcctgtctcagcttcccaaagtgttgggattacagggtgagccactgtgcccggcctggtgtttcttacaacattgccactggggagaattttccaagagtcttatttcattcaattaccaaaagaattgtccatttctctccttatatctcctcaacttctgaatctttcaccattatcatttctagcactttaatgtctccacaaaagtcagatctggtcaacccaggccatcaagaaaaagaaaagactgcttctccatgcccaataaacagcaggagggtacagtttacaaatatgtgatttatggtaaaggtcaagtatgcactgaatgggaacatgtcccataggcaagcaaggtagttatgacaaaaaacagatttgaatggaatcaccaaaattgctctggaaatattaaatcaaagatcctttttgataactggaaagtggctggtgtggtggagggccaccttccactctgacaagggcctaggaagacaagcagactctgtctgaggtctgcaactggggagaacaagaagggaggccctggggagagccacacatgggatggaagtcgacaggctgtgggaaagccattttttaatttttttaatttatttttattgacaaaaattgcacatatatattgtgcacaacacattattttgaaatatgtaaacatatggaaaggctaaattgagctgatcaacatatgcataactttgcatctgatatggtttgctgtgtccccacccaaatctcatcttgaattatagctcccataattcccacgtcatggggggacccggtgagaggtaactgaatcatggggatgggtctttgccatgttgtttctgtgtagtgagtaagtcccacgagatctgatggttttataaaggggagttcccctgcacaagtctcttgcctgccaccatgtaagatgtgactttgctccttgtttgccttctgccataatgtgacacctccaccgccatgtggaattgtgagtccattaaacctctttcctttataaattctcagtcttgggtatgtctttctcagtagtatgagaaaagactcatacagcatccttaattaaaaaaaaaaaacaaaagatcctgatacactctgctaacatgaaacaccacactgtttaatacggatgaacaaggttctgctgcagtgaggaacaacccccataacacggtgacttatacagaaaaagcttaattcttgcacatactacaagtccagaaaaggctgtcagggccctgttagtctcaatcagagatgctggaagatggaggatccattttgtcatgtgagtccatatcatgatgtcaggagaaagcagggaatccacctgcactggcttgtaaatctcccccttaagtgacagttcatgcttctttggctaaagcaagtcacctatctatgcctgaccaaaaaggagaaaaagcatcatccccagaaggacagacgaggaatatttaacaaagcacaaacgacaccacatctacacatgaaaaatgataataataacataaatatatgacatctgggttgctgggcaattacatcaaatgtaattatactttgcaaaaatttgatcttaaatcaaaatatggtggaattgcattcttttatgtaccagggagagaagatgaaaccccagaaatatcattcaattagcttgacatcttattttgctaaacggatgcctaaggaataagcatgcaatgtgcatttgccaagcagtatttatggattcccagacagtaaccggcccttttctcatatcatgttttcctgaccctctacatttggactaagttgacgcatggaacaacctccctgttccattaaaatacgatgcatatggttttgcttaaagaacaaactatgtactcctggtaagaaaatattagtgggatggacacagaggtcagggaatgaaagatttctgaaagggaactttcactaagaggagcatcatttccagaaagcctctgtgtcaaatgatgggtttcactcacaggcaaagagaggctgagggttaaaaccatccagaaggcacgtgggacctagaggaggccaacgtgcacacttttcaggacatgaaatacagctcctgttttgacacttgtgtaatagcatgttgttcaacctccttgtttctgtggggtttatggtccataaagtttaataacaatcttacagctgaacagagaatacatgaggctcgaaggccactcttaccaaagcggatctggatctaaaattctttcccccttggcatctcaacatttacaagtgcctgtctcttaatgttgatgtacaaaataatcacgtggcacaaggaaacatgaacgactggctgttattaaaacagctttgcaaaaattataacggagaaaattatgaaggtgatggagatctgatgtaactgacttatcttgcttctaacctccaggctgtcttgttcaaagttgatttggttgtaggactaacaactttgagaggaacttagtttacggtttaactttgaaacaaaagatgataacagcccttcccaaaataaacaaccttcctgcctggggactagactgcctttgcaggactaacaaatagccacaagattagaaattagggtttaggagtcatgctgccggaggctgcaagattctgacctccccaaattgctccaggggataatgtcactatggtaaaaccgaacatcagtacttagatactttgcagaccctgcaattgatggatcagctggcaccacccaggtcaataaattactcatatggtcttgtggctcccacccaggaactgactcagtgcaagaggccagcttcactccctgattccatcttaaacctgaccaatcaatactccccattccctgacccccttctactaaattctccttaaaaatctctatccctgagttttgggggagacttatttgagtaatataaaactctggtctcccacacagccagctctgcatgaattaaactctttttttttttttccgagacagagtttcactctgtcgcccaggctggagtgcagtggtgtgatctcgactcctgcagcctctgcctcccaggttcaagcagttctcctgcctctgcctcccgactagctagattacaggcgcctaccactacgcctggctaatattagtatctttagtagggatggggttcaccaccttggccaggatggtctcaaactcctgacctcagttgaaccaccctccttggctcccaaaatgctgggattacaggcatgagccaccgtgcctggacctaaactctttcttatggcaatccccctgtcttgataaatcggctttgcttaggcagcgggcaaggagaacccttgggcaattacactggctcttaagttgtgacactgccacacacttggccatagaatccggtgtaaaactttgaggaaatgaagattacagagccttgttatcctgcaatttgggaacataaactttcatagggttagtatgccagggcttcatccaaatacctggacaaatgagataactcgaaattccttcccaaagcctgcaaagctgtgcactgatcccagcctcctccccttctcatctgttcactggggtcaccaaagccccttgcagttggtgaattcatcgacccttacatgccacgggctttggaacttgctgctccctcgtctttgcggggctggtgaggattctggtagtcctgtttccctaggactggctccattacatttctagatctgttgaaatgggactcctcagagaaaccctcctggccccatctaaggtaatactccctctagtaacttacccactgtctttgctaaatagcagttattaaaactgcctttgcaaaaattgtaagagtaagaaattatgaccgtgaaagagatctgatctaacctagccccatcttgcctttaaccttcagccgcccttagtcattcctgggcttgggccaagctaactttggggggatatttagtacttatttaaatgataatggccctacccccaaactaaactgcctttgtaaagctagcaaaagacaccaagttaggaggaggacaggagcctgaattctgctaaagagtggacataaacgattgcagccattattccagaggttacaagatttgcaatttccccaattattcctgcagataaatcactttgtagaacctaaggttggccttctgaaatgtcttttccggcttttgcattttgaggactggtagccccatccccattcaactggtcctgtgccctgccccccacccagaagggattcagggcacaagggttttacacacccctatgattgcatccacagcccatcagcagacccattctcttgtccacaaaactatccttaaaaaaaccccagtctctgaattttcaggaagctgatttgagtaacaataaagctccagtctcccgtttagctggctctaccaacattaactctttccctattgcaattcccctgtctagataaatcggctttatctgggcatcaggagaatgaacccattgggcggttacgttatcaccacctgccaatagcttatttgcgtaatatttccgtgtttattcacagacacacacacacaacaatgagagcaccatggagttaggagcttgacatattattcctaacttcacctactgctggtttagagcaaatgaataaaacacgtgggtgataaagggtcagaagaccttgtcacatgatcaaaaacaatttcaagttaaagaactttcagagcttaaactgggcacatccatagagctgacaggataaggtccttcccacccacaacaaaatgcaaactttcatccaacagtaacctttatcatcactgaagctgactgcatggttttgctctcctgacttctccaggttctccctcttcccctgaaagatgtatattatgcagttctctttggaagccgtggactaccctgcaatcgtggcctgattttgcacagccaagtgaagagatggggacaaagacagaaaactccctgctgatgacagggctcctgggagagaattttagcttgggggagggttggggagggaaagtaggaaggagaggaaatccttacaggctatatttgcatatcaaagagcacttccagccgggctttctttgcccagtaacaagtcatcttattcaaggccaagaggctttcctctcaagctgccttgggctatgcctcctattcttccttgtggagacaaaacagcatggctatctcaaggcccagggagataactcacccaccagtggctctctgctgccccagatgtccctagatggctgaggtttcgctgaggatttgggtttacagacttccatggcattcccctcagactcctcagtttactcaaggtccctaccaagaagacaaaatactgtagcctatgttattcattcattcattcattcatgcgtcatgcattcatcccaaaaatacttatcaaaatattactaagtggcaagcatgcagctacttccccttttagctcttgggtcctttaattaatcaacataggtgggaaggagccaaggatggtgggtgctccgacactaatgactttgggccacgttttgagggggtggaaacgtgtttgagcaactagcatttgaaatccagattcccccttagctcatggttctaagaagttggttttaactacattgtataaataggatactattctgctcacatttgatcggctcatatcataaagggagttcatggtccatccttttattaatggaaggattctggctgggccaggtggctcagcatctaatcccagcactttggaaggggccacagctggagattcacgtgcatctcggagttgagtccggcctggtcaatatggtgagaccccatttctacaaaaaataaaaaattaacaggtgtggtggaacatgcctatggtctccactacacaggaggctgaggtgggaggattattgcacccaggaggttgagtctgcagtaagccatgattgggccacttgcactccagcctgctgacagagtgaaagcctgtccaaaaaaataaataaataagaattcttccaagcgtcctcaacagtcacttgatttacatttctttctttaaagcagaatttttcttagatttgcttatattggaagtaaatatgtgtgggctcaatatacaactgaaattagcacgcaattttctctccgcctcctcctcttcctcctcctctcctgagattggccatcaacctcatgctcaggcagcagcttggtgtccaggggtataacccctcatagagggtcagttccaaatcagagtcttgaaggcctcattatgcagtatgttttaagtgaccccaagaatacaagtctcagagaccacatttctagctgaaagcatgaagtggaaggaatgaaaatatattttctgtagttatataacactataggatgaggtactctattgggaggtaggacaaggatgggaagacaatttgaaaaccaacaggggcaccaacagggaaaaggaatgtaataccaataaaagaaaggtgtggtgcttctttaaaaggagaaaaaatggttattttctttcctgcacttaattaagaaatatcagtaacatagaactaagcgttgataaaaagaaggtgcaaaggcccgagaattttagaagtactaagtgtgacagatcatagatagggtgaccagatatcttgacatacgcctattgcccagcataattacctgctccccatcctctctcaaaaaggtgccagtgtggatgataaatatgtggtcactgtaatcatagcaccaacacctgggaggcaggctgacctggggaaggggggtttacatttccagtgaccatgccccacccagaaaagacatttatggccaggccggtgctcatgcctgtaatcccagcactttgggaggctggggcaggcagatcacaaggtcaaggaagaagaccatcctggccaacatgctgaaaccccatctctactaaaaatacaaaaattgctgggcgcagtggtgtgctcctcttgtcccagctactcaggacgctgaggcaggagaatgcttgaacccgggaggcagaggttgcagtgagccgagatcatgccagtgcactccagctggcgacagagtgagactccgactaaaaaaaaaaaaaaaaaaaaaaaaggcatttataaatcatctaagtgatgacatcacaagcacctgtaattgctaacttctgctttaaagaaaactctaacagttggactttacatctgttgctagtttaataactgcaaaagctctgcagtttcttcagaaaggtggaccctgatcccttttgtacgtggtgttccctaatttcagacacgtaataacagggtaaaggtgttgatgatatatgattatagcttatagggctgcagccattactacacacaaggaatctccattcattcgctgtgtggctggcccggagaaaatgacttaccactctgtaccttcagacccacctctgtaaaggaggaataacaacagtcccctgccacgagttctgagaactaaatagaatgttcctttatgaattatgttataaatggactggacttcagcatgattgagctagaaaggaacccacgggtgacttttctgagctcctgtactatgataatggatggcagcttgaagaagacacgtgcctagagcgaagtgtccaggtgcttctcaagtgaggctggggaatagaatctgcaggcagggaatctaaagccatttcactctgactcttagaaccaaactgaaaggaaacccttaactttccacgcctaagtaacaaaaggaggagggctactcttttgcaaccccttaccttttctgcagggcagatgggaaattgaaagtactctgagtggttttgctttttgcaaccaatcagacgtttgcataggagtgtaactttgtacttcacttcagcctctgatgggttgctgcccacaaccaatcatactgactggaggcggatcttcgtttgcataaaagagcaactctgtaatttcactttagcctctgattggttgcttccaaaaccaatcagatgtttgcataggagtgtgatatttgtaacttcacttcagcctctattggttgctttctgcaaccaataagactgattgcaggccaccacttcatttataagggtgtaccccaagtggccaatgggaaacctctagggagtatttagactccagaagattctcatccagggcccctgagtggctgcttgggccgttcccactctatggagtgtagttttgcttcaataaacctcagcttttgttgcttcattcttctcttgctttgtttgtgcattttgtcaactatttcttcaaaatgccaagaacccggacaccctccgctggtaacaaaaggactcaccaggaatgtggatcctcgactcagccgcgactcccttgcagctttacaagacactaggggaagtgtcctgtccttgctgtcttttcccttgtattttagatgggaagctaaaactggggggggcaaaaaccaggcccactaaggctaagcctgaggacagggcagaggaaagcacacagatttactttcattcttagaagacagtggatggaaaagtggatttccaccaacaaaaacctggcctttttccctgagcaggaaatactgagctgctgtggtcttgccctccctgcaagccggcctaatggtttagccatggtaaaagcgttgcagccaaagagagcagaagagaaactgggaagctggtgtcagattttctactcgggcatatctttggcctaggcccccgcagagtcacgggggaaggcctggaaagccgcagtctaacaagatgcctgacattgtgaaatgcttaaccctagcctttcatccacctcttagccttgcctctcccgcccgccccgcgtggcctgctggatacaagagaaaaagtcaccgtccccttgtccttgaggtaattaatcagcgggactctttaccctgggaataatatgcctcagaacacttttcattcctgtaatatcaatttgctgcagagatgcagttctgaaaaagatacaaaggcatttggtggggtttggtggcaagtaaccaggctaagttgttgacactacagcacacaggatggtttcagacaccaccggatagctgcaggctgcccgattctccagaagaaaaatgtttcccttgcttcctgcagaggtgatgtagatgctgtctgccagctctgaaatctgcaccatttccttctccaagacgattttccagctctcaactcccgccaacccagtaatttgtgttggtcactatttcatccccttctccatttcctaaggcaaatctgccacttagaaatacacacataatggagtgggaatgggatgatcagcccaacagtgaggtgcggagggacgcccctcacttgatgtacactcagattttaggagaggcccgtgtgaattcacgtcatccctcctctatcctgggcagcgacagacttgattgtacaccagtgtttagaacactgactacctcgctaggcgcagtggctcacgcctgaatcccagcactttgggagaccatggcaggtggatcgcttaagcacaggagttcaagacagcctgggcaacatgaaaaaaccgtgttactacaaaaaaatacaaaaactaacccagcgggtggcccatgcctgtggtcctagttactcaggaggctgaggtgggaggatgacttgagctgggaagcacaggctgcagtgaaccaagatcctaccaatgtactcgagcctgggcaacgagggagatcctgtctcacaggaagaaaaagagaacactgactaccagctacttatgaaagaaggagcaaaacagaaaatgaaacagaagtggttgtggggagagggaaaagaacaggaaaaaagagaaagaattaaagccaaaattccatccgaaatatttccgtgaaaatattcttaatgtgttggatattctaaagctttcatgacatagtcttattttcacaaacacatacttgtgatcttttgtcctcccacaaacctttggatgattgccagactattgctttcaaagttatgtcttcattcctttatctccttcagcacctattctcatggataggaaggaacccgactctgcattttgccctatgaaaatggactctgaatcccagcttgaaggagaaaggtaatactgggagaaccggaacttctagatgtgtgcaaactctgatacaagggttgggtctgaaagagagcagtggtccattctgtagaacatgttcttggaaacttcaaaatatgaacgctctggaaactgtggtacccttctagagagattaattagtgctcttcttgggaatagaacataaagagaatatgggatgaatctgtattgtagccatctcccacaatatcaactatcttttcttttttttttttttcaaaaaaaggctctgattaaaagtacaattttatttaatatcctcaaataaaaaagagaggttattacgttagcatgaccactatgaatattcttgaaagtggactagtagaattgttttttatgattccattgattcaaaatgaaaagtggcatttgccaacatatgatctgatgagtaatagatttacaaagcaaccaaagaggaaagacaggctggaagaaaatctatctgattatgactttgtggtttgtgtactggttacaaataacctgaaggcacgaaatatccaaattggaacctctgcttagaaaattcttatgtgaatagggacctctggggtttcttgaaagttgtgaggcaggatcttcactgtttcatgaatcactttcctaacaaaagtctcatttttaaggaaaaataaaaaacaaattatttgggtgcccagcaaattacagcacagtttttaataatatgagcgtgcatacttgagtgacagttcatttgggcttaaggatagatttcaacatgttcagtgtatggagaaaccaggctggaaactttccccttcagtgctgagctgacacaaaacaggaggagaaaagactttaatctcgtcataaacaaatgtacagtctgcatgaaggtttacaccctactctggcaaaatgatgaacggtttgttactgactcttcatttaaaaaaacagtaataaagaaataaaatagagaaggagcagcaacgctctctgaggaaaaaaaaaaaaaaaaaaaaaagtcaggagggcttgtatattgcacatctccgtttggtagcccaaggagggaatataagcttaaagtcctgaatttaacaaacctaattatcaagcttaattagtaccaagggtacagcttcatggaacacctgcagacttaatttatgtcctacagagaggaacaagtgttaatgggctgtatttatgttaatacctgaaccttaggagccgtggaacaaaacagaccacgcgctagttttccaagctacaacacaaatataaaagatttcgtcttaatgctgctttgcacacaattcttcagggatcacagagatctacttaaactttaaaactaaaaagtggaatatgaagaagtagagccgttctgggtatctgtaaaagtcttaaagatcaactcaccaactagtcatcatatcttttatttaaaattgacaatggcggatgtgccaatgttcccgttgttcaggatgagtgtttctcaggacgctgaaatataaacccacttttccacagatgctgtaatattaaaataataactaacatttatggagaactcactgtgttcagtcattgtattaagctcttcgtacacattttccagttacagataaaggaaagtgactacggggtaaataaacaggccaggtttctaggaagttcaaagatttggagttaggtttcggaacaaatccttttaaccaatgagctaaactccctctaatatgcagatagtaagaatagaaaaatataaaacatatatatatgaacacatttataaaagaactctcagcaaactagaataaattcaaactccttaatctaatgaagtataggtacagaaaacatacaactaggatccatataatagagaagtcctgaataaagcaatgatgtctgtctcaaaacctctgttcaacctgtcctacaggctatagccagtgcattaaaacaagaaaaagaaacaaaagccataaaattggagaagaagtaaaactatattcagagatgtagagaattctacagaatctatttaacaaaaggaaaaggtgaataaataaattttaagatcacaggatatgagagcagtttgctagatcaactgtatttctatatattagaaacaaacagttggaaaaaagaaattttataatgcatttacaatagcataaaaaaatcaaatgtgtaagagttaatttaacaaaaaagtataagcctccacattcaaaatcatcaaatatcactgaaatgtttataaataaagaagccttaaaaaatggagagatgcatgctcatggatggtaacgctcaacactttcaggattttgatcctctcaaattgatcaacagattcaataccaaagcaaataaactcccagcaaggctttttaaagaaatggagaagctgatcaggaaatatatatgtaaaaggaaagtatctaaactaacccaacaatcttgaaataaagaacaaagtttgaatccttattattacctagcttccaggcaacgagcagtaagtataagaaaaaaaattagatcaatggagtacaacagtctagaaatacaccacacatatatagtcaactgatttttgacaaagatgccaaggaaattgaatagcgcgagattagtctttgaacaaatagtgctagaacaattggagagtcttatggagagaaaaataacctctaccattacctcacaccatatacaaaaattaatttgagatggaacatagatctgatgtaaagattgaagttatggagtgtctagaagaaaacataggaaaatatttttgtgactggtgattggtaaaggttcttagaacaagaaagcactaaacaaatgaaaaagataaattgacactatcagtatttataacttctgcttttcaaaagataccattaaggaataaatagaaagacaaaggagaaaattcacagtacatatgaaaaaaaaagaatgtatccaaaatatattagaattcctataattcaatattaaaaagactatctaatttttagaaaatggccaatactaaacaagcagttcacagaaagaaaatatatgaacggccaatgagttcataaaaagaggattagtcactaggaaaatgcaaaataaaactagcaagagatagcgtttctcacccacaaaaggctataattaaaaagactgaaattacaaagtgctgatgaggatgtgaagcaacataactcttacacacttctagcgaggggttaaaatgatacaattactttagacaactgtttgcagcattcttacaagttaaacactaagagtcaataatttcacacctaggtatttatcaaaatacataaaaacataagggcataaaaacatgtatacaggatttatgaatattcgtggtgctttattcataatagccaacaaatataaacaacccaatgctcatcaacaggtgcacagtaagcgaattgtggtgtattttcaccacaggatactatccagcattgaaaaagagaaccctaatacacccatcaacatggatgaatcacaaaaacattatgtgaatcattaagcagaaacgacacatacaaagcagtaggtatgatttctattaaatgaagttctagaacaggtaaacaaagttacaatgattgaaacaagaatgcttgtttctgggaataaaaggatttattggaaggagaatgagatacttaccgacgtgatgggaatgttcttgtttttgtttttttggttttttttttttttttttttttttttttaaagacagtctcactgtcacccaggctagagtgcgcagtgccatcttggctcactgcaacctctgcctcccaggcgatactcaagcctcagccccagagtagctacggttacaggcatatgtcacaatggccagctatttttttcttttttttttcttttttttgtatttttagtggaggcggggtttcaccctgttgcccagactgatctaaactcctggcctcaagtggtccaccctcctcagcctcccaacatgctgcgattacaagatgatccactgaacctggccctggaatgttctatatcttaactggggtggtggatccatattatgtacacgtatacatttttcaaaatccagagaactgtatatttaaaatatgctaatttatagaacataaattatgtaaattatgtctcaataatatatgtatatgtatgcatatcattttctctctctctcacacacacacacacttctgtgaagagaattattccacaggccaattttatattagtaaaacagaccttacttttgagtgctacaatccaatcgacaaaaatcttgaaaaggttaagattatttatgaaaatgtttactaattactatctgagtacatcaactttgtggaaagagagtaggcttcagtgtcatatgtcccaggtcattatgatgcgtttgttctcattagctatgtgaccttatgcaagttaatgatcagcctcagacggtttttgacgaaggggtaggggaagcaacgctggcctcacaagtttgcggtgtggcttcagtgtgctaaggatgtagaatacacgattcagggccccaggttttgttattaccatcagtggtcccagccgtttttgataactttgtaaacaccaagtggttttgggaagccagtcattctacaatcctttcccaaatttttgtctctgaaaatgactaagcaaatttacaaaaacaattggaaacacttggtgactttttttttttttcaaatgggtaagtgcattccggatataattatgtttaaacatgattcagcacactttatttcttctgaagtatttctatttccttcttttataaaactactatttctatcttatttttaaagatcaattgcctgcatgttttcagagccctttcaaaatatctttggttattactcatctgtgaaaaggaaatttaaacaaagtttgagaactgtcatttctcaaaaaagacagtggaattgagtatctgtttcctgggatgttaagtcagcgcaagaccaaattcatgagattgttttccaaagagaagacaggagtaatacgaaagaatgctgaggtttcatgaactgtatcagcttcctggcatgagagcactcgactttatatagtcgatactg

SEQ ID NO: 5100 - DNA, 14082 bp, Homo sapiens
agatttacaatgggaccacaggtaagggggtacatttcctcccagcccacttcaaaatgaagttgcaaagagtgcagctgatcactttcattcaccttttgagtaacagttggggctgggctagggacgtgtgcagtgatgaggcatcatatcatccaaactgacagaatactgtcaggatgctataaagagggcaagaaatcactttgctttgcaagccataattaaaaataatagctgctgttcagagggagacatggtcggcacgtctctaatttaaaaccaatacagtttactggcatcttatgattatttatgtgtttcagagccctagctgcatccactaattttcagtgatgagagggagaggggttgcaagagaggaccggaaaaggtaactgaagataagctcgccccacaaggaaaacactaaggaactttgattgtgggggaaatggctttccgacccgaccaaagcttatcatttttctgcccctgcagggtttacattgtgaccatgcagggtgcttatagaggagtttccctcaaatggtctggtttgcaatcactatgcttgcattctaggatcctgggagagtcaggtccatactgagaaatagggtcccaaggaaggtgttacgacgtgaagatgtgccataaggcagacttgggtttgttgttgtcattgttgtttggttttagcttcttagtgtcaggatatctagtaacaatggagttggtctgaaaactgaatggtcaaatgcagtaagtgatacgactctgggcggggtgtggaccgtgagtgagacaaagacttgggttttgaaataactggctgcttgatgatactggacaagttccactggtcctgaatttgaataactgcatgacttgaacttaatagtagctggtttgttacctccccaatctccctccattatcatcccactccaaatagccagatattatcctggattcagctgtttcttttcccattgatttggtggctcaagtctaatggaaatgagttcatgtcatccaaatttcctttcactgaattatattcctaataaccctgagcttagcacctggcacatttatctaaacaacttcaaggggttatctggctcttctgcatcccatgtggggaaaagggaagcagaagtgcctctaaagacaattggagaattgagatgctcatccagctaactcaagccaagtattattttggcctggaatttagagttctggtggagatggtgttttgtatcaacttccagatatctgtcatatattttattttaccttgcagctgccaaaacgaccagagtggccaagtgacttgccattaactcccagtggtgggagaatccagctcacccatttcaagtccagcctcccgccctctatgccacatggttatactattcagcattcaaacgtcatgacagactggcctttcactgttctgccaacgtgaggaaagaccaaagcagtccgtttgggaaagcaaaaagcagaattcttcctaaccgataaaatattttgccactatgacctactgtaatgataccacgttgcactcttgcattatggaatggtatttttgctaagaaattctgcagtcccattgattcagaatgccattgttgaggagctggggacctaccttttccttccacggaatctaaaggcaattacaactggcttctttcatgccaacctacatttggctacaatgctgagagccatacctttttgaaaagcctactttttatcaggagatggctttgattcctttgccactaggcttggggtgatttaccatcaaattccatcacaagtggctctggctttgtagaacacagtacacaggaggggcacccgaagcaaagacgaccttctctactccaaaaatcaatcgtccacctttggcaaattctcctttcagattcatgcttggtgctcatgggtactcactctactttcctcccttgctggacaataagcagtaacaatatcttgttggtcccatacacaccacacctttggtctcttggagaatttcagccgtaccaatggcaacctctgagtgacatcttaatatgatcagatgtgatgacatttagtaacaggttctcatttttggctcaccagcttttcggcctacatatcatcagaatagactgaggcacattagtgaaatctcaatagtaaacaagcaggtactgccaataaaagaaaagcattcttaaactgattaaaaaaaaaatttaaagagcactttaatcaccatcagatactttcattcataccaccttttggggcatcagttcataatgcagaaaagatgaaagagcatctaaaggaaataatgttaacaactccgttataaaatatctgaagcaataccttgccattgtcatcaatgcttactgatccattgtgataaataataataccttgacatacaaacacggctggagctatgggttcccctaaacgatttttttttttttgagaatcaatcatttatcgaagcctgtaggttgtatatggttgctaatcatgggaaacgggggaggtgtctatcccgagcaatggcaatgagttaggttgttgacgacacaggactgagaatttctgggaagcccaaagaatctttttaatcatgcccgaatgccatttccgatctagtcaaacatttgtgagctccagaggagaactgtgcaatcaatcttgagagtatatgtaaaattacccaggactcttgttgggattaagagtatcttggtaataaggattcatcattctctttcaaaaatcatctgtagatttgcagcacaatcttcaactacagaaaggtgggatttagaaagcagttgctgttttttatagttgaggccctcagatctaaattatccatccttccaaaactcggtgttgggataaaatgttaagtagctgcttttcatcaacattcatttgataactgctagccatcaattttagttgtcagcacagaatacaaatgaatattgactcctttaaaggaaagggtacagaggttctgataaacaatatatggtaaagaaaaaaaaaagcacccacatattgatatttgtaagcattggttagtactctaatataatactcacagggacacatgttacaccgtgttttgcttcaggtttttctattttaaaatgcatgctcatttaaaagaaagaggagattcctgtcttaagtagacttaactatgagatatataaaaaatagacacaatatcatggcatatctatatttcaatgattgtgagagagtagatgttctaagattgctttcttacagggacattgcacacaaatgctgaattaatccacttatgcaaaaagtagagttatgaaaggaatgaaccctggagttagattaggcttggaacaccaagagcagggaaggagaacagcccttttgaagacggagtgttcccatgactaacgtcccaggacaaagtggtgatctgaagtgagcaggtttggcaaaaggaaagacacatacctcttcaaaccctgcctacttccattgttactcatctggtgctgttggacaaagcaaatacttctcaaatgcaaagccagccaccttatccactgactcttgaatacaccactaggaacagaatcatttatcagagagctacatttatcagagagctgcgcggtggagatgagggggtgagccctcatgtcacaggtggaatagatggccgtctacacccctgtctttccctgtctcccagtaacactcccccaggagaggctataaccactctcccgaacagtgcagaggtcatctccagatacctcggtgcttgggatacagccattcctcacaacaattacagcttcaatctctcattggaaacacaaatgaaagcaaactgctccaaaaggcacttgttccctactcactatccaagagcaatcttttaggggacacatttgccacaaatgcatttgttcataaagtaatgcagcctatacaggaatgaggctcataggcctccctggcaggtgaccacaccagtaagtcaccctcttcttccaccgtgatacttctataatgaaatttacaattcaatttggaataagtgctaaccaacgaacacaccaacttccaccaaaatgatggaagcagcagacgagaacagagatgtctactccaaagtcctcagccctgcaaactgccggctttttcagtgagttgtagccaacgagtactattcaagtgacatcaatgactagcattattgagaggttacgatttgccaggctctgcatggagagctttgtaagcattgttgcctaccctcacagagctctatgagccagggacagttagtatttccatttatttagagagaagctacctgatatcagagatcaaaagcaactcgtccaaagccatacagataattacgtagatgagtgacttcagactccgtgtccgttggtacatgaaacctgctccccaaatatgtgaccaaatatttgcacgtggcccatttcctcatctatgtcttccacggggctccggcttccttgcctctctgcctgctctgccgccttctcagccaggccatgtctggccatgaggtgatgcctaacatggcctaaaatgaaatgtgggggctgtcgtgtgttcacccgagaaatgttaaaggagatttttttttccattgatttactcatggagctaaattgaaatgatatccatttgatgaacaaaaatgaagactcagcacccccttcgatgatccaacagcaagtgacccttacaaaaaggtcgtccgattcaaaatgccatctccaggtgccagatttgcagaactaagaaactactctttgatgatagaattttttcaaagcaccgacatcccatacaagtgaagtggaccaacccccatcttatcagttcccacgcatgtaggtgcgggctctggagtgtttcatcagtttgcagagaaaatactgatccatccctctgactccctctcctccaatgattcctaacaagtcattcctacaaattcctgacaactgactcccacaaaggccttcaacaatccagcctagacacatgcaaatacttcctgtaggtattgaaatgtaactttcttcataaacctttggagttttgctaactcacaggctattcttaacctttattatagaagaggaatgcactcaattcccaaaaagaaacaatgaagatgatcaggaaagcaaatatttgttttcaggctttagagtgtgagaaagtgttctggagaatccatttagatcccatgccaactcttagccctccagagagaacatgccctccctaacaaattagacgtggacaatgtgtttagatgttgatctttgccacaaggaaaaatatttctttgctagcaacaggttcacaaaggtagaaaaacctcagctccttttcagttgcctctcccatgacaggtgaagagtgtcattccccaggtgacactaggacagtgtctatgacaggggcttgatggccgtggctcagagagagtaaagtgccagtcatcaccataaatgcaacaggttcaagcacagaccacaaccacaaattacaagggacacctgagagaaacgcatgcagggggaagagtgccatgcagcttttaaatgacaggcacgtgccacaggcttctgttcagagagaacctgtgagctgtcctgtggcctttcctgtttgcggtcagccatcccaaatatgatgcccccaaatccgagtctggctagaaggaagtgtcatacaaggccatgccattctccctgacaaaagacatgagtttcttgcaagagcactaagaagtttaagaggtggactcgaagagaggagaatgaattggaaagccagcaagaatgtggctcttctcctctgtgaaatatttgcaggaacgagcctggagaccagcaggttcaggatggaaagtggaaagaattctttcctaaaacttaagttttagagaaaaataggcagccagtcccaacacccaaaggcgtccaaagccatgtttgttctgggaaggccaaggcatgggaggatgttacttgggctatcagcaggattgaagggcagggtgaccttggtacgctgtcagggcctgtgttccaagtcgacaaactgttctgagcttttccatgaaacgagtgaagcccttttcatactccttcgtgttccagaattcttgccatcgatgttccaaaggatctgtgatagatttatgctagccttaaatgggacgagttgtaacattcagaattattttatctttctgagacctgcattattgtgagaccctagacatgctttgctggggttagggtgagggtactcctaacgaggaaggaaaaagaaacggcttcaaggcaatccatgtgggtcattacatgcacacttgttcatcttccatttgtgcctgcccaaagcgttctagaactgaccggacctgagaggctgtctattagaactaagagaaggtattgttgatgatgtcttatatccatggaagaattccctggcattccctctgatgctgcctgggatacctacattgctcaaagtacagtttctttatgaaagggatgaaacatcgcattggggtatctattcttccatggttggtttgaaatagccaagagaagtgccatagaaatttgccaacaaaataagcatctaactgatagtgtcgtccttctcatggaacaaatctgatggcatgtcactgaaattttccaactgggccaccttgatgccctgctaaaggactgctgggtgtttataagatataaaagaagatatttagtgtgtgtttattgaaacattttacatttttactctacttctttaacctctgttatggttatagctagctctgtactgcgtataaatgtatgcatctgtattcgccatctacaccaaaataaacctttgaattattgccaggcagaattaatgagctcagttctaacagcgcaaagaatatcttcatacacaggtaaaacaaacagcttctcccttcccttcttctgcacagaatggctctacgaagttgcctgcaaaattacgtcttttagaaaaccaagtagctggctgttttgtgagcagggagatttcaggacgaaccacaaacaagctgtttgtttagattttaaggttgacagttcatttcacgtatgccccataagtattctataacatagtcctgaaaaagcactgaagaaaaaaaaaaaaaaaacacaaggtctccgctggggccacatcatgggaaggaattaactcttaactcgccttccagaaacaaattaagaggatgtactttgcaataattcagatctcacaggtaggccccaatgtccagccccgctatttcaaatcgggcatgtctgagttaggtgtgtggatttcatacagagctcactggaacagaccatttctcaggttccaagacgctggccttgttaattttcatttagaacatactgtggagagtgtctcatttatattacttccataattaatggtatagcttaggcactgcctttacacagagagatctcttcacagtggtcgatgggtaatgaaaacaatagatatttcattcaccagcagcgtgttgctagttagtaggaaatgatcgtgttgctgttgctttaattgcccgggtaaataattctgcctcggtgttagtgagcattttaagcacttgatgcccatagactagaaacaaacaaaaattaaccttgattatgcaacaccttgcatagaaagttacaaaggtatgtctttttcaaagtttgcattctatcatgcaaatatttctaaatatgcatgtgctgactactcatctactgtattttaggaaatacaattaggctgctttctcttcccctatgtagactgtaaataactgtagatctttctcttgtttccctatgaaatatatgtaaatactaacaagctatgcatgctgctattctaggcaatttcaggtactttataatatgaaggcatgtacttgaactcgtttgttaacagaggggaaaaaacgctctcaactctttaaagctgaatagaaattaaagatttcttcctagactgttgtggcttctttttttgccttctcttgccggaatcgagtgccccactccagctctgaccttctcccagcaaaacacacagcacacacaggcccgggaacaacagtggaaggacttggcttgggctttttcaactttctttgggtttcctaaaaaacatctagaatcacaaggtaggtttctttggatcttctagcaaaagaatctcgacggaatgtaattcctatttgttgttcctttaccgtgtgcctatatcccaaaacactactgagggtcccgtcattcccatctcaacaatacggagactgagcaggtcaaggccaatgacaaaagtgacaacactactaagtgccacccaagccctcattcttcctgtatataataggtcagtaaactacttctgcaaagggccagagattaagtaatttggctctgtggcccatataatgtctggcacgatcactcaactctgctattgttgtgaaagggccatcgacaacgtctacccaaatgaacgtgtctgtattccaataaaactttatttataaaaaaaaggcactgggccagatttagccggcaggccatagtttgtcaatctctgctctcacacgattaagactgttattaaagactgagagcatttccctttttaacttgtgtgtttatggatcatggaaatgatttgatcaaatgaaaattcttctttttcctgcaagtgtcatgaataaacaggtgaacaaaaatgaaatcacctgagcttataaaacaggctgccttcctctacaaattacattgtcaaggtttcaatttagttatctttttgttttcataaatagggatgaagaaaaaagtcaggaagacaaaagtgaaaaaaaaacaggaaaaaagtaactgagcaacttcactcttcaatgagaggaaggaggctattacctcaggtatccatggaaaccaagcaggcataaactttttaatggttggaaaacagcgtttgcgtttgaagatgtttttcccaaattgatgcttcagtgtaaatgcattaattgacagtttccttcgggacttttttattgaagttccaaacttaatttgatggcacaagggactctctggagcccttgaagaatgctgcaaagtaggtctttagaaaaccgagccagctcaggcatcgtgtacaaatccaactctcttgcaagcaaatgaagaaacagatcttattccctgtaagtttcccatttaaaaaaaaaaaaagaaagaaaagaaaaaggaaaccctctctattcagctagggaagggagaggccctttctaaccctatcaagtgagaatcaatatcatctcttcagtcctggagggagctgagaatcagcaggggaagatagatccaggtatttttgcagatggggtggcaatatgggatggtaggaaaatccctgtgctgaagccagaagtccttacattggactcctgtctttgacacctatgacaagcactgagcctcagtctcctcatctggaaagtcgacataataatataaccttcatgtggttttggaaggatgagtgataacatttggccatttcctgggcacacaacaagtactagttcaaagcagctataactctgatttttacaagtttaaagcagctataactctgattatcacaatttaaagaaggaagcatacacatcaaagtatagatgaagcctgcacctccattttttggcctgccgtatagagactcgcctgtcacctggccccagcacctctcctttagccagaccatgagcccaggtacaatatcagcacagaggcacttgccagtcctttcaccatttctagattcccttccaaatcatccagagtttttcatgtctttgtccagggagtgtgaggctcaatactgcttagggagggttagtctaatcccaactgtaatggccaaaaaaaaagacgacgacgtggtgatgactgctggttactgagagtctcttaggtgccaacgacctgttattacttctattcgcacaatatcctcactccccaccaggcaggtgttattgtagtggaggggagacagggctaaaggaggtgaagtaactcacggccaagcaacggggcagtgctggaactcagattaaactgaggtctgggttcaaaacccatattcttgttgacgtgtaatgttctaactccatctctataccctttgtagcaccccagaatcatgcatacacttgaaaatctggcctcagattgagagcgggatacttatttcctgcctgggccatttgatccctctggtggccaaggcccctccacagaccagcagggacctttctcctcctttctgagctccatttctagtgcctaaaccctggcttcccaccaggcctctggcggatgtcatgtgattttgaacagtacagaccagaggggtctatggtgcctcccctgcagtgttctcttctgcaaattgctcttcgtgcaaagaggtcctgaaggctggcagggctcaggtgaggagcttggcatttgtggatcatctggcacaaccaccggggcagtctcacaacaagccagttgcaattggaactctctgcccccacagtaacagaaatgatgaactcatgacaatggggtacaccaaggaacatcttattcttctcctgcccctgccctctggctgccatacctgttaggattcatcctcttagaaatgcctggcaagggaaggcacacaaatgcacattgctactcagggaggtgtcagcgaggaacacaagccgttgtgtagctgaccttcgaactgtcaaggggttgaaaatctgtcctctaccagtacacctctggatccctaatcaaatgactttacaaggcagtcctcttcatgtatgaatcccataaggggccaggataccttctgtgacatgttctaggtggcaaggtggagaattttagctgactcttgcaagagccctatgaagttactacagtctcattgtattaataggaaaactgaggtcaagtcagtaaatgacttcataacataattctcaatgatgcagttttgattttgtgcccctggcggcctcctgctaagagattcgtgtgtctttgacgctttctgtgagggtccacctacgcatgatagatcctttagggggaattctgcacacattatccccagttaaagacagggaggcctggcaccatggctcacacctgtgatctcaacactttgggaggccaaggcaggtgatcacttgaggtcaggagttcgagaccagcctggccaacatggtgaaacctcatctctctaaaaatacaaaaattagccaggcgtggtggcgcacacctgtagtcccacttacttggaggctgaggcgggaggatggcttgaagccaggaggcagaggttgcagtgagccaagattcaccactgcactccagcttgggtgacagaatgagactccatcttgaaaaataaaataaataaaaacaccggggactgaagcccaaagaggcaaagttttctgcctaggtcaaagagcagtgacagagttaggagctgaaccaaatcacatggctctagacacccagtctcaacaactcactatgataaataggaacatgtccacagcacaagtgaagcaggaacatagcacaccttaggtcaggattttgagccatcatcatagtgacctttcaacaacaaagactagcaaacatttatgagggtttctggttcacattaagtgtttgatgggtactatttacaatatttataaaatatggtatttccatctaaccaatgtggaatcaaaagtccagaaaagttaagcaacctccccaggtcacacagctactacgtaggggtggggaaatttggacctgtgtcatctgtgccttgaccccactgctactaagcatcctgagccacagaaatcagacactcacaatgcattgtcaattatcccgtagtatgattaatgtctctagttaggttgctccaccaaggggcaccgagactcttaggtttgatgtgaaaactgcagtggaggccagggctttaattgcccatggaaaataataactcaaaccagtgagcagaggatgcagccatacccatgaaggagcaaaaaagcgggaggatttattttctttacttgtttttaatcttactcttttcttttctttactttctctttttttgagacagtctctctctcactcaggctggagtacagtggcgcaatctcgcttacatcaacctccgcctcccaggttcaagcgattctcctgcctcagcctcccgagtactgggattgcaggcacatgccaccatgcccagctaatttttgtggtttttgttttttttttagtagagacggggtttcaccatgttggccaggctggtctccaactcctgtcctcagggatccacctgtcttggcctccccaagtgctgggattataggcatgagccaccatgcccacccattttctaaagctgctcttgttcctcagattttggtagatgaccaattgatttaaatgttgtacacataagggaagatttataactgccccagatttcagttctccttaactccttgctttcctagaggctgggaagcataacttcctgctgattggaaagtgagagccttatacaggacacaagatccctggagtcctgatataaggacttcccatcatcatggtgggatgaactgcctcccatcgtcatggtgggatgaaccttgccctttgtcctgggtgtttgtgtttcaccacaatccgtagcaaacattgggaacaaataaataaattaccaagcaatatgttttcatgtcattacagaactgcctttctaaagcgatcaaaaaagcccagattatcaccacaacacctgtttgtggcagtgaggaatctaatgaaatggtctgataattaaatttactttccatgaattgctttgcttaaaggacatgtctacaaaaagcagggttggtgacagtggtgtacagtaagtgttcaagaactcgctcactggaggggggcagtgcagggggtgggtttgattacagtgtctgccaattcccatggtatgaatactctcaccacaagcaatttaaactgaatcagagttgggaggaaatgtacacactcagctcttggaagctgctatgatccagttctagagtcccttggtgatgacctgtggaatacagctgtaagaatttttgaggaagatcaagagtatgataaaacagatcaggacctcaaggtcataaagccattgggatgtggtaggcactggggaatgtataaacccaaaccagcttagggtacctgaaggacagaatggtacagacttggaattttaagcatgtttcaacttggtccctataacctaaaagttgactccactcaggtactcccctggcccaaggtaactatacttcctactgggtcaatatgagccctaaatatcatctagaaacggtgcaacgttgcctcagttaatactgcagcacctctgcaggtagataataccccatttcagagatgaggagactgaagttcaaggaattgaaagatgctcagggtgacacgaactcccgaaatgcattgccaggattcagatccagatctgccagaccttagacttcatatttccctagctctccagggaattgtgctccctttgagctctgtatccttgaaaatagacatctctacaacaagtgaaatctacatgttgtaacaaataatttggctccccctaaaaaaaaagtctctcattgggggagacaggatctgaatccctgggggtctggaggtagtgtaaggatgagaactggagggtgggggaagaaggaatggagac

SEQ ID NO: 5101 - DNA, 12700 bp, Homo sapiens
tccactgacatagcaaaagaagatatcctcttagctaccattgacacaggagatgcagaatctcaataacctctgaagtctctggcacactaaaggacagcagtgctggtgttgctgagctcctgcctttccacgtaaaaaggatgaagctgatatgagcaattataattcctccataaatccaatgtccctgctgatgaggctgtccaggtcactgattccattattcctgaggcgaaatccctcctgctcctgaagaaagcttcactactattccagacataactgcccttgagaagagaaaataaccgaaattgacctaagtgttttagaagatgacaccagtgctgtggcacattaactgactctgatgagaagtttatcactgtgtttgaactcactacctctgctgaaaagacaaagataaacgggaagatactctgctaactgatgaagaaactaccgagggagcagtatttggatggagagagatactgcaaatgaagcagagacccattctgttttgcttacgctgttgaatccagatatgacttcgttgtccctgcatcaatagctacaaacctagtggagaatcatctacagaagaagatttgtctgaaactgataatacagagactgtacctaagatactgagccattttctggaactacctctgtattagataccccagactataaggaagacactccacaactgaaacggatatctttgaactactgaaagaagaacccgatgagttcatgattaaaagcaacaaaagggataccatgtagaattgtgcaatagtctagccagctagccttacatctaagaaatttttccaacaagcaaaaacctttagaaatgaaagaatgtgggcatttaggcaagtattcgactcaataaatgcagatgcttaggactacaggtcatgtaacagattacggaaacttagaaaaaaaaaccgcagtgtaagggtccccctagtatcacaaagtttcatattctaacaattacttaatgtaaaatttttcgtcctagccttcagggagtatgaagacgagcaatgtaggggctcatttctacaacatttaatgatgcatatcatttagttaacagtaatattatacttaagtgagaattaaggatatgaagagaagcaaattaacctctccaaaaattaccatagcctaaaaagttctcccaaaatgcttgttctaagcaattttttcattagttttcatcagtgattctcttctatttaaaaaatttttaatcctcatataagaattaagacattcagtaattgtttagcacccacatgtaagatacataagatttatgatagggttcttgcacatgttagatacaaactaaagcaaaatgatattttacaaatatgcatatttgtcagaaaatgttctgtaaacatatacatcaatttaattttctttctgttaaaatgtgttttctgatttttgtccatgttttccaggtcttaaacactgaatatcacactcttcttatgactctgttagcgattcaaggacataaatcttcattcttttctggcacagactacttaaatgggttgttttcactttgctcatttttcttcaataaatctttttggcaagcaactgatttactggtgtaggtgtgtttgatattctactacagacttctcaaattaggagaaataaagagaaagaaaattcattgtttgtttaaagaataatatagctctaatccccagaagtaaaattatttatagagattcataattgtattacactaaaaaaagaaataagaacaatgccaaaacaccagtgaatgaaagatattatgtacggggggtttgtatagggatttgcaccattagataaatatagactagaataatcacaacagtgtgttaaaacccagaaacaaattacgaaacaaaatttgttatacagtgaagtggacttcaaaaacatgggatataatagttaatcttacttgacaatcagtatttgggaaaaaaatatgttggaataataaacaaatttttaaattctttttagaccatactttaaaataaattctacatggattaaatactttaatgtaaaaactaaaacatacaaaaacttaggaggaaatgtacctgtatatctatccaaatggacctgagaaatgtagcatatatgaaaaggtgataagaagattgataggtttgacaccatgaatagttaaaatctgaaacaaagaaaattaacataaaattaaaaagtaaataactaattttattttacatacagtgaaaagattactatcatttttctataaaagtttctacaaagtattttaaatgaacgtagaaattaacataattcatgaaacacaaattgttaatgaacatgtgaaaaatattcatagacatattcaaaaaattaaaataaagctagtacacatcagttttagccatttgaggatgacagtgattattgtacatattcattgttgactcattttccaaactttctccaaattttccagcctttctggaaggctggaagccaatttggcaatacatgtagcaagcattttaaaattggaagttttggcccagttattttacatattttacatattttagccctgagaattttctaagaatcagaaattattaaagttccagcagttattgagctctgactactggtcagcaagttgtgtttatatttagaataacatttgatcctcatgataccctagaaggagaaacatactattctcattttagtgataaggaaacagaaaagctactcaacatgcaccaagcttcaagttaatatgtagcaaagaacgcttctaacccaggcagtcttcatccagaacccatgctttttaatcactatactgtatgggccctcagatttaaatacaagaatgttggcaaactctacactgaagaatgtgattttacatgttcataagggaaaaacactgaaaacaatctacaatgtagtcacatgtaattaattacacttctgtatacccatatgaagccatagcttgcatctttaaaatggttctaaggaagaatatttaatcaaatggatgatattttcatacaactctagcaaatttacacagtggtatgtatgcaatatacacatgcacacacatacacacgcaagagaatgtctggattacatatatcacaatatataatctctaggaaggactgcaggtgatttgtttcattctctgtgctttcgtgcgtttttaaatgctctccaatcatccagaacataactgtacacaggagaggatgaatgtttgtcaaccccattaactagaaaacctggaagccagctaaatctttcactcttacttgcttcccatacccaattaaaatattacaagtattttggtgttccctatgtatcagacactactttatttttcatttacaaggcatgtatatgcaccactatgttccaagcaccatgaaagtgttttgagacactgtagtgaatcaaatgacaccaccctgccttcatggaaattaatctaccataaaagacaaattttagacaatctcaaataacacacaggaagaaatgactacatgcaaaatatggtgggtgtttcaaagaaaaaacaaaaattataattgcagatttcacatacatttaaggccaagaaattgtctctgagggggtaggtttaagctaaaatattgaaaaatgtggagagataaggaaacaacatctccaaatccttgggctagatttttcaaggatatgaacagacacggtatcagctggaacataagatgaaactgaaaggtaggaaagagagaaattatacagtacttgttaaacatcctggatcttatctgttggaagatattaaaggttttaatcattttatcctcaaaacagtcttagtactgagagcatgcctagctgaaaagcatcattattttataaactccaactatacttctttcaagggcttgtttaggaaaataacttgatagtcccctttgcttggaggagatgaggctctgaggcataaccaaactgcaacagttaaacaattaaaaagataatgtgctgtacaatacaagttaacaaatttggggctagggcttagaaataacaagaagaacagcacactggcaattggttagagccaggaagatgagtgtccagtgagattcctggtggtcaatgaacatttttccaagaaaggtgcctaattatgtgttttaccttgcgccatttcaaagcaaagtttctccttgccctgaatttgattaaacgtctgtaagacacaaggtcttaaatatgcacttcttgaaaaaataaaaaatataggaggcaaagaagaaacagataagtaattagagaatgaatatgagacagtcttcttcccaaatattctaaatagtgatgacctgagaaaggagtgatgggcatacagtgagagacatttagaatagtcacatttcacagataaccaaagtgaaacagaaaagtcactggcccagataacgatgctagtaagtaacaaagctcagctccagagacttgagtggctccaaattcaagttcaaatcacactgctttgtgtgaactgttgaataatgaatcattccatctcttatcataacccttccccttgatccattcctgttgccactgctttggttaaggctaatggtgtcttgtagctggtcatctcacctctggtcttgtatttagcaaattaattaagccccaagcactcatctctaaaccgttttgctcactccctgttcccacatgccttgccacagtcagaagaataagcacatgaaccagtcagagcaaaggggacaagaggaagtgctttggggagctctggggaataagtttctgaaggaaacttctgtctaaagacatttagggccgggagctctagaatcaccttggatgacaaggagacaggttgcttgacagtaaagtgaacactgaggtattagagacaagaaatataaatatgaaataataaaagaatgtgagactagtcacatccgtagcaagcctaactagtctgcttatttacctgagacaatgcattttctaattaaacaatttgggttatgttttttgttgtttgaaaccaacacaccttaaaaactgacaacccaagtatttcaagtccctgtgtctatttatttatttatttggtagagacagggtcttgccctctgcctggaatggtctcaaactactggcctcaagcaaccctcccaccacagcctccctaaggctgagattatagtgcctgctgttctcccagtgccacagtctcatgtggtaaatatcgttttcatattcacctcacatgctatcttctttaaccacccctcggtatgattacctgttggtatctcactatatacattctttaatcacactacctataatatttcattgtatttacttataaaagatcctcctgtgtcacaagataatcctacccatagtttcctctgacacatatactctgtccaaagttccctctgtcctagtgtaacccctgtttataatccccactgtacccttccctacagataaccttaccctggggcacagcactatcctccaagtcacagggagctttgaccacaaaaagagagggagagaagccaatcttaagaggcaaagactcctgaccatgagaaagaacgttaccctgaggagattcccaaagttaaactagctctacatgaggatgcataaagaacactcataacttcaaggcaccaagaacagtgggaaattaagccagtgtctttgagtatatgtgcttccaccaattctacctattgcaaattaggagtaaacaaaggatacataattacattttgagtctatggcctttattttcattacagcactactggtgtgttgttttcttttctcacatgtatttcaaacataagagaaggctgaattaaaattggcatttcccttcctcaaatttctcctcttctaatattctccatctcagcaaaaggcactatcttcacagtgtccaagccagaaactggggatcagccttcacttccctctcattctccatacctaataatacaaagtttttaccgtggcattctaaatacagcagaaatccatttgccctccttgccatgccatttctttatccaaatctctatcaagcaaaagtggaagtttattacacaaatatacatatcacttccacctcctaattcaaaaaattatccagtgactttccaccaactttaggtgaactccaaaatctttacgatattcatcagagtcaccacaatggaaaccctgcttatcatgcagccttgtaatatgctactatcagtttctgttctgaaatttcaactatatagatccattttgatcatccttagaacataaagttatgtcttgtatcaggatcaccgaatgtgcttgctctccctgaaaaattctgtaactcaccttttaaagtacacctaaatgtcacttggtagttatatcctccctggaccctaaatttatataagcccctgtattcttctgtcatatatattcacagtacactataccttgctttatgtagcatccataattatttcaattgcatgtttattacttttttcacactactgtaacaaagtgccgcaaactgggtggttaacaacaagaaaatctatatcccccacagttctggggtatataagttgaaatcaaggtgttagcaggacatgttctctctgcagtttctaggggatttttttcttgtgtttcttcctagcttctgggaccaactgctggcaatccttggcattccttggtttgtaaacaggtcattccactctctgctccttgtcacatgaggttctcctttgtgactccatgtcaagatgtctctctatttataatacaccagtcattggattaggctcatcctaatccattatgacctcatcttaacttgattcatctgaaaagacaccatttccaaatttggggtctcacaattactgggggttaggacttagcatattttgcgggggaggacataatttaacccataacctggttaatgcttattttcctcccagactgtatatctgataattaggatgatcacatcatttgttatgaaaaccagaactttttgagactgaaagagacaatataataatgactccaaaacaacagctgtaaaccagatgtcctaatagagctatccacactgtattcaaagcaaagaaaccagacactattgttcatgctcaattctgagagcttggaacacaatagatgctcaataaacatctgttaaataaataataaaatgtaccagtaaatgaggaaatgatgttttcatttattagactgaatgctctcgaagagagatggtctgtactagatgattagaattgaataccagttggccaagacaaaaagagcttgctggttgcaagctggaaaaggggaaggtcaaaaacacagaagcatgaaggcattggtgttattaataactatgaagtaagcacaatgggtctgagtataaatcataacaaaagattgtaagtgatattacagctttacaagcaaatcagaaatataatcaaattgtatcaaccatgcatattaggcaggattctccagagaaacagaaccaaatgggatatatagaaaggtgaaaaagccaggctgggaattcaggcaagagttgctatggcagtattgagtctgaaaccacaggggaggccagcaagcagaaaactcagaaagagttctgtgttacattcttgaggacaatttcttcttttccaggaaacctcagtctttgctcttaaggcctccaactaattagtaaggtctacccccattatgaagggtaatctgttttacttaaagtcaactgattgtaaagtcacagtaacacctagactagtggttgaccagacaatagggcatcatagcctagcctattgacacagaaaattaaccaatcacatcttgtgtagcaatttagtgttaaaacttcataaactaacagcccatattccctgaactagtttcactgaaattagagtttcagggtaaaatcattgatgaaatattggaatgaatttcctggagtctttaaataagaatgtatgtaagaaggttcattcagctctatcgtcatggagctctagtaaactcctctaaggataatgttctgaacatgttttgggaaatgcagatatagacaatgggaggcaaccaaagttttaagcattgatttgcatgttagattgtattttagaaagataatttcggtaaaaacataaaagttggatgggtgatcgaggaagctaaaaacagagatacaaccaactatggcattcatgtaagaaaggaaaataaagcccaaaagaagagcaagaatcagtaagaataattattaacattttaatattatcaaggtattccaatcacactgttaaacaaaatgatgatgtaataaagcatgagctaactacacagactcctcgacatgaacattttacgttgaaatctgaaagctctgaccagcctgttaggtatggtaggtgttcctagccaagttttctaagcaagaatcttgtgtattggatcctgacattttctcttagtctacagaattttacattagaatcatttgcaacaaaggaaggaaagaaaatttatttttatatatacatatatttacttggtcaaaagcattatatttacctagattaatgccaggaaatctactaattgatagagccacaaaaatacctaagacagctctctctgtctacaacttattcaccataatgattagccagaatgtctcacaacaaaagtaaacatacataagaatatcttggtgcagaggaaagaaaaagctgtggagaaaaaaaaatggattcaaatattggcttttgaaaatatgagcaagttattaattttctcaaattttgggtcttcccatacaaaattaccatctatgaaaaagcacacggatctagatctacatcctgtttatactttaggttgttctcattgtttttagtgatcctaaaataatttttagaaagtagagtaaactgaaaatccaataaccaaagagacgttgcacctagtgccctccaatttaccttgggataaaaagtctagaggtccttctccgttctttcattcatcacaacatgaattaagccaagaggatataccactgttaacagctaacttgaaagaaaagcattgaaaatctgatatccaccagtaggttttccagatgatgtttttctgtctttctggtaacaaacaagggcatttcatggaaattaaagcttgcatcaaagcaaatgtcaaactactacaatgttcacatttgtattggttaataactgtcacatttcttctgagcaaggtttcttctgtgatacaaaaccttgtgtaataaagaattattctgaatctagtggtaaaagatgtatagtaaggggtctcaaatggttcattagttgcctttttctctttcttttttttttttttttttttttaagacaggtctaactctgtcatccaggctggagtgtagtggcatcatcacagcttactgcagcctaatctcccaggctcaggtgatcctcccacctcagcctctgaagtagctgggactacaaagcacatcaccatgtccagataatttttttaattttttgtagagacagaaaaaggtacctgcccagctaatttttgtagagatggagtttcatcatgttgcccaagttggtctcaaattctgggctcaagcaatcctcccacctcagctaattcttgcgttttctctagagatgaggtccatcatattgcccaggctagtctcacactcctaggctcaagcgatcctcccactttggctcccaaaatgctgacattacaggtgtgagggccctttttctcatttttatgttaagaaatgtgagaaaagagcccattaatgtttcagttgagctaattttataatctctaaaaattacttcagcaatattttactttaaaaagccaaaaatgaacataaaagaagctatcattttaaatactttctcccagctcagaatacacattagcatataatagccaagcattatattataatagcagagtacagttaaaaagaaagaaaacattttaagccttgggtttctggtcaagttcattaattattgctttgcaataaaatgttaagtaatatctgaaatgaaggaaagagtgattcaatgtatcacatttaaattataatgaataaaccttcactttttctaatacacagtaattaaccatgacgttcctgaaaaaaatgaaaaggacaaatgttaacttttaaaaatttacctgtcctttttttgtttcaggaaatgatttggattaacccagaggcaaaggctaaataataataataatattttgcttcacaatatagaagggataaaggagagaaaaaataacctttataaggcacgaatcacctgtgctctttcactgagcttccagatttcacaagctgagaaaggctgacatttctggacaaacaaaaagaagaccccctcgttacagtatctttttttttaatttcaaaggcttaaaaatccattttctttagtctttgattatatgcagtttctaatagtggaagtatcatgaaatctcagactgctttccacataattccaacagaaaaaaatgatttgaaaggaaatactgtaaacagaaaaaaaattgatactgatttaataagttctcagctactagttttatccatttttaacagtaaaatggtaagaatttcaggaaaaatgataatataaaaatagcctgtcctccagaatctcagaatctttaaaatggccctttctagacatatgccatattttagttttgaacctataaaaatgaaaatgttctcagtggcagaaaaatcatgtactaaatgatgcaggaaatcattgggcctgattttatattagttgattgcctctatttatttatctcttttgttacaaagggacctacatattaattttgaaatgtgtctcatatttgcttgagattatgactgtttcatatggaagcaatacacttgttaatttggttttctatcttatttttggggtattgaaatctgaccacttcatcaatcaaaaaataaatcaccttatttaaaaattagaaaaataggcctctgataggttaggtaatatgaccaggatttggcaataaagctcttagctacttttctttgggaaaaaaatgaatgttagcaaaaaagaaaaaaggagagagagattcattattgaagtatcatgtgattgcaaaattatgaagaaagaatattttataatagtcttcaaataattaccatttgagatggatttgttttttacattttgtttgatgagagaattcagaagtaatgattgtatcaaaaaaatgaaagtttaacagaaatactaattttaagagttatttgttgataataaaattaatgctgatggtaaaattaaatgagtattcatatttctaacaatatatgtattttaggttatgagttaacattaaatttttctgtccgtgttttaagtatgtaaggtgaaaattagagtcagaagatcattttagtggaaatttctaggttttttgtgtgtttaaattatgatatcaatagaataccataaatttttttgagaacgaaaatccacacataaattacacaatcatctcatatctaacttcatttatgcttacattttctgtcatctatgtggataatttacatatagcatgatatttaaacatttaccttattaaacataagcatttttcaaatttccacaaacttgtatgattatgagtattgatgattatggcattcatatttttaattatgattatgagtattcatatttttatgattatgagtattcaatttttaattatcagtaacactgaaatgaacacaattgggtttgttctattgcttaattgttgaggatgatttccataaattaggttttgaagttacaggtatcaacattttcatgttattttgtgtattgttatacggctattaaaaaaattagctaaattaatagaactaatggtgtgtaaaaggtcatataccttaccacattctcaatcttattttgggtttgccttcttaataactgtttagtaatcataaaataatagataaaaaggtaggctcaatatttgttttcctacaattaaatgagaaattttgtcaggattcttcatttactttatgtagtgttattagaatcactattcttaacctttgctcctatatgttgaactccatgtttttcttttaaattgtagttcttcttatgccatagatatgatatatgccatagatatgccataatagacataagtgttttccattggttaaaatttaccaaaaacaaatttttatttctttttttgtctcatcacaatgaagctgcttggttccagaggacccaaagacaagatgaaggctctgattttgtttgaatcattttggtctttactgcttacctcacagttatataaaatattttacatatatttatttcttattcagttc

SEQ ID NO: 5102 - DNA, 26757 bp, Homo sapiens
agagatggttccaaaaacttaggctggtcgatcaggagggtttgtcttagggtttgttaaactcgaaaatgcccccttgaagcaagaaaagttaatgtcaggcctgaatcaaacaatgtttccttccaggccccagtctgtccataaagaatgtctgatccaaaggctagaaatggaagaacaggctattctcatgctttatcatgaccctgtcaacagcttcttcggaaagaatctcattgcaactgacccattaaagagtatcagtcattttctccacaacattcctatgtttgagctgcaaaggaggttagaataatttagaacaaaatcctcaagttactgatgaagaaaaggtccagagaaattaagtgacttgcccaaggtcactctgctagtgaagggcacaggcttgttggagcccaagatctctggctcccaagaactgctttttccattgcatcatttaagaagcacaaagctattttcctggaattgtgatttaaaaaaaaaaaaaaggtggcatgcccttggatcccaagtctcttcctgtagggcaatgctggagatagtatttattgagggggaaccagagaaatgactacaatatatgcaacattttatggatttatttttactataaaaagatcctaaacaattgcaaacattaagcaaattattagctgctcaaacttttctggaacaacaagaaactctctcccactgctcagtagcagttttgggtcataacatttgcacctgcttggacgtttccacctgtgatgtttcacttggcccctcagaaaaagcgctgccctgggatctttgattcagtgatgcaagagggatgttggctggtgagaaatgcttatttgagagggaaggggaggaggagaaaatactcccatagcacttttctttcttattttccttattttagaaagccaaatctgaacacattttccatcccatgtagtaatatatctcacataattttggttacggagggtacacaacacaaatctagcaagctttcaaaatcgatgtgcccagcctaaattgcgggctgtcactgggactgtcaatgatggaaaaatgaatctgtgtctgagaacgccacacatttcctccaagcctttaaggaacacactacccaaacccttgtcacaccgggttctcagatctgcaagctgcagtcccgtctttcatttcgctgtgagctccctcacagcccaggagatgcgttttcccagctcttacctagctctggtgctttgcagtaaagtgtatggagcctaggcactttcaagccaaaggaattccccctccccccatgacccaaaacgatggcatccgcgcactcgcaggtctctctccctcccttggttgaggggggcgggcaggaatcgcgggccaccccacctggcccgcaggcccgcagccacgtgcgggactccctcctgctcgcggatctcagaccggaagacgaaggaacgtggcctcgtagtaaaccgtagtaaagagagaagggaaaaaaatggggctcgtcacatggttacggcctggatttttctcaattaaaaataagagcaatgtgtgtttccggcccccgtccgtgggctggttggactttttcattcttaggattctgaccaaatgcaagaatacagctgagggcacaacgtcctcagtcggcgggcgcggtgcagaggggcctgcggctcggcctgcgggcacccgcgggaaagaggtgccaggcagggtggcagaagcggcccagggacgcccgcccgccaccaccgccaggggacccgcggagagccccgcccgcgcccgccgcggctcagccgtttcacatgctgattggctgtggtgggggccaatcagccccaaccgccccgcccgcccgggacccagagccgcgcggctgtgcccgagggcggggcccgcccgccagcgccgaccacgcggcccgggaaggggccccaccgccctggatgacccgaacgggcgggggcgggagacccgagggcggtctggctgcagattcccccaccccgggcgaagggggctcggaagagggaggagaaggaatgcaggaagcggaggtgacccggaaaagggaagtgccagggccgagagggtttgcgccagccaaaaaggccacagggctggggaaagggagggaggggaggcaaccttggaggtacggaatccttgacatcacaaaaaaggaaactgatgaaaaagaaatggaaagagtctttttctgttttttttctttttcttttttcttttaaaggggagggcataacaaagaatgacaaaaacaaaaaaactgaacccaaaaggcatggctgggtctgtgtctttgtcagctgcagtttcaaaactaaaagataaatttgatgccaggtaaggtggcagggctgctatgaccgagtctgagaggctctttttgccctgcttcttgggctccaatttactctctgcagagagtgggccacaagtactgcgaaattctgaaaaggagcaaagaaaaaaaggataatgtcaggaacatgaaataagaggtggaaacaaagggatggcagggatagtactagaaaacgagcaagccagaactaagaggctatgcaagagaaagggcaggcaaaaaggtcactggactacaggtaaagcagacaggcttccaacaagtagagctcctgagccagtgcttcacaagtgttctcctcttaacagacaatgaaaaattttaaacaagccgagagtttcaacagagcccacgcctcatcatacctctattcctttcaccgagtctcaggttttcctgagaaatgaggaaaagaagcaaagacagcaattgctgaggaagtgaggaaaataattttgcacacacattcggagcagaagctgtttgccactcacaggtctgacttctgtctgttcagatagctatagaataacatctttggactcaacagggcacaggcaagcaagcagaatgaggatgtaaatgtgccaggtagcatttggtgcctcactttaaacaccaacacaaacattcaaatacgcattgtagaattttcctggcactgtgcaaagcatggtcgattgttactccgaattattagaaataggattatatgattattccagaatattttattttcccaaagaaggtaaggatagaattttgtagagtttttgtttttttaatgcatccaacacataggagaatttattttaaagccctttttaaaaatgaaaattctagttggtcatcaattctcttcagagcaacatcatttattctactctataaaaagaaacctaaacaaattaagatgacaagtaagaaaacttattctctttatctcctttaaaaccaaaattttagttctgctgggctggttttctcaaattctcattattttaccaatgaggcactttataatacaaatgcttaaagtgttgaggattctgactcccaaaaacatcatttgatataacaagatttgtactactgatgttgattacacaattaaatctttcttctagtgaatgatgaaaataaatgttgaagtaaatactgacaaataaatgctttttgtaacatatcacccaaaatcttcatttgagtgttcatataccttttcttgttctataaaatagagaattatatggatcaaatattggaaacagaattaagaaactatgaacacatgataaataaatacctgtcaataggaaaccagggcacagattaatttttatgaatggacacaaattaagaaaaatcagtgcttttaaaagctcattctgtggagcaagataaaattcacaagataatcagtttgtcagagtaaagtgtttccaaatgctggaaactctgcattgccaactcatcacattatttgcaaactgtactctcttctacccacaattataccaccagaaaacaggatcaacagaacgaagggcaggctaatttcctattacaaatgttttcatttttaatacggcattagccacagaagacctaaagccaactttcagcatttactgggtgtctacttttgaacttaaaggcacacagcaaataaccctaaaagtggagggtatacgtttagcccttctactcaatgcaaaacaaaacaaattaaggcatgttcctgacttagtagcattcttctcaacaaataaaagtaattttacagaagatatatagtagcccccaaatgaatctgtaatgtctcagtgcaagaagagataactataaggcagacatcctaggatgaactccataactcttaataatgggtcccagacacatacagagtttcctgcatatcctgtacaaagaggccaggcccgtgggatggtgggtcggtgtgtgaataatatttcacaaatcctggtcatgaacaaaaggagaacgtcacccataattactttcttgagagatcacaaaatagatagtacttctctctaaatacatatttctaaaaagctcttactcctgatctttttagggcagatgaatagaaatcaatgcttcccgctgctgtttatgttgccctagtattatgaaatcacgaacaaaagtacagagaacaacttgataagatcacccttaagggctcccagaaactattagatagtttaagataaggaagggtttagcccctgtgttaacaaatattttttgtagaacgtcccttccaggggctgacctaaatatatagtgaaaagaaaacttcaacaaacaaatcagcttcttacggaggaactctacaaaacgcagaactggcataggatatatgttttaaaaaactgcagtaactacttcacttgggaattctcaaacgaaaaagccctcctgtggctgctctacatgtttgtttgactctctgccagatgtcagtgtggggtgagcatcttgtgtgccctagaatgtaagtgcattctccctgaggaagcagtgggaaagaacaggaaggggcagaggcaagaacagaattcaaggacaaggttaaaagcagttttgtcttctgactttgtcaccatgaacgcacctgctgtgatgtccagttgagctactgacggtcctctggctgcttctggaaatgatgctggcataggcgcttaaatcctcacttgagcggcgggtggagctgctctcaccgtgcccaggggttgatgagggggtgggggtgggggaggctgcggttcaggggtgcactccgagggcactgtttgaagtccttgaccaaatccaggtctatgtagttaagaccattctccaacccccagcagccccacacagtttggctggctccttgggggctcccccaagctccccagcctcagccacacattctcaaaggaagcagagctgtggcgtttcacatcctcgctgctgtgctgctaccgccaccgccccctactgctgcccccgctccaaagggcactgtgttgccccccgggtggcactgggtgttgaggagaaagtctcggagctatgcctccgccggcaccctgtgggtctgcacggatcactttggcactctggttgcggttaggactgaggttcacccggtgaaggcgctcatgcccccaggtccttgtgggccccccagcagggacgagtgggcagccgctctgctgccccttgaggcccagtcggggaagcagaggctgctgaggatgaggaggcacagccatggtggccctgggcaggctcacctcctctgcagcaatgcctgttcgcatgtcacatagcttacaggggcagctggcgaggtgtccacgtagctctgacggggacaactcatcgcatggtcatgtagtcaccccggctgctgggcactgcccgggtaggcctgcaaatgctacagccccgggaggtgcagggcccagtctgcccatctcgaccccagtgctctcctgccagctgccctccggcccggccccaggtccatcttcatgtactcctcagtgccagtctcttccctctgggagctggctggagctgggatggacacctgacagaaggtgagctgtggaaagccccgggccagacaagtagccagactgatcactcccaaattcaatattgacatattcccccggctcttgggctctggagggtgcagcaagggctgctgctgctgctgctgctctcgggccgaggtaaggtgctggccttgggatcccccagggacagcctcgtgggccgggccaggcggtattggtctgagcagctgtgtccacctttcgaggcagatggggctgcagaacctgatggggggatgtggaaggctgggctccagcctagccccgcagtatcccccacccaggctgtcgtgctggtggaagaggaagaatcatctgctgttgcagcatagagaaggcgaccagagctatggaaaggcggaggtgctgatgccgggcaccctcctccggctccccggggcgctgggtggcttaaaggatcttggcaatgagtagtaggagaggactggcttgtgctgggggtcctcaggccgtagtagcagtcggaggggctgctggtgttggagtcccccactggtgacatgttctgtagtcacctgtgcaaggtaagagcttaccaccgctgctctccactgggggtttgggggaggcaagacatgagagtggtggccccctaccccgtttgtccacagctttccatagctgtcccggaagggacggcgttgctgctgctgctgctgctgctggggccacctccaatgtcagagagcagccaccgctgggggacatcatcatgtagccattggggtccactctctggggaggcgtctgatgggattgatgatctgctgtggggcagatacgctcttggggctcatgggctatagtctccactgccctttcggccactgggcactggggccacccctggggacatgggctgtagccatcatccgtgtggagggtggagctgtctgggcggtggtgccccccccgacgcccaaggggtgcatttccagaccctcctctgggtaggagcgggtgggcacgaaggcggaggcctgtgtcccggcagtcggcctccactgccacctcctggtgggtaggcaggcatcatcctgtgtactcctcaatggaagccactgaggactgggacggggtcttctggtgggtaatgtaggggatgtgcctgccgagtgagttctctttcggaaccgattatccagatctgcagcatggctgcttcatccccagccaaggctggactcgtgcccaagcctgttcctggggtgcagggtggccattgccaccccgagacaaaatgtagtgaccgttgggggcggtcagggtggaggccccttgccacccatgcagatatagttgcttagctcctcctcaccgcgggctggtgggtgtggcccagggaatccggagtgacactgcggaaggaactccggaaatcgcagggactgagccatactcatccgaggagatgaaaccgccatcgctgggggaaccagacaccgaagcatagatcgccgtgggaagagacaatccgaggtggagccatggccactggtgctactggacacagactgaccgggctggtggccgaaggcgagcagcgggaagccggcatggggatggagggctgtggttgagcggggggtgcagccgggcgctgccccgatgccggtgggcgtgggtttgttggtgctgggactcacagggctgccgtccaccgaggctgggcgggacatggtgcctcgccgtcactggaggcgcggacacggaaggagcctggcttcccgcccaccatgctggccgggaggtggcggtgatgctctcagtgcgtgatcggcgggtcagccccacctggctgggcggggattgttgagatggtgccggcgcagggggacgctgatggggttagagcagttggacaggactggctcttgctgcgagggcggaactcatcactcatggcccgcatggcctccaggtggtctcgtgcatgttctgggccaccacagagtcatccacctgcatccagaactccccggccccgtcacggcagaacggcccacctcgatgaagaagaagttttccgagtggccacaggcctgatgttcatcagctgcagcaccacggccgctgcctccgagttcagcttcacgaagtgatggtcttgctggtcaggcaaaggcggtagataccaatcaggttctttgtctgacccggcccttgggcttcaggatcacttgccagacctctttgaatgcgggtcctgggggcacgcaccgtagctcaagtcctccccagcctcaccaaggccggagctgccgctgcagctgccccaccacctcccgccccgagggccgcagctccgtcgtggtggcccttagcacggttgtgcgctgtaggagagcctggtaccagctgtcttgctcggcctcgctgtccgccgcgatggcaagtgctcgtcccgggtgtagagagccaccaggtgcttgttcttggagtcagcccgcttgtgatgttgaagcagctctcaagggggatcgagcgtttgggggcgctcgacttgtgccgcacttcttctcgttctcgtagtactcgaggcgcgccgggcccccagcctcgctggccgcggcagtacgaagaagcgtttgtgcatgctcttgggtttgcgcaggtagcccaccttgcgccgtccgagaagccatcgctctccggagggctcgccatgctgccaccgccaccaccaacgtgagcagagggaggctccgaaaaacaaccgggtggggggcggaggctcctcgccgcggccggcacatgcaaacagggctggaggcagcagaaaccccgactctgaaatccacgccgcccccgcgccggggaggggcagctgaaggaggacgcagctgctgagcccaggagagagcccaccggagttttcgggcgcttcacgcccggcggggaggcagtgcgtccggggtgagggcaccccgatcctccgagagccaagtctcctctcagccgccgccgccaccaggaaggagcgagatgcatctctcgtcgccccggctggagtccggcacagggaggcgacagtcgggggtcctgcggtgcccctccaggagcgcgcgcgcgcgcgcgccttccctcctgagttcccctctgaagcagcgattcccgaggcaaattaaatatccttgggcagggggaggcgggttgccaagcccaacgttgcacggggttctccctcctccttcgcctcctcccaccccccaaccgtcccgccgccaccagccgcccaaataccagctcagtcgcagagaccgcggcgctgcggctgttctgttgctgctgctgctgctgctgctgctgccgccgcccgcgggcgcgtcctctgcagccccatccgggcccatctcggcgggtggagaaagtggcttttccatgcgaaacgataccggcagccactgcagctggggaccggccggagggacagactcatccctgcccctcgctccagcggctggggaggaggggaggggacaagggcgagaggggatgggggaggtttgggaaggttcggggaagacgcctgttcctcgggaggcgctgccgctgcagttacttctcccctcctcctcctcctcctcctcctcggagagttgccgagagccccaaccaaaacaagcggcggcgctggctctgcgcgccggccccctccgaccgcgccgccgtctcactcggaggagaaaaaccgtgacggagcctccgcgctcggcagccgggcagccgccgccgggaggctcccgcccggtctctacattccgggccgagcccgccccgcgcccgcccctctccgccccccagccgtgcgcagcggcgcccgcgccgaccccggcgcagcgctaggacagcgcccctgcgcggccgccgctccggcgcagcgcctccctacacgcgcgccaaccggggcgcccccggcccgcaggaaccccgcggcgggcgcaggcgggggtgtttgggtggctacccgaaagcacgaggggagtcgggaaaacgggagggggcgagctcgggaagacgcaggagtgagggtggggggccacggggggcactgcggctacagagccccgagtgggaggccggggggaggcgggggcgccggagcgggctgcctcttacctatcaggtaagactgacccacgggagggaggtttctagtcaaggtgtttcccccaggaaatttaaaagctagatttcggcttcagggcgataggccatggtgagggatctgtattttttaaggtttttctaaaggacttctgggccagccttccaccttgggtccccagatttgctgccgtgaggtacctggaaggaacagagggacgcccaagggcagtgctgggggcagttatggtcactacaaaaggagaacagggatccccaggaagtgtctcacgccggcgctgtggaattagttgctgatcaagtagggagaaaatgtaaatatcaccttttccctgctccccttgcccatccgtgtgacggggggactcacacctaaggctgagggcatggggaggggaaatgagaggtcccttatcatattccgaagtctatccgtgactttaaaaagcgttagggaccttcagagggttcataaggccaaaaccctactgtgcaaatattggctgaatgtttgtttcacacacagctcccacacccattgaaccaccctataagtttttaaccttgccacaaggataacagggagaaaacaaggatggtgccagctcaactgtacaggaaaatggtacttcatgagtggaccagatcagcagcctgggtctacttgaagcgcccctttcagggtaccttgcggtatcagtctccccacaaacaaacgctccccagagtttttttattttttaaccgacctataaacaagcagtttgtccctgcttgctcgcctggcactaaggacccacagaatgtcactcggtttaatgctgtctcattttgatgcctggcccgtttggggttgccgccctttactacgccgggaccctcctcggcctcaggctcccaggcactgcaggatgctggctggcactcagcagtcgaggcgctgggcatgctcagtggctgggacccggcgggccgcggggagcgcgcctcggcccaatgcggctgaggggcggagcgagtttcccggggaggcctgctgttggtgggatggcctgtttttcaagccttgcactgcagagggaaggtgggggtagaaggttgagggtaccaaggtaggttgcaaagcgtagtaaaaaaagaaaaagaagatgatgatgtgaaggagaaaaagaaccataggcgccattcaggggtgtgcgatacgtaaattagggggttgggcatctgcagaggggctcctccccacccaagcctgggagcctctcgtttctcctcccccttcctgttcccggtcgtcatgcagcctcatctaaacctggttaatctataatttggtacacatgttgaattgaaagccctcccttcttttcctctgacagcttggtgatgtgggacacgtgcccactacagcaaggctattaatagcagatatttggaaatggaagcgaggcgcactcacagtgaccgaaattctgggggtatagagtgccttacagggggtagggcagggagtgcagaataaagaagcctgaagttggtggaaaagtgtaactgtgtgcctggttttacctagacaagaaaaaagagagattataaaagggttgtttactagtaacaatgtaatccagaaaggccaaagggcttttcacaggtttgatgtttagcgctgggatgggggtagtggagtattaacattttgtaagacaacaaatcaaatccatggacatttacttttcaaatggccctgccctacctccgtccctccaccccccaccccccaaaaaaagctaaataaaggtactgtactctatgggggaaaaatactcttttctggaaggaggggagggttggaaaatttatttgcagtacctcacaattatcttcataggaaggattttgatcataaaaagctaattatgataataaccttttaaaaaatatatctctcagtgttaaagcatttctgctttaaaaaacacaattcagttgctaaatattcgataaaaattatgaaataagcctcactgctgtgacaaattatgtcagaccaatgggtttcctatggaagataatcactgatcataggatattagtgccatttttctacttgctgatgttttactaccaatttaaaggtggttaatatttgttataattatatacagtaaattcaattgttctctacaattgttttattaatgggctaactggaaattcattacatttggttcatgtaatatatagaatagaaagagacgcgtttgtgggaactcactgagtaatgctgagcaggtatgggtattattctgtcacctaagctaaattagtcttttggtgattgtaatgaaatacactgtatgaaaaatttactccccactgaaaattcacggaacagagaacaagctattaccaaaatctgttgctcaatgctgccatctataggagagttagagccatttgtgtaatatgctaaggttcattttaaaagagggctaaaatagtgatttcatcacacattgcaacagctacgttgatgtcactaatacagtcctaattcaaggagttaagggtttcatgctatggacgcactttggggcaataggtctacaactagctttaaaattgagttattgtttatgtatgatactatcaggaaaataatgcaaaatttatagattattacatatatcttaaagtgcttgagttgggtggatgtaaaactaaacatttcaaaattataaaacacttttgtatcaaaacatatgttttccttaagatgtatgggtcataactggaggagctatttaaaactggcgtctcttagaattaattttggcaatttagaacagtgcttgaaggacaattgaagtggattttctcactttaagatctgtttttattttaagatggctcaatagtaataagcattgaatgcttactctgcaaggcaatatgaaatagataaaaagacagcttcttacagcttgatggggtaataagagagtacaaaataacaatagttgatgactaaaatgtgtgtgtgtggtgtgtgtgtgtgagagagagagagagagatgtcaaataacaagtggtatttactttcagatggatgaaataactacttaatttttacagaagagaggagccttaagcttgaacttgaatgggctataactcagataaatggcaattattttttcccactcaagttttttggaacactacttgtgttaggcactaggctggacactgaggatttagatatcaaagacatgctgccccaggaaacttacatcgaaaatggcagatgaacacaattgcagagcactatgatctctttgtggaaaaaataggcacagggcaaatgagatcacataacaaccaactgccttctgacataacattatcagttacagacagtgcaatttgggaatctgaaaggtgcctcttcccttaaaactttgttttctcatgtaattaaaatctttcatctgttttatttaaaaatatataaaatggccaattaaaagagagctgaaaagtcacacttggcttgtaaatcggctagatcagggctctcaaacccgaggatcttgttataatgcaggttctggttaaatgcagaaggtcaagggagtctgaggcagtgcatttttaacatactctaggtgatgctgattctgctgggtaagtacatagttctaatgactgatgattaattgaaagacaataatttggtgctgtgacatgcaacaaggcacttatactttagtattatatacatatacagagagaacaacagcaagaaaaatctacttaactgaggcttcattgtatttgggcttctctcttttcaatcacaggcatcaaactttctggtaagcatgaagagttattatcaaacagttgtgttagtgttttccaaggtgtattgaaaatggagatttcttacctcatcccagtcctgctaaaccaaaatctcttagggaggatgggccccccagcattcacagtttaagcagcattacaggagattattatttacatcaaatttaagaatcattggcttaaacacaaagaaaaaaatgtaattttattcttccagaatggcaaatgcacagccttaaccagtcaacaaagatcttcacctgtgggctgtttactacgctgggtggagcaggcaatgacccaaacctgcatgagtctcccaatatgaattgattttctttgaagaatatcaattactggcaatcagctagtgagaatccagttctgctctcatctgatttcatccctcatctcttctagagaactgagggaaaataaatgcaccaagaactaactgggattttggaaagacagtaatgccctcaacagatgatttcaaaacatttgctgtttgggagcaaataaagcatgaaataaacaggtggatgaggttggaagaaaggagggaggtgaaactccatgccactgtttaattctttcacttcagaaattctactgattgattggtgattggggagtggtgaagagaatccataactgatatttgtctaaaaaacttggtcctggtccagcatagtagcttatgcttgtaatctccgcaatttgggaggcagaagcagaaagatccttagcccaggagttcaagtttgcagtgagctatgatcatgccaccgcactatagcctgggtacagagtgagactttgtctctaaaaataaataaaaagacaactagctttttcttttttattttcttgatttccttaactattatattctcattttcttgtttgataagaatcaggggttgccagtcaatttgttatcttagacaatgccactaatgtttttggtcatttaatccagaaaagaacccccagctgttttgtttgtttgtttgtttgttttgttttgttttgaggcagatcttattctcacccaggctggagtgcagtggcgccgtctcggctcactgcaacctccactcccaggttgaagcaattcttctgcctcagtctcctgagtagctgggattacaggcatgcctaccacgcccaggtaatttttgtatttttagtagatacggagtttcaccatgttggcaggctagtcttgaacccctgacctcaggtaatccacccgccttggcctcccaaagtgctggattataggcgtgtgccaccacacccaaccactgtttctcatatttgaagagccaagtttatatctagataagcatatgcttagaaagatttgcagactttacaacaccttttgctgttttgcccccttctttatcttaaatttgtctttttggtgcagtgcactctaaactttctaatttaaatttatatttaaaatctaaaatttgatagcccaaaaatgtcttcacagtaatcctcaacttcatttgtttattttttaatgtgaatttcagtaatgatgaatgtcccatgcctctattcagtgggcaggatctagaggtagagctagttggttttactgttggtcatattacaaagaattgctaggtcaccatgtccctctcattcttctcacatcccctcctcaattgaaggcaaatcatcataactttttctcagtaatgatggatattccgtgctctctattcactggcagggtctggtggtagaactagttgatttcactaacaaagaattgctgggtcaccaggccccctcattcttcccatatcctctcctcaactgcaaggttaacgaacatctctctcctctctttcttcttcttctttttactgggtctcatcactccaaggttctttattttaagaagaaaaaaaaaactgactagaagattaaggacattagttttctgtggattgggaagatcaagttaatttgaacttaagaaatttgtaattgcatcactacctgtggtgttgtccggttgactctacaagtgggcagagggttacccatatcagaatcacctgtggaattgttcaaacaaagcttcctgtgtcccacctctgatccttctaaatcagatcctctgtaggtcaatgttagttcccccatttcccattcccacctccatgagttttatgtatgctaagatttgaaagcactgatcggcctatctctaaaatcctagattacaaatgaagacattaggaaatatatgaatattaacctccagcaactgtcacaagtttggtcaatagtttttctgaaatattttacgcagtgactttaaaacttttgaccatgacctgcagtaaaaatacatttataaacacattaacatcagtgcgcacacacacactcagactcacttacaacgaaatacaacttacccttatacctgcaatgcactcagatctttttactctttcttatctctctttctctcaatctcacctttctctttttcttttaatgctttctaagacccactaaattaatttcctagcacactaggtgtcatgacctacagtctgaaaacaccaactttctatatgaatatttctgaattcaaaacagaacagaacaatgatcatctctagatccttggatgcaccaccaattgaactcctaggaggaaattcacaatgcttccaatggattcgagtttacctaagattatttttggtactaccaagaatgattttttcactgcttttttttcttaagtggttgggcaccagtctgtcccactaagcaatgaaatctgatgcacttacagttttcatacagtggaaatctgaagacaggaaaaggcaaattaagaacactgaatgtgattcagttactattttaaaaaatagacattttcatcacttcccaatattatttcattgtgataattgagctaatgttgtttgctatataagtattggaggaaaataagttagagattataaatgtatttaaaatatattcttgtaaattgtattttatttttgcatcagttttggattggggttaaaggagaaaatagtggttttctttataaagaagaaaaattttaaaaactgcttaccaggaatttaaattattagttttattataacattagtttcataaaaactagataaaatgttgctattttgtatttcttaatttaccaacataaatgtctttgattcctaggaaattaaaattttaagggctaattccccttcattaagaaatatttactgtgatgaagacatgttccatgcagaggaaatggccaatgcaaagacccctgactggagggcatttggcacattctaggagagtgaggaggtaagtgcagtgggacagagtgaggaaggggagaataggaagaagcacgcttagtgaaataacagtggacacaacataagggatcatgtaagcctttgtaaggactttggttttcgctctgggaggggaaaccctggatggtatataatacagcagtgacgtaatctgacatattttaaagacactctgggcgggcgctgtgactcaggcctgtaatcccagcactttgggaggccgaggcgggcatggtgcaggcacctgtagtcccagctactccagggggctgagtaagtagaagcacatgaaccagcaggtagaaattgcagtgagccgacgtcacgccactgcactctagcctgggtaacagaggagactctgtctcaaaaaaaaaaagagacactctggaagctctgttggaatagactgttgggggaggacaggggtagtggcagaagcagacctcataaaaggctactgcagaaatatgtcaagagatgatggtcattcgtaaagatggtgagaagtagtaaagttctgaatatatttgagggcagcatcagcagaatttgcaggtggtatggatgtgacatggaagaaaaagaatgaggatgactccaaggttttttttacttgtacaactgaaaagataaaatcaccatcaactagacaatgtatcagttttctatggctgggttaagaaactactctaaaggaataattatgaacatcaactcttttattatgctctaggattctatgggccaggaattcagacagggcacgtgttgatggcttgtctgtgtcctggctgggatggctcaaatggttgtgggactatttgcttgaaaggctggagcctggaatcatttgaaacattgttcactcatgtgtctggcacctcgttagaatgactgaaggctacatcaactagagtacttacatccggtctctccatgtgattggacttttcacagcgtggaggctggatttcaaaggtgagtgtctgaagagagaccattcgagagttaacatgccaagagggagcttctagagaggaggtgttccaagagaatcagaagaaattgtgtagccttttatgaccttacctcagaagtcagagcttcatttctactgtagtatcctattgatcaaagtagacatgagcccacccagataaaagggcagggaacctagacacagttcttgatggaagtagtgtcaaaaaaaaaaaaacttgtagtcattgttttaaacaccacagattgaaatactgtggctgaacaggaatggggaagatgggggaagatcaggagttggttctagacatgctgagtttcaggtgcttattgatcctccgagtggagatatcaagaggcatttgtgtatataaaccagagttgaaaagatgagtctgggcttaggtataaatgtaaggttgtcagcctatgagtaggatttaaagcccatgatactggataaaatcatcaagaagagaaagtagatagacaaaagaagaggacaaagatgccagcaagggagacagaagaacaccagtaaagttgctctcttttaggcaggaagacaccatatcaggaaaaagagagtgaaaactgagtcaattgctgctgatggtcaagtcagaagaagacttggaattaacataagattagcatcatgtttgtgttatgtataagatattaacattgattgcagatgcccacaatgttatgatctgactgaattctttagtggaatcacaaaagttcaacatactcagatgtgtacgtaggttagtagagtttgtagggataattatggcaacatattttatatttcctaaataatttaacttgaaaaattcctatgaggacagagatactaaagtacagtggatgctatgtttgtctcactatgcaatttagtcttgtctctaagattagacttctaaacattcttaagatttgagaaagagagggagagagagagacactcatattaataggaaaaattgccaagatatgcctaatttttaaaccaaatattttaaaatattttagacaaaagtttatatctaggaatcacttctagatttattagtctttactgatttaaaactttacaaaataacaaataatagcttcacctttttaaaaactattttaaaagactaatgtaaggtaatttactgcaaaagacaatatcaataccaacacctagttttaagttggaaaatgtgaaataaaatcttatgtaaaatcatcaatacccaacaatataataataatgtaacataaaattaccatgtcattggtgggaacacaatttactaaagtgtaaaaaccataacataactcttggaatctctatagaactacaaatatagttgatgcttgaacaatgcaggcattaggagtggcaactccacaaagttgaaatctgcatataactttagactctccaaaaacttaacttctaatagcctaccattgaccaaaactttactgataatgcagtagattatcacatattttgtatctgcattatatactgtattttaaaataaaataatctagagaaaagtgagtattgacggggcatggtggctcatgccgtaatcctagcattttggaaggctgaggtgggtggaacacctaaggtcaggaattcgagtcagcctggccaacatgacaaaatcccgtctctactaaaaatataaaaattagctgggttggtgtcaggcacctataatctcagctacttgtgaggctgaggcaggagaatcgcttgacccagggaggtggaagtttcagtgagccgagatcacaccacttcactccagcctgagcaaagagcaagactccgtctcaaaaaaaaaaaaaaaaaaaaaaaaagtgaatgttaagagatcataaggaaaagaaaatatatttactactcattaagtgaaagtggagcatcctaaagacttcatcctcatcatttccagattgagtaggctaaggagggggaagaagaagagggcttgtcttgctgtctcagtggaggcagaggcataagaaaaacgtggataaatggatccatgcgttcaaacccctgttgttcaagggccagctgtatgcttaaacacatccctgggggttgtaaactaatgttactgttgttttcattttgcaatttttccatcttgatataaaagcaaaataaagctaatctatgtacaatttattataggtcaactgagaatggcagaggactcatccacctttgccacatggtgacttgccccactcccccaggtgaccttgctcgtgcatgtggaatttgctcagattaagaatgtttcccacaaaattgcttactctctttcattctgtccgtgttgcttgtggtttatttgttgataactgagactatttaaagattgccaaaacaaaagcatttcttttctccccgaatagcctcattttttctattccctttttcccctcctattaactttctggggactctaaagcagagctcaagatggttcaggaccacggagagcgcaaggaagggaactaccaaagcactttagtcatgcaggtggggaaagagatgatcctaaaattgttttatttttctgtttttttgagagggagtctcgctctgtcacccaggctggagtgcagtacacgatcttggctcacttcaacctccgcgtcccgggtccaagcgattctagcgcctcagctcctgagtagctgggattacaggtgtgcaccaccatgcccagctaattttttgtattttagtagagactgggttttgccatgttggccaggctggtctccaattcctgacctccagtatccacccccctcagtctcccaaagtgctgggattacaggcgtgagccaccacgcccagcaatagtggaattgttgccggacaatatttatttaaaagacattattgtaaagagtaacgtgtaattctggctccttgaaatttgaggggaatgatttttctggacattcgaccagtgtttctaaatttctccactgaattctatctaatgacagatgagaggacactgaaagtagggtagccataagtcaccagtgcaaaatgtcttttgaagtttgcatttattgattgctacctttatgtaaagttttacagttttgacagtcatagggttcaccaatccaccatagaagagattaagtcatgcggacacagcagggtttagaatggatgagtagaggagtgtgtgcaggcccagtccccaaagtctctaggactgtcctagaacctgcagctcatctgtcaattctgtcactactcaggatcctctcaagaattatccccccatacccaccttttaaatttcctcaagtagtttcatttgagttttgtcacttgcaactgaatgagccctgctaatgcagatagattaattgagaaggggaattctaggctaggagtacaaggttacaggcaaggagacaggaacaagcttgggatttcctggggcagtgagaaaactgactttaaaaaaatggaatggtttctaaatgtttgtacaacttctctgtatggcaatggggtaggagtataaattctttcagcttctctgagggcagctgaacaagaagtataaaaattttgaatgctgataacatttgacctagaattccatctctagaaataaattctacagtagtaatcttaaaaacgtattcactgaaatttattttctcatagaaaatgtcgaaacaacatatgtgtccatcaatagagaacttgctaatgatttatactacctttacatattgaaatacgcatagccgtggaagataatttagtagtctatatgtcccattatggaacaatccccatggtggggggaaaagtaaggtgcagaacttatcatagatgttctctctctctctctttttttttggaaagcacatgtatgcttttataacacagaaaaattctagaatggcaaacaagatatctttgcaatagtttttttctgggagggactcatttaaaaaaattctcccatattgcttgttttgttttgttaaagacatccatgattcctacttgggttaagccatgataactaaatatgattaaagttcagaacaataaaaacttagagatgtatacataaatatcacttgcttaggaatttctaggtaggtactattttagccctctacatatattatttcattcaatccttggagcaactctaggagggaggtgttatctctaattgcagatgaggttgatgaagcttaaagagtaatgatgccttgagtccatccttggctccaaagcccttgtatttaactgttctcccttttgcatccctgtgctaaagtgacttgctataatatccacaaggaagaatttctgtgtaaaaattagacttccttgcaggcagctatcagtgatatccaataaagactcaataatggctaacaatacaaaccacacacacaaaaaaacttctccttttgtgccaggtacttagattaggtgtagtggttttcttaaactgatatcaaggtaaacaccacctcatacatttcagcagagagcagtggtttctctctccagcgtgggagccattgaatcaggacaatgccacacagttgggctttcatgttagatagatcatcttgtggttttgggggatggcattataagagaggagactggagacaggggggctattgcatgcagatttgttggatgtccacccagcattcactttttccatcttttgccaggggtaactacacaacatcaccagtcatttcatagaatggcaattagattaggcttaggtctgcatgccttccttcactccgctctgtcacttgccatcattgtaaatgctgacaacttagtgctttcatgcttcaagtatcaataagataggaatagtaatagtatcacattgaattattgtgagttttgaacagatgatacttgtgttatcagtgctcaataaatattagctgtcctcttcttattgttgttgtcctcaactatgtattttaaatgggattagtcacacaactcctcattcccccacccattaatacctgactcctttgcaaaacaaagcatagcatatggtggtgggattacaaaatcgttacagaaatttcatatgtaaaaaaggggcaagagttggccagtttgcacttccttaacctattttatttttcttaaatattacagtatcaccagatatactttcttttatttcttctctgagagtatgcaatttgtctgatgtgttgcctgctgtttttgggtggtgataaatatgagttctatatagggggtgaagaaagcattccatgagtgggactgtataacaatggagaaaagtcatgaaggaaagatggcattccatgtggactcgagtaaagtgacatgatatcttgtctataagggggatcatacatttaaagcattcagcaacctgtaaccacacaacagtctttccaagaagaagagagtatgagcttttagaggggaagaaaagtatcccttcccttgagaagcattcagagcatctagtatcacacttgggatatagcaggcatttgtactcaattaaagaatagaatgtgattaaataactttgagggcccacatggatgactttaatacggatcaaaagtttggacttagcttgtcagtaatgaggagcctttggtatgatcacaggagaagtaacatagcacatctgagatatagagtaaaatggaaaccttgagcaaaggaggctagttaggagtctgtttcaatagaccaaaggagatggagagcatgaggggctcagtagtcttgtggtggtggaaataaagaggaaaaagcaggtgcagaaaacattcagaggagaaacaatgggctgttgaaacaaattggatatttgggacaatagcaagagaaaagtcaaaataactgggattttaatcctgagcaacgggtaggctagtgagacatctaatcactctcccgtctccttccctgaaagttaattactcacagaaaaagcattagccagaagtcagcatgttacatcagttccttaaccctgcaagtccacattggtgatgcaggtggccaagacaggtctgcacacactggattacagcatggaagaggagcccagggtcatggaggcacccagcaatggcaaaatatgggcaccttgacctactgggttgcctatgtgaccagctacagaagctgtcagtatcaggagctggagctgcctgcaatctggccactcagcaagaattttcagagacgtttctattccatagtggatgctccatccaacaccattcttttaaagtgcgcacatctgtcactttccaagtataaatggcctgaatttattttcctttctttaccaaaatccaacctagtaatttttttctttccatactccttattcatgaactctaattgttggtaactttgaggcattggtcatcttaatttcttaccactaatgacatgacaagttaatttctgcaataagacagctaaaattatttttatatcttctaacataatattttgtcatgaatgctttcctagatcttccttctggaatcctactttttatgtagtttggagattctcttttctaaaataaaattagcatgtaagataataaagttattatatatttcatccaaactgtaaaaatacattgatattttacttcttaattcctctaggtaatataaaagtattttagacagttttatattgattaattgaagcatatcaaagttgattgatttctaaagactgtgaactcaacccacatagaggaggcaaaagtaaagattagaacttgccatttctattccagtccattaattctagctaagctatttctgataagtgtgtactctggagaaaaaaaaaatgttatttgaagagtggcactatatttgtttctggcaaaactaaagttttaaaattccagttcctcaacaaatggagatggaattttccagttcttcaaagtatgatttttaggacttgctactaaaggttaaatttctctctctattataacatattcatggatcctttagacattaaagtaaagttggagtgaagagtagaaaataacagaatctatttattgctttaggttttcttatgaattgccccctctctgtctctagtttgtgacatgatgctgatagcatgtctgttagtgtgtaggtgacgcgccttcagctagaagctggattcaacaacattaggctgacttgcaggctacaaagcctcgactaaggtcatcacatctggcaccagatttgatgtcaggagctgatgttcttttcacctcttcccccatgaacttcttaacttagtatttctaaggatattatacagtggcatcgtgtgacttaggctaggcagtgacaaatttaatgttacttcacctctgccagggtgaattcagacccatcaccgtgcccagaaacccaatagcacatttgaatattctgaactgcaaacctgttgcattaacaagaatagtatgggaatggtggcaaaaaaaaaaaaaaaaaaaaagaaaaaaacaagttgtgcaataaattatcagtttattttctggagaaggttactttgaaggtccaaatttcttctgtctaaggatccttggaatggtttaagaaacagcctacttatggtcaagttaagaaatgaataatctcttaaactatgccccatatccaagactctgttgtttacaattataccaagaaaatataaaacataggtctaggccaggcacagtggctcacgcctgtatcccagcactttggcgggccaaggtgggtggatcacctgaggttaggagtttgagaccgcctgaccaacatggtaaaaccctgtctctactaaaaatacaaaaattagctgggcatggggcaggcacctgtaattccagctactcgggaggctgaggcaggagaatcattcgagtccggaggcaaaggttgcagtgggcccagatagcaccactgcgccagccttggtgacagcgcagacgccatctcaaaaaaaccacacacacacgtctaatacctttttctgagggacaactgcattttagttcatttctcactgaagcaaaataacaatttacatttaaattgtggttttcttaaacataagaaaatgtatagttcttga

SEQ ID NO: 5103 - DNA, 61487 bp, Homo sapiens
agtctttgttgccagggacactatttgtgtccttcctgttctatgatgcctaacaaagactctaactcagggtgctgcactgatgcagactggatgctcacagaattgccagacttcaaaaagggggctcagtacattggtcctcaattttacatgcttagcttagtgaacaagaaataagggacatcttcagggatcagaatatgcggaaaaaattaaaggctacagggaaacttcaaaggttggcaagaaagacttgttccctcatatggatggaagaaaaacagaggtatgttaaaccaaaaatctggaattcaggtcttccacataacagcggaaaaacagatcttcagtgaatgctgcactgggaaaaacaatttgcccattagcaaagggagaaaacaaggaagctgattgtccctgagaatctgaaactttacaccaggcttcatttggatttgagatgaatattacaccacctgccttggataggaaccatcacagactttcaaggcatagaaacaaacattaaaatagtaccaggttgttaattacttctgaggtgcctggcacaggcagaaacaaagcaatatggaaggatggaatctctatcaaaaatcctcagagaaagctctattagcaatttaaatgacaaatatgggaggagacagctcactgttagtaaatgtgggcatcacaaggcacagaggattcaatgcccccacagtcccacccctgaacttcagagaggaaggtgaatagaaagaatgaaggtagaataatctcggggcttaaaggaaggaaagcatgctgcaattgctctctgactgaagcagagataaatattatgtaagctcctgtatttgtggatcatgcagaaatatttatcttcaaacaaatttggaaaattctggtttccacagagccgaacaggtggttctactcagaacttctcaaaatcttcagggtgttaatgttcagcttgctgtcagaatgttgtacaatgtttctcaaatgtgcttgaccatggaaccctgagacagcacaagtaacattggtcagacagtgtttgggaaccccctgtttaactatttgtgtctattttgtataatccttccaagaccgaaaagcattggaaggaaagataaaacttttctgtcccttacatgtccctccctcattgacctgaagatttttttttcctttttcttagaaattactgaggaaactatttaattgggtttttgccatggaaggtacttttacaccaacctaatacttttcttcatatagacatctctctgaagtgttttggaattgttattcttcatttcattattagttgttttcagaatttcctttttatttaaaaataattgatccatgtttttactgtaaaccattttaatctttaaaaaaataggcagtgtatgaattttaaattatccatgttgtattatttcattttccaatttggaagtagacattccgcacaatttatgacagaattgttaaacattaggctatttgccagggtttaatccagtgtaaaaatacattattggtgagattctttcattagcttcaaatgtctcgtttcaataagaaaatatttcttcttattacaaaaaaccaaaactttcactggatttaatttctgcttgtggaggttgaaaaaagggaaacggagctatagactgtttgccagcagttaatccagtgaaaaatacattattggtgagattattagcttcaaatattgttggttcgtaagaaaatgtttgttcttattacaaaacacaaaactttcactggatctaaattccgtatggaggttgaaagaagggaaacgaagcaagtaacaaaaagaagttgtggagtttattttttggaactttccacgattgtctatctaaaataatgatctacttaatttgttgtaaattactggagaaaggtcctaattttttaaaaatgttaataacgctccctgctggtttgcttcaaagggagcaaactacatcttcactgaaatttgtttaaggaagacaacaaaggaaaatagaggaatttgttaaaatcactttttaaaatacttggtgcattttgatatagtatagcggagcatcagcagaaggctgtttcattaggagagctctccagaaatttcataggaactcactaggttagcgcaacagcggagcccaaaggtagttttctagtgccctctggtggttaaagctattattactctgactgagattctgcgttgctggaatgggaaatattagaatagtggaattcctttctttttttttttttctgctcagcggttgaaattaaaaattgtaaatttatttacagttatatttgacatgttgttatttgaacagtgtatataaatccaaaatgtctgatagttaccaggttgagccacttaaagtagctgccattctatttggacccataaaaatggcattttataatacagtgcgttatctaaaaacaggtcacatatacttatttatcagttgaatttgtaaaaaacagaaccatttttttaagactagtttcttgtctttcatagctttcctggtttcccgaatactttcaagggggaatattatagtaagtttttgctatcaggagattttcagacagaaagcatggtataatccactctcaagaagaactgaaaaaatttggcctaaaaggcgggataactaatggtcacatttttaaagaatttcttggatgaagaaaaaggaagctgaataaaacaaaaacactggggttagttataagtcaaattaaattagaaataaaagattaaaataagcatgactgtctaagaaccccagctgaaggcttgactaatcatatctaaaccccgtgtcttaccatcctcttcaaatgcagcttcactcctagaaggggtttgaaatggctttccccagcttctcctctttcttgatgttttctcagccttgtactctggctaccttatctgcttagcttcttccctttggataccatccttcatgccctggaatgttatctgctattcttgatattttctgttattttaagttcctctttgaaatctttacaaaccccaattaaatctatcacccccttgcttaactctgctcaataacttcccactgctttcagaagaaagaaggagcaaggcaggaaagaaggaaggaaagaaataaaatccttactttgcttacaaggacctggtgatctggctccttccttcctcttcaccttcatctggtgccattcttccctccttcacccctgacaacattcgtcttctttccagtgcttggatggagaacactcacctgtcttaggctttacgtgacctttaccctctgcctagcactcttctttagagcttggctgactgacactagtgttttaggcctgagttacaaagtctccttctcagagaggatttctcagccactctactgaggagtcatcaactgtggcctgttccctaaatgagagctattatattttgtatttcacttgacttgcttatttgtttataatctttcttctctacccaaattaagctccacaagaaggaaccaagtctacttcattcatcaccctgtaatccaagtctgaaatactcccagattacggatactcaatagatatctgttgagttaatcaatgaacatgaccacttggtagcctcctcaagtttacctatatttaattctcagccatgctttgtcccatctttgctcatacttgtgtttatttataatgtaattactcattctttccacacatttttgaaagagattttgtgtttgtttttatggagtaagattttaaattgccacttgaacttaccacaccactagctctacaatgggagcccttaagtcaggaaagacattctccaagtaccatttgaaacttttgcattcagtttctttcgcagctccctttgctgggtgaggttgccaacatctagcccttggtcatgaggtggtctccgtggccatagaacagctccttatactcatccagccagacctcggcacccgcaccaagttccgctccactgtcttcatccggtctttggggaaggaatatggatttcatttctgaatatatggcccactcgggagcagggaatgatctcaatttcaccaccacaatccacacctggaagaatttgatgataagcatcaattatcaaatgattatccacaaatctcggcacttaacaatgacaagaaaccaccttgtttccccctacctgaagtaatactcaattcaaaaacacttttgcaatagaaaatcaaactcaacaggcttatttaattttgtgtatgctgtggatcattttaggattagtaaaatgtaattttttctttcctaactttcaatgtagttttttttaatttgtaaataaatcttcacagaatcccattttgtaaaacatgagttctgttttgattgaatcagggaaagaagtatagatgtccatttgttcacgttcctctactctatttttgggaagaaccaaaaggcttgtggaacacaactcaaaaccatccttcatgatcacagctccaaaattacacccttttacatacatacagaacacccacccaataggaaagcaatactttttggacactctctactactgctgttgccaaggctttctcagaagttaatcaatattgtataatagattgtataaagtgcccaaaggagctgtactataaggcacacctgaccgttggtgacctgctttagaggtattttaatgtacttctgtcatttgtgttctctaagatatccattacagattgagtctattccttccaacattctagacagatgttccaggagagttttttgtagcacgtatgactcccacagcatttactctgagtggcagaaagtcatttccccatatttataagcagaaatggtgttgtgaaatattagggaatgctaataaattttatgacgcaattgattcttccaaattcaatctgagatatgaaaaaattaatccagagaccctaaatttctgtgaaatttcctctcagtggcagtcacatacctgattatggtagtaaaatcaaacatttaaaattgattaactcattatcgtaaagaaaagttgggaaacacctggtaatacctgaatgagagctccatattttccccaccccaaacatcaaggccagggtcgtatgttccagttcaaaaaagtaacttttgtcaatagaaaacaatccaccagccatgacagggcacctaaaaaagaaaagtttgttttttaaacttgcatctcatgaaagctcgacttttagagttgtcctctgtacatctgtacgggaggtaggaggcttttcagaatagctacctgatgcagggagccctgggatggagtcacaaatagggcttaagtgatgcgatccctggatcatggtggcaagctagattaggttcagcaaagatgcatcctggaactagtattatttgtcctttatacttgacacaaactgtccaggaatgttatttttaacacttattcagggctaagggagtatcagcactattgtaagtattatatatatattccagcccagacttcacaaaaaatcttgtgtggcaattattaagaatctgcaacactggatgtgagggcgatctggctgcaacatctgtcacccattgattgccagggttgattcggctgatctagctggctaggcggctgtctccttccccctcaccgctccatgtgcgtccctcccgaaagctgcgcgctctgtggaagaggacgacatccctgatagaggagggccggtcttccggtcttctggtcttccggtcttccggtcttcgtcaagggtatatgagtagctgcgctctctactagaacctccaagcaagcgctcaggaatggcaacacggagaaggtaagaaactttcccaaggacagtagacaccttgggtttgctcgggcagtctgaggggacgctgtgccactcactccactgtactgcctctcagccgttactgaaggaaggccgtgagtgtgagttgtccaggttctgggtattttgaacaaagagttgaaaaaacacactaacaaaggaacgaaacacatgaacgaagcggcacaagcagggattcgttaagcgggaaagcgctccacagggtgggagtgggccggagcaaacggttcaagggccgggtaccaagttttctgggtttcaagtactcctttcgaggtccctaccagctgccccttatcgaatggaggatttggttggctaatgaaaggctgcggtgaattggcgccctgtgcagatgagggaaggtccctgcttggccagtccaaggcagagactctccctttccttctgagatgtgtggaaggggagggctgtagggagagtagccgttgatcctttgttactcgggtgtggggaatggggttttccttctggtttagctttaggaagtgggtgttaatcggccttagatccctgcccctagacccaggtgttttccttttgatccaggtttgggaagtcagcaggaattggcttagattccctgcccccagaccttggtgtttttccttgattcagctttaggaagtcggatgaattggccttaagcttcttgcctccagaccctattctcctgcctcacaaccacacaaaactttactgacagcgtgttatatggcaagcacctttcaaagcactttatatgttatcgattcagttcttaaaacaatcgaagtagcagctacttttatgagtctttatgtaaaaataaaaaacagaggctcaagatgataagtaaccttttcaagctcataccacttctcagtggacagttgagattcaaactgtctccagaaccttcactaataatattgatcatggaggataaaactacattttagtcagcagttagccaagactggaatcacttcctatggtggtcaccatcagccagctaaagtagtttctgtggagagcctgctttgtgcttagggtatacagtgattcaagggggagataattcctgtcccacacctctctcccctccgccaccatttatgttcatttctttctgctctccaattttcctactagactatccagaacgcattctcgtcctaacatatgttgaatatagtctgaactcaaccactacattggccctcaacatgagagtatggaagagcagaggttctttaggtgtaggttcagaataagagtgttaaatccaggtaattctggtttgagtctcaaattcttctttgattagctgcgtattcctgggaaaattacttaatgctttaagtctaaatttccccatctctttaaggtgaattcttccacctccctcctagagttagaagagagttaggtgcctggcacagagtgctcaataaatggtagaaccttcacttctttcttggtggaataattctgaaggcatcacacctggcaaggaaggcgggtatgactgattgggggtaagtttggggaaaacacgcttcggtgcacggtctgggcttggctttctgttgggctggcttacttgtgtctgtttaagtggtcactacaacagggaaagtttaagccccctgcgctcttcctgtggctggcttaatgcttgtgctgcaggcttatattctgaagaagtaatagaagcctccacttcagcttcaagtctaagctgtgttcttcaatgcagtttcttggaaataaagcccaaacttgaattcatatccagcttctgaatcaatttttaaatttattcatagatttggcacttttctcatggagggggtaggattaggctgtaaaagaaaatcctaaccattctatcattagaatgatatttctattaccattatttacttttaatttgcacttatgtttatttaatattacatgtgtttgtatagtatgtatgcagcacattttgctagtttgtgtttctaggttgcaaatcctaggggacaggatagcattagtgaatttttctgtgttcaggcctggtagggtacaaatgaccagtgaagaatgagttttgggaacgaatttctcaagaacactggtttgctttggtaatctattggctagaactgtgattcttaatgttctatagaataacaaatacagctgttttgtagaattttttaatgcttttacaaaaagatacatgactgctttctgtcttaaatttcccacacttaccttattgtatcagtttctttaattctgttttttgcaagacatctggaggaattgttctccaaccaaagttcatgggccacacaaagatgcctctttaaagttatccactgtcatgtaactaatccaggaaatgaaaaacaaagtgttatctgggatatatacatctttatatactttatcgatttggcttcacgatgtaatcaaatgaatgaaaaagtgcttttgatgagtttagatcaccaccttttaataatagttcaagaatgtttacaatacaatttgcattagtaactgattggcttatttgtgcttaacttatacttttataataaaatatgctagccagttttgaagaaaaaaaatacaagagcaacttaaaagcacatatacgttcccacagaaataagaactaaatttgaggtaaataaatatttggggttcagctaaataaaaggggaaaaactaggtcatgagtattaggatttattggtatttagagttaagaattttagtgaccagatagattattgcatcagcagactctgatcccaagatatcgaccatgttttccatttatttaagtagataaactgtatatgtcttggattttgaaaaaacacacatattggcatatactcagcactttctgctgcttgtgattaaagatgtgcttgaaagtatcttgtgaatgtgtaaatattacctcatatccttatcattgatgacttcgattactggacaggccctttctttctacttaaataaactctttccagaagaggttccaaccaaccaacgttacatccacatgagaatctaaaaatgtcaacacatcacctagagggccaaacacacacaaaaaattagaaaatacgatatattgaatgtgtgtacttcatgttcaaaggtattgatgattgctcagaaatgtggctataaatgcagtgaccttttttttttttctgaattcgtggtcactatatttcatttcatactgaaatgagagaaactttgctcctaggagtcctgtggtgcaaacaaatttatgtttggaaaaaattgataagccatttagaatgggcaaaagaatctgaaaagatacttggtattaaatgtagttgctgaagtcccctctgagagagtgtgcccattaactctggggtgcaggatttgggactttgtttttaagaagcagacagactgagatgacaagtttgccttaggaatgatgaagaggaaaaattacttcacacaatagggatgaaagaaattaaagggacaaaccagcgaggctaggaggtaatgaaaagagttataggagacaggagtggggaagggaggttactgattaatgggtatggagttttatttttgcaaggtaaaaagagttgtgggattgcacaccaatgtgaacgtatgtaacactatgggcctgcacacttaaaaatggttagatggtacatttttatattctatgtattttatacaatttttaaaaagacttagaggaggaaaaaaaaaaggaaaagaaacttggaggccagaaatagtattaagaactcttttatttcctgttagttgtgtgaagtaacactctctctctctctctccattgaaacctcagtagcattacattgctccagaggatcttatacaagtgaagtgtgtgtgtgtgtgtgtgtgtgtgtggtgtgtgggtgatgtgatgtgtgtgtgagagagtgtaacaacccaggaaataagctcctgtccacatcctatgtgtgatctttcaggcccaaccacaggtaatacaaaggctctacctctggggctcatgggggaaacctgctttctcactcagacttggtgcccagccagtgtgttaagtctctaaagggagttgcggtccaggtctcagaccctccactcggctgcagcacttgtcttctgcctgtctgcattcctaactcaggtgcctccattcaggccaaaacctctgccagaccactttattggagatggaatgggtcttgaagacactttgctcgactctgactcactttcagtgctttcccactcctagcctttcgctttcttactctggatcccagggccacatacagaaggagccttttgtgctgggttccttgggcaggcagtgagatgcccctcttgtctgtctgttctgctctgatccatcactcagcaacattccagggggaaaaatggaacataggagagccagtgccttctcctgttcagcctcctgttgatactgttgcagtaagggattaaggttgactactgctttcattttggtttatcattttaattgactactttgatacctgggtgccagctcagctcttgacatacctgtaagagcaaccatcatctaagtgcttgttctatgccgtctctgttctaaacattcttcatgcatgttttatgtagtctttacaacaaccctgcagatagaactaatttttattcccacttaagagacaaggaaactaaagaacaaagaccctagtaacttttctatggttgcgcagctaacaaacagcaatgtgatattagaaaataagtagccattccatagattacattctttaaaaaatgctagaaggaggcagagctttgagtatgagaggcttagagaacaagatgaggatagttatctagatgacagatcattatcactgaaatcgcaaactacctctcaattaatagaatttagcatcgtattaattacttggttaacaatggatttttgcatgagggcaaggtattggtgtggagtgttcttgaggattctgtttagtgaaccatctgtgagaagcaaacccgctccatgtagtcttctgttcttggagatagcagtttctctcctgaccaggctggaagggtcctattttcagggcattaatgcttgtttgacaatgaagggtattgtcccctgcatggtctgaatgtacgtgtcaatccaaaattcatattttgaacctaactctaagatgacagtattaggaggtggggcctttgtgataagatcatgagggtgagtcttcttaagtaggattagtgctcatatgaaagaggctggagagtgtttgtgagctcttttgcccttccaccatgtaaggtcacagtaacaaggtgccgcctttgaagcagacagtagctgtcactagacaccgaatctgctagtgccttgatcttggacttcccagcctccaaactgtgatcaataaatatatgctatttataaatgatctagtctaaggcattttgttatagagcccaaaaggactaagccatctcctaagggtgtcctttggggatggcacctttgggacgctgtctcccctgtcatgggaagactcacagagtcatgtaggtgtatgaagcgtggcctctaaagtccacttggctagtggtatacaatgtagtagaaaaagattcctggccgggtgtgtggctcacgcctataatctcagcactttgggaggctgaggtggtaggatcatgaggctagagatcaaggccatcctggccaacatggtgaaaccccatctctactaaaaatacaaaatcaaccgggcgtgtgtgtgtgcctgtagccccagctattcaggaggcctaggcaggagatcacttgaacccaggaggcggaggttgcagtgagcagagatcacggcactgcactccagctggtgacacagcaagactgtgtctcaaaaaaaaaaaataataatacgatttctacttgggtccattcagacctagagtttaaagagcattctttactacgccacctgtccctatcccatagcagccttatgaagtcaaaggggcctggattatctttctcagtccccagtggcagcggatgggtccccaaacctgcattcacttcccacctggcccagatccctatgaaaattctattcatttgctgccaggacctaagggaagcagcatctgctcaaaacatagtctggaatttatattgttttattttggggaagaggagaatcctcctgtgcatgcatgctattgctctatttcagacactttgttttaaaataagatcctaggactatgttaggtgagaaaacagggactctctgcgtagctgactcttggtgggatttctgattggcgtggttattgtctatggacttgtacgcactgttcctgattcagagaggggagaggcacagtgaaataagcatagcattaagttacatacaacagccttcaatccgagctctgcttttcctagccaggttagataagtacttaacttttttgagctttgccctatgaagatatttctaagagctacctgatatctaattctttaaaaattgctagtataatttactgtcagaataatcaacccaatcacttaaaattttaaatgacacataataattgtatatatttatggggtacatagtgatatttgatacataagtgtgtagtgatcaaatcagggtaattagcatatcaatcacctcaaacatttatcattatctgtattgggaacattcaaaatcctctctgatagctacttgaaaatatataataaatattgttaactatagtgaccctatagtgctacagagcactagatttggaaagggtaggaagaggggatatagggagaggcgggttaaagaatataaaattttagtccaaccttgattgtacctgttaggattttctgttttctaaggataggtcccaataatactggattgtttacaatgggtttcatttgtaacttaaaaatctggggggggggtgggtggtaacataaaactgtcaatgtgccaaaaattttgggtccttgttgagcatggacccccacttatatccagtgtacagcctggaatattgctgctgtaccagttaatgctagatggttatgtctaggattccttagggatgttggcttggcgtgccgtttaattttacataatgcctcctaagtaatgctaagaaaaaatttttacctgcagcagatacaagttataaaagtttgcagacagatgtctactgtgctttttaggagaccttggagtttgctaggagttagatgtcacttgtccagttacttaagttagccaagtgattatttagaatgctcatagaaatgtcaggaattttgccaaatgcctgtcatgaaggaaatgaaaacctaatatttactttgactctctactgcctgactgtaaccctcttggcagggcagtaaatcacttggtctgttccatactaggaagggatatgggtgactacttcttccctgatatctcatttactctatctttttaattctgttggcttcatataggagcaattcttagagatccattgccccggcctacctgtcaattttaaaatcctacttggcctctcaacctcctcattcacagcaagcaactgattggacctaatctttttgcctgaatagattcagatgaagaactaacatgccctggaaactgaatgcatagtagacattgctaatgtaaggccgatcactgcttggccccttattattttgtagatgattgcagactttcagaggcctcttgcagaacttcagagagcctcataataccctgggaccaaaataggccatctgattctatttctgcatgtctttggatctctggatctcacccttgcctgttacttccctttttttgagtcctaaagggcaaattttagggaacagtagcatcaaggcctgtcagattctggctcagattcttatctttaaactccttgtttggcgaggcatcctagagaaaatttttgtcgctgtctttgctgatctctaatttacaggaactcttcaggaggcccttagtctcttactatctctactcttgagagctgtggcacacccaggggagtttgagaggacccaccacgcctccatctctgctcaatgccagtctctgaattacattctctgctaaaactgatcctgcattccttgaattccccacaggggacaggtgtacttcccagcattggatgtatccttgggcaagatacatcgagacaaacctttcttctttccaaactctcaggcacccaagctccactaatctgctccaagtgtaggccacagaccctgctgtctacagggtgatagcaatagaaattgaaacaaatattttgaaactttatagcaatttgtcaaatttataaatttattatttatgtatgtttttatatacatgtagatacatatgcatatatatgtatatatgtgtttgtgtatgttatatatatatatatatacattttttttttttgagacagaattttgctcttgttgcccagctggagtgcagtggtgtgatcttggctcactgcaacctccgcctcccgggttcaagagttctctgcctcagcctcctgagtagctgggattacaggcacctgccaccactcccagctatttttttgtatttttagtagagacagggttttgccatgttgggcaggctggtctcgaatcctgacttcaggtgatctgcctgccttggcctcccaaagtgttgggattacaggagtggccaccacccagccatatatattttgtatgtaataaaaatgggtttgtgttttatatattactttcctttttgggtaattaatattgattataatttacaaaggggtaggtcaataaaaattggaaattaggggaaaaaaattccttttcagatagtttgggaagcatcactctactggcagtggcaagcaattaagatacacctagctggggtttttcaaactgagagctgtagatcccttagtgaatcaatcactaaatcaatttattgagattggctaggatctaaaacataataacatagaaaagaaggtattagaatctattccacatgttatttgataaaatgtctacgtagttatatgtgtgattacacatgtactgagttgtgatgaaacatttatttctacacagccattgtcaaaatggtttgacagttactgagctaatattctcaaggctgttaatgaattgaatttacattcagatttgctaaattcaaataaattacattatggatgttaactgcaacacttgagcaagcagttgcaactgctttaatcaagctcataacaccccttctaagacacccacccatgttgtctaatagtttggactgtgttggaggccgttactagcatactctgtgtccgtgcaggcagagagaaaatttttaaataagtaacccatatttggttctgtattctatttctgtgcatgaatatctcattttcatctcaaatttatatggacaaaatcaaaactcactgcaattccaaacctgctcctccagttttgagcctaccacccaccaagttgttcagatccagtcctagggtttgtttctgattggtgtcattcttactctcttcacatcttatctgaggcaagtcctatacgttccatgtgcacaatctatgatgaagctgaccatttctcccattaccctggcacctccctggtacttggacaactatagtagcctcctaactggcctccctactcctttttcatcttcctaatatccattctctacacagtggccagaatgagctttgaaaagtacatcagacagtttcgttcctatttaatattcttcattggcttcaccttatactgagataatgcctacaatctttaagtgatgcacaaaactttagaaaaatttgcttttttcttttccccaaatgaatcttttatgactctccccatggtcagcacccatgagtcaaaatgaactatttctttaccttgaatatgccaagctcatttcttcattaggacatttgtacttcttgtccatttgcttgggaatattcttcacccagacctcagctcaaaaattacctatttaaacagttcttgagtatcctatttttacatcatttatagataattactttccaaaggaaattagcatggaatgccattaaatttttctgaatgcagtctctcatcaagaatcttaactgtcatgcaatgccaattttggtgtgatgtatttgttgcttacttaaaatttcctctacaaagaaagacatttgttagcaaaccaatgaaatgagaagagcttcaaatatggggtccagttatagaaaattaaactcaggtaagcagaaaacttcccatcagaacatgcttgaatttaagctgtggagacctgtaaaagcagggcttacagggccagagtggtggctaaatgtctagaggctcaaggtgtagttgataagaggacggactctggggtcagggcattcaggtgccagctttgatttaccactggctagatgggggagcttgcataaggcacagcctcactgtgcctctatttctcatatgtagaatgaggatgtgattgtactcatctcatagagttattgtgaggattaatcagttaatacacaaagtattcagaatggcacctagcatataaatcagctagtattaagggcacagatccttccatagaaatgtatgaacatgaacccaaatgtttgatgttgttttagaatactcataaaatagattcacttctcattcactcaccaacacctgcacactaaaaggggagaggaaaagaaggcatatggcctttggggaaggcagaaagaaccataggaagaaagacatgggtcagagaagagaggggtgaggattatagaattaaaacattacgaaatcttaaatattgatgggtcaggtcaaaagggcacaggcttgaagaagctcctagtggtcaaattgggacaatttgaacaccaacaagaataatggtgatataatacacatttaatttctgagcataaatccatatcgatgaggggatgagagggaggggagagggagattgaggggaaaggaggaagagttagaaagcaggagagggagagatagagattttctccttacacatgaatgcagctaaataaaaaagaatgaattatagaaaagcaaattttcagtcctcagtgtaataatgatttaagcaaggatgatcaatggatactaaaaaccattgggtaaaacattgtaagaaaacagaatattttcatggatcaatgtgtcattccacaaattacttcttaatcccaaagtaaggtttagctgtcaacatcttaactaacaaagttagtatcaacaatactggtgatattagttatattatatgcctcttgatgagatgtataccatttctatcacctatgtagtagcatctatataatattttcactccaaaaacatttatcctgcaggtaacaagaggaaatcaaaatttcagaacatggtcactggtaccaaacaaatggcatgaacttaaaatacacacacacaacacacacacacacacacacacacacacacactggtatttaaacaaagtgtgtgaggagtgacttttcagactaagaagaccaaagtatcaaatgcagagtatgaaacttaattagttccgaatttaaaaaaacattttgaggcctgtaatcccagcactttgggaggccgaggcggcggatcacgagttcaggagtcgagaccatcctggctaacacagtgaaaccccgtctctataaaaatacaaaaaattagccgggcatggtggtgggtgcctgtaatcccagctacttggaggctgaggcaggagaacggtgtgaacgagggaggcggaggttgtggtgagctgagatgcaccagtgcactccagcctgggtgacagagcgagactctgtctcaaaaaaacaaaaacaaaacaaaaacattttgggaacaatgagaaaacttgaaaagagcatatagtaggtattattttagttatgaaagctgtgcttatttaagagaatgcttctgttcttcagagctgcccacgaagtacttaggggtgcagtatgatgatgtctgtaacttctttttcaaaggttcaggaaaaagtatatacaataggtgtctatgtgtgtttatgataaagcacatattataaaaactgttaaaattgatggaactaagtgatgcatatataggcatcattgtgctggtctttcacattgctgtatgtttgagaaacattttaaattaaaataaaaatgtaacaaacaaaaaaatgataacttcttacctgttgcattctgtgctcctgccagcctggcccttattaagccatgtcctctttgaggcgaagaatccgaacttttggaaactgggacatgtatttatccaaattatttttagatagtctacatcagagtaaagataaaccaggaaatacttgaattaagtaagtcggatagtatcagaagtgctccccaaagtcaaatgccaaaaactatgacattaccatcatactgaattttattccttgggtcataattttattttctgatgtcattttcttggaaggatctatctggtttcagtattcaaagctgtctgatttttcaaaccccaaatgtttgttttcatgttgtaaggtgatgtagtggagggcacacctttctgagtatttgtcaaggtgggggcaatttgccttaaaatatatgtagctcaggcttctgcacaattctgcctctactctcagcccacctcttgcaaaagccccttccatgacccaaggaagaggctaaacaatgtgtgcaaatagaccctttcattctctactctgacatccccttccattacaccttttctctcttattagtggccatggagggatccagctaaaggaacagttttccgggggctttatgagctatgttttgtgacttacagtcatttctgtgtgtaatcaagctattgacagctatcctaggttggaaggcttccagaaaactttctaagaaagtttttcttagacaggaccctgaaaactgaataacttcaggtcccacagaatctggacctgcccctcataaagggactcctatctacttactattgggtactattcctgtttatgcttccaaggccacattttatgtttttcagccagttttctctatcatcccacagcttcttgagctcagtgtgattatggcagaaactctgaagctaagaaacttcccatgttgctgtggtcacagctcaagggtaagctgttccattagcattgccagtctttgctattttctaaacttttctgaaaaatgggttccatttgggaatttgtaatgggctgtcagaccacctacatacacaggttatttgacaacccaaagagtgagattcttcatgtaataagcaaaaatgaacataaaggctatggtggattctggttttgaactttgttggatcacctcatctctcttgtcctattggcaatttgtcttcttaacacttaactgaacacacatatgccttgctctcaaggaagaagccataagatcttaatttctttgccttccatagatctaactgtaactctagttattaccagtaggcaaggcctcccgttaattgtgattccataaaagggatttgtgcaattgtagaggacatctaaactccactacttctaagtgcccatcccaaggagccatagttagatcattccaacatggtagcagagttacaactgagacaactactgaacagagctccagatgacttttaacgtccatagatgcttagacttatgtctctgagctccacgtaaaacaaagcatttgtacgatgtttatgcttcatcaaattatcctataatttgccatccaaactgctactaaactttgcttctgccaaactttgaaatttcaagagatagctgagtggttttcttacctttggtgctgaagtcatctaccagcagaatctccttgatgagtgtggaggagagcgattgatgacactgtgaacagatctcaggagagtggaccacacttatccacaaagcacatgatgacactggtggttgggaggttattgtgaactagctgctctgacatctgggccagaatataagcagagcacaagagatgtgctaaggagatccacaagatattttaaaagtcacagagtgcgatggtgtgcatatacacacacacttaatctgtcatcgactgtctggtctatctatcatctatttatatataccaatgatgattttattatttatcattgcctttttttggggaggggtacatgcaaaataaaaaagcagaagaattacccgtaacctggttgttataaaaggactagaaatgcaagacatgagaatgtcccatgcagacatcacatgcagtggaaaggacagggtttacaggtagttagactctatttcaaatctcatggccaaatttctcaggtctttaaccattaatgccttctttaacttctctgtgcctcagtttcctctctgcagaatgaggtaataaatggttcttattcaatagagttttgtagcctagtgataagtacatacaaagcctagcagggttcctggcacaggaatttatgaaatggtagttattgcatcattactagattatatgctagaagatagcattctgacttatttaatgttcccaagtgtttatgattgcctttccaactggctgtctgccaactgccatgggatttattcttttctccattctgcttgtgtatgtacttatggcataatatatatgtgccaaataattaaactcttttagcttccgtatccggggcttccttgctgatactctgctacagaatagccacagttgaaaaccattttgctggcataggaatgcaatccaggctacagtgggagttagtattcaggtggttgcaactggcctgggttttttcccatgccctgcagaatacactgcctcactgctggattctttcaccccctgcctgtgccactcttcataagcagtgcccagtggaacctcacaaatgtatttgccatcttactaacacagctactgtcagtaatgtgataattaatgatgatctaaatattataagcattctatattatttcaatgtcgacctcaaattaccagcatctcttccctttttattggtgaataatcaaaatcatggaaagactagtccatgattctgcagttataaatggcagagctgggactcgaacactgatccagtctggctccaaaagtaaccattgagaagccttagatccacaagaatagaagcagctggcagtagatgcgacattttgtgagagtggcacttctgccaaataacatggttatactttacttattccataaataagaaataggtagagcaaaaacgatagtaaagcaaatcacatttgcatgacactctagtgttgccaaagtctattctgtacataattgaattcagtcttcataacaactgcttgagatacatattattaacacttcttcaaatcttgggaagttaaatgacttacccacatcatccacctagataggaatataaggaaatatgaacaaataatgtttttactttactgctggttttttttgtagaatggctttggaaatagatatgtgctcaaatatcagtttttctaattactgatttggaacagtttactacttctttgaacctcaatttgccaactacaaagctgaaattaaacatgtaccttaagattacatataaacattatgtaaaactcatctaatatatatctgacacatagggggacttaagaaatggtagacaaatccagctgtgcttcataatttcaatggtttcctagatgttgtttatcataataattgacaaagccttagaaaaacataaatatccaatcctcagcccagaaaatcaatttacaaggtttgctgagggcccaagaatccatgtcttaaaatacaaacaataaaagaaaacacaaagaaaccaacccaccaacaaacaaaagaatgactcacaaatcttgattggtgagtttaagaacttgagctcaagataaagttaatttattcttattatttgggctaatattaaaaaaaataaattgacagctgataggagcatgtcctaaatgttcaagtacagagaattaaaataacacattttgattcactatcttcatgtagtgatcaggtatctatgctaacttaaaatatcagactgtctaaactaatattagtctacactaaggatccatgcttagcacttctgaataatatgagaagatattcctctcttcacttaagagctttatcagttactttggccaccataacaaattactgaaaattctgcttaacagttccttcctgaatgttctattttctctcacatttgtactctgaacagaaagaagatatcagtatgcaccttcaaattttgcttggtactctcctcagctaaatatccgatttcatcattggcaagttctgctattttcacatgactataggacacagttaagccaagctcactgccactatgtaacacggatattttcttccatttctcaatcatgtgctctatatttccttctaagcctgcaccagaagtcttacaatgctcatatttttgccaacattctgctcaagatagcatacatattttcaaagtgattgatagaagctttctttctttctttctttttttctgaaatagagtcttgctctgtacccaggcgggaatgccatggcgcaatttgataggagctttctctactgtgccgctcactccttctgagccctcaccaacagcatccttgatattcatattgctaccaacagtgacttagggcattctaggctttttctatgatgcttcacagaattcttccggcctctacctattacgaattccttggtgtattaggccatttttgtgttgctacaaagaaatccacctggctggcacctgtaatcccagcactctgggaggccggggtgggtggatcacttgaggtcaggagtcaagaccagcctggccaacatggtgaaatccagtctgtactgaaaatacaaaaattagcgggcatcgttgcgggtgcctgtaatcccagctacttgggaggctgaggcagggagaatccttgaaccctggaggtggaggttgtagtgtgcagtgagctgagatcgcactgctgtactcagcctgggtgacagagtgagacttcatctaaaagaaagaaagaaagaaagaaatacctagactagctaatttgtaaagaaaagaggtttaattggctcacggttctgcaggctgtacggaagcatggctctgccatctgctcagctcttggtgaggcctcagggagcttttacccaggcagaagacgaagtgggagcaggcatgttacatgacagagcaagcaagagacagtaagtgaggtctctgacacttttaaccaaccaaatcttatatgaactgagggagaacacacattcaccaaggggatggcactaagtcatccattatagatctgcctccgtgatccagtacctccaccaagtctcacctccaacattggaggtcacatttcaacatgagatttgaaggggacaacatccaaaccatatcacttggctattccttggatgatacttctgtatttttgggtactgttatagcagcacctcactccttgataccaaaatttatattagtttcttctgactgcctgacaaattaccacaaacttggtaacatattctgtcacatttctggggtccagaattctaaaccaagatgtcagtaggacctcagtccctccatatgttgtaggggacattctgttcctgcctctttcagcttctgctggcagtctttgacttgttgaatcactcaaatctctctcttgtcttcacatcactttctcctctgtgtctctctgggtgaaacctctgcctggctctctttataaggatacatgtgatttagggcatttggggcttatctgggtaattcagggtaaattctcctctcaagatccttcatcacatctcttgcttcagaaggtaatattcactgtttttcaggtgaggtaataatcacaggttctgagaattaggaagtaaatatatttttggagaacatgtcttttagcctgacacaagggcttaatgagttaaggcaagaaataggctgggtgagtagctcatgcctgtaatgccagtgctttgggaggccaaggtgggtggatcatctgaggtaggagttcgagaccagcctgacgaacatggagaaaccccatctctactaaaaaatacaaaaattgaggtctgttccaagatggccaaataggaacagctccgatctgcagctcccagctgattgacacagaagacgggttatttctgcatttccaactgaggtacctggttcatctcttgagagtggttggacagtgggtgcagcccacagagggtgagccaaagcaggttggggctcacctcacccaggaagcgcaaaaggtctggggatttccctttcttagccaagggaagcgtgacagattgcacctgaaaaaatgggacacttctgcccaaatactgtgcttttcccacgtctcagcaactggcagacccagagattctttcctgtgcctggcttggcaggtcccacaccatggaaccttgctcactgctagcacagcagtctgagatcaaactgggaggcggcagctggctcggggagggacgtccaccattgctgaggcttgagtaggtaaacaaagcagctcaactgggtggagcccaccgcagctcagcaaggcctactgcctctgtagactccacctctggagtagggcatagctgaacaaaaggcagcagacaacttctgcagatttaaatgtccctgctgaccgctctgaaaagagcagtggttctcccagcacggcgtttgagctctgagaatggcagactgcctcctcaagtgggtccctgacccctgtgtagcctaactgggagacacctccagtaggggctgacagacacctcatataggcgggtgcccctctgggacgaagcttcaggcgaggaaggatcaggcagcaatatttgctgttctgcagcctccactggtgatacccaggtaacagggtctggagtggacctccagcaaactccaacagatctgcagctgagggtcctgatgttagaaggaaaactaacaaacagaaaggaatagcatcaacatcaacaaaaaggacattacatcaaaaccccatctgtaggtcaccagcatcaaagaccaaaggtagataaaaccacaagatggggagaaaccagggcagaaaagctgaaaatcctaaaaaccagagcacctcttccctccaaaggattgcagctcctagccagcgatggaacaaagctggatggagaatgacttgacaaattgatagaagtaggcttcagaaggtcggtaataacaaacttctctgagctaaagagcatgtttaaacccatcaaaaggaagctaaaaaccttgaaaaaacactagacgaatgctaactagaataaacagtgtagagaagacctgaaatggcctgatggagctgaaaaccatgcaagagaacttcgtgatgcatgcacaagcttcaatagccgatttaatcaagtggaagaagggtatcagtgattgaagatcaaattaatgaaatggggtgagaagacaagtttagaggaaaagaggaaaaagaaatgaacaaagcctccaagaaatatgggactatgtgaaaagaccaatctatgtttgattagtgtacctgaaagtgatggggagaatggaaccaagttggaaaaacacttcaggatattatccaggagaatgtccccaacctagccaacattcaaattcaggaatacagagaacaccacaaagatactccatgagaagagcaactccaagacacataattttagattcaccaaagttgaaatgaagggaaaaatgttaaggacagccagatagaaaggttgcttacccacaaagggaagccgatcagactaatggtggatctctcggcagaaactctacagccagacgagagtgagggccaaaattcaacattcttaaagaaaagaactttcaacccagatttcatatccagccaaactaagcttcatgagtgaaggaaaaataaaatcctttatagaaagcaaatgctgagagattttgtcaccaccaggcctgccttacaagagctcctgaaggagcactaaacatggaaagaaacaactggtaccagccactgcaaaaacagaccaaattgtaagaccatcgatgctatgaagaaactgcatcaattaatgggcaaactaaccagctaacatataatgaaaggatcaaattcaaacataacaatatcaatcttaaatgtaaatgggctaaagccctaattaaaagacacagtctggcaaattggataaacagtcaagacgcatcagtgtgtgtattcaggagacccatctcatgtgcagagacacacataggctcaaaataaagggatgaggaggatctaccaggcaaatggaaagcaaaaaaagaacaggggttgcaatcttagtcttgataaaacagacttcaaaccaacaaagatcaaaagagacaaagaaggccattacataaggtaaagggatcagttgaacaagaagagctaactatcctaaatatatatgcacccaataaggagcacccagattcataaagcaaatccttagagatctacaaagagacttagactccccacaataataatgggagactttaatgccccactgtcaatattagacagatcaatgagacgaaggttaacagggatatccaggacttgaactcagctctgcaccaagcagacctaatagcatctacagaactctccaccccaaatcaacaatatatattcttcttagcaccacatcgccttattctaaaattgatcacataattggaagtaaagcattcctcagcaaatgtaaaatacagaaatcacaacaaactgtctctcagaacacagtgcaatcaaattagaactcaggattagaaatttactcaaaactgcacaactacatggagactgaacaacctgctcctgaatgacactgagtaaataacgaaatgaaggcagaaataaagatgttctttgaaaccaacgagaacaagacacaacataccagaatctctgggacacatttaaagcagtgtgtagagggaaattttagcactaaatgcccacaaaagaaagcaggaaagatctaaaattgacaccctaacatcaaaattaaaagaactagacaagcaagagcttacacattcaaaagctagcagaaggcaagaataactaagatcagagcagaactgaaggagatagagacacaaaaaacccttcaaaaaatagtgaatccaggagctagttttttgaaaagatcaacaaaattgatagaccgctaacaagctaataagaaaagagagaagaatcaaatagatgcaataaaaaatgataaaggggatatctcactgatcccacagaaatacaaactaccatcagagaatactataaacacctctatgcaataaactagaaaatctagaagaaatggataaattcctggacacatataccctcccaagataaaccaggaagaagttaaatccctgaatagaccaataacaggctctgaaattgaggcataattaataacctaccagtcaaaaaaagtccaggaccagatggattcacagccgaattcaccagaggtacaaagagaagctggtaccattccttctgaaactattccaatcaatacaaaagcaggaatcctccctaactcattttatgaggccagcatcatcctgataccaaaacctgcagaaacacaacaacaaaaaaagagaattttagaccaatatccctgatgaacatcaattgaaaatcctcaataaaatactggcaaattgaatccagaggcacatcaaaaagcttatcaccatgatcaagttggtttcatccctgggatgaaaggctagttcaacatacacaaatcataaatgtaatccgtcacataaacagaaccaatgacaaaaaccacatgattatctgaataatgcagaaaaggcctttgacaaaattcaacagcccttcatgctaaaaactctcaataaataggctttgatggaacatatctcaaaataataagagctatttatgacaaacccacagctaatatcatactgaatgggcaaaaactggaatcattccctttgaaaactggcacaagacagttgcccctctcaccactcctattcaacatagtgttgaaatggccagggcaatctggcagagaaagaaataaagggtattcaattaggaaaagaagaagtcaaattgtccctgtttgcgatgacatgattgtatatttaaaaaactccattgtttcagcccaaaatctccttaagctaccagcaaattcagcaaagtctcaggatacaaaatcaatgtgcagaaatcacaagcattctatacacgaatagcagacaaacagaaagccaaatcattagtgaactccgattcacaatgccacaatgagaataaaatacctaggaatccaacttacaagggatgtggaggacctcttaaggagaaatacaaaccactgctcaatgaaataggacacaaacaaatcgaagaatattcatgctcatggataggaagaatcaatatagtgaaaatggccatactgcccatagtaattttagattcagtgccatccctatcaagctaccaatgactttcttcacagaattggaaaaaatcctttaaagttcatatggaaccaaaaaaagagcctgcattgccaagacaatcccaagcaaaagaacaaagctggcggcatcacgctacctgacttcaaactatactacaaggccgcataaccaaaacagcatggtactggtaccaaaacagatatatggacgaatggaacagaacaaggcctcagaaataacaccacacatctacaaccatctgatcttcgacaaacctgacaaaacaagaaatggagaaaggaccctatttaataaatggtgctgggaaaactggctagccattgtagaaagctgaaactggatcccttccttacactttatacaaaaattaattcaagatgattaaagacttaaacgttagacctaaaaccgtaaaaaccctagaagtaaatctaggcaaaccattcaggacataggcatgggcaaggacttaatgactaaaacaccaaaagcaatggcacaaaagccaaaacagacaaatgggatctaattaaactaaagagcttctgcatggcaaagaaactaccatcagagtgaacaggcagcctacagaatgggagaaaatttttgcaatctaccatctgacaaagggctaatatccagaatctacaaagaactcaaacaaatgtacaagaaaaaaacaaacaaccccatcaaaaagtgggcaaagaatatcaacagacgcttctcaaaagagacatttatgcagccaacagacacatgaagaaatactcatcatcactggtcatcagagaatgcaaatcaaaaccacaagagataccatctcacaccagttagaatggtgatcattaaaagtcaggaaacaacagatgctggagaggatgtggagaaataggaaggcttttacactgtggtgggactgtaaactagttcaaccattgtggaagacagtctggcgattcctcagggactagaactagaaataccattcccatagaaataccagtgatcccattactgggtatataccaaaggattataaatcctgctactataaagacacatgtacacgtttgtttattgcggcatattaatgattgtaaagacttggaaccaacctaaatgtccatcaatgatagaatggattagaaaacatggcacatatacaccatggaatactatgcagccctaaatgatgagttcatgcctttgtaggtacatggatgaagctgaaaaccatcattctcagcaaactatcacaaggaagaaaaccaaacaccacatgttttcactcataggtgggaattgaacaatgagaacacttgacacaaggtggggaacatcacacactggggccttttagggggtggggggctggaggaggatagcattaggagaaatacctaatgtaaatgacgagttgatgggtgcagcaaaccaactggcacatgtatacctatgtatcaaacctgcacattgggcaggtttaaagtatattattacatttattaaagtataataaaaaaaatacaaaaaattaccctggcatggtggcgggtattgtaatcccagctacctggaaggctgaggtaggagaattgcttgaaccccagaggcggggttgcggtgagctgagattgtgccattgcactccagcctgggcaacaagagcaaaaattgtctcaaaaaaaaaaaaaaaaaaaaaaaaaaaagcaagaaatatgctgttttcaaataaaaatttaaaatggcttccctatccctcaacaaaatgtaggtttattttgaatttacagattgttagtcatgctgtttttttttccctaaatttgaagcttcttttaagtttgaggaattgcacattgaagtccacgaaagtgttaattggtgataccaaattatgaactatcatatgaaactctattttagaaaataaagataattagaaaaaaagaagaaagaatataaattgaggatttccaagaagtactaaaaaattggtctatttggttgcataattaccaacaattccacaattagaggacaattttggaactggacaaactttagactctgaaatgtttttcataagcaaaaaagggaacatctccaaaataagattctaattctcagaatctcttgtgatgaccttaaagaccagagtgatgagactaaagtttcccaacgagagaattggtggggctagagccaatgaactgcaaagtaaaaggtaaatgaacaatgagacaccatctcataccagttagatggcagttattaaaaagtaaaaaaacaacagatgctgtcaaggctgtggagaaaagagatgcttatacacttccatactgtcggtaggaatgtagttcctaccaattagtttagccacgtagaaggcagtttggaggtatctcaaagaacttaacacagaactaccatttgagcaagaatccaattactaggtatatatccaaatgaaaataagtcattctaccaaaacaattcagactattcacaatagcaaagacatgtaatcaacctaggtgcccctcaatggtggattggaaaagaaaatgtgatacatatatatcatggaatcctatgaagccataaaaaataacaaaacatttccttagcagcaacatgaatgcagctggaggacattatccttagcaaattaacacggaccagaaaaccaaatatcacgtgttctcacttataggtgggagctaagcattgggtatcatagacataaagatggcaatgatagacactggggactactagagagggtaaggaaggggggtaacagttgaaaaactaactgttgagtactatgctcagtacctgggtgacagaatatttgtgtcctaaacctcagcagcatgcaatataccctgtaacaaacctgtacatgtactcctgaatctaaaatgttgaaattatttaaaaaaggagtaaaaggtaaatgagggaaagatagtattttgtggacaattttgggagaaaacctagaaaagaaagaaataggagggtagtaggtgggataccaggaaaatttgtcatccctgttctcccttcctctgttgagtagacaggacagaatcatatttatgagcatcagagtaggtacagatagagctgagagttgaaaaaaaatcagtaattgataggattatcaatgaagcaaggtctctttatattaacccaccttaaatggcagttgatgcaattaacaagtctagtttcctttggccactctctattttttaatttttgtcccatgagacactacaccctcctagttttcacccatcattcactggcttttcacttcagtttccttcttagctttcctttcctcttaagaaacacaagattctcagagctggtctggggctttgttttcttctatgtgtgatatgattgtatgagcccatcatgctcacagtttaagtgtgataatatcttcatagtttatatacaggtcagatttcccatctgaattgcgacttaacttatatccaaacaatttctgaacatcttctctgcatgtctcacaggcatctactcataatgtgtctgaaacagaaaccttgacttcaccccactcaacccaaccagctccctgcatttccctcataatggcatcgccacccaccttgctgcagaaatatggattctcattagacttcaccctcttcctgaccataaatacaatcaatccatcaacttctattctgtgtttgccaacagatatctcagctataacatctttatacctccacagttgcctcccctagctttgagcatccactctctttctccaggattattgctggagtctcctaaagggacactactccacagtttgtcagatcaacaccactcttctgtttaaaatcctcagtcaatttctatggacaaagtgaaaaggaaaaaaatccaaattctttagtgtataggacccctgctcaactttcaactgcctgtcattccactctcccctcacacactccaccttggccttctttcagttcctgaagaacactccagcttttgttatttgcttaacttctagcatttttgctacccttccctgtcttcgcagctggctgcttctattcctttagttcctatcttaaatattcccttcataagatgccgtctctgacaacgctttcacattttttttttttttgagacagagtctgggctgagtggagtggcgtgatcactgctcactgcaggctccgcctcccgggttcacgccattccctacttcagcctcctgagtagctgggactacaggcacctgccaccacgcctggctaattttgtgtatttttagtagagacggggtttcaccatattagccaggatggtctcgatctctgaccttgtgatccacccgcctcagcctcccaaagtgctgggtttacaggcgtgagccatgcacctggcctaccctctcaaaattaactattcttttattattctctattattgtgttctgtcacagcattcatctatcaatcttatttccttatcttctgcatccaaaattttctggggtaggacaaatctgccttgcttactacagtaccacaagcttccagcacagttacacataaatatttgataaatatgtattgaatgcatgaatgaatggatggagatgagatggaactaaagcttaaatagtggaagaaatatttccctttgagatagaaagtacaaaaaggtggtacgtatacaaatatatttatgcacatgggatgagaagttgaaaatattcatagctcatatggaggaagggttatctgttaatgtaataggctaggggcttgaggagaatggagaatatttggacagatactatgggcaatgggagagaatgctggccagctagctaggatttcagagggcagtgagcactttcctgaaactggagatgccaaaattttatgaaatttcaatatatgtttgctccaccagtgcctgccagcctgcgtgtaagaagagataaagcaaattgctggataatatgagtctaagggatatcagagcacatgaggtagaaagagaatgggtagtgaggttgaggggactggtgtaaggtggttgaatgttccggcatgggctctgggtcagggaaagagaagtaaagctaaggggagtttaatagcctgagtgaaagggagggtacagaagaaaacagtacagcctatgacttcctcatctctaactttataatataaattaatgagaaattcacattcacagttacattttttttaatggtatttggtgctgaaaaaaaaatcaaatcagttctgaaagaaaggatcaattacacaaattcggcataaaccaacaagcccggctgtgaagtcctagagttgctttatggttaaaatttggttggtctgagaaacatccagtgacaaaaggaatgtatcaggaggagttaactaagcaggctcatgcaaatgactcttcctatattttaaattgtagagtttttgtcctttttagaaggaagttctaaaaagtgctagacagtctaaaattgaggtaagaaaaattctcagaaatttgagagatttggggaagacacctctaatcaccaaaatctaatcctctattcccccgattatgtcatggtgccttaatttcactattagtaccctcatgggcagatcatgagagattccactagatgctaatatcccagcaaataagtagtaccctgccaattgttgacaaatatatatcttagatgtgtttaaagaattacaatgaagaaatctgtggaagattatatggtacagatcatattagtgcctggtaaaagcaatattacaggagggaaagagggacccaaaagagatgcctgagatttccaatacaaagtttcagggtgtgcttgatttggggtgactgacatgtcaaggcactctgacatttacagagacctgttctcctcattactaaacagattaaacatgtttccgggtatctagcaaaactagtgtgcttgttttttcaaaggaacagtgggaaacccccgcaaagctttcagcattttaaactcttactctagctttcatactggaagaaaggttacttgctaatgtaatagggtaggggcttgaggagaatgagaatattctgggcagacactatgtcatctagttggcataggttgtaaaaaccatttcagttatcctacaccaacctaattcaagcaagtttcctttatttcagtttttccttaattctgcctatatcatgggaggagaaattgctgctaaagtctaatttgaatgccagatattttaggtttgtaacttttttgaggctaagaaatcacatttatattctatatgcctatttatatacaaattaggtatttagagtctactggtcccatgctatacttaaaaaattaatccaactctttgtcttgggggggaatctaggcttagattactgcagccaatccaagttctaaaacaaatggggcctctaatgtggggagtttcactatcctgcacttagctgacatactactgggtggacagaaagactctggacttgagaaagatgacaagagactaagtttttagttcatctagcatttattggccctatggccatgggcaagtcagttaggcccctagaaccttagttcctcacttttaggatgaagattacaatgccttcatcacagaacagtggtgaagatttgagagataatggatgtaaaaatattttgtgagcttcatgctgaaaaactcatgtgagaaccacgattacccataatgcaaatacacacattttgagggagcacactgcctttttctgaagagtcctttaatctgaatctatcaagtgctcaaccatttatcgagagacccagaaagtgagcgtcccaccctcctggcttctgtgtgctgaatgctgagccactaacctgatttgaatgagcctatcaaatagagaaggttttaaatcataagattgagggaatgataacattctctctttctatgaatttttcattttattccgagacagtcaagatgtactatgtgggtcaagtccagccttcacaggtttgaacagaaggtcaaggagaatattttcttaacttctatttgcattcaactactgccttcatgtgagccttcaggggccttcactccccaagcactgatgtctaggaacatcaggaggagaattgagcacacagctgaagagctctgcctgggattttattctttctcccagaccttagaattgttggggctgctttccctctcactgataagaaggtacatgatataaaaactgtattttcatgttttgttctttctagggtagactatccatgacattagtcaaaatcacctggctactgattcagaaaatttaagtcacactcatcacttctactcaaagttcttagccagctgcggctgtggttgccatggtaaatgtaaagtcatcaaagtgaaggactcaggcttagaaatataagccaccagcataaacattcaccacttcaacaatagttgttttgagcaggaagctgtcacagtgaaattgggacggcagggagaagaggaggaggtgtgtgatgtggcagaaatagtactaggtggggatgttctgtctttcctgctgtgtatgacttgggcaagtcatttttctcctggaacattgtctgtaacataaaggactagattagaaactttcaaatcttcacctagtattaacattctgtggttttctatgcaactttagcatttcctgtaagtgctttcctttgggtcataagtcccctgagaaaaggcaaattaaattgttattctatggtcttaaatcatttaacggtttcccactggcccttggaagaacctgaaggtctgagtgatctggactctacttacttctgtggcctcatttacgtcctcattgctctcctgaacccatgtcagatttccctcgatttctcaatggatcatcctttttactgctttctccattctctgactctctactctttcaggttgcagctcaaacatttttgttctctcccaggacggtttagctttttatctcctttttcccaacagtcccctgtgtttcggcatcacattttgtgtatacgccttgaagtcaatgaccatgctctgatgccatactttgcagtagcagcccaagagatttgttcactgcagggctgtggttatggccaagttttaaagaatcacctttgctagtgctatataggaaatgctttcctataatttttttctctgatgaggtacatgtcatgcaacttaattcccatcatgcatctcttacccatgtataaggaagagaggtgttttaattttgccaatgtcatatgactataaggaaacaaaggaaggaaaagctgtcacctgtggaaagacactagaattaaaaattgggaaattttcttttgaatcccaaatttgctattagtttgcgggacaatggataaatcatttattcttttacagtctcactcttctcaactgtaaaacattgaaagttaatatctcatagggttgctgtgaggattgcttagatacaaacacacacacaacacacacacataagtctacatgcatacatatatgcatacacacacatcactgactgaacaaaactaagcattttctttgtgtgtgaagctgagcaatggagggattcccctttagcaagggccttggcaagctaaggagacttgcaggtgatgatggtcactacgtggggagagttctggaggtggagagggaaccagactggtgcagtggaattattactgagtgaggaagagtagaaaactagaggttgggtcccaacattggcacttgtgagctgtgaggccttgggcaaatactttaccatttgctcttttttcccccctcatctgttaataaagagaggtaacactttctaatctggcatggccacaaggatcagatgaaataatatgcctgaaggatgaaaggcctaactgcctggcatggcgcaccgctcctgattgataggcaatgagcaaatatcacgtgcatgaaatgaactgccactgtctgaaatatctgctattatctgaaacctcagcttcctctgctcagtttttctataggtaaagctgggatgatgatagtatctaccttgaggaattgtttaaggattaaatgagaaggcaagttgtgaagcctttgtaaacactgtttcctcatattgcgcttctcacacatgtccatattatcaacattttagaagcaacgccagttgaggaggtactgagtttggtataatatagctgtttttccaggagactctaaaaagctcctttcatttcgaagcaaacagcaaaatacagcttctaaacattgctattttccctgaattttctgaacctgagcaaaaaagttgtttctctcttgagaggctctgttctgattggatcagccagaaaagccaataggaagttattttcagggccaagagtaccagggcaatattacagcaaaagtttgtatattatgctgatggttaaactgggccttgtgttccgtatatgaaaaagtatacttcttcaaattcctgcatatactaactactctctcccaggagtgtttctagggctttcacagttttaggaggaaaagtcaggaattcactttaacatttctgttttctattaattaggcacttttagctgttttctttttagaaagaaactagtagcagaatttgaactagtagcagaatttgctttccattcttctcctctaatctttgttgtctttgttattccctttgttataaggaagtgggataaataaaagtattcaaaggcccagttcattgtcctttggccatatttcacctcattatgttacagcctagtctgaacccttttaacaagttttcctttttatgtcctgcttcctacatgacttttgagtgaaaaagagtactgtgctctaacacacaaacacaaatgctacaaatgcatgcacgtgcacacacaaatgaacacatacacactattcaaaaggcaccacgcattgcttacccatagaggtgaaagcaggaagtaaatccttttgaattcatctcatgagtttttttttccctgcctccaattggtttctcaaggagatctcatagcttctccaatcattttaattaatgttctccaatcactattagtcacaaaatcacgttcatttcatcaattagatttgtgtcccatgtaaaaattaaaaatttaaatttaatttaactttaaagtttcttttttctctcagcctgataaacttttagaagctcaaagtttgggaggatacctgatcacttattttctctcttctgtctcctccccctcctcctcttcctcctccagtaactcattcgtttagtttttgaccctactaggatcaaaattaaggttccagaaagtttttctttcccctcataatttagattggtttgtggcaaatgcatggtgctatcttttgcttttcaaatgtgccaaaaaaaacctttctttagctgtgtaggaaggaatcaaattattggttgacagtcctggcctgggctaagagaataaagaccattttaattgctttattgaggggcttgccagagtttttagggaaagcaaagcattaaattaagcagttgagtaacgttatgaggacacagcagtggagacaagcacgccagaattcttattgtactttaaaaactaaatgctggcagcaaaaattctttgagtcatttttctctaaattcagattcaggaagtgcactcttaaaataagttcattttggagttccatcttaactatagcttcaggccaaaagacagacttctccaagtagaacgccctgcataggatcacattttagcaaaacctgtgtgtacgtgtgtgtgtgtgtgtgtggtgtgtgtgtatgtgtgttgattgttgctgacagaaacaaacttcaatcattaggagcagaactgaaaggattagcttttaattaaaaaaagattaaatatggaactttaactgtcaaaaagcattttatttcaagcaaattttataggcaaaatttctaggcaacaatgaagttgtttttacatactgacgtaaaacattcttgtaaataaaataggctttcctctcttgaaagcaaaacattaaaattaagaaccaaaacaataacaaaaatataaaataagggataaacacaattaatgaatagattatagtgttaaacagaatgtatttgccttaaatcagattttaatacttctatatattcataatgaaaaattaagaagtcattattaatttataaacagacttgcgcaggtttcatttgaattgctaccttttgattatttttaaagtagtatcaattttcaaaatcatttcagagaaacaaattgtaaattcatactgtgtaaacctgttgcttctgaatgtcagcactgtgatcagtgctaaaggagtacaaaataaagctaaagacaaagtttccttcaaagcttataatttcactaggaaggaaaaacagacgttcaaggattcagttaatgaagaaacagaataaacagtgtttcagtaactaggatgcctgtgtacactaagagtaattgcaattagaggtcacagctacctcatggtccaggtggaaggaagccacagttggattctgagcacattgaattagaatgtgtgcaagagaatggtgaggatggagggaggctgtgggaagggacagtgaatgaaaacctcagtggatggttacaactgtaaagggtggagaagagcaaagagttagcttttcttatgctaagggcccagcttggagaaaatgtcatgtgcagggtgctattctataccacaaaggggagaaacatgggcagacagaaaaggacagtgtgagtaaccctgaaacagaaaggagttcttgtgctttagaaaagaggtgtgggccggatgcggtggctcacgctgcaatcccagcattttgggaggccaaggcgggcagatcatgaggtcaggagatcgagccatcctggctaacacggtgaaaccccgtctctactaaaaatacaaaaaattagctgggatggtggcgggtgcctgtagtcccagctactcgggaggctgaggcaggagaatggtgtgaccccggaggcggagtttgcagtgagccgagatcgcaccactgcgctcagcctgggtgaagagcgagactccatctcaaaaaaaaaaaaaaaaaaaaaaaaaaagagttgtgaaattgatcttaacattttagcaatggtcctttgggactccagagaaaacggagtgaaaaagcagtttggaaaagagaatctgattttagaactagagtaagagaagttgtcctggaaatccctcctgtctcctctacctttttattgttgttgttgttgttgttgttgttgttttctgagacaggtcttattctgtcacccaggctagtggcacaatcttggttcactgcaacctcgaccgtcaggctcaagtgatcctcccacctcagcttcctgagtggctgagactacaggcatgcacaccacccttgggtaatttttaaatttttttgtaatgatgaggtctcactatattgcccggctgatctcaaactcctgggctcaagggatcctctaaccatgtcctcccaaagtgctggattacaggcttgagctaccatgcctgtcctctacttcttaatggtaacctcaccctagacatcagctcattcatctttaagatgatgttaactaccgactagttattatcttcactggtgaagttgaatttaaatgattataccaaatctgtgcgcttttttttttttttttttacttttttggttcattctgtatcaatgagcagttgtgatatgacagttatgtgtgaattcactataacagtggattttggggaaatgaataggccaaaaaggaagatattctccaaaactttaaaatttaaaggttgcagtaggatgctactccagctaattttaagctagccctcctgattcttacagttatttctctctctctttctttcacacacatgtactcattttcttattcattttataacaatttccccttatgctgacttcgaaaacttattatcttaaaaaatcttatgcatgcattcctgtaagcagctacctcaaacgctttttgagccaggctgaaaataaataagccaaatttaaaaaaacaaaaacaaaaaacactccaaatcttgccaaactgatgaataaatgttttttgattgtattttctttaacctttatctatatgaatacataatttacacaatttatagtcaaggtgtttgggtaaaagaacaaaaaatgatttatcctctttcaaagaaaggactacaaaaggactgaaaaatactttgggaggccccaggtccaggatccctggtggagacccctgagtggagcgtagcatccgccaggcagcttgagacacacctatatttagccaggtgggttatgtgataagagggaggaggcctggccacatgctctctgactcatcctctaagcacatgtgtcaatttttcctacagttgggacaacctccttcagaagacagagcctgctgtaactttcctgggctgcaatgcttaacttctacagaacaaagtatagaaactaagagcactgggagtccccgagctttcaatgagccacactagtgataacatcgttattacttgtttgagcacccccacccccgccacgcatgtgccttttctctggtttggaactggagctttgcttctgtgcagtgtctaattcctccccagactccctagcagcctgccaggtcaataaggcatgttaaaatgaaactgctttaacggctacttcatttccttgcactttgtgttcaagctggcatgtgtaatcctgtgatacacaggactttagattagagctgggccaacacaattttaggatcctttttgaggggagattggcaagagatggaagagagtgcagaataattttagcatgaattttaatcatttctctacaatgactagctttgtgaccacaggcaatctagctcccagggcctcagtttcctcatctttgagtatgtctgcattctcctcaagactgtgatatcaccagggtgagaagcgtgaatggcacagtgcttggtataagcagtgcatggctgatgctgtttgctgatggctaagagatggaaaacgacctggttgtagccgacatcacaatgagagactcttctttctaatgtggataaagcttctcctgtatctgccttcctcctagtaacctgactaaaatgtaatgctgactacctagatcacaaagaagaattttctacagaagccaacaaggccattgtttacatgccacatgtgctaagtctcaatcttgacattccccaatccacttcctggcaaatattgtttgacttagggaactgagttaacagatattgaacatacggtgttgagtaccttcacttatcagtgggccaagaaaaaaaatgccaggaacccaattatattgaatcagattaaatatctatgttttgatccacatctggtgatatagttataggaattaactttttgaaggactggttactgaaggcccattgggcagctttagaactgcattacctgagaaagtgttgtaacttctgagcgccctcgccagcttgttaatttgaaccataatgacgcctcctcctttgcagggctcatatggagttcatctatgtgtatgcaggctctttgtaatagtgaatgtctacaaatataagtgattattattatgctttttatacctcctgtaggtgttgctggtcatggactgattgactttttccaacattatgattcctatgtaactgatctctgaaatatctaccatctccacctataaaggagattaaattttagggagtaaagtcactttcttgctatcctgcttatcattacttatgattaggcagaattctgctggttaagatatgttccagggaggcctagaagagtccttctgtgtgcttctttcccaaatatattcctgacaacttgctaataatgaaaagttccaaaattgggaattcacttcattgtcactattctaatgaattacactttaagctctaccatttatatacacgttattatgaactgagttcatctaacattttaataggttttcaacagagggaagaaaattgaacatgagctaatggtagggaccaagtctcagagaacaagaactctgcaactgctaataagagaatttttgtctctgtagctgtgaaatatttgaatgatatccaatgattaatgtttctttaattctctaggtgaccaaaatcacacagaattatctagcaataaatcctctttacataacagccaaagcacttggggtgaggaaagagaagagaaataggtcttacccagcaggtctggtgtcttcaatggctctatcactgggatcaaatcgctaaggtagacattgaagtttccttctttccatcttctttctgctccttctcctttccatgggggacaactacaggacgcccaaactgccctggagctttgggtcccttggagaaagtgtcacatcaattcttaacacctggtgcgttccactgtcttcagtaaaagggcttttatatgactctggttgtattctgtagagggggctttggcagttatgtgatttttgctggctctagccctccagttaaagcatggttagtttgggacagtggcactcatgtggagcaagtgaagaggaagacatctcacttctattcctggaaatgtgtttactttgcttttacccaatactttaggaaatattgttttggttttagaattagagacctctttgggtctgccttttgctcttcctctttggttataatcacaagatggctttcagagaaattgatttcttcccatgagcccctctagctccatcatcctttgacaaacttcccaaaggtgtctattaatagattgcttccttaagcgatttgaattgacagtgaacttaggaaaaggaagaccgtattggctttgtgtttatttgcattgacttctttgctctgagtcttagttttgtttaggccatggcttccccagacttcggcactgctgtgctggcagggtgtgccctctcgtttgtactgcctgtgatcgctgctttggtctatcagtactaagactgatggtcacattcaagtcctttcagctgctagttttgatgtgtcactgctgggactatgactcttccggggctcctttttaaactgacacgtcccatgtgtactgatattttgactacctgagttccttttgctgtatgaatgaggtctttggagccccctgagctgtcgtttgctttggtgtcccctggtgagggaggcttcaggtttggtgcctctcccgtctgtcttctgcttgttaggagtcacagggaggtctgcagatgtgcaggatgccacaacggcacaaccttgccccttcccagggcattctcatttttctttccctctgggtttggtccaagtccacctcaaccttgagcacactctcctagtttttctaacattctctttgccccatgcccctttcccatgtccccttaggggaggttcatctcttttatgctgctgtaaaaaatttttccttggtctggctgaactctgaatcctaccgctccctcctcacaatgtcttccttgatgacccgagtgttgatctcactgaatgagagcggagagctgccatgtcaaagaggagccagatgacagaagctacaaagataaatgccagactcgcccacttcctcggaaaaactttcggatcctgttcatggtacaaagctttccctgcagcctgccctcccttagcctgcttaccttgagtggagaggaagctgaagtagcagcacagcagcagcagcagcagagttgccagaaagtgaccccctcccctgaacacagcaggaacagcagtccaaggggaaagctcagttcctaccgcttgtcagtctctgcctgcgtggcattcatagcagagcatctgtgcctgcttggctggccctggctaagttctgataaacactggcttaggtcactccaggagcagttgattccagccaccgaacagttcaacatatcacttgtttgtctccgggagcccatgtccaccttcctacaagcccaagaaaaggtgggggccagatgagactgccgtttctctcctccccgttctccgtctgcacgctgtaactcaacaccactttcataaggaaaacatttcatgccattacccagaaaacttcattcagctctcaccttctggttatgtgagagcatgtgtgtttaaacggcaattaaagaggaaaaaaagctatctaactggagggcatgtgttcctggtttgtgaccccacctaccctactcctgctcattaaccctgtgtagccaggtgccaatgctctgcctgaggaatttatcactgaagttaacatttcagcttaagacataacagcttaaagaaggggcctggtatatcctcacttccagagatgtatatgttaattatttagatcattcattcaaggggtttcaatgtatttctttgtaagccaactattttttttcactaatccatctgtttttattattacatttgattacaaataaacttaattttcatactgctataaaagtttctaaacactttgttatggtctgaatgtttatgtccacccaaattcatatgttgaaacctaatcataaatgtgatagtattaggaggtagggcttttgaggtgatttcattataaggatagagccctcatgaatgggatcagcacccttaaaaaagagccctattgccttgccattccacaaagtgaagacataatgagaaggtgccatctatgaacaggaaatgggccttcaccagtcaacgaatctgctggtgccttgatttctgacttctcagctctagaactgtgagaaataagtttctgttgtttatgagtcacttagtctatgttattctctatagtagcctgaacagattaagatacacttactctcagtttcagtacttatctcgtttaaaccagcaagcaacagtttcaggaccacaccaggacttggaccagattttgagtgagctggttgactggtagggtagcagttccgccacaggcttttcattagaaccacttgaaaaagatccccaaaactctggtcaattgatgagagaggaggtggagatgacatttgggctgtattgtattaaatatatatatatatatatatatatatatatatatatatatatattttttttttttttttttttttacaaagcttcccaggtctttcaaatgtgcagctaaagttgagaacactggtctagaaaaaaagtctcaattttttgtttgtttgtttttggtttttgaacatgcctatgagacatttaattttaggtgtctacttgactgggctaaggaacacccagagaccagtaaagcattatttttaggtatatctgtgagggtgtttccagaagagattggcattgactcagtgcactgagtggggaggagatgccctcacccaatgtgggcaggcaccactaatggttgagggcccagatagaaaaaaaggcagaggaaaggtggattctgtctctgttagtagctgggacatctttcttcttctgcctttggactagaactttagattctctggctttggctctggggcttgtaccagtctgcccccacaacctccacatccctcactaggttctcaggttttgacctcagactgagagtgatgttattggcttccctggttctcaggcctttggactagaatgtgccatgttactggctttcctggttctccagcttgcaggtggcctggactgagtttctcagtctccataaccacatgagccaattcctgtaataaactgcaactcacttatcacctctatgaatcctattggttctgtttctctgaaaaatcctggccaatacagtctacacttgtgtgacattccttccctgtctaaagtacagtctaataaaatctatgcattcccatacaactaaatcagaatacacattttgacattgccagttgtaaagattgtccatagagttgagaagcacttctcgggaccactgtccttctctctgaggaactctgagtgatttgtggaaacactgctgttcattactctagtgtggggagggtctagcttccatgctttgaggtaaattatgttcccaatgacttgggaggggaaggagagattccaaattcatatatatatctcagcactttgctaagttctttccattgactatctcactcaatcctcacaagaatctaatgtaaggagtaaattacaatatgtattttgtagtcagcaaatgaaaccttagagaggtaaagaacttctggtagagattggaggggttgggtcttgaatacacgactgtagtccgtgtgctcaatatcacacaatactgctctctagctgtatgatcttgcaggctagttaattttatgtgttactgagcaataaaaaaaaattctgctttgcagattaatgtgagaatatttaaaaatgttaaagttattgttatattgaaggtactctttaaatgttagccattcatattgttgctatactttgctgtaataggagtgtcggatgcatgtgggaggcaatgtaccagctcttcccaaaaaacaagtagaaaactagtgactaacatgattctggcaatggggaagaaacaaatcgagtattttattttattcttgccattcttatttcctctaattatagatttaacaagaccttgttcactgagaactccctacatgcccaaaacatgaagtaggtgacattgtctctgccctaacaaccttaaaactcccctcagtagaacgccaccagtataataataataataataaaaaagaacgccaccagcaaaaaacatagcacacatctttagcatccacattcgaaaataagtgagaattttttttagcatcatggataaatggtttgcattacaatattgttttaaactgaaaatagaatactttaaaattattttactctgcatgattcaatcttgtccagccacctcccaccccaaatggcagttggaattactcaaatgtcttttaggaaagtcaacacttgtatattctatgcttggcagtttaaaacactgcttgaaatatattcttgtttccatataaatttatcaaagagtactgatttctttttatccctctctggtttgtccttgcgaatcaaaaacaaattacttgcaacaggagagcaacatgttaagaaaattaaaagggaatcttggctttctatcatgggtaaagcaacacattaactctggcttagtcttcggtctatttgacatacattcagaatgaaatgtgaagagtgggtaggagagtaaggaaacattgattaaatatcctgaaatggaggagtagatttgttgtcagacctggtctaaagtactgacttggccactaatgccatatgactatggatgtgtcacacatggaaaagcttgtgtaaggttctcttcccagctcttcttggtcttttcccttgtgagtttatgataatctgtgatgatggtagaagttggtataagccataccactaattcaacactatgtgtcttcaggcactcagtaataatttctgtgccctcatagctgtacatctttctccttttttttctcttttccgacacacatgctgtttacatctcagatcaatgaattgcataggtaaaaggaatagaaaaaaaaggatattaggaattctaccttttcatcaacacacatattgcccaacacatgacatttgtatattggtaaatacggtgcttctaaaattttagttgtattaatttccatgttaccagcaggaaactaaatagtaagtgggttggttatttgaggtaccccacagttagggagcctggcttgtcatcccaatcgtagaatgcaggtacctttggctggtcaaatttctcaagaatctgtacatacttagtggagatgatatccatctgaaaatctggagttacgaattatccttgggagacatttggagggttattccaattatcagtctgactccagcttgtactaaacatttaaaaacagattttatttcttcttctgtaaaacgagcataatagtaggaggacttgccctctactctatttggtgttgtcaggataatcatattaatagcaacctttcattgggaatttactgagggcctaccctagtcacttcacggtatctcatttaatcctcaacatttaattttctcagactagatcaaaactgttcagcaaaacagatctgcataaagttagagtgaaaagtatatttgtgttatatctcatggcaaatgtctttgaatcatcctcattgttaatcaagtaggagctcagtaaacctgttttatatctagccttaaatctccctgatggaagtacagaatcttagaaacaccggtccagctctctggctttgcatctacagttactttatctgggtatttgaagatttcttgatatgtgagtatatcctaagtaactaatatctgttttattttatgatatttactcaactatcactcctaagtaaaaagaaagatgtaaaaggaaaattaatttaaatgtatattttacaagaataatgattatccatggatgcatcactgaatttctttttccccagttttactgagcataattgactaataaaatgatacatatattaaatatttaaggtgtacaacatgactttgatagccttatacattgtggtatgattgcctcaatgcagctgatctccattatctcacatattatctttttttgtgtgtggtgagaacatttaagatctactctcttagcaagtttcaatatacaatatattattatcaactatggtcatcaggctgtacattagctctccagaacttctaatcctgcgtaactgaaactttgtattctttgaccaataccttccaactttctccatccccaacccgcagtaaccaccattctactctctacttctatgagttcaattttttagctccgcatatgaatgagatcatgcagtatttgtctttctatgcctggcttatttcacttaggtaacgtcctccaggttcatccacagtgttgcaaatgataggattttcttcttttttgagcaaaataacattcttgtgtgtgtgtgtgtgtgtgtgtgtgtgtgtgtgtgtgatatattgtatgtatgttgcactttctttattcattcatctgttgatggacacttaggtgaattcatatctaggctattatgcgtaatggtgcaacgaacatgagactgcagctatctcttcaagtgctgatttaatttcctctggatatatagccagaagtgtgattgctgggtcatatggtattctattttttagtttttttgaggaaactccacactgttttcgataatggttgtactatttacattcccaccatcagtgtacaagtgttcccctttctccatatccttaccaacactgttatcttatatctttttcatcatagccattccaaaatgtatgaggtgatatcttattgggttttgatttgcacttccttactgattagtgatgttaagcattttaaaaatatgcctgtggccatttgtatgtcttcttttgaaaaaggtctactcattttttttccctatttttaatccagttgctttcttgatattgagttgagctctttgtcaatcagtaggagcgcaataaaatggttatatatttgagatattaactccttattggatgtatggtttgcaaatatagtcttcatccataggttgtcttttcactctgttgattgttttcttggctgtgcagaaacttttagtttcctgcagtgtcatttgtctatttttgtttttgttatctgtgctttcggagttccaataatcaccactcagaccaatgtcaagatttttccctgtgtttactttcagtagttttcacttttaggtcttctgtttaggtctttaatcaacattgagttgattttaaaccacaaaaaattaagcaaacaagcctatttacaatagcataaaagtacttaggaataaatatttttaaccaaggagatgaaagcatttttaactaagaaggtgaaatctctgtgtactgaaaacttaaaatattgatgaaagaaatggaagacataaacaaatggaaatatatactgtgttcacgattgaaataattagtattcttaaaatgttcatacaaaccaaagtcatctataaattcataaaatgtctatcaaaattctggcgtttttcacagacatagaaaaaaaatcctaaaattgtatggaaccataaaagatatcgaatagtcaaaaaaatcttgagaaagaagaagctagagcatcatagtacctgacttcaaaaatatgctaccaagttatagcaatcaaaatagtatatactgtcttgagacaagcctgggcaacattatgagacccccatctctacaaaaaataaaaaattagcagggcatcgtggtgcacctctatggtcctagctacttgggaggcagaggtggaggatagcttgagctcaagaggtcgaggttgcagtgaaccgagtttgtactgctgttcccaggttgggtgacagagcaagactctgtgtcaataaaaagtatatgatactgccataaatcagccacatagaccaatggcacagaacagagagcccggaaataaatccacaagtttaaatcagttgttctttgacaaaacagccaagaatgcataaagtggaaaaggtagtttattaataaatggtgttggaaaaattggatatccacatggataattaatttcaactcattgcgcttcagacaatacaggatgaagatactaattagaaaatttaaatgggaaaaccaagtaatactaattactgtttttttcggattttaatgtgatttttttctttccaaattctctcttctcttttttagagaagagacaagttgtaatcaactggataataacatcctgtgaaacaatccataaaaggaaagaaaagttttaaaatcatatactaaaaggcaggcattattgcaattcaacaggtagagtaaaaatacaaatggaaatattattccattttaactaattcttccatgaagatgaatagttacaacttctggcagtcattaaacattggtgtatgtctctttttaataaaatttggaagctgactaacaaatgaccttatttcctaagaccaagagaatcagtaaccctttacacatttgttcttgaaaagggttgcctgtattagtgataaatcataattggtaagcctaagtttaaaaaaacaagaaccctattattgaaagacaatttattgtgtttagcctcagttttcattgatttttgagtagtgaggctaagccaacatttgtgctatactacttacaggtccctagccaatttttacttaaaaaatattttagtttaattaggaaaaatttataaatttaaaagcaaaacattaattgagtatcttccttggacaaagaactgtgctagtcttaaaatggagaaagtgagcaggttcctgaaggacatattgtcaatgagcccaaaactgcaactcataatcttaattaactgagttattagtattggttaattatagctttggggataaaagagaaaatagctcagggtggctctgtaagaacttcagtaacttaaacaggaatggtgggggaaaatgatagtttgagagaaaagaaaagttcaaatttaaatatgttgtatttgaataaatgaagattttgtaactaggtgcatatttaaaaaatatttatggagtaccgaccaatactagactaggccctgtgctaagctttgggaaaataaagaagccaaagcccataattagtgtagttgttttcatttatatgtgtgtccatcaaacatttcatgaggaagtgttgttaaatatagactctgacgttctcccctcagagatttcaaggttggttgtagggcctagcatctggattttaactggagtagataatgattctgatagagttggaccaccaaccatacatgaggctcacaggttcagcagcagaagcatattaatattaaaataagaaaactggaatagttatttggaggggtgtttggaaaggtgtcctgggggtgatgactgagtgtgaattcctctatgaatagggagagggtaatttaggaaaagcagtctatgcagaggtaaaagcaggctcaaacattgagggaggaaggcatgagaataatatgaatggataattaagatttgtttgatgtactagattttacagtagattggcaagcaacgaggtaaagattgttggctgagcttctttgtatttgttcaagattttggatttttactgttcaagggctagaagctttttaaagttgagtgtgatactctcagggttttggatagagagcgggtgggtgtatgaagaataaattgtagtaagcaagctgcaggctgggagaccaattaacataagtgctacatatttattgccctcttttgaacagtctaatcacacatggaataaaatctgaactttaattgtacatgttagctatttaagatatttttctagatcaagagggaagactggaagagggatcatttctactatagagtgggtcttcattaaagacacagtctcttaaagtgcacgtaaggcacaaatatacagctatgccctctgtttctaaacctaaggtgtgtttaacttttaagaaactgccaaaattccccaaagtgcttgtatcatttcatattcccactgacacttccccacattttcagtaaacttaactttttaattgtagtcatttttgtgggtatatagtggtatctatttgtgttttatttacatttccctaatgactaacaattttgagcagatttttctgtgcttatttgccaatgtctacattctttggtgaattacgtcttcaaatttttgatccatttgttaatggattgttttcttatcatttagggacatgaagaaacctttaaggatggaggtgtgtctactgtctcatcctggtgatgctttcataggtatggacacaatatcaaaatgtattcaattgtacacctagaaatgtgcactttattgtgtatatattatacctaaataaagctgttttttaaaaacaaaaacctaaggaaagaataaggacaattcctggaccaaaaaacgagtgcagtgttttgtttcttactattccaagcaggaaaaaagtggacgatgccattattacagcttgtagatctcaagaaatgaggtccctacttctttggtcctaagaaggagctgcagttctggtctcccaaggtcagtgcagactctctggtttgtgcagtgctgccttaggctgttaaagagagcagccattgtgtgctccctggatgggcccagccagatgcccttcttactctgttccccagggcaaagtacccatcaatgcttttaaaacgtttaaatggaagccactctcaaaattagagtcgtcccattgcctctacattcaaattgttatgttatcattgagttgtataacatttaaatgaaggcctataggcttcaattacagtattgtttgaagaaaatctttataaaatatgaatttttggagcagagttgggtaggagctccagactccaggtctagagtcaagattgtgcaggggttctttctacgaatgacggtgagggctttgatactataaagagagtggatacggctaatcagataaaagtgtgtcaccagaggagacaagaaatgagtttacaaatacaggctataatttaattgtaaaaaaagattagagacaccttttgttttgaaattgttccagttccggacagataaaaatgagtggaagaaagcaaagttcagagttcgggcctggtgacttctgttttctcagagaagtacgagatagactaatggtgaacagtgaagagttgagggtgagtgtgtcaaaagacaacactgtaacaaatttagtttaaagatttaacaggaattggggcagttctcctccacaaatttagaaaaggtgctctgatgggcatggtagaacagttcgtttttaaggacagtctaagcaggaccaaacatatagcataatacaaaaagcagatgggttaccataggttacttcaggttactttccttgcagggttaaaaggatgtttcctgactctaccagcaaaactggcctgtttggatacttggcaatggtctttctctcctgatttcctgaaaggtgaataagcaacttttttagtttggtaccaaggaactttagcacgagtgattccattttgattggtcggttggggcctagttcaggagctcagtccaactcaatgacttcctataaatttatttaacagtgggtaggggttggatgcacttggtaaagtttggaatcagctgttaagagagaaagaaatgtgctacctcagaacaagagtaaggacttctcagagagcttcgagagtctgctggcattttaaccaatgcctctaagcaaggagaaaacacaatgagtgacagtagaaaaagaaggcatgtggacactcccacagcattcctgagacagagtgataaaaggtgacaggaagcagatatggagtaatgatttctgacaaacgtggaaagaaggggatatcatgaaagattttagaaagtggaattgccgtatctaaaagcattaggagaaattctacaggcgagaaaaaaagaaggcactagagatttttgttgttgattttatttgtagaaagagacattctttacaactgcaggcatgttaggactttgccctttgaaaatctattagtaatgatataaaaaccttccgtggtctcttttggcagaaactgaattaaatcttcagctgctctctgaatcaccatttaaaagtttcagtgattcatatgcaaagcttgagttaagagaacaaagacctgaggagtttctgtagggctcggcctaagcaaagttgtcacgcagaacaacatgagtgctgggcccctacccttggccctgacaacctccatccgagcagcaacccctatccaacttactgcgccctgcagcctcccaggtgctgccctgggaatgccctcagaacgggtcctgtcctctgtcctgactctccttcctcttctcatccatccccctgaaatgatcctgtcctctttatggctccattatagcaaagaaaagagaaggaagaagagaggagtagaaaaagaagtcttgtggaggagcagacagcaggtgctatgtagggcatttgagggctcttttcatgtgctgtgaaaagtgggatgaaatgaaaatctttttgaaaaagctggaagctgtttcagatctccccctccctgctccccaccaattcaattcctgctcccaggggaaagtgcaaaataactttctgtgaatgaaatgatgacaatgactttggatccaataatgttatcataacctggaaataaccttccatctgaggcttgcaaaggcagtgaagtgtgaaactcagactacagttagagaaacaaagagacttgaactcaggaccctttggacatttccttcaatatcaaagaaaagttttttttctctcctctgaaaatagggtaggaaatgggtaagtgataaacagagaaaaaggcagagcaatacctaattagaaatcaaactaagagaggaaaagaaaaatgggttcagattaattcaggtttggttattccaggatctcaacttcgttgctgttatcacatactttcagaggcttcaggtcttgtgatgccgtgtgcttgagtgtttttcttactcttggaagctgaggattatactcagggctgggcacacaggagaaaagggtttgttaagcatccactcctggttaagtaaaaaatgtacatagaacttgaaagcacccaactcagttccagagggatgaaataaactaaaaataggtgagctctggttgtattggggctggcctgaaaacacacaagaaaggagccttgaaagagaaggaaagaggagcaatgtgcatattttacatggatatacacatttgtgctacatatttatatacaaatgtacaaactccatgtgtgcttcgtttgtgtgtgcatattatatttatacatatgtatatatgtagagttcacagagcatacccacacaaatacacaccgaggtgctgactttgagctctgtaagaaaaaatttactactcgggaagaaatgaaacagccttttgaggacattggccatacactaccaggtatactaccttttggagggcagatcattgttttgcatatgtttattttgggtaggaggagactcaggagcaacataataaccacttaaaattttagaggaatatcctgtggaagaagggtttaactcattccgtatggttccagagagagaactgagactggagcatagcagatttctgttctaaatgagaatgactttctaacattagtactaaacaaaagacacgtgtatttcttctaaaagtagttaacgatatgcctgccttgtaaatgacatgtggcagaggatgaatggccatctgtcacagaaacggtagggggtttcttccattaggtgggggtttggactacagcattagctggaccagctccattctgaaatcagtggttctctgaaatacataaatgagttttgaggcaaggcaagtcagataatggtttgatttactgattgcttttacttcattcagtgacttaggagcagaaaactcctatctcatagttcctatagatatctatttttttgccttctgtttgatttctattcttcctcctttttctttacctttaatttttgtgtttctattatcttttccttttcttttcttcttcctcccatgccctctagatataaggatggagtaaaggcaatgtttgtcaagaaagcaacaaggaaaaaaaagaatagagaaaggaaaactttgaactcagttaacttttaattttcacttcaaatttggctgtgtgtgagtatgtgaatgcatgtatgtatactggattgtgtatgtgtttgttgtgtgtggaggggtgggatagaaacagagagaatgtgtgagtaggtgaatagaccctcgatgtttggaaatgctggaagttaggtaccacttcttgttgtcacgatgcctagtgggtctagtagtaattaatggcaaaaggggaggaatgctctatgtcctgcaatatgcatgtcatgccatccaatcatgtattatactaccctacataacagggccccattgaggaacactaggaaaggctgtggagacagactgtctgggtttgaatcctggttctgccatttttagctttggatcttggataaatactttaagctttttgggtgtttgttttctcttctgtaatatgaaggtaataagaacaccaacctcacattactgtcagaattaaatgaattagtatgagtcaatgcttagaaaagcacagacacataaaacacattcaacagtgtcatctatgattttaattttctgaaatggctggaaatggactacttggactcatcttatgtgctgagtgtatgaaagctctacatgctttaactgattttttagggaactagatagtaatgaaccagtacttaagaagtgcagcttatggaccccttgatgttgtgaagcttttgtgatatcacatgaacacacgaagctttggcagataaaattaatttgccttgttctttttgtcttcctcacacataagcaacatatagtcatataccacataactatactttggtgaggaacagacctcatatatgacgtggtcccataaaattataatgaagctgaaagatttctattgcctggtgatattacagcctcttaacttcacagctcaatgcattactcatgtgtttgtggggatgctggtgtaaacaacctactgtgctgccagtcatataaaattgtagcacatgtaattatgtacagtacataatcttgataatgataataagtgattatgtttctggtttatgtattcactgtagtaaagttaatttactataatttattatcatatttactatactatagtttttatcatcattttagagttacttctactcattaacaaaagttaactataaaacagtctcaggtgggtccttcaggagaattccagaagaagtcattgttatcataggagataaaagcttcatgtgtgttcttgtcctgaagaccttcctctgggttaagacgtggttgtggaggatggtgatatggatgatcctgctctgtgtaagcctaggctcatgtgtgtgttgtgtcttagtttttaacaaaatgtttgtaagtaaaacaaaaaattttgaaaatagaaacaagactttagaataagtatataaagaaaaaaatatttttgtacagctgtacaatgtgtttatgttttaagctaagtgttattacaaaagttcaaaaagttaaaaaatttaaaaactaataaagttaaaaagttatagtaagctaagttaattattgaagaaattttaaaatgaatttggcgtagcctaagtgtacagtgtctacaagtctatagtagtgtacagcaacagcttaggtctccatattcactcataattcactcactactggcacagaacaacttccagtcctgcaagctccattcctggcaagtgccccatgcagtataccattttttatcttttatacaattttttttgtggtatcatttcgattttagataatttagatacacaaatacttatcattgtattacaattgcctacaattttcagtatagttcatattgtataggattgtagcctaggagcaataggctatgccatatagcctaggtgtgtgtaggctataccatctaagttcatgtaaatacactgtatgatattcacccaatgacaaattacctaaagatgcattcctcaggacatatctctgttgttaaatgacacatgattatatcccaaccgt

SEQ ID NO: 5104 - DNA, 16067 bp, Homo sapiens
atatatatatattatttatataatatatataaacacacacagatacatacacacactatatatattaagtatatataatagtgtgtattatatatattaaatatatataatagtgtatggtatgtatctgtgtgtgtatatgtatgtgtgtaagtatgtatgtatgtgtatggtgccgccataagctaatcaaacaatgtgagttaaattacctgagaaaacaatatcagttgagcctgagatatgtacttagtgttgtacatatatcttatacaaatcagcaatagacaggcaggtaaaataatgttctaagtagcagagggattgactgatttccactgaaatgctcagggatgattagttctcattgaaatgactttccctagttacttatgctggcaacattgtcatccgtccaggtcccctgaattattcctcagagaccagtgaaacaatgtcatgctctagagtgggcagagagaataaacgaagtatgccactctgaatctgcttagttttaatgctatagataatgggttcataaaaggtgggaaaaggaagtggatgtagctcattgtgatgtgaacgactgaggaacatgctttccaaacctatgaataaatgtcagacaaactacagtgacatagaaaccaggatgcagcagatatgagagacacatgtgttgagggccttggccctttctcctccgaaccaatgcccatgacagtcttgagaatcaaaatgtaggagaaaaagatgatgagaaatccaacaagaccattgcaaataaaactacaactggatagagacggttgaaggtgatgtcgcacaggctagcttgatgacatcttggtgtagacagaaagcatgggagagtacatgggacgacagtagggaaaccagtgtaggcgaacaactattggcataatggacagaccagccctgtcaatacccgcacaccaatcttcattacctgggtgttggtcaggatagaggtatatctaaggggttgtggatggtaatgaaacagtcataagccatggcaagcaagacacctgactcatgacagaaagagtatggataaaataggcctgagagaagcaggctccatggccaatctcctgtgatctaaccacagaacacctagcactgtgggcattgtggtcaatgtcactccgagtctgtagctgccaacatagctaagaaatagtacatgggctcatggaggttatgatcattctgatgagaaagagaagagtgccactgccaagaagtatggagatgtaggctgccaataagggatgaatatccagtgatgtgccttctccatgcctgggaagccagtaagctggaaggtgaagcagacttattgagccccattgccagctttgcaaagaggcaaatatttactccaggaaagcaatagtaatcagttgtataaaagttgctccttgagaactctacctgttcataagtgttcaccagtcctgactttcagtgacagcaaggatgataatttagtcattcctgggagtcctaggtatgggaaaatagaatgtataaagaagatattatttagggtttactctatgtagattattggatactacgttggggatacagctattcatgcagaataaacattgttgaatcattgtaaatcatataacccagaaaataaaaacaaaatgaaagaagaaatcactatattgaatagtgctgtaatggcctgaaacttataggtcacttttcatggtgctcttcatcctgctggtggtattatagggtggatgtaaaggtttcccaggctatgtgagacctaaaagatcgtagaaaaatggttctaagcactattggaaaagcagatataaagattatatggaaaaacaatacacaagtaagaaatatatgagcaaatacaataaaatagtaaatttcagagattgattttcttcaatattcctggagggaaaattcaattgatgaagctccagagacttttgggtgttagaaaatgacgtaagagtgacttacctgtgtgtgtttccaaagcacatagaactcttgttgcccagctttataaccctagttattgatacactgcttcaaagaattcaaattttctaatataaattgaagaataaacagtaaaatgtggatttgatgataagcttttgaaggcataattgataatagcaccaaactactgttgcatatcacctacttggtgatgcaaaaataaaattggtaatttaggcaagatcaaggagaattttttttttaaaactatggaatctgatggatttgacaaaagtgagaaggctctgtgactcattagaattctaagatttcagctggtgaggcagccaacctctgagaatacataaattgtgtgttggtggcatgagccagagaaaatggcccaccttctcttatggttggtttggactatacatctcatatactattgaaagagcaattgatgtaaatttatgcacgatttacaagacctctttctgtccatgaaaagaatgcatcaagattactggactttcattttcagaagaatttgttgaagtttcagctctgctctttcaacaataatgatcttgggaaagtaatttaatcttgagatttggttacataacctgtaaaactactagtgatttctgtcttctcagtcattctcttgacacaaagtaaggggaaatgtttgtaaagagtggataatttttttatttttgtgtttttgttattgtttcagagaagtacccctttctctttctctagtgagtacatgtcaggattattcacccagaggtgtgtcaaatgtttcctttttttctgtggaagccttgggaacagatataagatgatgatggggtttttagagcctgtgtttgactttaaataaagatattaaactatagtttctctaatcagcagataaatgtgatatgtctgggtgggaaagggaaaggagaaaagattgatgagccaatgtgggaattctgacatagctaaaagtaacgttgagcctggggcattgggactgagggaagtagagggaaagcaactctgtcctcaaaaagtgagaaaaggaggtattattgctcaatctgcctgcagtgagaggttcagacaatactcagcttatgcaggattaaagaagcagtatggcaaataaaattgtacataggtatataacttattgttttattataggtattcattgttaaatgattccataatcaaactaattaatatatctatcacctcacataataactttaatttttttggtgtaaaaatatgtgaggtctgctttcttagcaaattttaaatatacctaaataaagctggagggaaaagataatacagaacattaatctagttaattgtgttatattactactaaataacatataattgataaattaaaaaaaaaacaggagtaggaataccagatagggaaaataaactgagaaacaaatgtatggaacaaataattgttgaatttctaccgtgtgtcaagtattgactggggcattatatacacctcattttttgggaagaatccttaaaatagctgtttgtctgtctgttttcatattgaaaactgagtgctttcacttgattcactcagttgcttttgtggatatgagatgatctgtgagtttcagaggggataaaaatctaaaacctttgcctcatcccgcagccattcaccctcttccagggtctctgtcatagaatagacttgagtttttattaatagaaactaattctcaaagtctcaaactctgccgcataaactgatggctctatgcagacactcagcaggagcccattcagatgttaactttcatatattctctcaccttccctttggctttttccttcacttttcctgacactcttttctgtctcaagcacttagtatctccatccttttttacccccttacctttggctattatcctttctgtgatggttaatattgagtgcaaactgattggattgaaggatgcaaagtattgttcctgggtgtgctgtaagggtgttgccaaagagattaacatttgagtcagtagactgggagaggcagacccacccaccctccgtctggggggtactatctaatcagctgccagggcggctagaagaaagcaggcaaaagaagatggaaagtagtggatgcctgttacacaatataaacctttccaggtgctaaagtcacacaggctagtgaatctgtacccctgatccagaggcacacataacccaagctccgtccaagcttaatttgaattggtttattagtcatatggtcagatagtgactttttttctagaaagtatttgaactctgatgattacagaggtatacctcctcaagaatttggaagagttgattctatatttgcacttatctggacttctagggtaaaagacatggggttgggggcagggggactctcagggtagaatggaagccagagagattaaagaatcagtcaggtggagagaaattactacaacccataattcatgcctgagtcaacacccatgctctggtttgttcgtagaattgtttgccttagtgttccagaatctatccttcacttttttatatttgaagaggtaactctcaaagaaaccagttttagagatgtcagggagtctttaggacccatgcctactacatatatctactcttacagacaacactattacttttctcttgctaagaaatcagcttcgatctctctgtttttttttgccttggttcctgcaatgagatcttacagaggagattcattaaataccctcactgactgaaactttgttcccttccattcttcagttccatagtcatgtatctcacatctttagcctatgaaagatttgggcatcatcttttcagaatctgcacatgagcctggctggtaggaactttattttagaagctcctccccagagaccattcctgatttagataattattgttcttcctccctccctcttctgctccctcctctcttccctctctccctacctccttccttccatcttttctctattatttgtgccctcagccttgtgggtattgggctttgaacagcacaactcagatctctgtctctgtcctggcttttactggaggttttcctctgttggaggttgaatatttgtctacattgtggctttggctcttgctgtgctactttggaattattttatctcattgctttcatagtccttactgtaaaacgcatataataattgccatcacaaagtgatgtggtgtcttggctgaagcaccatgtgatgagtatgcctgctgcatcccctggaaaagagaaaactctggtaggctaaactcaagaagggaatagttagtgataactgcagaatgtgcgttcacgtgggtactagagaaggctgcctgaattttattatattgactctagtctatctagctctcgctttcaagctttctctgatctaaaccaagcaggaaatatagtagaaattcaggttacaaggccaagaagatatataggctttctcttgagataaactgggaaagatttgactgttgagtaaatgtagggaataaattacctcccagaggtgataccagagtctgctggggctatgagacaggctgtctgattccccacacataaaggtcctaccagtggcttgattcagccagtacttatttgaaaaaagaaagattatttaaaagcttggggggactaattaagtgttccagcccctctaaggaggagttaatacagagtaaatatttcttaagatccaagttggctataaagggagacatctgggaaggtgctatctttattaataaccacagtgactgcttctcttcacgatgttgagaaggaacaacatgatctaagtctttaggtaagacacaagaaccctgctctcctcaccatcaaacaagttatggtacctgggagtatggtgaaatactcctagatatataagagtgtactaggagactcctctataagctctccagagaaagatacggagaagaagtgaggatctcaatagtccacagctttggatgtgtgcacagatttcagtctgaagttgatagacttcaaaagcaattccaagtgctaccaaccaactacctaagaccttctgtactcagtgagtgaatatgattgaccctctcatatgtcttctttcctttctaaaagatgaacaggaaggacctcttattctactacattttactttttaaacaaagcagagaaaaattatggctgtaatgttagaagtttatctgattttctaggtgttccattatagaatcttcttgcttctatcccagtctttatgatctctttccttccctatattttttttcctcagcttttatctcttctccattgtctttcttctcagaaaccaagagccacgactagctgaggacacaagaattttcaaaaacaaagtagagtgattccatagatcactattatagctgcattaccaggtatgtctgatggaattcttgggaatggagaaggaggaaactttaagttgcaggttattattggcaaatacaatcattgccttacagtttggttagctttccctgtagtgattcatcacttgtgctgatattctctgataagaaggaatttttcacaaagttgagatacagtgaaagattaggttaaggagattattgctgaaacgtcagagaagtaagagtgttgacagagaaatgaagtacatgaacacagaaggggaggagctaagctggattatctttgcgtctagtaactgaagaatatcatcactcattgtatgttcagtaggcactgaattctggtttatgtctctcagtcctaggcagaatatggatgctgaaaaatgattctttcaaagtgctgagttgttgcctcacgcccattgtctggcatctcttcactgaaactattacagttagatctcatctctatgggtggaagtaagaggatcgtttcctttggtggcatctttagggtagtgccttacactgacaaagtaatctgaaggggtatatttggatacgaccatctttttaacttaggataaaaacaacttcaaaagttgttctggcatgtgacaagaaaaaaaagcaagggatgcatttgctctaattcagcatatttactaatgactcttgatttcctcacaagtgaatatgtatccccctcagacttccttttgagtaaatggcttcaccattctttcatttgttcaaacagaaatctaggggaaacccatttgatttttccctcactcccatttttaatatatcagcaaatcttggcactacttcaaaatgcatctgtctctgtttaagttttcctatttttctctttttttcatttcccctgctctctcctagtcaaggtcaccatgactcttcatatggatttttaaaatagctttctaactatctcttttcttgtctcttgcttagtcttcttcacatagcagtctaagtgagtaatttaaaatacaaatcagaatatatcaccacactattttccattgtgattttcaaagtgtcctatgtctttactacatttatagtaagaagaaaacaaaacaaaacaaaaattccgtggtggttgtaaggccctatgacacttgagtactacctgcttctttgacatcatctattgtccctccctgttttcttatcaaatgccagtcatgctgattttccctctggaacagttttcctctagtctgtatacggtcaggttttcttttgtattgaggtctcagttcaaatgggacctcctctaggtgcagttctaggcccctcaaactgctatactatcttgtatacaataccatccaataatctacatcaagtagtactgttttatgttaaacttgcatttatatttgtttaaaattgcttatttatttttcaacttaatttatggtttataagattagggactttgtcttattacctttaattccagagagctttaaatatcatggctgtcacatgatgcgtgttcacaaatattggtgaactaagaaatgtttatcagtcacatgttagatactttgcaaggtgttgagcaaacaaataaacaccatgtctatatgcaagaagcccctagtctagtggcagaaggaatattaaaccttctcaaaggactaatctcttctcttcagtaaaagacagcaccacgtttaagcaggaaatagctctcactcagtattggggagaacagattcagaagcctatggctggggataagggaaggaaaccaggaagatggatgtttaaatataaatggagaacttgaaatgagagagaatgagagaggtcagattctagggaattacttcagtaggcctatagaaaaataatttaaaagaaaaagacactacttgtaaataagaaacagtaagatgtttaaactgaaggagatacctattataagtgatgtctttggctggcctaatcatttattccagccccaaagtctaactataattagactgagctattgtcacaagtagtgagtagtactgaaggattctacaagaggtaattcacactaatcgtgaatgtctgttccccatcactagtccatgaaatctggaggccagtgtctctttctcaatctgactgctccttagctacagtggtagtggcagagtttctctcccacacttttctttcttaggctgttgagactttagctgataattcaggtaagtctttaatgcaggaaaatgtggattagggatcactactgtgaaggcaattacaggtttaggtggtgaccagaaaaaaattagtgttagctttctggaaatccccttgaatgccccatagaatacaattctttaaaatctgcatagttaagggtaacagtttagaagttgtagtttacataatttttttctgaagagaatgcttaaatgcatataaacagttgaaactccaagaatttgattagtaggtaggagatagatcctggaatgtgcagttaagaatacaaatagtatgagtaacccgagaatgtattttgagaaacaatcacttatattgatgtcattattatctttaggaaaaattctgagaatgatatagtcgaagtgataccttgaaggtagaactgtgcactgtggtaatacagaaacagaaagacgacatttcttctatataaacccaggatgtcgtccagcagcagccccatcccttcctattgactggttttccaggcttggaggaagctcatcactggatttcctatttttcttgttcatgtatatatccatcctttttggcaatggcaccctccttcttctcttaaggaagatcacaatcttcatgagcccatgtacttctttctggccatgctggctgcccagacctggggctggccctgaccacaatgcccacggtgctgggagtcctctggctggatacagggagattggaagtgcggcctgcttttcccaggcctactttatacactcactttccttctcgagtctggcattctgcttgccatggcctatgaccgttttattgccatctgcaacctcttagatatacctctgtacttactaatactcgagtagtgaagattgggctgggagtttgatgaggggatttgtatccgttgttcccccaatcaggcccctctatttttttctgtatgtcactcccatgttctttcacatgcattctgccttcaccaggatgtcattaaactcgccgtgctgataccaccttcaaccgactgtacccagctgtgcttgtagtctttatatttgtgtggattatctgattatcttcatctcctatgtgttgatactcaagactgtcctgagcattcctccagagaggagagggccaaggctctcattacctgtgtctcccatatctgctgtgtctggttttttatgtcacagtgattggattgtctctgattcatcgttttggaaagcaggttcacatattgttcacctcattatgagctatgcctattttctgttccctccactaatgaatctataacatatagtgtcaagaccaagcagattcagaatgccattcttcacctttttactcccatagaattggaacctgatctccaatcatcacagtcactctcacagaatgtaaaaacctaatatttagcaggagagcaaagaagtctcatatctagcatgcatgctcatatgacttgtaaaataggtgttaaaatacagcttcaagtttccctaaggtatctctttaagcccaacctttagctaaatgtagtttgtacaaatttttgttgcattcctgtaaacggaatatttcttaagctttccactaaattattgtgataacaataccttaggcatctattggtatgtctatatgtaactaacatatgtttatttcatggtataaagttagcagataggaacagaatcataaaatataaaattattagttggttcgagtgaaatggaatagagtttggtttactatgtcaatctaatttccaactcttatgaatttctctgcaggtgtccatacaaacaatgggaaccttaaatttggtcactgaagtccaggaattttcctgcaaaaaagaatataatcttctttgacagtgacctaattacttatcatctcaacagtctagttggttcctcctccctccatcaaatataatgaatttgtctcaaaaaccataaactcatatttattccccaaggcagtaccttcgacaaacttgtaacaaaaaaatgtgagaagaggaatcacggataaatgagaggacgtagcacagtcagtacctccttctatcttgctctcattcttattctactaccctagttgctagtccaatgttgaggccatcctcagatatctacgctggctgactagtccaaattagtggaaagacagttccttcaccctccttttgctatgaaaaaggtctgaaggaacaaaaaaaaatagtttctgcatttttttgaagaatgattgctttctgtacatacattctgattccatgtaaaagtgtaaatttcccaaagaatacaacaatgtcattctcatttgattaaaattgtctgagagttaggaagggacccataactcaatttaaaatatcctaaaaagagggaggttatgtctaattatactttaatcagagcaaaaataatacttcagtgagacaagagaggggactataagaagatattgtttatgtctttggtgttttaccccgatcattttacagaattgtgcaccgtgaatgttggctgctcattgttcatgtttctgctttctgcaggttgttgttctcaactagcaggaaatgtcttatgaagaaaatggcccctgctccttaggtagcaggccataggcaatactgaccctcttgccttctgaagctaagctccagcttcagtatgcacttgcttacctcttcccctgtccacactgcttttacttgctccctgtctcctgagagcattcattaataattgcacacatttgaatccctatctcaggtattgctcatagagagtccaacttaagaaaactgcaatccttatttatattctgtttcattaagagatgtaattgtgaaagaactgaacaataaaaaaatcagctttatcatgttttttatccttgtcacgccatgtcacctgagcaaccagtctgaatactaaattgtgagtgtgagtgcatatatgtgatggtaggtttttgtcctttttcaatcattcataaaaccaaacatgtgtcccttaattatgctctactacatccacacttattttattcataaaaatattgtggggtagatattatcactgttttcttgatggggaatttaatataaaaaagttaaatattccctccaagggcataacatttttaattggtatagcatgattcaaatttatatcttctaactataaggccagtgtgaatggtactccactacagagactatccttagtggcttctactttttgccttgtattccgtcatgcttgtagtacctatttctttttctgaaaatttctcctccttctactccaaaaatattgttccctatgaaaacgatattttgcattgtatctccaaactcctaaccgcagtagaagaacttttttaaaaagatttttcaatatgacattgcaaaaaaaaaaagagtaatgcttttgttgtggtagaattacaaaatgcaatgcttagaattgttaatgacaatgtttttcatcaggcaagtgacttcaaatataataaatatttagagtaaattatagataaagaaatgataataaataaaaagaatctcaaatctctgattccatgttttcctgagactcagtgacaaggaggacagtttgaatctttttttgattccacagcctaataaactcctcttcttgtaatttgttttgttcagcctagttcagttgagtttcacttataaccaaaggctattaataattatatcatctcagttatagaatgtgaatcttctctaactaatatttaaaactggaaaatactgttaggtagaagagctgctctttttctaaaatacaggaaatggaacctaaaaatggcaggaaagttgaccatttgggaatgatttatgaagttatttcccttgtttaagaagttcatttctgacttgaaagtaaggtgaaactaaattcactgagaagatgctgtaggatgaatacagacacaggacatcggagtggggggaagactaaataattatctcaaacttagttatacagaaggctacatggtggaatccactcagacatgtttttctattcaaaacccattgtaacaatcaacataaacacagtagttagtattatcataaaatttagaactttctgtgatctcctacaagtcttcctgtggtaaatgctatgtactattagaagccttagcaaattaatacaggaacagaaaaccaaatacccgtgttctcacttatgagtgggagctaaatgatgagaacacatggacacatggaggggacatcacacactggggcctattggaggatggagggtgaaaggagggagaggatcaggaaagtaacaaaagggtactaggcttaatacctgagtgagtgatgacataatctgtacaacaaccctcgtgacacaagtttaaatatgtaacagacctgctcttgtactcctgaacctaaaaaaaagttagttaggaaaagaagcctatttataacactatctcctaggaaacactgcacagaatttgtattcataagaagagtagaattcagagtggtccagtggactaacaaactggtaaccaccttcttacagcaggtgaagcctgtaattcagcttttcatcattcaagactgaagaagaatataacttatatagagaaggacctcatgaggaataaatttcatggtgcctattagataaataagtaccatgtagttatgggaaatctaaggtgtaaaagaatatacattaaaaaagcccttgccaaataccatcctttctttttcaaataataatatacttgtgtagtatggcttgaagggataacataccataagaatatttaatttgagtcaggaaatgaaaggctaatgtgcatttctgtagactaagccaatcttagaaatgattaagaagacatggaagaatctagagacacactgaaaaaatatgtatggtctaatgagtttacagatcacttttcctcccaataaaatgaatttatactagataaggggaagatgaactttattcctctcattaacaaatattgctgggttccttcaccagagatgcagatttttatagggtaaatgaaaggtgatatattaaagatacttactagattatatgagtattaaattgggcagcaaggatgattagaaatattaaggacccagaggtctccatgtccaattaaagaatgtaaatctgtttttgattttaagcctaaatccttagacacagtcattgttattaataaactcatagacaaaatttatttttgggaaatttaggagtttatgtccctagatttcaagtacatgccaccaaactgacagatacagtgattagtcacaaagtgcctcaaaaatagatggccctatgttagtcatggttctcagaaaaatagaatcaacaggatttacccaacttcaaattatactacaaggtgacagtaataactgaaacagcatggtactgataccaaacagacacactgactaatggaacagaatgggaactcagaagtaagaccgcgcatctgaaacaatctgatcttcaacaaacctggtaaaacaagtaatggggaagggattccctattttataaattgtgctgggagaactggctagccaatgcagaaaattgaaactggaccccttccttacatcttatacataaattaactcaagatcattaaagacttaagtgtaaaacccaaaactataaaaactttagaagaaaacctaggcataccattccggacatagacacaggcaaagatttcatgatgaaaatgtcaaaaacaattgaacaaaagcaaacactgtcaaatgagatctaattaaactaaagagatcgggcatggtggtcacgcctgtaatcccagcactttgggaggccaaggtgggtggatcacttgaggtgggggtataagagcagcctggccaacatggtgaaactccatctctactaaaaatacaaaaaattgctgggtatggtggtgcgtacctgtaatctcagctactcaggaggctgaggcaggagattgcttgaacccaggaggcagaggttgcagtgagctgagatcgcaccactgcactctagatgggtgaaagagtgagacttcatctcaaaataaagaaaaatacaattaaatacagagctctaaacagcaaaataaactatcatcagagcgaacaggcaacctacagaatgggagaaatttctgcaatctacccatctgacaaaggtctaatatccagaatctatgaggaacttagaatatttacaaaagaaacacacaaacaaccccattaaaaagtgggcaaaggacatgaacaacacttctcaaaagaagacatttatgtggctaagaaacatacgaaaaaagtctcaatgtactgatcattagagaaatgcaaatcaaaaccacaatgaaataccatctgacaccagtcaaatggtggtttttaaaaagtcaagaaacaacagatgctagcaaggttgcagagaaatagaacacttttacactgttggtgggactgtaaactaattcaaccattgtggaagacagtgtgcaattcctcaaagatttagaaccagaaataccatttgacctcacaatcccattactggtatatacctaaaggagtataaatcattctattactaagatacatgcacatgtatgttcatgtagcactattcacaatagcaaagacatagaatcaacccaaatggccatcaatgatagcaatttaaaaaatgtggtacatataaaccatgaaatactatctaaccataaaaagggatagatcatgccctttgctgggacatggatggagccgaaagccattatcttcagtaaactatgcaggaacagaaaaccaaacaccacatgttctcacttagaagtgggagctgaacaatggaatgagaacacatggaaacagtgaggggaagaacacacactggagcctgtcagggcatgggtgtggtgaaggggagcattagaaaaaatagctaatgcatgctgggcttaacacctagtgatgggttgataggtacagcaaaccaccattgcacacatttacgtatgtaataaaccgcacatcctgcacatgtacctcagaacttaaaaattaaaaaaattgaatgtacataaaatatggaaattaataaatgtaattcactgcattaaaaaaaaataatggcaaaaactgcaatactgttgcaccaacctaa

SEQ ID NO: 5105 - DNA, 14140 bp, Homo sapiens
ttactgtagccttgtagaatagtttaaagtcaggtagtgtgatgtctccagctttgttcttttgcttaggattgacttggctattcaggctcttttttggttccatataaatttaaatttttttctaattctgtgaagaatgtcaatggtagtttaatgggaatagcattgaatctaaaattactttgggcagtatggccattttcatgatattgattctccctagtcgtttattttatcctctctgatttctcagagcagtggtttgtaattctccttaaagagttccttcactcccttgttagttgtattcctaggtattgtattctttctgtagtaattgtgaatgggagtcattcatgatttggctctctgcttgccttttattggtgtataggaatgctagcaattttgcacattgattttatattctgagactttactgaaattgcttatcagcttacgaagccttgagctgagccgatggggttttctgggtgtaggatcaatgtcatctgcaaacaaagataattgactccctctctttttattcaaataccttttattttttcctcttgcctggttgccctactagaacttccaatactatgttgaataagagtggtgaggaaaggcatcgttgtcttgtccagttttcagggggaatgtttccagcttttgcccttcagtatgatattgactgtgggttgtcatatatgactcttactattttgagatatgtttcttcaatagctagtttattgagattttaaacatgaagggatgttgaattttttgaagtacttttctgcatctattgagataacatgtgatttttgtctttagttctgttaatatgatgtatcacatttattgatttgcatagttgaaccaaacttgcatcccagtgatgaagccaacttgatcgtggtggataagcttttgatgtgctgccgaattcagtttgtcagtattttattgaggatttttgcatcaatatttacaagtatattggcctgaatttttctttttttgttgtgtctctgccaggttttggtatctgatgatgctggcctcatagaatgagttagggaggagtccctcctcttcaattttttgaaagtttcagtagaaatgtgtactagctcttctttgtacctctggtagaattcagctgtgatctatctggtcctgggcttttttagttggtaggctattctctactgcctcaatttcagacgtggtctattcagggattcagtatttttcctggttcaaatttacctttcttataaggaggcaatcatgttggatttgagtccagtctaatgacctcattttaactttgttaccttggaaagactctaccttcaaataagttcacaatgtctaactgtgagttaggaatttaacacagaacccattcaacacatgaacctttgggggcaggacttaatttgacccttaacatgaaggataaaaatattttttagacttgataattgtagctcttgtttgatggctgaagtatcaaaagattatgagaacagacatgaggctatgaatatgttgaaggattggaattttggatcatcaaatgtgatccaaaacctctggacacccttaccctttctagatatattttttcccctaaagaactcaaaggagaacaaagacctggaaaaatatctgtggatatctggaagtaagcctgtactagaggttatcttgtatttgtctctagtttttatgttcgattctcagaggcagtatttcattgtacaaggtgcaataattatggagtatacattttatttaatcacataggagtggtttattataaaagagaaagaatactttaactttaaacctgttggacaaaagggttagtataactttctcaattacttaggcaaatatattcttgaaaataaaaagttagaaaaggggaaagactgagaccctcaatgttaaataacattttataatgatcacatgctgagtcaaggcaaaagcaatttctaagtcgcctacttaattctctagaccatgcctgctatcttattttatatcttaataaatgtacatatgctgccttgctgttttggggacaatgggaagtataatttgatctttcttgaattctccacatttaaagtctccacttgtcacttgaattaacaagtattttagcatttaatttcctggggataccagatgttttattttgtgagtttgtttttttatgttatagttgtggtttaaacaactatatgttcatttaaaatgaaactcaaaaaaaggaaagaatggcacaactcaataaatatgtagtttaataatattcagtgaatacgtatcacagtgaatggaagtctaaataacgtactccagtgaagaattattagatgttgcccgttcagctggattttcagttatactattcaagctggtgggaggtttcaggggaagaacagggagaagacaaagcagaaacagccttaggcagtataaattctgaatacctttaatttgataacatgttaatactagcaggagagttactttgttgtattctagggattataacatggcacatttgaaatgatatggttcccaccgataaggggaggatgaatagaagcatacactgaattctctccagggcattgagttcctttggcgacagcactgttggctaaatatgaaaggcttgagatgaaatggcagcaagagaacagcagaggaaaatgtaaggcaaggatgggaaataatgagaagtttatacctgaccatctcttttctatcattggcttcctatctcctattcttttctttgtcaatctctgtagcctccacctttgctcaaattggctcagtgatatgattttatactaagcccacacccagttggtatgaagacattaagtaattaattaattcaataacttttactgatctgaacaaagtggacaaaaaaccctgtctctgtggaattttcttccaggctgaggggcttgggaatgggtaacaagtaagtaaattatgtaacttgtttgacagtgctagtgctacaaagagaaactaggtagataaaagaaatagggacttgggaggttgaaatttttaaaaaaaaaaaaggtcagagaaaataccacttttctgatgagttaaaaagctatgaccgctaatttttatgtatttattctgtgtccattaaaacttccagaaactttctcttgaaggacatttgagtctcaagatctggccctggtgattatattgtgacacactgtgatcattaaaaaatttttatcatcatgtataactgtgatgctattttgcttgcagcccagacaatgtatggatttattaaaacattctgataatcataagacagtgattctaggacatgtattatcggacctcttctgtacctgtgtttggagttgccatagatgaaagtcatatgataagagaaagcaatatgataatttgtaagtgagctgcttataataagcaggatatgacagtcaacattttcctttttacctttccttccatctctacctcttttctttgttatagactttgagtttgtatgtgtcaggtttcattcatttgggaaaccaatgtcacatcaaattaggaaggatgtatgaccctctaattggcctttgcattgtacacaagcctcctatgtttgttcgggatagcccacgcatccttttaaattggtagtttgactgtcagtttccgtaatgcccttgacagtaaacaaacacaactctatgtgattctattatgaaacattaatcttctgactgtatggtaaaggaaggggtgagagtttctctccattcccccaaaggaaggaagagtaagaaagaaattaaaatgtaaaagcactcccaataacaggtcatcaagtcacagcttttcattgtggccacctttgtcagctgtgtgtgtgacaagaaacaaatcacagctccatgatatttgatagcctgagtaattaaagagtcttcaatgctttttggaaaatgttgtccaatattccagccacatcagtgctcccttaataactcaataactccacatttctctccctgtgtgtgtttgactatgctatcccttttagagatatttgcatgtaatcaagatagagttcaaagatttaccatttccttactattattctatatttgaatatccctcccacttccatttttttcttccgatagggaaataagttaaccaaaattcaaacaaaaatcagttttaaataaatattcctaataagattattataactactaccacacatacatttatggtaggaaaatttagaatctgtcctggaaaaaatacgtccagattatttacaaagatttgctttcagaatccctcttgagataaataacatgttgggggtgattctgggatggagcaaacatgtagtttgggtcgcagtttaacgagtagccgtagtgtattaaggctatgcatagcaatttctcttgccctggagtagttagtgcaaactctttttacccattaaacatttgaagtagatttattagctctaaggattcttggtcttcctgaaaaggaattaagaatctttggacagtggacttcttgaaaatcctatcaaaacccctaagtatgtttctggtagcctctcggttgtgctattcagtgatgaataacacaggcttgattgttctaatttagcggaagaaacacatttttttttaatgtggtttttgccatttctattatactttaagttctgtgatacatgtgcagaacatgcaggtttgttacataggatacatgtgccatggtggtttgctgcactcatgaacctgtcatctacattaggtatttccctaatgctatccctctgctagccccccactacccaacaggccccagcgtgtgaggttccctccctgtgtccatgtgttctcattgagaaacacattttttaaatacataaataaatacacccttttgtcatgtatcttcataagcaattgacccaaccaatggatttgcagtcagtaaaacaactttggatagatgggtggatggatgaatgaatggatctcatttatttgtggggctaaaaatttaaacaattgaactcatggagagagagagagtagaaggatggttaccagggctgggaaggttaaggaacttggagggaaaagtggggacggttcattggtaccaaaaatagttagaaagaataaataagatttaggatttgatagcctatcagggtgactataatcataatatcttcattgcacatgtcaaaataactaaaaaagcataattggattgcttgtaatggataaatgcttgaggtgatggctaccccatttaccctgatgtgattattacacatttagcccatatcaaaatataacttatgccccataaatatgtacacctactatgtacctacaaaattttaaagaatgtgaatggttgaatagataggcagatagataataaagtaattactattattttgatttcagaagattttaacagggcccttgattatcattcatctgagatctaccttgtctgtatggcttatttgggttgtaggtaagagtcattcttgaatgagtgggggttctgattatttttaaacagccattcaagaccaatgcagatacctaggaggaaaatgtttcgatttttatgaatgtgtatgaaaccggtaaatattcataacatagctaccaatatatgctctgcaagccaatctaaacaaattgccagtatcaaagattctgttgatgaggaatagacgcctgtgtttgcagtcttgttaaggtggttaacagtggtgtcctgattttttccaaaacttccagatttgggctgctgagtagatgatgctgacttccgatactgcttgttgttgttgttaaaccattgagcaggttacgaacctctgaacttaaacgaaagaaatcagtggtttcactggaataaaaaagtaatactatggtatagcataacggagataatacaatttttgtggtttaaaacagagaaaaaagtccctcttttaatgcaaaatcacctgtaaccttgaatgtataaccagtgtgacttagctgataatttaggcctatttcatagagctgttatgagaactaataaaatcatgcacatacaaatgattagttacttttaaaaactgtaaaatgcttgctgttttgttgctggattgaagagttcattgtgatggtgccattcaatgactatatgactaagagatcatcctttgtactctgtctccccatctctcctccctcccttgtttttccatgtggttgtgttttctctctctctctctcttttttttttttttgagacggatagtttcattcctgcgcccaggctggagtgcagtggtgcaatctcggctcactgcaacctccccctcccagggtcaagtgattttcctgcctcagcttcctgagtagctggaattacaggtgcccaccaccagcctggctaatttttgtatttttagtacagacagtgtttcaccatcttgaccaggctggcttgaacttctgacctcaggtgatccactcgcctccgcctcccaaagtgcttggattacggcatgagccaccgcgcccggcccgtctctaagttattttctaagctaaaagtcatgctctgcaaccaacggatatccccccttttttggagatacttggtaatgtagaaactatttcgagagtcaaaattctacagatagagtttagaatgcacaaaatctagacatggcattgagcatctagatattgcctttacctatttcctgtaggaacttgctccagattagtatcttaagacaaattggcatttatttttcttacacacattgcattgtgccatgtaagaaaattacaattaaatcagcattttcctcctgcttgatgtgaataaaatcaatgctgaaatgggagtctagttaatctatgtgatagaagttactaggaccagtgtttggtggcttaggtccttaaaaaattggaaagctctttgcaatacagtgtgttaacaacagccttttctttttattccctccctttgcaactgttcccagcccttctttaaaaatctaagtcagaaatatattgaagggtttatttctatccatttttttctatctgcacatggctgttgatattccttcactgtcttgagctatcaactatcagtcttttgtaaagtagcatacatagtaaagtatcaagaaaacatttctcaagccagactgcctgtgctcaaattgcagctctgctacttactggctgagtgacttggacacgttatttaacctctctgtgcctagtaaccactacataggagggtattttaaaggattaaatctctgtaacacacgtagaaaagtacctgccatatggtaggcacaatatcatttttgttaaataaaatgaagcttagtagtttacctgcattgttcacattatctaaccattaccttccacatcgtaggtacacaatgaatattattagtcatgacttatacatgacaaatgtattcttaaattggagtggtacaaaaaacatatgggtccattccacatttctacaactagctctgcagtcttgcacatcaaattttagtgtctttggagcttccttctcatcttaaaataaaaatatttgcccaatgtatttcaaagggtaattttaatgatcaaaatgatatgtacttccaatgagttgaaaaaattatttctctatatgaaaggtattataacattttttttctcaaattactaaatcagttctaggggaaatatgctagtaaaatagttaaggcttgcagatataactggtccagaggtcggtagtcatcacgagtactaagacctagatactagggtctgtgtttgttcttgagaatacagcaaagtgtttcaaggaaggaggcttctcctttattaccaggcctgttcagctgtatttggctacttcttgttatggaaggaaacctgagcagccttgggaatccagtgttcctttatcacattcctcagatctgttaggctggacgccaagacagtagtttgaaggtgtttgtcttgatgctgatggatgttgcagtctgtaatccacgactgaaacagggcttctcttcattgcagctggcatatcttgttgtgtttatgagtctgacggcaaacatatctgaagcatatctcatatgctgatctgtgagggagataagccccttgtttgcttgactggaaacaaaataagcaggtggcagaaaaccctgcattgatttctgcttggctaaaacacccagaataagatcaagtcccccttgggcacactccagcctctgctatttatcattgatcatttgacttaagtttgcaaattgttgtagggaagtgtaagtttctttctctttaacaaagctacttttacttattataattttataagctattagcactattttgtgaagaaaaaactaaaaatcaaatggtgtcagagcttaaaaatctcttacttcatttgccgttaatctttatgcatttgatttttgcttcaggatccttacctataaagcatacccatttctttgaccactagatttttacagaataaaaatagttcctttctgaagaggaactatgaaatgtatacatgggttaggagatggagctgaggactccaaagtaatcagtccctgataagacttgagttttgatgcacacattattgcattttagagattttggtctcccagttagattgaaacttattgaaggcagtaggacattgacaatgcataaatattagttaggaaaatgaaaataaagtgttgcttaccaattcagagattcagaagaatgtggataggattttttccctccacctgaaatttcgactttataaactctttttattactgtccttccttttctgatccctgatgattattaattggttccagtggtgtatatttcagatatttaattaagtcttccttttgtccaactctctgccaaaacatatttttcatttttatacctgcaatgctcaaacataattgatgccaaatgcatgctgtttgattacattccatccagatttacttccaagcaggacaggcctgtagcatttatttcaagtagctttacaaagagccattcttggccctcaatgtggtggcaggcggggaggcaggagaggaaaatgaggtagatgtccttcccataccttaactgtttttgagagaaatggaaaatggcagatcagatgccattggccgtttgcccaattaagcatagcagtgttagctaagatgtgatcaatatggaagacttggtctgcagagcctttttagctgtgctcctgtactagtcaagcacctcctgcaactttgtggtaaattcaagcacctgtgcaactttgtggtaaaaaccatcctcatgagttagagccttgtcttataagaaggaaaggacagcttctgggtgagacacgtgctggccatcatgctgttgcctaatctgtcacctaactattgattcccagctcttgattctcattgttcattcatggagttgtttctaaataaggtgactagagaggaggaaatggtgttatattagttctctattgctgcataacaaataatccaaaacgtagcagctcaaaaatcaacaaggcattacctcctaatttttgcaggtcagaatccagatgtggcttagctgggtgcctctggcttagagtccctccataaggctgcaacgaggtgacagccagggcttcagtcacctcaacttgggagagatctgcttccaagcccttcctatggctggtggcaggccttagtcattgtggactgttggccacagataatacttcatggcacaagagcctttctacaggacagcttacaacttaatagctgtctttgattgagggtggggagaaggtggaagccattgttgttttcaatctaatcttgaaagtgacatcctgtcactctactgtattctattcatcacttagaagtgagtcaataagtataggacatttaagggagggaataatcaagggtatgaataccaggaggctgagacagttgggagccaccttatagctgccttacacaggtgtaaaaagcatgaaatagacattagacaaatgcagggtctgctggatggcgtgtaaaaagttctatcacagggcttgccacagagtagagaagcattgcattttttcttgccacccccagcacattgcctggtgcattgtgggcactcaagtacctacatgccatgaaactgtgtctagtttactaaaaacaaagagtctctctgttccaaaagagattaagtttggtgttatcctttctggacaattttcttcctatgcttcatttctccagttatcgtaagggaatggatttaagtctgaaataaaatcactcaaaaataaggaatagctgaagcagcctagaattaccttggtggaattaccttcttaagaacaattagaagtttattctttaggcaggaatgctgttgccaatcttccacagcaggtgataagaattaaattccctcatgaccaggaaacgttctttctgctaatctggttccacctggaggttcaacaaatagaagatagacacacggtgtgtttagtcttaaccacatagcccgaggcactggggaagtgtccacacgagtttgccttctgtgaacctggaaagcaatttttttctagttttcctttttttcctcttctttcctattcatctgaattcttctgtagttaaattattaatttctctccctacagaataaataaattactatccttgttaattcttttatcaaagatatgtactaggcttctgcttcccatgggccatttgaaaaacagtgcttcatacgatccctgaactttttggcaattataaaagagatcacaaatgagtaaggttgaaaattaaactataactggaatgaaatgtcctatagactaaacctatcagttgtattgcagatcagccccttataattggtgatgtggtatgagcattttatataactataatatataggccataaattattattatatcagtctgtggtatatattgcaccttagggtagaatttgctccatttacattatattcaggcagaaaaaatgaaacatctgtcagggagagtatagccctattgatcaggtatatataagtaaggtttacttaataaggctgagaaaaggggctttccatttgatttcagttgttttatagacaagtttctatttgagggagctatttagaaatgtatgtagccttatgtagaaattccaataaagctttcaaaaataaagctggtatttatattggttgaaatggcaagataatgagtctaaaagatttcccttctgatgttattttttttgttgttcagaatgacacttgaaagatgcctaagattttactgctgctcttagaatcacaggatctcagggtaaaatcaaactttagaggtcattaattcaaccagccataaaggtctttttgtcaaacttatgaccattcaagatactttggtgtaaagtagctcacaagataaaataaatcactcgcatgttaacccataggaggttaaactttgacagcagatctgtggtggtagataccatgttttctactgtcctattggaaatgagtgtagaggcccatttccactacaaatactgcctagtggctgacttacatggtaaaaatccaccaaccttgctctgcatacattccagaactctaatgcaaaatgatgcctaaaccattttactctatccatgcatgaggacactaagtaagatgaagcttgttttgatatatacacttttaaaaaggtagaagaataagaggtggtaaaataagttattcaatttattgactatagtacaacttggctctgattgttaatgtttgtccctgccatgtgatatatagttgtgtgagataaaaacccccttgggtataattttatttacaccaacacatatattttgaagagatgaataccaattctgggaatagttagaagtaaagaatttgaattttctgcagcactgctgcacgtaggtaaattcctctctttgggcctcacttgcaacaccaataaagagaggaagttatacagatgatctataagccccttccagccctaacatgctattagcccatgattcttgtgtaggataccagaagaagatgaaagagagaacctaacttattttctgtcaccagtccttataatcatggcattgtgtatttctccttgagtcaacattgcttcttttagtgacacaagcaagctgctttctccagctcctcaggaggcaactctgctactgcagaacaaagatcattctctcctggcactcttctgattcctggtacctgtattcagtttcacattccctttcttgttgagatgccattgcctatagaaagatactttaggtgaattaccaggcaaacgttactaaagcaagataactgataagggggactagaatcttggaatttgtgcaaataaattcctttgttttgaaactgcagactgattagaaaactgtcatagtaaaatactttaagcatgtccttttccattttaaaataacaactggaaggaaaatataaatatatcactgaaataatggtttctcatgaagaaaaagacatttagacaaaccaaaagtgtatattctatggtgtagtaaatcataccttactatattaggttaatacttgataaaaccttgtagtgagataaatggtgatatgagaacttaaatcttcaaatgtatgttttaagccccattatagctattttttttcaaactacctactataaagttttgtccagagatattccaaaaaagaataatagattggtattaattttctgcctcttttactctttggaagacgtgccaataggcaggtaaagagatcaaaaagaaaagtcgggcagggtgcagtttctcacacttgtaatcccagcattttgggaggccgagcgggtggatcacaaggtcaggagttcgagaccagtctgactaacatggagaaaccctgttctactaaaaatacaaaaattagccgggcgtggtggtgcacacctgtaatcccagctaccaggaggctgaggcaggagaaatgcttgaacctgggaggcagaggttgtggtgagctgaatcatgccattgcactccagcctgggagacagagtgagactccatctcaaaagaaaaagcaaactagatcaccatttacttaacaaggagctgttagtgtattaagagtattatgccatcagtctgattaaaccacctgaaggaacagtggaacctcttcctaatcattcccatgtggacttcctgggagacagctgggggcagccagaagcaagtagctagagaggactgtggattctttgtgaggaaatctgaaactggccactttaaggcccctgggttctactgaggttaacgtctaaagtgtccttgactcactcaatttcaaagcaaattcaatttgatctcttgcctataataaacactggtcagaagcagacatggaaggatttggaaaatggtgttaaaagatcaagagatctaaataaactattttgtttgaactagagttaccaagtagaatagattgtttaccatagatggagactctttgagaaggagttaaaatttgtgggagatccccaaaataatgcagttcccacacacacttttcccccagagtgtatataggggatatataccactttctccctccttttccacttcttatcattgttagatctctagaaagttcatgtagcttctttctctttgtcgttatatgtttcagatacctcaccagcttcctttgctttcatttaccatatctagtggtaatttcctcaattcctatatcctacaagagcttgatgaatgaaaagaaggaacctgtgacaattattttattcaagcctccaaagcagagt

SEQ ID NO: 5106 - DNA, 100000 bp, Homo sapiens
  misc_feature (90325)..(90343): n is a, c, g, or t
ttcttgagtaacatccttttgttctgcttcttgtgattttggtgtttccggggcttctgttctggtgatgcaaccacattgctctctgagatagctccattccactccagagattttgaatctgtgggtcatggtaagggactcttctttttgaaataaaacttggctctttcgtgagcctacaaaacacggtatacaaaaatagtagctactaaagcaaaaagttacaaagacaattttaagaacacttgtggaggagaaatgaaattttaaatttagttcagatatatgtaccatatatacacacaatatccttcagattataggattttaaaagtacagcttttcaacataaatatttaattttgcttttaaaagcattaaaaatttgaccataacaaaaaattaaaaatggggggtcacaaaatgttccagttatcctaacaaaagtcactagaattgcaacgtgataacctggcaggccaggcagtacatgctgcctcgtttctaattactttcctgtgctacttacagaacaatgggccctggtactgtcaaaatttggaacttttcacaaagcttctcttatgggagcagaccaagatgagaagggatgagatgtcactgtgctggatcttggttctacatcgccttgatttcctgagaattaaaaaagaataagcccttttaacaacagctaagatacaattctctatatttctgtatggaaagcaaatgtccaaaaacttaaccttctatgaaggtaaagcagctctgcagaatgacagccactgagagactgccctagtttagggccattctttaaacagttgcagggtgcagaaggaagattaagaccagaatggaaagggaaggtggaaagaaattgggcatgaggtaaaacccagggctccttagcctctgttgtagatgtcttggccatgcaccccgggtccttatccttttaaaaggcttccctagaccacaggtcttctcactgggtgatatctgtctggaggcacacaaagatgttttaggagggtaaacagaagtgggcagcttagggaatcattttccagatcctcaactccacatgtgctctcttgcctgatgctgatatactgcctgagagctgcatctgccatctgcagttccatttcccaccgcccctttcataatccctttttcccactttagagaagaaagacacacctcttaaccagcctgaaacttactccatgcgtccgcccaaggtagaacaaaacctcaggggtagggagccaaacaaagggacaattaagaaagcatatccctgagggagaatatttgacagcaaaacaaagcaggcagagattagaataacaaagcaacagcatcttatttcatatagctccatggattttccatctaccttctagtattaaaattcagatatgagagggatgtcatgtgaaatgtacatatgcatataacactttaccttaattaaagataaacagactttctcacagaaaataattctaatttggccggtagtttgccaatgaatactgactttgccaattgtatgataaacattttccaaaaattgaagggctaaattggcagctccagagtttttacaaaatatatgtaaaatatataagcactatcaatataccagaaattctatcattcaaaactattcataaaaatttattataaaaaatagaatttagaaatgtgtgacgaagcacaatgtttttctaaatttttctaggaagtataaaacaaaaaagcttgaagatcaccaattagactcctctctgctttaacacagaggcaggttttggtagaagcacaaaatgaaagaagattctcaagtggtctgccgctgtctcccagcaccgcaaatccccagggtaaaaatacactactctaaaagaagggacagccatcctcggtaacctgctgttgttttttgctaacctcccacctcccattctgagcattctggaattcttgctagtccctccccatgacctaaaattccccactaacgttcctcccctagtccattccttcctcattatataccatgctctaaggtggctttgctctcatggtctcatttcatcaccttccctcaaatgcagctgatctaagctgaaatgttattggacaactacccagtttaatgaatttccagtgtcataatagccctgtaggcgctcagcagggtgggatatctatgcttaaacaggatttatttggattcttaatctaatggaggttcaaatatgtggaatttctggtcatttgaaaaagaggattatgagcagagggattttcctagcaccctgccggagaagcagggacaccagtctctgaagtttgccgctgggtcagatcatgatgcttcagaggaactctaaaagagcactcactcttgcccactcttccctttgttctctagaccaaattctgaaaatacctcgtgtcttactaactttccaggcttggtaccctacccataagtcttttcctggcttcaaacactaacatttatgtgacttacatgccatgctcgcacacatcacatgtgggacactaagcatgatctgtgtactcaaaccaggcccttaataggcaacatctcatttaaaccctcccagtatcctatgcaacagacttcctaaaatctcacttggtgaaactagctcaatttgcccaactcacacagctattataattcaaatttaggctaattcattcattcaaaaaatagtttcaaaagcaatagaatgttccaaggcctgtgttaggtactgggtggtgaataagacagagcccactctcagagatctaatatactagtaaggaagaattaaataagcaggtataatgaggtcgtctgtctcccttctgttctatcaccctccgggaaactctggcccaggactctgccttcctgggacacagggaggaggcatgtgtgataacaagaacatgacctctgaaattacatgcttgcacaaaacagacttgatttcaaatcatggttctgccacttactagctgtaaagctgggcagcgacctcatctccctaagcttccatttctcaagaccttgggagcactcttccccgcattgtcccctcagctttcaggtctcagctcaaatatcacctcctcaaaaagagccttcccaaccatctaatctaaagcattttccctccaatccactcctcccgcatgttatgtatacacttccctacaattttatataaaaacctgaaattcccttaattattgagtgacttgctactgtttctctccacagttaagggactttggttcagggctatatccctagtgttcccaaccaaactgagggtcaggctgctatttctctcggccaataacgagatgcagataaactaggagaaagagagtttttatttctataaccagttacgggaagaaggcctgcaaattatcacagacgaaccccaaattacaaagtttttcagagcttatataccttctaagctatatgtcacgtgtaagtgtgcattcatctaaggatataagtgattaacttcttttaatctataactaggtctgagtcctgaagaccttcttctggagcatcagtaaatttacttaatctaaatggtctaggtgctgggctgattacccttatcttgtctcctgctgaatcatggaggtttgagggttccttcagaccgccaataaatttgtggaggcctggggagtttcttcagacccccagtaaacttgtttaatcctaaacggatcctgttaagaattccttattttgtcatgctttatgcccaggaaaggcctaggcaatactcttgatgggcttttgtgacatcccagcctttgtgtagggcactggctttttttagctttcaatatttaacttaaccgctcagtcagtaccgaaaagttgtgatggaggcctccattagtgaaacctggcctgccacactagctgctgggaatatcctggctcatagtaaaccttcaataaatacttgattaataaatgaataaatcaaccagccaactgaacttttaatatatcatttggtaaacttagcccaaggtttacttagcccaagtataacggcttggcccaagttataaacttagcccaggttagaatggctattagcctgctaacttacctaattgatctgatctaagtccagcccatgggtactttcgccccacggaggattacaagactctgacaaataagactttttccacaggaagttcctctggtattcactcagccctgtaatgcaaagtacacttttgagtacagtccaattaatgaatgatgttttaaagcgacatcggtgaaaaataatttctgaacctcccaaaagagacttaagactgaaaattaaaacagacgagctccttaataagagctaatattcacccagccctgtgctaagcagttcacagtgttatatcctttaatccacaacaccacttgaggcagatgctaccaggaattccaggccagaggttaccctttcactgattatctgattccaaagcatgagttcttgtcggataactatgacaatctaaattctcatcattctagatttatcgcaggttttcaccgagtacacaatttatgtaccatgcctaggaccttttgctatttgataaagtcaacaaaaggcaaactcccttccattctgaatacacgcctttaagataaatgagtcaggagatgtgggacgctgtggcacctgtgaagttgcagggtgctagtccctgacagctaccagctacctggaacttttaactacgctaagaatgcacaacgatgaaaaacgtgtatttctttatacgctgtctttactaaaacccatttctcaagcctttaaaagccacatacactaaagttttaaaggtaatgggggtaaatgctaagctaaatgggccacaggtgtcccaatctgaagtcgcctttagttctcttccaaagggacctcctcccatctccactcctcttgagtccccctaagtaaatgtgtctcgcccatctgactcttcgacacactgcagcttgcaaatgtgagtgagcggagagggaactagttaagaggcggcgggcagattctggggcccctcgagcaggccctggggctggcagcttcgccgggcagagggctgcagcgcagaaaagcagcgtgacctcggcgctccacacctccccgccatggctccccccagccacattccggcccggggaccccagcctcaccttgaagcgcacggcatgtcgcccggcgccggagcccccgctactccgacagttaactggagaaaaagctcgagggggcggggcgataacagtgttccctagcaaagcctcggcccggcgtccccgactcgcgccggcgcactccgcgcttcccgcctagaggcctgtcggtctgtttttccccgcccttttggagcctagggaccaatagagactcgcagagtgccttacctccattaggatttgacaatgagtggccgaaagggagccgcctacctcccttgccaaatccctggggctgatagaatggcgggcggaaggccggccaataaggctcccggaaccgggctgggcgggaccccggggtgccttcctgggttgggtggaccggtccctggttcgccgggtcctgcgcagcaatgcgctgcttgctggtggaattcgccagccgccagcctcgctggcccaggtgcttgacagcataaaggtcaaagtgtgttcttcatgctaacatctatgagaaaaccgaacgcttctttttcgaaagtgctcagatttattctgctgaatatcggttcgtacaaacgacagccgcattacatttattgtcacatcaaaagggaaaggccaaaaaaatatataacttaggcaagatttttgaactttattgaaactcgaaagacaaactgctgtctcttcctccagtgatgttcttcctcttcaatctctaccttccccaaaatgatgtacatacagcccttagatgagaaaacgtttatgaagatggttgtctcaacttccaaaccttcagccttgtctctccgctcaaccttttttaaaaataaaacttcatctgattttaatcgactattgccatcatcgtcgataaatgtttctgacagaatactgctgattctgagaattgggaaagaaagaaattgtccagatagttctcgatatacttgggaaggacatacatctttatttatttatttattcattatttattcaatatggtgtaatgtgacatgtgctaaatttctaaatgaaaggtgtcaataataagggctacagatctgggagcagggagtcatttcggacggcagaagatgcgtcaggaggaaatattcagctgaaaggactgcaataagtaaaaagtgggacgatgaaagggcagatgtctgaatggaagctgccaggcttcttccaggaacaacaaatgagtgccttttacatttgtcatgtgttgatgaataaaagtataccactcttaaactttcaaatatcaacaccaatccttgatgcttcctttaagcattttccgcaaaagctgtcttcctgaatcctgattgatgtctttgttcttcacatcatcgagatacttaaaaatcatttgaagaagccacctgatatctggaacaaagagctattaaattagtcccaatgcagccatgcatccagggggcccttgattaatgttaattgggatgacagcatctctgtcgtgtaaattaagaatggcacaaacaagacacagtggaacatgaacaaaagtcatctgcaggaaggcagcccatcttacagagtaagaaaggcacaactttgttgtgcacacagctttgttaccacaaaatgctaaggtgagatcagcaaaagcaagtgttagaatgtagcctgcctgctaaacaagcgcaatgatcactgcagaagagctctgctgagagggagtaaatgacaggaaaaccaaacagcagattgtaaaaataactcagtcacatcccggcttgctagagaagtatcataaagacttaaggaagaagattttactttgctattgttaacaaaagcctacccaagtttaagaggcaaagatataggaatgggaaaaaaaaaagtgacaccttagtaaatgagttttgtagcctgtgttttaccagctcttatcttctctgctactgaggaaacagtacccagtaccctacaaagctccacccatgttttggggagtccctaggagtatttcacatgtgctcgcagcaaccacatagcgtatgccgggcagcactgccccttgttcaatagccatgcatctgtaggtgtcactcttgctgctggctatcacagccactttagctggtactgagtcttcactgggcacagcaactgggtacagccactcctcaaactgcctggcttggtggtaatctatggcaaagcacctctcctttttgcgttaccctctttgaagtgagtacactatgtcttagagagccttcttttcatttgtgttttagcctttctcatcgccaaaggctcaaaatgaagtccgtggagtctaagccaaaaagtaattcctcaagtgacagatctctgctatgcttctctcttccactagctaaggccctcttactgggacagtggtatcacaccggctcactcttccctttgttgatttctctatttctcataggaatagatttctgtctattctcgtgagagactgaatttgcacaacctatatgaagggcattttggcaatttgatccagagttcctcttctataaatttatcttacagatagactcacacatatgtgaaaaaaaatatcatttaaagttgtttaatgtactgtttctagttacaaaaggttgaaaactacctaaatgccatttagagagaactagtcaaatacattacggttcatccaaattcaaagagtagcgcagttgttctgctcctttgggccttctgatcctgcatggatatgttaggtccagctaggaaacagaccctacacaaggcatttcaacaaagagaacttaatataagctattggttcattactattgaagaacttaaagccaaaaggataaagaagaggaactccaggaagcagctcatatgtaaggctgagagaacaaaaggaaaatgttgaggttactagaatgcggaggtttgtagagaggcctcctggagttggtcagaccgctgagaaagggccactgccccactggtggggtcctctgaggggacaaaatgagactctctgggaacgtctggaaaagagacaagctggagatgcaatgaactgccactgtggggtagaagatcactgttcaggtgctgcggggaggaacacaaacaaaacagagcatcccagtctttccctagcttcctttcttggcaaacataacaggagctggccatgtgatttgcacagtctgaagggtgagactggaactgacatgcaacagctattaacttgcacacttccatacaacccctaacaagcaagaagcacctctttatgagctacatagaagactctcaaagaaaagaagcaaggcttagaagactgtttatggtataccatcgttgaaataaaagaaagacgagtgaataaaagaaaaaaaaaactgtcctatgatgtcgctaatgatgtcattcacaggcactttctccctcactcatgagtccaactccattagcggcgctataaagaaaagagcattttattcagtttactggtaagatatggaaactttaagttatgatagttaccactgaggctattttccttaaataaaataactccattggccctttctagtttatcttgacatatacctcacgataaggctgttgctccttttagagacaaaaacatataaaatcctttgaggcaaattttatttgcacttgaaatataaaatattctcatctactaccattctattaaaaaaggaagttgaccacttcacaaattaataatctcctatcattttctagtagcagttgaaacagtgaagaatttgtatttgcctctaactatatttatttttatttacaaaagaaaagtgtatatgagcaaacacatcagacgagggttgaagaagggaggtacaagatgaataagacatagcccctgtcttcaaatataattataatcttctaatgggggatcataagtacacaaagaacacagaaaataaaaagaaaggagaaagtgagaaaggggctaaagtgagcaccttggtattctaaagatgcttttaaacctggagccagaaagtttgatctaaatagactattaaagagcaggcaggataaaggagctgaatttaaattccatcctgggaaaacctgatctagagacctttcactttttttgttctgccctgggtagctgaatccaagccaatgttccttgagaagtttcaactaacattgctgaagatcggttcccaaaaaggtgaattcttgctttctgttgtctttttttttcttgttgcttcggaaatcagtaaagctgttttagaactactattttatcaatatagtgatacacagccttgtgtttacatatatgtaattttcctgaaataccttacaaggtaactgaaatgccagtctttgggcttagtaatgctctttagtctgttaacattctctcaggtcacatttaattgggctttcattggtaaatcttgagctcgcctttgccaaaaagcaatcagtctgacaaccgctttcttttgcatttttccataggtatagctgatttttcctcctatgaatgaatttctgattgcacaactaaaaaaaatgacaataaatccatggattctgtctgagaagcaaaattgctgatacttcacattaatgtcagtaaaatcgaataaataggttctatgattaagacttagcaatgagccaagtgcaatttgccctcagacttttagccgtgagatgcctttgttgacaagggagtgtctggcttttgaatcagtgggcaccttttggagggactccaggttctcttgacaacaggactttttttttttctctcttttggtgagccgaaaggactcctcaccatacaaggccacggctgagtaaagtaattctagtaaggcataaaccactggcaagcctcacataccataataataatgttgtactgcagcgcacaaggtccagggaatacatttggggcacaaaatttctttcattttaataccttcacgtatgattctgttctaagaattccctttccttttcttcattgattatttattgtcctaatcaccatctctttgaaaagtcctcacagggacgcagatattttccagaattgctaattgtgatttgaaagcatgaattctctcatctcatcaaatcggattctgtgtcttaaggtcagtcagcctttctaagaatcttgtaaatctctacctttatgccaaaataaattttgaaatattcttttatcacgggtaatgtacatgcacctgtaatcccagcactttgggaggctgagggggcggatcatgaggtcaggagtttgagaccagcctggccaatttggtgaaaccccttcgtactaaaaatacaaaaattagccgggcatggtggcacacgcctgtaagtttcagctaccgggaggctgaggcagaagaaccgcttgaacccaggaggcagagattgcagtgtgccgaattgcaccactgtactccagcctgggtgacagagcgagactccatctcgaataaataaaaaataaataaaataactgcagattaagtccagattgctactattattctttctgaaatcccagtctttctactgataatggtatctgaagtatcaataagggaccaaaaatttttcagacataaagtcagtttcctctcctttgtggcttataattgttgactcccttaagagattttatctcttaaggcctggcacggtggctcatgcctgtcatcccagcactttgggaggccaagcaggcggatcacaaggtcaggagttcgagaccagcctggccaacaagatgaaacccctctctactaaaaatacaaaaattttccgggtgtggtggcgcacacccataatcccagctctcaggaggctgaggcaggagaattgcttaaacccgggaggtggagattgcagtgagctagatcgcaccactgcactccagcctgggcaacagagcgagactccatctcaaaaaaaaaaaagatttttacatgtattttgctggagcaattagtataaaatcttagtatcgtgttatcaattcatccttcaacctctcaacttctattaattgaatgaatgatggttgacagtgtacatgatatgtccaaatgtaaaacactgaatatataaatatgttgttttagtatcattgacactatctatggaataagtttcaggaatcgtatgtattttagttaatcatgctgtggtgtgctgagactgactcattccaaattcatgccaacctccttctcctactgcagaagctggaaactaaaaacccctttgaccttagacccctttgcaactgaagtgtgggtataatttacttctgctgatcagaagcacttgcataaactgagttagatgggaaaaaagcagagcacagtttgcattgctgtaaatcatgacagtagcagcaacagcagcgtagttctggagttggcactctaccagcagcttcctggtcatagcagaggtgaagtcggagcttgtagcaaaggtgttcaacttagcaggcagattcttggttccacgacttcctgactgtaggctcctttagtgatctgttctgtgatgtggccctagagtctacttcttcagctctcataatgattctttaagcacttgtatcaatcgtcggttgccacaataatgctgcataacaaacactctcaaatgcacaacttaaaataataaccatttattattgcttatgaatctctgggtcagttggccagtttgctgatgtaggttgagcttagctaatcccactaagcctgcttgtggatttgtggccagtgatgggttagctagaaattggctggtctcagatggcttcagctaggacaactcctcatgttccacttgggctctcatcttctagcaggatagcctggattgttttcatggaaaaggaagattccaaaaggaatccaaagtacggaggattccaaagtatgtgaagcctcttgaggattggcttcgaaacagcataccatcacctctaccatattttgttagccaaagcagattaaaggccatcccagattcaagggctagggaaatagactcaaccccttcacggaaggagtggagagtcacgttcgttgtaaaggaagaatgaagaattggtagactagtattgcaatactatcttcctcactactgaataccctgaaaataccctttctgttttgaaaagctagaataaatatattatctgaaatttaactctgaccgatacaatgccagttcagacatatgtgtgcatttgattccctcttaaaactctgtaaaatgacagtaactgaatgccagggcaaacacatgattcatctcaatttcctcttaaaacttcatgaaatgggccaggcgcggtggctcatgccgtaatcccagcactttgggaggccgaggtgggcggatcacgaggtcaggagatcgagacatcctggctaacacggcgaaaccctgtctctgctaaaaatacaaaaaaattagccaggcaggtcgcgggcgcctgtagtcccagctacttgggaggctgaggcaggagaatggcgtgatccggggggcagagcctgcagtgggccgagatcatgccactgcactccagcctgggcgaagagcgagacaccgtctcaaaaagaaagaaaaaacttcatgaaatgatagtaaatgaataaacaggtataacaggtataaaccagtgaggtcaaagagaatggcagaggggacaactgaaaatagaaatattaacaaatattgaagttatggagagtagtctgttgcagatggggtttctggaaagcagactcggagatgaagtttaacgtgctgaatgtctattagtgagtgttctgagatcaacacctgtggaagggagggcaacagagtagaactgggtagaagaagaagtgagctgcaaggcaggcctgacagcctcagccaaccccatgagaaatcatgaactaaaatgtttgtcagaggtgtcctgccttgggccaaaatgagcctccttaggaaggctgtaaccttgaaaaggtggctgtctgccgtggaggtaacctctaaaggggctgacagcagaaagcactcgagtaggagcagcaacacatccttctttgaagtggaatatggacagtgcatcactgaagcacgttactgtttaagcagtcagtgtacctcacaagcagcacatacttgaaggcttaccacacaaaaaaactctggtcctattgggagctagtttcaatgcagctgttagactcttatcttcaaaccttcaggagtgaagaagagtacctgtcagcatgagttccttttgccacaggtagagtcccagatggaacattgccacatcctgtccggttcctgccttagcaaagaactactcctcctactgccagaatcctaaaaagaatcctttatctttttcataagctttccagctacttctggttcaaaactctcagagacaaaacactggatctgcatctcctcctttccctccctagactggtctccccttccttgctttgtggcaaagtggttatgttttgctcctgggcggatcatccacagtcctgtgcttccagacattctggtaatgttggtgccattgaaacatgaggaaagccagatccaggaaccaacaggacatctgcttatgacgtccatagccaaagaaggatgggaattgggtatagagaaaccccagccctagaagagagcaagaaaaaaggactggatttgaggagctatgcagacttgtctttttatctatgagactataaaacaccataaaagggaaattgtccgtatttgtgacccaaaaaaaaattggctccctaaaattaattccattgcagtcatttataaaccagctactaccacttatgcctaattaccatgcagcacagtacaaccgtacatgccataaagcatgtgatcagttcattgattggaaagctaaactctgcactatagggacagccgatgtgcaaacactttgtgaattgaaaagtgttacagaaatggggcagttcttgtcattaggctataaagaatgtctccttttgtatccttcctcatctttgcgttcctaaacaatggaactcacatagtttcacttcagtcatctcttagtctcaaattatctaaacaatactttttctgattattattagtattggctacaattgattaagtccttgctcatgtctttaggttgtccatgctgtaccataatgtttcagtcgggaaatcagagccacttaggttgtacaggaataaggggcttcatatagaaatgcaagcttgcccagatgtgagagaggtaaagtagtgaaagtcgagacagtcacagcccaaagactggaaaaaaaagttgctgtgacttcagcctaaagcctggagtatggatagggagctgatgggtgaagactgagaatctgccatcactacagagtgagagctcatagaaaggactatggactcccacatctggtgacctgtctgataaacctcagcaagatttaccctgagaacaatggtctcctatcacttctgctaccaagtcttgcacaagtcgcaaactcaaagtctcattgactacttccaacccagaatatataagaatggagattctgggaaaggtagttcccagccttggacaggcatggcactgaggtgtggagtgaccaacaggctgtctggcatacggacaactctactatgtaggatgtagtgttactgttaatattttttggcagataaaattctgagatgtttaataacttgcctgaatcacatgctaatcagtgacagagctaaaagtcaaacccaggtcggtctgatgctcatgacctaccttaacaactcttctctaacagtccttcaaaatctgtataagtactattaattgcacaatatttcttctaatattatgtccctgtctctgtgactaccagaggcatatattttactatcctagaacattgtggataagagatatagatcttgggagtaaagcaacatgtcaggatgcattcctactctggggccagagctgggacatttctgctgccctcagtagcaggtgactgttaggcagcttacagggctgcattattagaaagtcctttttcctcctctggtcaagaaaaattaatatctacagtcctcaattctccagtctcttccaagtactgtgccctacaaatgcttccctgaatgtacttttggagggaggaaagggtatgcattcttaaacttcaaatgaatgtaaaaagctttaaggggactatttggagaacttcctatgtgctccctagacttgtgagatggagtggctattatctaattgggggaaatgcaatggggaaagtttgcagctgagttggtttaacagcagaatgaagagaggagggtgcattaggaacaatatgcataacaggcaagaatgtatgaactctcatgggccaagctagacagatggagaggaccaacctggagcatgttcaatcctacctaacagtattccctgaaggggaaatgtgacccaactgtggattccagaagttcaggtgttgagagtgagatcaatgtggtccctgaagtgcagccctgcccaaaaaagggagctgcagtcagaggtcctcactgggcaggcctccaaacacatccctcaaggaaagagccagcaattgtgcacctgccacctcagaggaaatcatcggattacaaactgccaagccacaaaaggccttttttcattaatcctctgttcttctgagcctagctctgaaaagtcagaaatagcatctagaaagcagagagtagtagaaggagaagcagagaagtagaaattcaattacgcatctctccaaacacggatatccaagccctaaccaggcacatggttgggaggtaggaagacaggaagaagggaaaagggaaccagatcagagttttatgctcatgagaactttaaaaatcatgaaaaggaggctgttcttgtgactaaaagtaaccaaaggattttttatttcctaactaggagtaactgaagaaatttggaacctagatgagattgcatccaggaagggatttagcagggagaaatgggaaataataaagtctttcccctattcagtccagcttgaaataaaatgatcataacaatgtaatagaaacaatgagagaacataaaaggactcttagaactaaaaacattataggagaatttttaaatggtgtataagagttagaaaataaagctgggaaatctcttggaaactagaacaaaaagaaacaatcaattaaaagacaataaaagtcacagtcatcaggaagacccagaatatgacatcgtaacacctctgtttaaaaaaagagaaaccagaaaaaaaatgtagagaagaaaattactgaagaaacaatgcaagaaatcttcccagattgctgacatgagtttccaaattaaaagtgcccaccctgcacatgcattaattcattcgtaaatatgtgaatgcaccttttatgtgctagatgcagttctagaactatggcagacacaaaacaggaaagtccctgctatggagcttgcattctactggagggagacaggtaagaaaaaagaattatatcatgtgtcagatggtgatagaaattattaagtaaaataaacctgcataaggaatatgtgatgagggggtgtgggggagggatcactgtttgaaagcgtacagttaagacctctctgataagtgacatctgagcaaagagggtgagagatgcaagtatgctaggaagtaagcccagcaagggcaaggttctttgtccaccttgtttactgacatatcccaacgactgcagcatacttggtactcaacaaacatttgttgaataaatgaatctgttccatatgctttgcataaggaacagcatatgcaaaaaccctgagacaagaacaagaaagttaatgtggcggagcagaggaagctttgggggtaattgtaggtgatgaccttggaggctgtggctagaatttggattttattccgagacacggaaatccattgcaaagttctgaacatcatagtgtcaaatacaattcacattgttaaaaaacttacccttgcatctgtgaagaaaatagatggcaaaggacaagaatgggagcaggtagaccctcccagtccaggcaaatattaccagtggctaaagtaaggtagtatcagtgaagaagtgatcctattattgatagatcttaaagcagagtagcaagacttgctgattaattaaatgttacgcgtgagagaaatataaaagttaaggatgaaccaaagtttttaacctaaacaacttggaggatggagggggaaacaaaggaaccagttgcaggtgagaagttaagggttattttggatttattgattttgagatgcctaaatgacaagtgagatgccacatgtatttctttgctaaataaataaattggtggagaaattgcatattcagtttatcctcctcaatatagtgtatctatctcaagggccacacgagtgacctattttaagctcatttccaacattgacaatgcagtagtcctcccctcacagctagagtaaaagctgtgattctctccttttacggtgcctgcaggattttttctttcacatgtacacccttcctttccacattacatcctccctctttcctctatattcttggggcataggtccctcttattttggtgtgttgcaggggaggtaaagggaagacaagcaaacccttcatttggccattctgctcttctccttcatttccctgactaaactttgtcgcttctccctccaatcacggatagagcttcacttttttttttttttttttttttaatattgagacggagtctcactctgttgcccagctggagtgcagtggtgctaactcagctcacggcaacctccacctcctaggttcaagcaatctcccacctcagcctcccgagtagctgagattacaggcacatgccaccatgcctggctattttttttatttttagtgaaaacagggtttctctatgtggccaggctggtcttgaactctgacttcaagtgatctgcccccctcggcctcccaaagtgctgggattataggcatgagcaccacgcccagcctgagctttcacttcttaaccctgacttccatcttcaaacccatcacaaaccagtcctttgaaggccaaggctttgggctgttctccagtctccttcacactcgggggcctctgcacccttccctgtgttgacttctcattgtaggcctcccctgggattcatcttggtcacctgctgtcctatctgcgtgcttcctccctcagaaagctcatccatccccatactgcagtgaacacctctgcactgatgactctcaaccgtaatgttcagtcttgacttccgtcagagcttggacttcctgagaggtagttaagcaaagtgatggtctagaataagcactaattcagatggcttgggtttaaatcccaatttaactgtataaacttggggtcatctttacttctcattcttcataaaatggggataataagagtatctgtctcaaacagattccttgagataaaataaaggataaaatacatttacatgtgtaaaacacccagtgtctggcacatagaaataataaaggttagttatcattattggacatcacactttcactaccaactcaatttaacaacaccacactcctcatttgtttctctctccctttaatcaattgtcctcctgtttttcatgttgtctctatttctcagatccacatcattgaacatttgtaataatctctgacttgcttttacttcaatttctttattcagtcagttaacagacagatcttgctaattttcctttttgttgttgttgttgttgttttgagatggagtctcaccctgtcacccaggctggtgcaaggcacgattctcctgcctcagcctcccgagtagcttggattacaggtgtgcaccacgaccccagctaattttttgtgtctttagtagagacagggtttcaccacattggcctggctggctcgaactcctgacctcatgatccaaccaccgcagcctcccaaagtgctgggattacagcatgagccaccgttcctggccaggtcttgctaattttcttactaattttttctttgatggtcacttaaatcttttgctttcctctttcgccctctgctatgcctcagtacagccccagtccccacaccaaggcagccagggctacagcctctttgtgagtctccgtggactcagctctcagccccaataatggaaatcttctttagatcccaaacaatgttcttctcttcactcagaatgttcagtattcccagtttccattcccatcaagtgcagaatccttcagctagagagcctttctagaacttccgcaatatggctccactctgtacaaccttatttccttccactttgctgccctgtctccctactgcaccaagaccacgtcacattgtttctggtctctgcttcttcattttgttctcgcctaaatttccctcctcactcttctctaccaatctcaatctacttgtatttagcccggctcaatctcagcttcctccctgagatgcacattcttcctattacttgcctcattcttcctattactgtagcacctgaaaccaacatttgaccccgatgacacattgggcatattattccatgtagtttcaaaatgtaagtcattttttgtgtgtattagattataaatccgttttctaaagttcagtgtccctgccccacccttccctactgcacacctggaaagccatgaatccatagaaaagactcataaattgataaaatataaaaatactactaataatcacactatactatatgccaaggagctttacatatattcatttgtttaatccttacaatattctatattagaaatagtagaaatattattatcctcattttacaactgagaaaactgagcacagagaggctaagtaacttgcccatgattgatcactgactcagagtaatcttcacattggagatatgtgaaggaatgcaaaaatacaatctaagaagattatactgtaaaaaatacctgaagacccaaggaagagaaatccaaaacctcaccctcacttcagtaatacaaaattttgtacttctgagttgtgaagggaaggaataagtaggagtcactttttttttgaaatcttttgagatagtctcactgtgctgcccaggctggagtgcagtggcacgatctcagctcactcagcctctgcctcctgggtccatgattctcatgcctcagatgcccaagtagctgggattcaggtgcccaccaccatgcccagctaattttgtgtttttagtagagatggagtttcacttattggccaaactggtcttgaactcctggcctcaagccatctgcccacctcaacctcccaagtgctgggattacaggggtgagccaccacgcccagccaggagtcacgtttttttaagtgcagtttgtcattttttatttatctgattctaaatgaatcacagaagaaacctaaaaaagctggtccccctgtccccatttttaggtgaggtcaataggactgctttgagagctcaccgggcccaaccatcagtctgttatgaaataagtatccctgtaaattggcaactacccaataactgccctatcccgaaaagggacaagtgctatgtgctgtgctctgaaagccgcacttctttgccttgttacaaaggaacagttctggctgttcacaaataatgtagagctatattacttgcatctgtttgaaatcagccaattatcccccaaaacagcagctagccttcacctactgagctccaggtcctgtccatcctcagaagggagtgcgaaggggctggatgatcccttgtgtctggctgagcggccaacaccctaatgctcaaggcgacagccccaaatgctgggctctgccccaacactcatcacctcccttgtgtgaaggaaagactacagcccatctccagactaggtggcaagtcgtagaattggactaatcagtcattttcctctgacctaattaggaagtgtacctcttggcttttagtttgagaagagaaaaccagtggcctgttacctcagaaaactttcccggtgagaggccagctcttctgctctgattgccacatggagattttgcaaatctgctaaaaatttattaaaatggttatgcttgcctacagtagtaggcatctttaaaatgaaaggaattaagaaaccttgttatataatgaatgttttataccacctcactggtattcaaactatttttttcctaagctcagatgatttccatatgggtgaaagacttcagattttaattgatcaaagataattaacaggactctgaaaaggtagttacctacatgtcattctacatccacaaaatatttgcgtgagaggatgtttcagctgtcgcacacaaccctgactgacatttaatggattattagctgtcttgccccagcatctattctgctttagtggcttctatcctccaacccgctgaaagtgactcaaggcactacagattccaaatgcagcctgccagattaagcaggaaactgcaggaagcatccctacattgtgagaggaaagtcagtgcagttcccctgagatggtgtgcgttaatgtaaccatggtttttaatctccttggatgctctctctgtacctatgataccatgtacagcatgctcaaaagaaacatgataatggctaacagctggattctttctgcagtttcttatcaagtgcctcatagtttgcagcttcccagaataaagagtgtctctgagcttaagcccagaagcttaatttataaactgagtgtaatgaaccttgtcagaattgtataccacttggcttgtaccataatatatgtgtggagtggctattgtatacaaagatgactttttcagcacactggaactttccatttgttaactgtctctcagccctggaatagtcatttgcttttgtttttatttcaatagctgccatttagcaagctgccatgaagatagccatctcatctgattcatttggggctacaattcatgtattaaggttaaatccatatcttttatccacttgggtgaagaacatgaaagatcctatacaactggtctaacacctgtgtgttctctctctaaaagttaatacccaattcagcttggtgcaggttttaaaatttaaataaaaaaataagttaatattcaagttaaaccttggtctatgtctaatcattacaatccttctggaatccaaaatgccaaagcatttgccccaaaaagcagcctggaaccaaggtgtaatgaagcatttcccggtcccactggacagggctgtgaatcatcttcctttcttacccagttggcacagataatagcaactgaacagcattttgtctccggaacagtataatttccttaaattaccattagtactagtgttgttttcactagcagcttgtacagggccagacatatctcagggagaccaacaaatcttcagaagcaacccgcatgtggagaaaccatgttgcagagtttgaaacctcttagatggagtaagcaaaatcatcctcctagctcagctgcctgggaaacttgagcccctggacctgaacatcaccacggctccaagcaatgacaccatcttttgttctctggtttattttctgcctaactccttctgtcacctgcctcttccctagggactgagctaatagaagattggacctctctcagcaagtccatctggttcattgaaatttatctcacaaagagtagcaatttaaagatgggaagagtggcacaaagtggtttagtttctataagtgcccccaccccccgccactttgtgggggaaaaaaaaagcaacagcttccctttcactgcagcagcaacctgtaagtaatggatcatttcagggcattcagatctggcctacattggcgctgatatttatccggctattctggtattttcttcaggttaaacttgtactacttcagtgtcgcactgacagtgacttctttcttaatgttcacaacctggagggagtgaacaaggcatatacaaaaggtaacaaacattcacaatataaacaaagagcaaagaaatctttatatttccctgtagattcctgctttttaagaagcagtggtggttgtgccacttattcattttttagctatgagtcggatttgagcattctcctccctagtctgtggctagaatagcgttttccaaactatgggccctactgtaaagaacacacaatctgcctgggtttgaatccttgctctactacactagctgtgtgagttaggcaagttacttaatgtccatgtgcctcagtttcctcatctgcaacacggggaaaaaatagtgcctatttctttttgtttgtatttgtttctgtttttgtcttttgagatggagttcactccgtcttgttgcccaggctggagtgcaacggcacgatctcggctcaccacaaccctgcctcccaggttcaagcaattctcctgcctcagcctcccgagtagctgagattacagcatgcgccaccatgcctggctaatttttttttgtatttttagtagagacggggtttctcatgttggtcaggctggtctcgaactcccgacctcaggtgatccacccacctcagtccccaaagtgctgggattacaggcttgagccactgcgcccggccaatagtgcctatttcatgaatggtagtgagaattaatttagttaatataggtgaaaaatgtaaatactgactggctaatgtaagtattaaatattatcattattcaattctacagaacagtagttccaagagatgttctagggaaacaagagcctgtggtcaaataagattgaaaacgcttcacaccaacatatgtatcaaatctacaaagttattgattacataccactaggaaagaaaaagcaatgccaattaattaggacacaatgctttccccagggatttggcgattttcctggtttcagttgtgttgccccttggtgagtggtagccactccttgtgcgcctacctcggtaacaaatatagccctagtactgggtatcttcctttcttaagttctatcaagcatttggttattgctttgcaagaagtaaggaactgtagtgctgtgggctagatgtttgtcctcctaaaattcatacattgaaatctaacccccaaggtgatggtaacaggaggtggggcctttgggaagtgattaggtcctgagacagagcctttatgagtgggattagtgcacattaaaaaatgcctgagacaggaatattagcccctattcagcctgaagaagttacagagggtgactcttcatccctctgtaaccgttggattaagggtccccttgtaaaaagggaggggaaaacatgtcagaggcatttgaaccaggcaactccatcttgaataggagctgggtaaaataaggatgagaccgacttggctccattccaggagattagacattcttagtcacaggatgagataggagtttggcacaagatacaggcacaaagaccctgctgattaaacaggttgaggaaaagaagctggccaaaacccactgaaccaagatggggatggaagtgacctctagtcatcctcactgctcattatatgctaattatatgcattagcaagctgaaagacactccgccagtgccatgacagtttacaaatgccatggaatgtcaggaagttaacctgtatggcctaaaaaggggaggaacaggaaccctcagttcaggaattgcctacccttttcctaggaaactcgtgataacccaccctttgtttagcatatatcgagaaataactataagcagcccatgtggctactctgcctatagaatagccattctttgtttctttactttcctaataaacttgttttcactttaacaacaacagcaaaaaggcctggagaatctcattgacgcttccaccatgagaagacatggtgagaaagcaccatccatgaacagaaagtgtatccccttaccagactctgaatctgccagcgccttcaccctggatgttcagcctccagaacttcgagaaataaatttctgttgcttgtaagctactcggtttgtggcatttgctatagcagctcaaatagactaagacatgtagttaacctacaatgatgagcttctctgctctaagatcttgtatatacccgactgctctgtttccataccttttgacatatacataacttttcatgtcaataccaattcatggtgtgatctttatgaagatactttaaagagcatgaaacatcattctatgctgtgctaggaatatacctaactcagctgatgtgacaacaaaatagctatggccaacatcgcatgtacccaggcaatgacaaccatggcaaaactgctgctgaccaacaactgctataagataccactgactgtaagaagcatcctacctcagagataaaaagtacagagggaagtgctacttagaattgatgaaatatttattccccctttaagagacaccaatgcatattaacatattaaaggtgcaaggaagccctgcagtaaagaaaccctctccctgctttaagccaatattgaaccagacagccctctttacaagttatacctatcaacagttggcaaattcatatcaacatattctactgaaatagaatctaacaaatctgagcataacaagtaatcacagggaattttttcaaccgctttatagtcaagcagctatatagtcaaccggaagactgacctggttgtggaatcaaagacagaaaagtagcccccacagaaatcctaggactaatgatgataagtcaatatctccatattcttaaagaagacacttgccggccgggccgctggttcacacctgtaatcccagcactttgggaggctaaggcaggtggatcacctgagtcgagagtttgagaccagcctggccagtatggtgaaactccgtctctaataaaaatacaaagttagccaggcatggtggcacatgcctgtagtcccagctgctcaggaggctgaggcgaagaattgcttgaacccggaaggtggaggttgcagtgagccaagactgtgccactgcatccagcctgggtgacagagcaagactccatctcaaaaaaaaaaaatacaaaaattagccggtgtggtggcatgcacctgtagtcccagctactcgggaggctgagacaggagaattgctgaacctgggaggcggaagttgaagtgagccgagatcatgccactgcactcgagtctggcaacagagcaagactttgcctcaaaaaaaaaaaaagcacttgcctcatccccaagtccaagtttttatcacgataagactaactccttagaaccagtcaaattccagtttaataaacatatggagcccttgatatacattaagtcctgagctcagcaccagagctacgaaatgcttaaggacctctgtttcatcatctgcaaaaacgcaataataataataacacaataataatagattactgtatgtatgcagtgaagtactgtatgtacagcacttaatatagtgccctggctggagggttgcaagtgtcattccagtgaggaagatggaagggaaatgtaggaaatgccgagaagcacgagccactgggagccatgggggccactgtcattcccctgtcccttattctatagagcgattgctatagaggctgctgagcaaatggcttactgtcttctggtttagttttactttaggttcaactcattcaagttcttttgtgcccacaaaatcacaagaatgaagtgagctttagctgggctggcatcagtcatctgtcacctgcataggctggggttcagcagtgcaagcaatgacttatttcatcttcaggtttgtatttggtgtgagaacctgcagggagaggggatcatttggcaagggcagggaggggcatataagcatcgggaggtgagccagagtcagagtcagctcagaggccttcacatccagcccagatcaggagctaagtaaaggtggcaccttagtactgggtcctctgaactgggggccatccaggacttcatgagacatccaggcccacttaactgggcccttaactggagttagagccacactaggtacacagattctaaagacagggtacttgtacccagggtacccacttcacagccacactcccagttctttctccctgtccaaaggcttaactagtcactcctactgtactgcagtgcttctcacactcacagccactcggcggaatatgtcaggagcttaaacactcagcctcctgctaggaaagagaaactaatgtcaggaaaatgtttaaaaggagagcatttgaaggatggggaaaccattaaattagagcatgcttttttcccatttttcattttaagtgactcaaaagtaggggaggaaaagggagagacaatcaacactgcagaaatgaccactgacagctataaacaaatgtctgaatgttctcttctagcaagatagtactactttctgttacacagcgtgagatctcattatgttcttttgataactaacactacactactggtaacatggaaaacttattaaaaatattcattagagaattaatagcttcatttcttccgattaagtgttgtaataaagatatcttgtctttatgtgccaaatactctcaaaagaatgaagaatatcagagttttaaaaatctgattgaattcatttacaaacgttaactactagaaacaacctggcataatatccacctgattcctcatagatgggtaactgtgttattgatttgatttcactcatcctcagggattagagcaatctacttatggtgactcttgcttgcttgcttttctttttctttctttctttctttttttttttttttgacagtctcctctgttacccaggctggagtgcagtgacagtcatagctcactgtatcctcaaaatcagagctcaagtgaccctcctgcttgagcctctcaagtagctaggactacaggcatgcactccttgcccagctgatttaaaaaaaaaaaaaatttgtgagacagggtgttgctatgttgccaggctggtcttgagctcctggcctcaagtggtcctcctgcctaggcctcccaaagtgtgggattataggtgggagccactgtgtccagccaacttcttaataactgaagcaaaacacacatagatgttgaaacttcagtaataaagttgataacatcaagttgccttggcttctcctgtagacattaatagggataaagaacaacttgttgaatcaacaaagattatcccaaacaaggaggaaaggaagagcaaggtaaaagagaacaaatgaatggaaagctatgtgtccagatcacaggaatgaatacaggataataaaagagaagaaagatgtaggtgaagggacagggaatattcaaggaaaagcttagtagtaaaggcatttacaaaccagtgagggaacttaaagagaccagaaaagggagctaagcatttttgtggcagcatctggaactgcctggaggatggaaaaggccccagagaaaaaagtgacatatatcatgggtttccatggtgatgatgacagtgcactatcagagcattatgacttcagaatagaaatgaggatataataatagcatacactacatctcccttttaaatccctcccaaagctcttagtatttactcattaattttcacaacactatgaattagggagtattacctattttagagatcaaaaaatcagaaacaattgaaatgccacaatgcctgaaaaagtatattgctgctaatctctcaccctgcactataaacttgtggataattgacataaagactatttcactggtgcttatgctaagtaatatgatgagtttttgagctaaccatttttgggaaatgtacgttggaccactggagaaaaaactttctaacaaggttcttagatttcttcttaattataaaacatgagaaaacagaaatttcagccttttcaaagctgagcattgttttccaaatgttttgcatcaaagattacctgtctgtcttccccatggttgcttttattgcaactggcattctttcaggctttttaattttttttctgggctttgttcactttactcttcttcccccctcttccccctacttcattcatctgttccattaacccccttcaaacacaccctcaaaaccagggatggggcctatgactatatcactataaaattctattactactcattcttagaatgattaggacactcattaacctggagaggaaattcatatacagttgaagaagttttggaatcggacaagctgggttctaatcctgcctctgacacctgcagcaaagtgaccttagaccaactacttctctgatcttagttttctccatctgtaaagtaaattatatttgtatgtatttcccagggttgctgtgaggataaaattggataatgtataagagcatttagcaagagttattcctgaggctatgaaaacgcaggcttccctatctaggtgctctccttccactttctcataccctattttgcaatccccaacttgactctaaagcctttaacactaatctcctttcaagggtctctctctgttcccatcttgaagacaaagagcaagatgctcagaaaagctatgttcacattcagtatctattgggacctcaggaagtggctgaggactataaatccagagaacaaaattttactgtgtttcctccttccaaaccatgtgatctgggtaagctgcttctcagatcctcaagtttcttctgtaaaatggcatcacaatgcctactcatagaaaatttttttttgagacaagtttcgctcgttgcctaggctgcagtgcaatggacaatttcagctcactgcaacctctgtctcccaggttcaagtgattctcctgcctcagctcccaagtagctgggattacaggcatgcaccaacacacctggctaattttgtatttttatagagacgggggtttttccatgttagtcaggctggtcttgaactcccaacctcaggtgactgcctgccttggcctcccaaagtgctgggattacaggcatgagccactgctcccggccttacagagatcttatgaaagttaaaagtacttatgaatgtaaaaatggcttatacaggacataacacacaatcaatgttcaataaagtgtgacctgaacgtgactgtgaattaaaaattttcctatcattctcactttcctagaatttaacagtaatgaagtaaattctggtatatctgtgatgcagttactaaaatcctagagtagaacattattaacatggggaaaatgctcatatctattactaagtgaatagtattttatattatttttgttttttaaaaaacactcaacaatacacacacacacacagacacaaaaagggtttttaccaaacttttctgtactaagcattatccttttctatttagggacagaaagttaaaatagaaattttaaaaggagctatggcaaaaaaaaaaaaaaagtattgtatggtgggtccatcaagcatgacaatggaaggaaggcataaaagcagtggggagtgtggagagggtaaggagaagccaagagtgggggaagggagaggagaaaacaggtcagagtgaggacgaggtaagtcagggctcagagtcagaggagccttgcttccatgcgtttgttgctgggattgccaaaatgcctgcggagatacagggtcgcgtctagccatgcaggccacaaacattcaaagttcactgggggaactgggagccggaggaattcgagcccagggggctttagatgccctgatttttctgtctcagatccacagaaagggtgattacttgcctgcttacgcaaaagctaacagatgacctagatggcctcccatgtggctttcagtctaggagactgatttactagggttttgatttattctcctccaatgagcaagaaaccaaagctatcaccgctaggtggcatgccccaaatactattaaactttgaaactggcagaaagttggtatctcagggaatcacacacactctataagtcaaaagcactgctagaggcaacagatgatcatagaagattttcagtttctcactgttaaaaacaaaaatcatcaagcaaaacactgtaacaataacaaacactcctttcccaaataatatattaaatgcgtttctcatggcacatcctggaatccccctgggaaacatggcccccatacccctatcagtgcctataacatctcctcctttcccaaccaaaataaacaagtgtcccctatcatatgccaaaagcagaagaggtctctgatgtcatcaaagaataatgtacaaccacagatacaagatttgcatgagctaagtaggacaagaaattccccacacaggatctattatggtcgagaaaggacaagaatggacccaggccagaaagaatatacttcttttgacctaataatcttctctttctaaatatcatgccactgtcaggatctctatattaagctagagctgttagtcatttacaccttaatgtgattacttttctctgctgtcttttctccggaacgttacatgtcattggttattctacaagataaaattttagttgaatggctaaaaagaggaatgattttagagcacatgaaaggagtaccagaaaggacaggacagggtagggccttgaacttgaggactctgcatatggctgcagaggtcaccaagctcttggcatttttgaatgaggagaggagagtgtagatggagaaataataaagggaagtgctgaaagaaagggatgtggcaagacacattttgcataattcatagattgcctaggactatctggatgcctagtgatgaaatgtgaagaaatacagacaatttggtatttccaactatgtaactctaacaggaaattccctgtattgtcctatatttaaataaattaatatatgagatgtgacaataaatacaagggcagatttttttaagcaaacacacatgtatgacacacaaatgagttattatccctttcaaagtattcacccattttaataatgcaaaccttttggaagctcctcttttaaaattgacacatatcttttgaaaacccagtgctaacacacagcattctttctgaaagtggatttcatttgttgaaagagtcaaaagttggctgggtgtgtggctcacccctttaatcccaacactatgggaagtaaaggcaggagatagctcgaagcaggagttcaagatcagccttggcaacatagcgagaccctatctccacaaaaaaaaaaaaaaaaaaaaaaaaaggcactggcctggtgcggtggctcacacctgtaatcccagcactttggaggctgaagtggaagaattgcttgaagccagaagttcaacaccagcctgggcaatacgtgggaccccatctcaataaaaaatataaaattttgaaaaagtcatttggagctaaattggcaaacagaaaggatgatcaataagaatgttccatttttggtcaaaactgaagcacgatcagaagtatgtgctctagtatcacactgggccacaatccttcttccaccattttattactctgtgaacataagcaagttatgaaatcattatttgcctcggttctctcatctataaatgcaaatgataataatacctacctgataatgttgctacgagattaaatgacataatgcaacaaaatacttacatggtactgtaagtatacgtggtaagtaagtatacacggtactgtaaggggcaaatgccaaataaatagtaataatgttagtagtggcaacagcaataatagtagagtggcagcagccacagtaatatgtagcttgtaaacctaaggaggcaatttttaaaatagtagcctcccaactagcaactttcaataactgcaccaatttgcatgtgtattctgacattttttaatcttgtttttttgtttcttaacccattcttatttaaactcagatggcacatatttccaaagagttccctccagtcagtgaagaatattcagagaggcagcttctgtaccagggtttaaaattattgtaccaatacattagaattcatgaagatgctctattatctagacagtcaaattatatgtcttgttaattcacaataaatatgtatcaagcaaatgccgatcatttctaaaaactgctaaaacagattaaatcagtcactgactaaaatagatctactcaatcatatataattattgaccataaattttgggctgtatggtctggtctctggggtaacaaccaagatatacggatgaaccaaacagatatagcagaccaacaggaagttcttggattctcgaactacttccagctaagggacacacacacacaaatacatagggcacctctggaagaacaccaatacactagcaatagtgattgtctctggggagcaattatttaatactactttgaactttcaagttaccttatgcatgcgttaccttttcaaaaagtaaatagaagttaaaaatttaacttttatatacaacaaaaaatggagtagtttcttcaaacctgctatgctgattcacattattttaatgatgtgaaatatctgtgcttacctcttcacttagaaaattaaatcattcatacaatataatactgttattgatcccagtccattaattactcctaatttcccttgtaagacataataacagctgtgcaacccatcagtccacatgccacggtgatggcctgttgaaatctttgctaaagaatttggtcatggaggggttatcaggatattgtcatctttctgggtaacatttccaaagctggtgagcagagtctaaagccaactcagcatagccatccagcatcctctcatccatcagctgcatgtcttcccaaggtgctaagcaatgaccttcctccatgaacatgaggctcattttcttctttgaggctcattgctatgttctcaactccagagagtagtattccttcaggtttaaacttgccaaaaaaaaatccataaatcaatcagcaaacatttataatcatctcccacattcaaggtactgtgatggatgtttcagggatgtcaagaaatataaaagtggtttctaaactctaagagtttattgtctagttagagaactaaaacacataaaaattaaaacatggaaccatacaagtagaatactaaaagtaccaaattaagaggttaagggggagaggcaataatatttatcaaatggctgtgcactgtgctaggtgcttcacatgtccatttacttaatcatccttccagttccactttgaattccattttatagacttggaggtgaagaagttgcctaaaatcacacagatgatcatggcagggcttgcgtttaaattaaagtaagcctattccaaggccctgctcttctgactcaagctttgtcttcccaatatataccacgatcccgtagaaaataagtgctctaaggattaattgaaacaagttatcactttgaatggtagcataggcatcatgaacaggatgtgaaatttgagaaaagcttttaaacaggttaaaaacccaagatgagtagaatgttataaggtaaaaggaaggaagaaaaatctatttccatctgtaagaagtgcctgtactacagtgtagagatggaagagcccaagctggtgagacgaccattctgtttgtgcctgatctggttacctgctcatctcagtacaggtatacagcatggtcctggaaggcagaggtgctttagggaccagccaacccatgaataagtgggctcttcttgggaggcagattcctgcacatacaataggaaaggcatgggccaaacatctccaagccttatatcttctagggattcttggtgtatgtcagtggcccatcatacaagaccaacaattttacttaattaaggtaatgaatatattaaaatgaacatatagatattttggagtagaatccagcattaactggattttgttagtacaaggtattaatgtaatgccatgcttgtaatgggccccatgagcctggcccagacggctgggattcatagtttgtactcctctcccattaggggtttctcaggtgaggactgagaggtgctgatatggaggagacacacatgtggcatagcacatgatattgggaggcaaaaagagaggaaaagagggtctataatggccctccagatctccatgttctgagtctgttgtcatccatactctcgtgttgtttgtttcttgccttgactaatgaataaagtctcattaggaacactccatgcgttactaggtcctcatagtcatcttcggctttgcacttgtctcatatcccacatctgatccatcagcaaatcctgttgtctctaccttgtaagtgtaccagaatccaacagcgtccccacctgtactgccaacaccccatcccaatgttcactgtcctcccctgcttcatcgccaccgtggcctcccagttggcatccctacctctgcccttgccgagagagtctactctccacagcagccggggtgctcatgtgataacatgcatcacatcataggctgctctgctccatgcccccaggaacaggctatccccctcagagtaaaagcccaggcctccaaatcccctgcaaggccccaccggtcctttccaaccaccccatctgtcctccctctctcaccattacccagccacattgcctgtttactgtttctgaggaagtcatctatctcctcctcagggctcttgtacattctgtttgttttccctgacacgcccttcctcagatatcctgtggcattaccctttccatctctagaccttggctcaagtgtcactttttcagggagacttccctaaccattcccaacatgctctgctatctgctctgctatcaacatctgacaatcacttattaaacatgtttattgcctgcttccctctaccaaaatgtcagttccatgagggtaggattgttatttcactcattcccagctccttgagcaatgcctgatgcatctttggcatcaacaaataatagtcgaataaattcatctacctggtagtccttggctggaaaaagttttgattttttgtctttataaagcaaagatgaaactaaactacctgccaaaaagacaaagagaattgcatttaaataaaacttaaaacaagttgcagaatttgcatagtataatctcatttcagtttttaaattgtatgtgtgggtatatattattgaacactaactgcatgctagcagctgataaacggactatacatgagctatgtactatactcatataaatgttcataattgcatataaaagcactggaaaacacgtaccaaactgttagcaagtgggagtgaggtttgagggattgagagaagactagcttttactttacaccattcttcattaattgaatgctttacaatgaaatattttataaatacaaaaagaaaaacatctgaagaaactcaatatcagcgccattttactgaaaatttttcatcttgcagttttaacttctcacagaatcctttcctttggacttaggcctctgaacctgtgctaattgcactctgtcaggaattcgtccttggcgaccatagaaatattacaggtgtctgtgctacccagaaagcaaagggttgtggtgctttcttttttccttgagttacattgcgactggcacagttatgaaatgagaaatgttacacacaagattgcccaatccccatttttggcttatctttatgtcccatacattcttttaagatttctatcgcccagtattgtcgatttccacatccacagcctaacaacgtggtgcaatcgccctttgcgacccgcagaccaacagacggatgctgccctgctgcagtttcacagcacaccgggtctttcccttcagctggacagaggcccagccaggccgtagggaggattccgaaggtctctctgcagggaccggcctctcagaccgagaaggctccacccaggcaggaaaggacactgtatgtgggcagtcggcctgggccccatggctcgtgtttgttgctgaattgggcaacgtgggctgcggtcacagggcaacagagacttcaccacctaacacatcggggctggtgcagctgaggagggtgcttctgcctcttggtgaccacgccctttcccaggctgggcccacaggaagtctggccggaagggaggaggcactgcaagctgtgggaaccacaccggctccttcactgctgacaaaatctactccacccccaccgagaaactagctcagaaccagctttcctcctcctccgcagcctcatgccctgaatggctgacttgggggatgtttacactcatttttttcatacttaaggggtgtgggtgccagatcaacttgctcaccactcagaccgcacacaagaagccttatgttaaacttgttcaacctccagtaaccaagtcatgcaagtggagaaaactagatagcattgccacacacatatacatacacaggcatatatagacacatatatatccatatatatgtgttttgtgtgtgtgcaattatctttatacatatatttaaaaattttatatatatatatacacaacacatatatatataattttaatgctaataatgcttgccaaatgcttggtttcagttgatgctggtggagtgtacaaccttggtacaacctctctgaaaggcaatttgacaacagatacaaaagccttaaaggttttcatatccacagtaattccacttcaagaatttaaagaaacaaaaatgtatatacaaggttgttccttctaaggttacagctacaagtatagactactttaagccattcaaaataatcttttggaaggtttttaaggggataaaaaagtcaccataataatgaaaagccctacatttatataaaaatgggcatagtctcacataaaaatatgtgtgtgctatgtatctatgcatgtgagtgtttctgtgtacatagagagaaggagcacttcctttctttgaactaccctctgcccttggtttccaatcactgcattctttcctagttttcttcctatccactggctgctcctttgttctcccatattgcatccttctcctcttcccaaccaatcctattagagggctcaacctctgtcctcagacctcctggccatctacatgtcactcctgagccatctcccctacatcctctctatgctgataatccgccagataaaatctccctgcctgtctcttcccctaagctcccgactagaaatcctcactcaggtgtgaaattcttacttggcctcttatatccaaaatggaacttttgatttccattgctgtctcctccccctcacacacaccacacacctgcttccgtctcattgtttcccatctcagtaaatggatcatcatttcacaaagatgggactagaaaccagggcatcatatgcttgatgccttccttcttctctcatacctacatccaacccattagtagcaagtcctgttgtctctatgttcaaaatatgcaccaaatcagcccctctcctcatcagcactgcccactcctctgccaccagcatctctcccccagactctatgagagcctccccgttagtctccctgaattcacactgcccgcctacaatctgttctcataaagcaactaatgatccttttataaaataaattacatcagaaggcatgaaacctataacaaaatgttaaaagttatccaggaatgatgagattatgggctgttcttattttattcgtctgcttctctactatttgtcacatttctaacaataaacacatttcacttttaccagtagaaatcaaaatgttgttttgaaaaaacaaaattacaggtttcaggttgacagggtagggtttagcttccatgaatcagccctgacaaaccaataccaagcaagctacagagcagtaagagttcccaacctccaaaggcagcagcaagaagcaaggaagaatgtcctaaaccaagacgcaaatacatggcacttgtgatgccacttctgcctcgtatacacataactgacatcactaatgactggcaccattgccagctgagcctggatgcagcctcatatccttctcaacacagggcagccactatcattcaattagggttgacacttacatatttaccatctgtaataagcatctatctcaggattgtggagttaaattattatgctcctttataaaagaatataatgcaccaatattttcaagttacttttacatctaaaatctcatataccttcacaaaacctcagaagtaggaagagcaggtatttttttaatttttatttttactttaagatctggggtacatgtcaggatgtgcaggtttgttacataggtaaatgtgtacaatggtggttggctgcacctataacccatcacctaggtattaagcccagcatgcattagccatttttcctaataagagcagtatttttaccccccttttaatagaattgagggccacaacagttaaagtcacacagcagaccctggtctcctcatggccacactcccctgtgcttttctgtggttcccataaacctctgaggctctgaaagaggtcagaacctcacatcccagcagaggtaaatgtaggggccaaggaagcaccaaacctggacagagatgggccacaagtgatgcatagtccgttactattgacaatttgaaaataaatagtgaagacacagatgaagggacattcacaaatttcataacaaaagcatcatcctcttcaggggcaggacctctagaagccaaacatgtttgttggtcaccatagaaccatgaactgcctgccacccctccatttgacctattctgaagtagctttttttaaggctcccaagcctgcaaagaacagattgctcaattggctttagcatcttttcacactttgcgttcccttctctgcggttgtacacaggttcaatgcccaagaaaaatgaagtatccacataccgccatgaagcagaattcaaatttccactgctgtcccatctgcctgaagtaagccgctactccataagccactaagcaattaattgctgtcagagatagtttgacccctgtccttgcaagccaattcatgaaactcctagggcaggaaataagtggagaaaactcatattcccaaggaatgggtgtggtgctctcaaacagaaaagactgtcaggaagattcctttctgtaacaacaggaccacgtggcaacatcagcaattggagaagtttgtcttctcttcagtccctgcttgacttccttcccctcacacatacacctcaccctcccattgattgctccacctgctcccacccccctaaggcattctctgcctcccctcttcagatacccccaaaggttggatccttttattattttctcacctttatgccttttttgtaataaaatactctgtctctttggtggattgcaagtgagagagccatcctttgaccagtgaatttttctgatattacagtaagactaacctgatccaaactctttctacatattttctattttaatgtttatttatttatttattttgagatggagtttcgctgttgttgcccagactggagtgcaatggtgcaatctcggctcacgcaacctctgcctcccaggttcaagtgattctcctccctcagtctcccgagtagctgggttacaggcatgagccaccacgtccggctaattttgtatttttagtagagacggggtttcccatgtcggtcaggctggtctcgaactcccaacctcaggtgatcagcccgcctcggcctccaaagtgctgggattacaggcgtgagccaccacgcccctcccgctctttctacatatcttgatgcaggggtggagtaggggtacaggaaatgtagagtccctggatcgtgctgccagcccacctcctttaactttattccgcccccatctgccttaagaccacagaccccaggatcagagaactttgctccaagtatgtctttaccctgcccccagccactccacccacccctaccttggcaaaggacagcctaagaccttcagatgtgctgggtgacagtgattacaccgtaggcataccactgccgaataaatgatgggctgaagtctgaatcccaggactggaacaccatctggtcctcccacttgttaatgatatgagtggactctaatttcttcttcagaataataatgctaccaggtactgtgtgcccatatgataattaatctagcaccgtcagagaataccataatgccaattatagatgacagagagacaaagggagatgaaagaaacaaagtgtgttttgctgaatgaaagctatactgtatcaataaattgtttatagggtgttccttattgccatgcacccaataataattagatgctctattcaaaatgtgccacactaagtttgttgtaaatttattcagttataacagctggatctatgctgggccatttgctcacaatcaaaacaaaaaaaggacacccttcctccccattccaggaagaagagaaatggtatcgctaacatgcctcatgtacagtctcctgagttgtccagctccccatttgcacttttctatattactctgtgctaccacaaacctctcagctccgtggatcccataaattcccaggtttgctcaagggcccggacgggcaaagggaaataggtccctctgggcaaacaatgatgtggcttaactgcgctgacaatgctgatcaaatggctggcattccccagtgggaagggaaggcaaagaaagggaagcaggagcaagcaggtgggtgagaaggaagttgtttgcacttgaaatggtcggtgacaagatatcccataaaccaccagatgtcattcagatctactgtcatcctaaaaaatggcagctccaggcctgcctgtttcagcagcgaggtttcacatctgggtcagccactaggctggatgtcaaacacaaggaaacatgataactcggggagtgtagtcatatgtttgctgactgataatcatgggtcccaaaacaacaggcttggaaggagtctagtcccccacacccagcagggagtattggtcatagggttaagacaaaaccatgcacaagaactcaccatgtggattccccactcccactccactcccactcacaaatatcttagacatactctgccagggcacggaggcgtatccagtgtcccatcgaagcaaaactatcatgggcctcctactgccctaagagtgaaatccaacccatgaccagggcctgcaaagcctggcaaacctctcctggtgctgctgcccccttgttacctgactcagcccctctgggctcctttccaccccttttccctttctcagagcctctgccatgacgttccctccgcctatacacctctgacaccacctatcctcacaaacagccccagtctgcacacatgtcccagggccttccactccttcagtcacccagctaatgctatggaggctgcagtgcccaggcacagcagtgaacagcaaagccctgccctcgtggagcttacattcagttggaggagactggaaataaacaaataaaccaggaaagagtaaaatattctgtcagtggtgttaagtactgtggagatgaaagcacagcaaggagtgaagggggtaagcaagggtggggaggggggtattacttccttatcaaaagatctttcccgaggttctctctcttagcctcatctatttccttcctaatgcccatcacaatgtgtaactttctattgtatgggtttgttgttgttatttttaatctgttatccccactagtatgtaaagtccatgtacgtaggaactatgctgccttcttttccatgtttcccagcacttatggctggactagtaggtccttgataatttgttggatgaatggaggaaggaaggcaggaaggaattgagggagggagggaaaaaggagatggggagggagggagaggctgagaactacagggagaagcaaagaaatcagagagccaggacaggacaaggtgagtgggaagatggtcttggtggacagccctcagagagcggtattgcaggcgcatgcacgtgtgtgtgtgtgtttgtgtacgcatgtgtgtgtgtgtgcatgttgtgtattgatggaagggtaggaaatgcaagtggaggttgccctaggtccatttaaagatttgaaatagaataaatagcaactgaagagttgtctcactcccctaaaaggaggaaacagctcagagtgattaaatatgctatccaaggttgcacagcctgagggggtgagaaccaggaagtttgccctccacaaactggagctgaaacactgcccttggaagggagtgagaacagggcaagtgttggcctgagtactcagtgctgctgcctttgggatgtccaggttcttcaagaattttagtggttgagaaggaagtgaccttggtgaggttaagtgaaatgggcatttcataattgctggtgccaacagaaattgataacactttgagaaggcagttaggcaccgagcattggaatttcaaatgctgactgactttgaaattttactttaggtattgtaagggaatacttaaaacatgaaaaaactttatgcccaaagatatccagatatttatagcaaaattattcatatttgcaagaagctaaaccacctaaaatgtctaaatatccaacaatagaagattagtaacgagaatatatctacttgatggaatagtatgcagttattaaaaataaagtatatgaagatgggtaaaagtgaaaatacttaacacaatgttaagtaaaaagaattgagattaatattttacatgatatgatctataacattatatttgcataattattatatatatgtaaaatagaaacacagtgtagactgggagcggtggctcagcctgtaattctagcactttgggagactgagcgggtggatcagctgaggtcaggagttccgagacaagcctggccaacatggtgaaaccagtctgtactaaaaatacaaaaattagccaggcgtggtggtacttgcctgtaatcccagtactcgggaggctgaggcaggagaattgcttatccctggaggcagaggttgcagtgatcgggatcacgccactgcactccagcctgggcgacagagtgagactctgtctcaaaaaaaaaaaaagtgattaaagcaaaattaagaggagatgtttctagcacaccataaaaaataccattttgtcaattaaaaacaaattttaataaagaaaatatttttaaaatataaataatggtaatctaaattctctttgaccactctttattgagctgtgtgccatgagccaggcactgggtaagcactgaggttagaaagatgccgtcacaaagaagcactaaaatactgcatgatgagtacatgacaagagaaatgtatgggtttttgaagcacacaagaggacctccaaactcagattggtagagaaaaggggaaggacagtcaggaaaagttttttaggggaaatactatctaatgctgaatcaaagagaaaatgtatgaaaaaacagatgaacacagacaaggaaacagagtaaagagagaaagaatagacccaagaaaggtcgcgaggtttccaagcagagtgaacctgaaaggtgcagcttgtttgaagaattgagggaaattccatttggcacaagcgtaatattatgggggtcggggtggggctaggaagctgaagacataagcagaaccaatcctgtggagcagttggacactaaaggcaacaggaagcctttgaagtgttttcagatctgtgctttagaaagtctcttcctggcaccgtgactggattggatgcaaggctggagagaatggtgcaggtttaagctatttgataatccaggagaaagagaagggtggatttgtgtttgggtaaagggactggggtagtttttcttttgtttttttctttttttttttttttttgagacggagtctcgctcatcgcccaggctggagtgcagtggcgagatctccgctcactgcaagctccgcctcccagttcacgccattctcctgcctcagcctcccgagtagctgggactacaggcgcccgccacccgcccagctaatttttttgtattttttttttttgtagtagagacggggtttcaccgtacagccaggatggtctcgatctcctgacctcatgatccgcccgcctcggcctcccaaagtgtgggattacaggtgtgagccaccacgcccggcggactgtgggtagtttttctaccttcaattttctagcatttccaaactttgtttaatgaccatgtgttattttcataatgggaaaaaaaaacatggtttaaggaagatgagccttatagtgttctgcctgaaagtccctcagagctttgggacttgctaagccagaggcctctgtgtctgtacaagaactcacacccacgtgctacctataatgtcccaggttctgcccacagtctacactgagagggtgtaattttccatagccagggactcaagtaaaagcagaagttggcagatgtaacagcaactgagtgggaagagaaagagagatggcctccaactcatacataaaatccaagcgttcattcattcatttatctatcaccaatattaagcacccactgtgtaggaggcactgttctaggcgctgcagatacagagtaaacaaaatgacaaagtcctagttacacattctaggaaataagatagaccatctatgattaagattcagctaactgtactccctccctcatttgaagaagtagagccgcatgccatctgctatttactgacaagagtggtttaggaaactttgcgaagtaattacaggtttgatgctcatagccatactaaatgtggcacctgtaaacagatacctatgcgtgccatggtgttttgactgggttggctgggttgggtatcactgtttctagaacagggctttcagtatcgattcatatgtacctatgtacacttacaaatgtaactcaaacttcgcctgatctggccagccatgagtacaaatgagcttacgctaaaataacagcacacatttcagtaatgtgttctgccaccacataaatggagacctttgcaatcttttctcccatgcttgtatttgggagcatccaaggcatctcgtgtgttcacaaacacgcttcttatttatgttctagcaacccagctacagaatagccatttggagcagcttctcagcccagcccttcgtaggcattctgttttcttgcccggaagcggtttaagaaatcccccaaactacagctctggggacagaaaaactctcttctgggagaaagtatccctttcccctaacactgtggaaagaccgagctgagccagttcaggtcagtgttaggactctgtaagcactagctctagaagcaactaacaatgtctgggtttacccgagcaatgttgcttgtgaatctttgtctcagggagtttcttgtaaaaatcagcaccttcgcttccgcctgcagacccctctctgctgagcacaaacctagtccacaggctggtctgggagcagcctcatggtgccttctccacattctcagctccaagccccaggcacaaatctccctcgggtcaccagacaggcctgggcatggctaaatctcaattaaaggcaaacaggatgggaaaaatcagttttaaaaagatcaggcaaggtttaggagaatatgagggcagaaaaatcctcccataccactgagaaaggaggaatttacagagaagagagcaggctggaaacagcattagccactcaagacacagtgaatcagaatgcaaatggaccgacccaaataggtacctcctcccatgctgctgggtccactctgtctcacacataaccctctgtcttagaactgctatagggacagaaggcctcagagaaccaggaatggaagacagaagagagattgccaggaaccattctaaattttaattctgtaagttataatccaagttttctttgatagcaagttttcccctgagagacaggttaagggacctttcagatgacaccttctgtccctttctcagcgctagaagtcagttcaggaacctactgttagttccaatgcccttgattgaagttagcaatttacagaatagactcaaatcccccttcaagctggagatcctggagagaatgcccagagacagaatggccatctccaaggccaactcaaatgctgcctgctccatgaagcccatctggagctctcctttcagatccatactccttcatctttttctccttcttattaagctctaggagatgttgttttggctcccttcaccctctggtgtagtgattaacctctcctgtggcagatggcagactcattgcagcatccctgcagccccatgcaaagcctccctcctgtaacagacactcagtagcaattatcgagtcaagtatggtcccagagaattacttatgaagatgactcctgcaaaatggtgagggattttctggcactgtcttttctgaagtccctgctagcacatgttattgtattgtcaggatgttctccaaaagggataatggcctatccagagctgatacccagccagttaaatctctgctgcataaaggcctacacctgttctgattagccagggccttctccttggcactcccacacactcctatggtctaggttctctggactccccactgcctttgcatactctttccttcttcccccattaggcagcccatatgcatcctttgaagcccagcttaacagtggctcctgtgtggaatccctctggcctctcctcccagcggagggaacactctttcctctatttccctagcaccctgcacactcccatacagcccttcttctatgctgagattgtttttgtcccagccccccatcttatgtgagcttacgtttgactcgtcttggcagatccagcaaaaccattgcctggcagaagcaggaactcaacaaatgtttcttgaatgaatgaatgaatgaatggcatgactcttgcaaatgttttctaaaaaagatggcaaggaaatcccctgagacactcaaattaacattcctattagtttgttatatacagattcatgtcttgctttttaaatttaaaataataagggctaggattgaggccttgctaggtgctgagtgttttacaagcattgtctgttagaatccaaacaaccacctgaggcagagataatttttactttattttacagttgaataacagaaactgagaaaggttaagaaatgtgttcagatgcatatagttggtaagtgggatgtgtttggcttgaaagcctgtgctctcgactgtctcactttccatctaacacacattaagtcaggacattttcctatgtcattaagctatttttaatgcctttattatataaaggagagcttctacacatgactgactgtagtgccttattattcaaagtgcggtgcgctcaccagcacgcttaccacttgggagcttgttagaaatgcaggatctcaggttccgtcccagatgtcttacttaatctgagtctgcattttagcaagatccttagtgacatgtaagtacattgaatctgagaagcactggtttctgtcaggaatcagcagaccacagcacacaggccactctagtgcccccgggcccccactccgtttctgtattgccctgaagctaagaatggtttttaccattcaatggttgataatttttcagaaaaggaatactattttgcaacatgtggaaattatagaaattcacatttcaatgtccataaatgaagttttattgaaacaagttcatttattcactactgtctatggtttcttttgtgctacaacagcagacttgagtagttataatggactgttggcccacaaagatatttactatctggttatttatgggaaaagttggccgacccctttcaactctatccctcatctgtcacccacagctctatggttcagaatgcaagtggaaaaaaggcaaccgtcatgtcggaagactaagagggaaagagcatcccagtgagacccagatttcactgaggcctgaaggctgagggaatctaccatggggtaaaagtccagagcgtagaggaaagggggtgaacatgaggtgtggtaaggcaggggttaggaggcaaaacaatgaaaacatgaagtagaggagagtgtggatgactttggaggcggctcctcaaaggtaagcgtggaagtctgccaaggccaaggatgaaagatcagtgcaggttttagcctcaatttttgcccacaaagctcaattttcttaaggctgctgcaagctgaagggttgggtggtatccacgtagttgaaatgacagacttttcctaatgtctccaagctgtgagggcgacaagtattctcatccctaagagaaatgctaaacttgatgtgtacaatgatgaaattaactagctctctatcctgaaatggagctgtagctgcctgcataaggagcttgttacatatgccaactcccaatcccaccctgaacagtctgattcagtgggaatttgtattttaacaagcatgctacataattccgatccttgagaaagactgcctctgtgaatgagacaactcaagcctctggaaggagttagctgcagctgagaaggtgatgcttctaaaagcaatcgtttatatgggtgaaggttttctgttttctgagctgtgtaagacttcagtaagaggcagtggcattagagaggaatttataggctctatcgctaatgagctgggggcaagcagaatgctgcaggcatctgagaaacctgcagaaaggcatagctaacagaggtgtccgaggagcttaggactgacactaagggtcctaatccaaagaagccatcaagtaagatgtggagcacacgatggccaaagaacagaaatacctgcctctcccaatgatgtgaagatctcaagtgatacttaacatattggggtgctcagagttcagggtcacctaggcaggtggcagatctcatatgtacttgcagttgtctcagttttgttacatttcaccctactcccaccattcccacagtctgtatgactgcatatatataatttccctcaggtgtagatgggggcttggtaccaagtaaattatgacatgggaccccaaggaatctctgacacggagagacacacaatgacaacttatttttcacaggttacaaaaataaaaatatcaggtgcatgaatacaaggcattgtctcatgaattaataatttagtttcctaaaaaagatggatagcgaaagaaggacaggatgggaaattagtgcttgttttaatctgctttggagctgccaagaaaaccagttgtcttctccgtttttctgtgcttcctggaaatcatgctggaagcaaccgatttgaggcgcagcatgaaacatctgtcctgttttggcttctcattgagatgttcattagcttttgcatacagcaccttgctgccttgagacaaaattttaaaaacaaaaaagcattccaggctttttaagctattgtgcagggttgctattaggaactcactgcacttagactctcagcccacccaggaatataggtctgacccttaaggatagtaaataagggagtgaaatccagaaaggctgacactccctgtgcagttatttttcaacccagaggctgcttctgcatatgtatcgcttatgtaacttttctttgcaaggactcctctggtgccccaatctagcctccaccccatccctccccatatcatcagcacaatgacatttttgctgctccacccagctgcgaattgccaacagtttaaggatgtggacattgagtaaacaaagacacaaaattgaagttggctttgtgcaactagcttttaggagttgcagttctgttctttcaggtttaaagtttcagtgagtagaataagactgcccaaacaatattgcaaagctgcttaggaatttccatcactaaaatagtattatgttactttgggataaaagatttttaatttatagtgtagctcccatgtaagatatgtatattaacctagaacaaccttgctagtttccatacgccagacttaaaaataatttatgattaaaacctttttaagaattccaacaatactgagtgaccatcaattctttagaaatgggaactaattaatggaaattttcttcaaagaatctgacctattaaacatgatataaatattcatctattttaaaagctgcaaatgtcaatgaaaaaaataaagctgtcaaatgtaggagcatttcattaagaaagcagcttcaaacattgatgagagttttataaagttaggactctcaagctttacctcctagtgaagaagttactaatattgtctttattataatcaaatgccaaaagagcaggaaaacagcagtatggggccctgaattgaagtccctctttttccagtttctactagcccagcccttttgtaaataaaacctttatacaactaaagcagcactgattcaatgggaagttatgatatcagtgctacagtgaaatggattgctacaaacagaataaagaggaatagattggataatcaacacatatagcaactcaaaaggatcgttttagtgattcttttaatcttctctactactaagtatttcacataaggatgcttttggctgcaagtaacgaatatccaactaacagtggcattaaaaaaaggggttctggttttctattgctataataataacaaaccaaaatttagtggcttaaaataacatttattttgttcctagtctgcaattgggaagggcttggtgggtggcagcttgtctgctccacttggcaccagctagggcacttgagactggggccagagtcatctgaaggctgcttcactctcatgtttgacagttcttgctggaagactcagagagctagaggctggtacagctggggctcctcaggcatctcgatttctggtgttctcccacatgagttcttcagcatggcagcttcaatgtagactgacttctaacattcagctcaaagctcccaaggcacatgtcagagagaagaaaaaggcagaaaccgcatcactgtgaacctagcatggagagtcatgcagtgtcacatctactgaattctactagttagaacaagtgggtaaggctggcctatattcaagggagggtgaattagactttgctgggaggaggtcaaagaatttgtggccttgtattaaacctaccacaaagggatttatttttcatgtatatgtctaaagggaagcagtactgtataatatggggctccatgatctaataaaaaccaaggttcatctgttcatctataattctgctctaccatttttagattggcatattgtctcaaattgcaagctgactgctatagatccagacattgtagccatgttcaagaccaagaggggtgaaagaatagtgcctgcagttctggcctcttttattaggaaatcaaaagccgttcccaaacccacctcagcagaattctgcttatgccacattggccagaactgttacaaggccacccctgcttcaagggaggttagagcagtgaatattcagcttctcctttctctactgtagaggtagcgaggatgaagagagccagaaatgggcattgggtcagtcaagccatgcttctgacctcaaagcctccatatcagacccaaaaattcacaagtaagtaagtaagagcttcaaagaactctctccctcagccaaggttaactataaaatgacccaaatatgcttaacagaccaaaaaaaaattggctaatgaatggaactatttacaactgtatttttgcaaatagaatcaaaagcagatattgaattaaatgaattgtttctacagtttaaacaggaagcagaatgggtttccccagagccatttgccggcaagataggagggacaaggaagaggagagaccactgacttgtgtaaaatgtgaaagctgccctgcagattaccttggcttcagaggcctggggcctaaaaatatttgggggcagggcaaagaggaactcttcacttgtaaacctaacccaaattctatatctattttatagaacattccttcttttaaccttgttactcactagtgaatggaaacaggaaaacattgtgagttgatggattttatctaacccatctgcaacgattattcaaatgtaagcttaaagttttataacatttagctaaagaagaatcaaaactcttttcattgccccgtgtagcacaaacactctcctcgccctgccaatttgccagtctactgtctcatgctatggtctctacaaggataaaaaaaatcacaccacagcagatatttttatagacccttcattcatacagccttggcatatgaccgcaacaatagctaaaactgaaaaatgagacaactggatttactactgatagtgtctagaactctctcccaggtaatttaatagatgtacgtgaaaatgtgtgtttaaggaggacgctgaatgtgaagaaagaatgcaaccacagtgagagctccagtacaacccaggctacaacttccaatgtctggttcatcctcagagaaaaaggaatgaggaaaggaatattttcctttaaattgaaagaactctgacataaggaaattaaataattgatccaaaggatgttgctcctattaaacagaaaaaaaagcaccaaggcctttgcaagcactcccattacagtttaatttagaatagaaagtaatgcaggtctttattctaaacaatggccaactttactaacacgaaatagactcttcttaaacaaaactcataaaacatatactatgggagttacaaccattttctgaattatttataagctaatgctctgctttcaatgtttctatcagctgcaaatttaattaagaagcaaagaatgggcttatagagatcatgaccctacgtatttcttatcatatttcaaattataatcatgtcatgatgaagtttgatcctcgtggagtgtaacaaataatatatttgaactttttattattaccagtttagagacctactataagatacttcagaactcccaaaccacatagcaaaattcgtaagtgcagtaattaccataaatgtactctgtactctcaaaagcaactgccaacagttctaggcccaggataagtgttcaattcatactcataaatttcattgaatattcaacatctttcacaaactcatatataatctttgtgtatgaaatatttttgagattgaatattccccacactcatttccaactagaaattcccattgggtttgaatgaaaagatttattagatctactcaattaggtgacaagattaatagtccccattaaccctaatttgctttttattccgcaaagactaacacagatgtaaaacaggtgttggccaccccagaacatatgcctaagacaacaagcaagctgagagtaatttggtacacgaactggtgtcccttccatgccacctctccattgacagttatgctggaaatgagatttaacagcaaaatttctctttcctacaccatgcccaacttcctcagtgctagtagctttggatgtgagagaagaccacacacacacacacacacacacacacacacacagacacacacagacacacacaacacactgagtttagatcaacaagcatatactgagtgcccattaccaggtgtcatgctgaattataggcacaggtggagcctcaggagtcaagctctctgaattcacaccccagtttactctcagtagctggatagcctcaggcaagttcctcagcctttctaagccgtagctgcttacctgcaaaacaaggatactaataacacctacttcatgggagtttgtgactatcaaatagataattcgtatacagttgcctggcatctagtatgtgcaataaactgagctataatcacaccatcatcatcgcagcatagcctcagtctttatccccaggtaaactagggtgaaaagaacataaacagattatgcccattttttgtgagatggtaagtggacttcagaaaagaggcattagctcaacgtggaatgcaaggaaggtctctgagctgagagtcaaaaggtgagtagagtagctggataaagagagttattttggtcggatgtggtggctcatgcctataatctcagcatttgggaggccaaggtgggcggatcacttgaggtcaggagtttgagaccagcctggccacatggtaaaaccccatctcactaaaaatacaaaaattagccgggagtgatggcgcacactgtaatcccagctactcgggaggctgaggcaggagaattgtttgaacctgggaggcggggttgtggtgagccgagatcgcgccgttgcactccagcctgggcgacagagtcagactcgtctcaaaaaaaaaaaaaaaaaaaaggagcatgttgtgtacaggaactggatgtggtttctattacaagcaagaaattcaagacggggagggatagaagatgaggctcatgaggaagaaaggactaggtcacaagaggtctcataggtcatgttgaggtgactgaatttcctccttaagaccaaatttcctaagacagtttatagaaatttctagtgttcacagaggcatttcatgaaaattccttggtattcctcaacataatagcttcactgtgacttctttttgaagcatccaaatttcacccctttagtaattcacagtgcatgcgttagcatgttgaaggctctgagaattttacaataaaggaacctctttgcctcaatttagctcaatattttttaaatagattgtcttcaggacaccatttttacagaatgctgaaagatattttgccagattttaacaagagtatgaattgggcagtttagcttcataaaattgctctagctacagagatggagtttaaagggcacgcttggagagaagatgtgaaatgatggtgagccgggacagagaagacagagcagatcaaaaaaatattcaggaggtaaaatctgtaggttttgctggtaacagtggagtgaggggacacaactgtctagaataatacttggagttctggcttgagtgaaaacaatagtaatgcacttacttcaaaagtaatacagaaaaacatgatgttcggaaaggaatgagggatgggtaggtaaaaaacttagtatgagacatccatgagtcttccaagtgaaataataggtagcaatcgtcactaaaccattcttcagtcctaatctaaaccaggtcatctgacaagtaattccttctcttccttaggagtcaaaatttttaggttaagattccataatgcattgtgttcattttgcagcaaatttactaataataaggttattatttaatcattaaaacactcaggcttttctaatgcattcgcaaattaaaatatgcaaatgtacatatgtagacaggtgaatattgcattctcaagataaattacttaaattctcacttaaaaagtgaatctgcagtagagctactaccttatccaaatgtcacaaatatacctaaataggttaatttttaatatatattgtagtgaacatttaacaaaactaatttttatcttttttttctatctcagcttcttaaaagcaaaagaacatcttcatctttgtgccctgagggttcaaagcagtttaaaacacatggaaagtatacttaaaatcttgttgaattaataaaattaattaaagcaagtcacagtaataaatacaaaatgacaagttttcaactctactctgtcactaattgatctcatccgccctcttcgctttactatgatctacatgctaatgatttccaaactgttatcagctctgctctccttttgaactgtatcatctctgctcttcctttcaactttgaaagttgaactttcaacttgaggcttataattcaaccttacttgacttttccatgtgaatgcttaccagagaccttaaacttcatgtgtcctggtagcattactggttgcctaccttcacagtatcctttcacctcttacttcctataaaatgcctccaattttgttcagtgagccactgtgaccagctaaaaagctcagcctccctgcagctggaattggacacatgatataattttggtacataaagtggaggtctggggtataatttctgaaaaagcttttgctttcctgacataggcactacccctacttctttcagctttcccttctcctgtcttacatgcagaccctatgcctaaagctcagtccctctcttacatagtgagagtgaaggacatgataaggatgctcaaggagaagagagaatgtgcctgcgatctcgtggcatttgtgagctaccataccagctgggtctgcctatttttgacacacttttgtgtgacaataaattaattgattaatcaaagagcttgtttgcttaagatatggtttgtcaggatttggttcctctgcagctgaacacaaccacatatgacataacatacaaaacaaacatttgattttcatcttcaaagagcacctgatgaccacctccccaaccatctcacagacctattctttcccagtcataaacatgtcagtttctaccatcaccattcatttggtagcttaagaaatataaatttgggtatgtccctgatgcctcctctctgtctttacctctaaactatatctcaaacccatcttctctcttcttccaccacctagccatccaacctatcatcatagcctctagctgcccactctgctgcagtcttgaccccctgcaatcatcctccacatagcattcagacaatcattcaaaaacacctattaggtcacgtcactctcaattttaaaaacttccgattgttcctattttactcataataaaatccaagtgcctagctgcaatgggctgaatgtgtcccccaaaattatatgtcaaaactccattgtgatggcatgtgaaattggggactctgggaggaaataggtcatgagggtatcatgagagtctagccttcatgatgggattaatgcctttatagaagagacataagagtgcttgcttcctctctctttctctctccaccatgtgaaggtatggaaaaagaagtcatctgtcttcaaatcacgaagaaagtcctcatcaggaaccaaatcactgccaccttgctcttggacttcccaggctctagaactatgagaaataaattttttgctgatgaagtggctcatgcctgtaatcccaaatttttcagaggccaaggcagtaggatcactgggtccaggagttcaagacaagcctgggcaacaaagtgagactctgtctctccaaaagcaaaaacttagccaggcatggtagcatgagcctgtggttccagccttacaagaggctgagcaggaggattgcttgagccaaaaagaagaggctgcaatgagctgtgttcacagtgctgactctagcctgagtgacagagtgagactgtctcaaaaaataataatagaaattttttaaataaatgtttgttatttattttaaaataacctggtctatgttatttttgttatagcagccaaaaagactaacacactaactatggcttacaaagttatatgtggtctgatctcatcttcaccgttttctcttttgctcactgcactcaagccatactactttcatttcattcctcaagccaccaaatgtagtctcacctcagggcctctgtacttgctgttcactctgcttcagttcttttccacctggttcctcctcatcattcaggtttcagctccaatgtcacctccttagaagaccttctctgaccaccccatttcacctgtgtttcatgatctcaataccctatgttgttccttcatatgctcatctgtctaaaattatcttgcttatttacttgttactttttttctctccttctagattaaaagcttcatgagtacagggactgtgtatatcttattcaccactcattcccatatctagaaaaatattagtacaaattaggcccttgataaatattgttcttaaaaatagattaatttttctaaaaaaataaataaataaaaaataaaaaaaaaacacacagcttggatgcttggaaatctgccaacatgtatgatcctagaaacataattttcttgtctaaatctccaagagcagaacagaattttggatttaaataaaagctttttctagcatatttaatcagaaatcaccaaatgtacttaatcctattgcttatcttctatcacaggtaagtattttgcttaccacatatattctttaaccaagttatggtaacataataagggattagacccttatacaagttgccaagtaacctcattgaatttcaacatttcagtacatgtctttgtaatatctgtgtgacaaactatcaagtacacagaaagcacttctgctgaatactgaagtagcatgttgtctctaccataaaatattcctggagttgcaagttgaactaaccactcttctaatgaacaccatttcacttgaaagaccaacatattcagatgtaggtatttgctaaacattttctgaaaatgtacaaagtgaggctgtcaccccaaaggaaatatatggcaatatttattgccaataaacctttaagaaactacctctagttgaggtttaggatagtagatacaattatccaaaaggttattaaaatagtcctctgttttccagctacatcactctgtgatgccaggttttttaatattcttcaatgaaaacaacgtatcacactataccgaatgcaaaagccaatgtaaaatctagccatcttctactgtcagacattaaaaggcaaaaaatgtaaaaacatgaaatatgctatgctactcactaagtttctcttgtttggaaaaataaatacattatttataaaaaatgttatttacgttacatgcaatgggtttattattgttattttaaaatgaatgaataaaaattatttttaaaatgtttatagcatgtttggttgggcgcgatggctcatgcctgtaatccagcactttgggaggccaaggtgggcagatcatgaggtcaggagtttgagaccagcctaccaacatggtgaaaccctgtcttttctaaaaatataaaaattagccaggtgtggtgacggcacctgtaatcccacctactcaggagactgaggcaggagaatcacttgaacccagaagcgggggttgcagtgagccgagattgtgccactgcactccagcctgggtaacagagcaaactctgtctcaaaaaaaaaaaaaagaaagaaaaatgtttatagcatagttaatatccacgatataacccaaataaacaaaagatttttgagatcctcaattattaagagcataaaggatcttgagaccaaaacctagtacaatagatagttataacagaagtatgtaatagaaataaaatgtatgatagaattatataacagaaatgcaaatcctacatttctaacagcatagatgaatatttaatatcttcattccaccacaaaagagagagagagttccattgtgcaattaaataaaaatttaagcaacagcatccaggttgtggtgttgccatcacagcaactagtggcttcaggagttaaaaagctgtcagggaacagtggcaggtgggctggtggtacagcaaagagcacagtgacttgactggaaatacgaaaagatgtagtgggataaaatgctcaaacacattagggcttatgttggtacagagatttgaacaaccaggaaagaactctaacacaagataactttttaagttcacttatgttttccccttctgtttttcttctttgacatctgtgctgctttgcctgggggaaagttcaaggttggaatgtttgatttttgttttaaaaaacctgagggcagaaagagaatttaaatagttctgggggaagaataccccctgtctaaaatgaaagtctcttggcttagaggaggagtcagagtttaaggtaccctgtattttgccttactccctggcaggccccaaggacacagcaagacctcagagagacaggccattggtgcaccaagaggcggaaattagcccaggtttcccaaccacaacagttctcatactccagaggctagcacaaaggcagagaggggagcctcttaaagaccacacagggagagacagtgacatcccagcagtaaccttgtggtcatatgtctgatgccctcctgggtctctgagatctcggctctgcttgagagccggaattttgacacagccccagatgggaagtacaagaatgactgaagttgaatttctcacagacctatggaacaggggcagaaaataataattacttactgagccaaaagtagagaagataaataccattcagcaataaaaaggaaggaagtacttaagtcatgccacaacatggatgaccttaaaaacattatgtggccgggcgtggtggctcatgcctgtaatctcagcactttggaggccaaggctggcggatcacgaggtcaggagatggagaccatcctggcgaacacggtaaaccccatctctactaaaaatacaaaaaattagctggggtggtggcgggtgcctgtagcccagctactcgggaggctgaggcaggagaatggcgtgaacctgggaggcagaggttgcgtgagccgagatcacgccactgcactccagcctgggcgacagagcgagactccgtcttaaaaaaaaaaaattatgctaaatgaaagaagtcagtcacgaaaaaccacatagtgtatgttccatttataggaaacatccagaataggcaaatctatagacagaaaatagattagtggtgcctagggctaggggaaaagagggtgacaactaaagaatagaggatttgcagggacagggaaaacattccaaaattgataatcgtgttgatcgcacaactctgtgaatataccaaaaaaaaatgaattttataaatagttaaattgtatcaataaagctactacccccaaaaagtaggaaatgtgatgtctcttgtccacctgaggtgtactgagattcataaccattttatgtgtaaatgtttcacaaagttatttgataaggttgtgtcaagctgaggtggtaacttctaaaccacacatatatcagctcaggacctagcaaacaggtccgaaacacaagcaatggggaaggtgcaggagggagcagacacaagctccagggaatgtgggtagcaagtggtctgcaccaagaaccacataaaactccagagcactgttttggagaagcaatattcagagatgcgggaaggagccagcatcaaggaggttctcagcagactgcaaggctccacctcaggagaggagttcagggcaggagccctgcccaagtgcacgattgcaatgaggcctgcagcctcagagaccgggaagtgatccaagaaggacccgaggcaaccatgcagggacctaaaaagcattaatgatatagcatgcattttgtcactcatgtatacatatatacgtaaggtaagttctataaaaataaaataataaatatttgccatacgctgttatatgtatttatattttttaatgtatcttcacacaaccctctgaaatagctactcttactcctctccattttacagatgagaaattcgagtacagaaaggcaaagtagcttgcccaagtcattagtaacacagagctaaggttaaaacacggcagcatggtcccagggtccatcttaactctaccatgctgcattcagagtaaaggctccttactacatctgagccatcaggactgggaggaaccatggttgatgctgaatccccctcgcataaacaagaggtctttaaagcttcccctgtgtaggaaggacagatcctggagcctggctggggctgagcatgcaggtggtacttaaatgatggccacgtagaagcagaatatggaccaggcaactactgccacacatcttacatattttcatttttaccacagcgctataaggtgtatcttagtctgttcaggttatgataacaaaataccaaggctaggtgacttatgaatacagaaacttattactgacagtgctgcaggctgggagtccgagatcaaggtgctggcagagcagtgtctgataaaggcccacttcctcatagacagctatcttctcactctaacttcactgacagaaagattaaagggtatctctcaggccttttctttacaaaggcactattcccatcatgagagctccacattcatgacctaatcatctcctaaaggcctcacccccaatacggtaccttggaagtgaagatttcaacatgtgaatctggggaggacataaatattcagaccatgcaggtaggtattgtcttcttcttttcagatgagaaaactgaggtttgaagaggttacaaatttggccaaagagccagtaagcaatagagccaagaccagatcccagaccatctgattcaggatggcagctatgaacaggcatttgtaaattggcaggcaatgaagaaaagcaagtaattgggaagtagggtagcagcatggttaaaaacatgtgcttggtggccaaagtccagcttgtcaattactctatgatctgaaaagagctacttactctttctgagtcttagcaccttctctgtaaaacagattagtaacaataataataaagtctaactcctggggttgccatgggattcaatgaaacactgtgtgtataaatatctgacagagtacccagcatatagtaggtgctaataagtggtagcatgttaaggaggcattcctcttattgtactgctgaacacagacaagtcagtggcaacacagatctttctcctgagctgttttacctcttgactaagagaacatcagctgaaaggaacattagaatttctttaatctaattctcttttttaacagatgagaaaatgagggttagagcagttacataagttgcccaaagctttatagtagttactggcgaggaaaccagatcttttatctgtaacttaaaaattaaaaagctattggaatgagatagaaaaatgttaagaagtaaaattgggcagggtgcagtggctcatgcctgtaatctcaacactttgggggccgagatgggtggatcacttgagcctaggaggtcaagaccagcctgggcaacatggtaaaccctgtcactacaaaaaatataaaaaattagtcaggcatggtggcatgcacctgtatcccagctagctgagaggctgaggtgggaggatcaactgggcccaggaggtcaaggctgtataagccaagattatgccactgcactccagcctgggtgacagagtgagaccctgtctaaaaaaaaaaaaaaaaaaaaaaagaactataaaagaagttaaattaagacaatcctaggtgctcttccatcagggatgtaacttagtgggaaaggcagtcatgccacactgaaaagagcgggggacttctgacactccggcctctctcacaccattccctgtgcacaagtgaagcaaccttcccaggaagcaggaagctgtgctttcagatactcatttcatatcatcccacccttacctgtggtattgtctgcactcaacaaaggaaactcgaccttgggtgatacacaagagaattaacaaaaggatgaaaaccagtatcttggaaagcatatggtaggcattagattagtgtagtaaaaggagccgagaattaaaaaaaaaaaaggaaaagtccttttatatcatttgggtggttgccttcgcttgctaaaagactagctgaaaattgaatgaaattaacaagcaggtgtagatggggatgcagaatgttagagaaggtgtatcgaactaaagaggtaataaagagtttgagaatgaggtttgaggaaaacgaatatgtgcgtttgcacatttgcacacacatatattatctgacagtgcctgtctttacttttgcagtaaatttaagagctgccctcaaaggcaaataaatggtgtccattgtgctatttacaagggtcaggagaggttcttgggcatgataggaatgtggtaggaatatgacagggtaaagcagttaaggactaaggagtagggattccaaacgaaattgctaggtccacctgctacgtattaattatgcaagaattactgtttgttcagtgcattgctgcatctcttaagagaaaaaagtatatttgggaaatgtctgacaaatctattcctaaaagaaagaaaatgttacactttgttagtctaacaataatgttagaccacatatatcttaaaagaaatttggccccatttgctataaacatactgagtgattatcaggcaaagaattactccagactttaaagctttttcattagctagaactagagttccagtcttgtctgtcgttatttttaagcaccccaagggtgctaacttgtgcattgttttgcacagatttgcacttgagttaaagaagtactaggttcaaatatgtaaagaaaaaaaggcagttaacattgcaactatctactaacaccatcatctgggatgtcataaactaaaaaagatcaatctcaaagatacagatcttcatagagattttcccaaagggaataatgaaggatgcccatgtgttcatatcgactcccactccagatgttaccattcattccctgcgtgccagggccacaaggtctcattataagctgatgatggtaggggttctgatcagcagataactttcttttcttatggagccttctttgggaaatctagttccttccttcccttctttcctttctttcttgagacagggtgcactctgtgcagtggagcaatcatggctcactgcagcctcaaaccccacctcagccgccgagtagctgggactataggcacacaccaccacacctggctaattttcatatttttataggacagggctttaccatgttacccaggctggtctcgaactcctcacctcaagtgatccgctgttctcagcctcccaaagttctgggattacaggcgtgagccaccacgccaggccccacgttaaatttacatgcaccgttgtcatgtttttcattagtgtctgttatattttacattgtttggccacaatggataacataaatacatataagagtaactggaatacaatttctacaccctttgttagccacgttggtctacctctaagaaagacattgtcatggtctcttgcttctaagtaaactagggaggaaatcattagcggctctcactaaaggaaggattgaaaatagagttccattaatgggattagatcctcccactcccttccgggaccaaaatgcctaaacagaaacctccactggcatccaggtcctaaagtttgcaaggtatgagaaaggactaagggggttaaatacaagtctctaagccttggaagggggccataaaaaagaaaagaggattgaggagaaaggaacaacctttcccaaatcctatgaggcctttcttctgtgtagtacacaatggaaacttaagtttaaatttttaccacctctattcctcccacaccgcatcgttctctttgaaactatccgttcctagggcaaaaatctcaggccagaaaaaaaaacaatccacagatactgctaatggtgcaacccttactctaaagaaaaagaaagcccaggtgccccagagccttcccagagacctgactagaataatgcctctgtctttccaggtagacaagctaagtaaattaagcattcagtgaccaagaaaatattgaattcctcctgaatctgcatgaattttgtctatttccgtatcctcaggaagctaatatgctgattctgaaatttccaaaatgtgagaggttcctagagccattatggaagggagatttgtttgcctattgctactctttggggttgtagaatatcttgtctggttttcttaaaaacttcagggaataaaaagactaaaggtagccaggcgtggtgtacacacctgtaacttagtgggagaccaggcaagagaatcacttgaaccagctactaggaggccaaggcaggagaatcacttgaactcggaggcggaggttgcagtgagccaagatttgccactgcactccagcctgagtgacagagtgagtgagactgcatctcaaacaacaacacaaaaagactaaaggaaaatatagaaatgcctccaggacaaactatcattcaccaaatgtcatttgggttacacaaatggaacatccttacaatatcttaagtcaaacagtggctttatagatgtgagatgaagtgcccggggcaagatattggttctccaattttgatgtgcctgaaatcacccgtgagacttgctaaaaatgaggattataggttgccacctccagagatcctgagcggagcccccaaataaatatttctaataaacaccacaggggagcttgttgcaatgcagtgttcagtaaaccaatttttgaaaagacatcaatttctcataaaacctcagttctcagccgggcacggtggctcacgcctgtaatcccagcactttgggaggccgaggcgggcggatacgaggtcaggagatccagaccatcctggctaacacggtgaaaccccgtctctactaaaatacaaaaaaattagccgggcggggtggcaggcgcctgtagtcccagctactcgggaggtgaggcaggaaaatggcgtgaacccgggaggcggagcttgcagtgagccaggatcacgcactgcactccagcctgggcgacagagcgagactgtctcaaaaaaaaaaaaaaaaaaaaactcagttctcaccttctccacttgctcccctttcatgctcccactccactgaaacagcatcatcaaagccaccaatgacctccatgttcccaaatctatagttaattatcaatcctcacttgtttgacttattggcagtgtttgacaaagttgatcactctctccctcatgaagcacttctccacggggcttccaaggcactaatctctcttggttctccctctctttctagtgactgtcagttttctttgttgactttattttcctaatttccacaccttgaagtgcccctggattcaatccacagggttttccacttctcagtctacacgcacttctgccgtagcttcatctttccattgattttaaatatcctattagtattgggaattcccaaattaatatttatagtcggtccactctctcaagctccagactaaaatagccaattgccaactcaacatctttagttgatgtctaataagcatacattaacatgcacaaaatcccttatttatatttcctctctcaaatctgctcctccatcagtattttccagcttaatcaagggcaattctatttttccagttctaagtccaaaaaccttggagtcctcattaactcctcactttctttacaccccacatctaaccatcagcaaatcctgtcagctctactagaaaatatatgcaaaatccaacaacctctccacacttcccctactatctatggtctaagccataatcatcattcaagtgtattactacatagcctcctaacttctttcattgtttctgctaattcccactcccccaaactattcacaagcaaccacagtgattttcttaaaacacaagtcaagtcgcgtcatttcctctgctgaaaacttccaaagccttcccatctcattgaaagtaaaatccaaattccacactataacccactaaaactttatctcatctagtctagggctacctccttgacctcattttgtactagccctcctcagcctttgcactaactgaaaggcagaggaaataaccagtgcaaaggctgaggaaaaccagtacgagatgaggtcagagaggtagcacctgctctctcacttcctttagaattctttcaaatgtcctctccttggagaactcttttttttttttttttttttgagatggagtctactctgttgcccaggctggagtgcagtggcgtgatcctggctcactgcaacctccgcctccaggttcaagcaattctccgcctcagcttcccaagtagctgggattacaggtgcccgcaccataccctgctaatttttgtatttttagtagagacagggtttcaccatcttggccagctggtcttgaactcctgacctcatgatccacccaccttggcctcccaaagtgctgggatacaggcgtgagccaccgtgcccggccagagaagtcttactgactatggtagtacagcttcaagacgccccccagtgactcccaccttcttgtactcacaccctgtgtaattcccacctttgagtatgcactagctttagtgacttgcttttttttattattattattatactttaagtttagggtacatgtgcacaacttgcaggtttgttacatatgtatacatgtgccatgttgtgtgctgcacccattaactcgtcatttagcattaggtatatctcctaatgctctccctcccactccccccaccccacaacaggccccggtgtgtgatgttccccttcctgtgtccatggttctcattgttcaattcccacctatgagtaagaacatgcggcgtttggttttttgtcctgcgatagtttgctgagaatgatggtttccggtttcatccatgtccctacaaaggacataactcatcattttttatggctgcatagtattccatggtgtatatgtgccacattttcttatccagtctatcgttgttggacatttaacaaacagaatcaagcagccatgatggggtgtacttctgagattcagttacaaaaaagactgtgccttccatcttggacacacactttcatctctcacttgcttgctcactctgagggaggccaactgccatattgtgaactgccataaaagaggcccacatgacaagggctgagggaggcctccagccagtagccaacaaggaactgattctctcagtccaacaagctgcaatgaactgaatcttgccaactgttccagctggcacatgaatgcatcctcttgagagaccttgaagtggagacaccagctaagccatacttaggttctgacccacagaaactgtgagataataaatgtttgttgttttaagccactaagttttgggtaatttgctgctcagcaatggataactaatacactgactatcctatataaattcacaaatcctacctctgccattctagtatttcttcccacttactccattacttgctttatagcataatctccaaagccttgaatattatgtttgtctgtttgtttgtttgtttgtttgtttgttagttcaatctccacccactaaaacaaaagctcatggaggcagggatatgtgtagcttgttcactgctctatatccgagcatgtaaagcatgcctggcacatagtaggctcttcaaaatatttgttgaatgaatcaacaaatctgagtacaggaaagaactttgtaaaatggtgaaacacaacttagctcacaaggttgtggtgagtgttaaatgagcaaaatacttcatgtgtccgtccttagtaggtgcttaacaaaatatgctttttatcctcaaaagaaattgtcatcaagagcattggtatggacatatacaattgtagaattttttcagactgggatgtttatttgcaaatacttggcaaaggagaggagcatagcacctttaaattaagaggcaaaacttcatttcgcagctattttaatcgtgagcctcacccagcccatctccatttcactcaggatccttcacaacactccacttatgtatgagccacacctttagttttctatattattttataactcagctcccttcaactttaagaactttgaatttatcacagaggttctttcaaacctttatgggtctgaattcgatgctcactttgagagtcagagaaaaattaaaaaatagttccttctgtcctcttactgaatggcctcttaaaactccgctgtcttcataaccattgccagacaataagtaatccagagagcaataggcaattattaccatttcaaaaccattgtgcagttgcctctgaaagaaatcactggatgtatgatcttcagtttttatggacttatgccattctttggcagaagcagtgtaagcagataatttctacagaacaataatgtttaaaactttaatactggccagcaataggagcaattttcctaacaggattgaactaaggataaatgggatgtctgacaactactctgctgcagcgatgtttcttgaacccttgggaactctattttcttcatcgttttttacaaatctagcacggttcctgttacatgagaggtgctcagtcaatgtttgtggattaatggatgaataggcaagtgaaagagttattataagcccctggatgaatgtctccttgtctataagctagtccacctggatacagcatcgtgggtggtcatgttttccctgcctgaatcgttgatggcctcatttgccttggtggctaaacagacttaactttaaaatccgggcctgcacttcctaaatgtgtgatattggcacaggcacttaaccactctcaggcttagtttcctccctataaaactagtatgataatatttactttatacagttagtaataagattaaattagcgctaacatgtaaaacaccagtagcaaacacacctaggtaatcaatacataattgttcataaacctagccctatcagctgtcactatgaacaaaaatatcccacttggcctgttctctccagctagtttgttcacaagccccaggtgatccttagtatgcagaaatttaggtcctagaaagtatttccattattatgttagccaactcttgttatttaaaatttattttctatttacaagtcctctcaaatacaatatttctttgagcctcacaacaaccctaaacggctggtagacaagagtcaaggccctattttacagatgaggaatctaaagcaaaaagaattaaattacaaaaatcacacagatagtgatggtaaaatgaagtttcagactcatgtccagaaccttttcttacattatacagcctctaaccaagtgcatggaggagaagccattaacctggcccaggccgtctctcaatcaccttcccacctgaagaagcactaactagtaacacaagatgctgggtggcagccccttctggaatctcaaacctgcgtctttcaaagttggccaggtgcggtggcgacgcctgtaatcccagcactttgggaggccagggcgggcagatcacttgaggtcaggagtcgagaccagcctgggcaacatgtgaaatcccatctctactaaaaatacaaacattagcaggcgtggtggcgggtgcctgtaatcccatctattggggaggctgaagagcaagaatcgttgaacccaggaggcgggggttgcagtgagccaagatcacaccactgcactccagcctggtgatagagcgagactcagtctcaaaaacaaacaaacaaacaaacaaaaagttgatggccagtaatcatctaggattgtggaaaggagcttccggaagggtggagccaagtcttatataattctcctgggaactgagtgtgaggtggtggtgctccccctgggcgattcctgacaatattgctatgggggacaggaatcttgaaactgagaagagatttctctgtgcacatcacaacctgtttcactggtcctgcaaatacacagccttgagaaacctaaacagggaatcttcttaaccccgtaccactttgctgcacagctaactagatggaggaaggaagagtaaattaacatcagtacccacctcctctgtgccaaaccctgtgctcggccctttatatgttatctcactcatttaatccttaaacaataaatacattcctgtagtggatatgtgatatttccctaccaacattccaatttttacccacacctcctccacatggcccgcatgttctagaaaagctggctacccctgctgctagggataggataagtggctagggcttaagctgatcggtataagcccttccctggtcacagttcagggaagagatatcaccaaattcaaaccaataagaagttttcgggggtgtaggaaagtagctcacttgtgcaaacttttcctctctctctctccttctagaggagctgacatgaagcctggaattgccatagcccttttgccaccatcaagaaatgaaccatgtgaacctgagagacccagcctttcagatgaatcctgagtggctaactggtcctaaattaaaatggagccaagatgctatttgctgactaaaggtcacacaagtcctctgagttcgtgaaaacccatacctttttaacttggggactttcagctctgacctgaaccaacagagctacctgccccgccaatcagggctcagctgtatcaaccaatcagaactcagcagtgttgacaatcagaaccatgcaagtttgaatcctttatttgcataaacagacctgactgggatcccgacaagaaattttgctataaaatctgaacgctctctttgttcactgaaatgcacgcagaggctatgatctcctcagtttgcaaactgtttacaaggatgaagtcttttctccaaattcttctcagagaacttttgttcataagggcaaccagcgccagagtgaagttgacttcatgaagagcaaagggacaggagaaatcaatttttgatgatatcactgaataccaaatcaaaaacctaaaattttccgtccttttaaaatttcctcttatatgggagccaagtaaaaccacttttaatttacctagtctgagttgagtattctattactcgcaacataaaaagacttaactcattgattagggtaaagctattctgccataagaaggaaactcaacaatgatggaatggttaaaaatctaagttcatttctctctcatctaacagtgggcaggtgttccaggtggacaggagctctgcttcatatctgcatttagagaaccaggttcctcccagatcattactctgaaaccctatgatcttgctcttgtctccacagtcaaggttgggttgctctgagttccaccttgaggaaggggaaagaacatggaggagtcttatgtcccagagctgaatatgacacacacttgctcacattccactggcagggaattagttccttgatcatgtctaacagcaagggagactgaaaatatgttagcagccatgtgcccacatatctgttaccacaaaagaaaacaagaatgattggggttaactgccagccccgcagtcttagccacattaaccattatagaacccatttacataggagagaagttaagctaagaaaacttgccttacataaccagtaagtgacagagcaggatttgaacctcaacttcaatactcacttccacatgctccataaggtagacttctatgctcctccatgtatgtatttatccttcttcccaattccagctcttgaaatgacctcatcaccattagcaacatatatgccataagttactatctactctggcagttgcctggtaccctcaaggatagccagcttctggcttaactcccaaccacaactttattttctgctctctagggaggaggtgttgaagaaaggattgagatgattatcccagtctggcacacagaaagaggttatgtagtaatatccagctaaaaaggcagttacttgacaactgcaggggaaatcaggtgcaaactgaggacagaagcagagagaaaatgtgtggcacctggaggaacagagaaaatgtaagatgaagatggaaagctactaacaatcaataataaaagaggctgaaatggaaaattaggacatagaacagactgggtgaatttaggtcatttccgatgtaatgtgtccagcatttccttaaacaatttttatttactaatttgaattagcagtacatttccaaaatgaacaaaggttaaaaggaaacactctctcccctaccctatgccccaggcacccatttcctctcaccaagtacaaaatattatcaatttcttggatatcctcctggacatattttatgcataagaagcaatacaggcatgtcttgtgtaagtattttttctcccctcttttattgaccaattttctaaccttaatttttttcacttaaaatatcttggagatctttcaaggtgtatatataaagatgtatcctcctttattaaagagtactcttttttatggctatatcatatttcattatatgatatgcataacttatttaaataatcacttattgagatatctagactgttttcaatcttccctattacaaacaaggctgcaatatgcaatcttgtgaacatctcattctctatgtatgtgctaaacctataggataaattcctagcactggctttaataagtcaaagcatatagatgttataagaatatttccaaataacccttcataagatagtaccaatttattttcccaccagtctatatgagagcacctgtctcttcacattcttgccaacacagtgtgttgttaattttttgcattgccaatctaatacatgaaaaatggatgtctgtatatgtttaaacaacattcgtgtccattttctatggacttttttgcacattttttattgggctattggtctttttcttatggtttttaggagttctttacttacaaagaaaattagctagcttttgtctattaaatgagttcaaatagtttccgtttttataattgtctagtgactttttatgatgggttttgcattgcaaaaagcattccttttattcactctctgaagcatctcactaaattgggagatgctcataaataagccaaactttcctagattgcaggaggcagcatgaactggggaaaacttcacttttagggtttcctctcctgtttgatcccacccttaattactccctggtaatgatattgtcacgaactcagcccactgaataaattaatatcactaaccatgacttccagcagtaacagagtcaaaggaagccaagtttcctgccctttggcttcccagctaagtcagagaggaaaataatttctgaaaatccccagagaatgttgttgacacatcagctttcatttttcctgcacctactcctccataaaattcaattataaaagtccttcctaggtagtcattcaatgaatggcactggctgaagaagaatagacctgtgggtgggttactaaatggatgggaagagaaaataaagaaaggagtaaatgaataacaggagaaatcacactgcaagtaaggggcatttcacaacagaatgaaattgcttctgccacaagcaggcaaacaaatttcttcacacaaggaaggagggacatatttcagaaggccaaacataagtcttggcagtgaatttcaggaccccagggattgtacaataggagggaggagtgatgcccctttttgaaggtctaggaagataggtagacagcattctctaaaatcaccaagaaaattctctaaggcagctttggagaagatgctggtttctttgcatttttcagcctgatccatggcatccccaaccttcagcctcagctgaaagcatcccaaccttcagcctcagctgctcagcatctgagcgaattctgactctgccttagtggacatgaaagccctttcccatcctatggcaagtgagtagtctagacctctggaattatactcctcctctctctgcatttccccttctctcatgcatccctttccctccatcccacagtactgtatctgcagcacccggcagggcagcccttcccaaccctgggcttctgcctgacttcctgatctcactcagccgcctgctcttgctggagccttgccctgaacttcagcctccttggcaaggccctgacagcccagctggcccacagccaccatcctgttcctctcagcaagcagccaggtcctgtttcaacacggatagtcctccccaccccgcttcctctgctgtccccctcttccgaccaactgaacatttccattatccagcgttcagcttttcccctgctgcattcccctcctccactaggtgggaacccatggatatctacactggctacatcaagcccagattccccaccatacacaccagtttgaccagccttaaaccaatatgtacctttatttaacttatgtaatagaagtccagagataggaagattccagggttggttaatttcatggctctcaagtgtcataaggacctagagtctttcacctttctgctccgccatccccaccacaatgcctactctttcacaagttgagttctgcagctctcagtgaccatggtgggctgaagttggttcccagaggtcctgagagccaattgctaaatatttaggagttttgccagtcagttgtagagcttgaaatggccataatgggagaatttacaccacagaaatggaaacagacaaatgctacaaatcaggcttttcattttttggcgagggtgttagcagcggattaatgctgcatcacatcttcatagataacatttagaaacaaaaagggtctatttctcaaatatatcttttttttttaagagcgagaaactttttctgaaaacctcatagaaaatccaccacccccactctcaccctcccaattccttggcctgattatgtcacatgcccacgttttaaccaaagattgacaaatgaacagatgacaacaatttccctaaagtatgggcacctgatacctgaaaatcagggttttcttagtggaaatagggtaggaggtagtgtttgtgtgaggaatccacaggatttgtctcatgcactacacacattctgccacatgattgagagcttctctctctgccctggcccaccgtggaggttcagcaggtttacagggcaaaaaggattaaatgttagccaggaagagaattatgttaatctgttttttagtttgtctgtttgtttttagagatggagtctcacagtgttttgcaggcggacttgaactactggattcaaacagtcctcctgtctcagcctcctgagtagctgggacaaaggcacgtgccaccatgcccagccacattaattttttttttttttttttttttgagaggagtctcaccctgtcgccaggctggagtgcagtggcacgatctcggctcactgcaacccctcctctcaggttcaagcgattattctgcctcagcttcatgagtagctgggactaccgcacacaccaccatgctcggctaatttttgtatttttagtagaaaccaggtttcaccatgtggccaggatggtctcaatctcttgacctcgtgatccgcccaccttggcctcccaaagtctggcattacaggcgtgagccacggcgcccagcctgcctcattaatttttatgtgttgaatactatttcaagtaagttaaataaatacaagactagatctcattaagcagtttactcaaattaatttttctctattcaggcttaatctaatcctgattttctctctggctggagtagctgtaaagttggaatgcacctgaatcttttttgggagccagtttcttcaacggcttgtcgaaattgcaaaactttcaagggtattgtgaggtatcagactctatgccatctgtcttcatggctccaaggaagggaccccaaaactgctctttgataattccaagaaagtgtccaaatgcacttctctgcatcccattcacctttttgagccttttcccttcctttaatgaaaaaagaatagaaaccttctgaccacacatgcctatgtttgtgcacaatgagactggctcacatcattttaaaacggccgggcacagtggctcacacttgtaatcccaacgctttgggaggccaggctggaggatacttgagcccaggagtctgagaccagcctgaataacatagcgagacccatctctacaaaaaataaattagcgtgagccgagatcgcgccactgcactccagcctggggacagagcgagactccgtctcaaaaaaaaaaaaaaataaaaaaaaataaattagcacactgtaatcccagcactttgggaggacaaggtgggtggatcacttgaggttagaagtttgaaccagcctggccaacatggtgaaaccccatttctactaaaaatacaaaaattagccagggtggtggcaagcacctgtaatcccagctactcaggaggctgaggcaggagaatcgcttgactcaggaggcagagcttgcagtgagccaagatagccccactgcactccagcctgggcacagaatgagactccatctaaaaaaaaaaaaaaaatttagccaggcatagtgtcacacactgtagtcccagctattcggggggctaaggcaagaggctcgcttgagccgaggagttccagctgcagtgagctatgactgcaccactgcactccagcctgggtgacagagtgagacccttctctaataattataataataataaaacttttacatgagcccctgtagggtataaaaagattacaaagcccagtccttcccttccaagagctgacaatctgttggaacaggaacatacaaaagcaaatgaacagtataagtaaaaaaaaaactgtagccgtttgggaaaagaataaacgttcctgggtaggttagcaatttcattttttttttttaattaatgttttccactatttattctattgtaaaaatgttcaaacagaaaagttgaaaggatggtacaatgaacaccatgccccatcagttagatttaatacctgttcatattctgccatattacctatctaaatatttgctacccattttaaaggaagttgcagtcattgtataaggataaggtagtcagccttattcttcactatgcacctttttaaaaaggacatttgcctaaaatccataatacctttatcattattttttaatatcatcaaaaatctagtcaatattaaaattttcctagttgttccaaaataaatatggtataggatatagtataatatgattttgcaaaccagatttatacattgcattgatagttatatctctttagcttactttagtctggaagagttctactttttttttttatacattgacctttgaaagaaccagactagtaaatggtcccaaattctggatttgtttgtttctcaaggtgttaacttgtttttctagacttgatgtcctgttcaaataaaggacaggttgattcagatagaatcaatcattgtcctgaccggaagcagatggcatactcaaagggtctactgaaggatgtgaaatgaagggactatttacagatgtgtgggcaggcatagggaacaacgatggtgaggcactgtgggactgctggccctaggtctacaacagcctgagctgagtgcgttactgaagcattgcaggagctggagctttgggagaggggtccccaccaggagccatgatgtagcagcaacacaggcaccaccaaaactgcacctgggcagggagtggggtggtgggaacaaataccacaacatctctctcctctaccttcaaaacggctgttggaacccctgcgtggccaaatctaactagaagccaaaaagcaaaggagcctgggcaatggagtctgcaggggggagtctccaggggtgcagggcaggatggtgaaaggtgctgaatggatttctaagggcaatggagaatgatgagcacgcaactttgacatttttggctagaatgctttataggtcatgtgtgaacttcagattgcatcacatcaggggaaacgaaatgttaggttgtctcacccattaccaagctcaatttgacccctccgttaaagcaatgctagccacatctccctactgagattaaaggtgtgttttcactttgcaatcagcaagtgatccagcaggagacacttggcaccaggggattcacggttttgctccaataatttttcacgtaattgtttcagcatccatggatgttcttccctgaatcggtcatttcactgggagttgcaaaatgttgatttttctgagttttcttcccatatttggatatggaatgaaaatcatgtgaaattttatacattaaaaatagttaggctgggtgccggtggctcatgcctgtaatcacagcactttgggaggccaacgcgggcgatcacgaggtcaagagatagagaccatcctggccaacattgtgaaaccccgtctctacaaaaatgcaaaaattagctgggtgtggtggtgtgcacctgtaatcccagctactcaggagctgaggcaggagaatctcttgaacccgggaggcagaggttgcagtgagccgagatcgcccactgcactccagcctgggcgacagtgcgagactctgtctccaaaaaaaaaaaaaaaaaaaaaaaagtttaatataaaccatttcataaggttcaaatgattcaaatgaaaatatttttacctagcactgtttgggaaggaaatctttcctcaaatggagaaaacctacagttcttctaaaaagagggagttaatgttcacttcttctcctttatatatcagttgtcaaagtgaggccaaatgaacgttaaactgctgcttttcttctcctccttttcctcttcctcttcttctcctcctcctcctcctttttcttctttctttctctctctctcttcgctttttcttcttaagcccaaatcgtcccaaatttagtcagtgagagctccttcaagctaaccccttgataggccctgttagtcttggaggactttccttctggaactctggtacgtctaggcttacctggttaagttatatttccctgccccagacctccaaagaaccttggctaattttagtagaaaatgtatttagaggctgggcatggcggatcacacctattatcccagcattttcgtgggccaaacgagagggtctcctgagcccaggagtttgagaccagcaacatggtgaaaccccgtgtctcaaaaaccacaaaagtattagctgggcatgttggcacatgcctgtagtcccagctactcgggggctgaggcgggaggatcacctgagcccaggaagtcaaggctgcagtgaccaagccctgcactccagcctgagcgatggagtgagacgctgtctcaaaaaaaaaaaaagaacaagagaaaagaaaatgctatttagagaccagtaagtattctctttgctggtgagccgttattcttctagactcttacagtggacagagcctacgcatgcacacacacacacacacacacacgcctttaaatcaggagttcacattaacacttccaattcaaatttaatgttatcagatagcaggaatttatgttaaggagcaaggatttaagttggccgtgagaggtaggtacaatatcttttaaaaaataattattttctataatacaatcctacttacaaagaaaaacacaactaataagaaaagagaataaatgtatcaacaatctcacccttttaacacatccactcaatctcttatataagtccttggtggttaggattttaatatatagagagctgaagagaggagcttcaaacagggaagtacaggtcccaatgtagataaaggacctgaaatggaaagtttatatataacattactcatctttaggcctctctttaggccatactttctttggtgcataacctttcactgtctctgactgtcaaaatcatattcatcctcaagagctttccccgacccccaggaccccagcatagtgtagccttgccctacctgcagtgcgtttctgtggatctgataaccgctttcacttgatattgttaaaggtatgtgtggatctgctgtatctccctagctagttcccactagttacagtcaggaactgtatctggttgtctttgtattctaaaagctcttagctcagaactcgtatataagaagcttcctttttttttttttttttttttttttgagatggagtctgctctgtcgcccaggctggagtgcagtggcgcggtctctgctcactgcaagctccgcctctgggttcatgccattctcctgcctcagcctcccgagtagctgggaccacaggcgcccgcaccacgcccagataattttttgtatctttagtagagacggggtttcaccgtgttagccggatggtctcgatctcctgacctcgtaatccacctgcctcggcctcccaaagtgctggattacaggtgtgagccaccgcgcccagcctgttttttttttgttgtttttttgttttgtttgttttgttttaaggcagagtctcactctatcacccaggctggagtgaagtggctcaatttggctaactgcaacctccgcctcccgggttcaagtgattctcctgcctcagcctcctggtagctgggattacaggcatgcgccaccacgcctggctaatttttgtatttttttaagtgagatggggtttcaccatgttggtcaggctggtctcgaactactgacctcgtgatccgccacctcagcctcccaaattgctgggattacaggcgtgagccactgtgcccagccaagaactttcaataaacatttgctacaagaaattcaactgcagagggtccaaaaatgagtctaaagcttcacactatattgtgcagacccccataactgttcttcttgattaaaagaaactttccattgcctgtccatctttcaccctagttacttacttttgaaacctcaggcttatgttattctaattattatagttgcctagtaatacttctattttaaggctgcttctaattttcaataacaattttaaatacctttaaatagattatactatttttttaatgtcattaggttgagggtataaacaacattctaacgctttacaagggaggtgactgaattgccttctttataggtataaagaaaaagacaacctggtgatattttttaaactcaccatgatagaggcagatggtacattattgtaagagacctggaggtttctttcagctctcagattttaattgagctataaaatgtacacagtcccacctttttatgactaaactaaattggtttggatcaaaacttcatattggcaaatataatagtaatttcaataatacttacaatacagaaatctgtaggcctcattttcttatctataagatgagaaagttgaattaattgatctctatagtcatgaagcacgtagttatgaaacaccacataaatcttctgggagtctattattgctaagatgcatgcttctatgatattgattagaataatttttggctcctaaatcttcctaatagctgatagatttctaaagaacaaatttagctttattggatacctttagattcttaacacaagtactacagtgaggaaaaggaaaaaggaaaaatagacatattgaaagaatattagacataggtttgaatccaactctgctacttacaaactatataatgtttggcaatttacttacccttggtgtaatgactgaatgtttgtgtccctaaaaattcatatgccaatatctaatctccaatgtgacagatttgacaatggggtaggctgggcatggtggctcacgcctgtaatcccagcactttgagggccaaggtggccatatcatgaggtcaggagatcaagaccatcctggctaacacggtgaaccccatctctactaaaaatacaaaaaattagccaggcgtggtggcatgtgcctgtagtccagctacttgggaggctgaggcaggagaatcacttgaaccggggaggcggaggttgcatgagccgagattgcagcactgcactccagcctgggcaacacagcgagactctgtctcaaaaaaaaaaaagacaatggggtctttgggaggtgattagatcataaggttggagtccttggattagtgcccttataaaagagaccccagagagcaccctttccccttccaccatgtgagccacagagagaagatgactgtctatgaaccaagaagtgagccctcaccagacaccaactagctggggccttgatcttggacttcccagcctccagaactgtgaaaaataaatttccatgatcttaagccaccttgtctacggtatttggttatagcagcctgaatggactaagacactggtatttccatctaaaattaaatgataattcctattttgtggtattgttacaaagttaattagataacctagaagatagcccctggcataccacctggcatattgtagggaatgaataatgtttattgagatgccccttactatatagatttggtggaaagtggtgtttggatatccaggtcagattgtccattgtaattaagggttttttcgtcagcatcagaaattacaatggtagcttaaacagaaggaaatttactaggaggatatgggagagttcacatgaaagggaagctagagaaccaggccagcagatgacaaacagtaaggccatgtcagggtctgtgtagcgaaatattcccatagtctagacagagtgttgctttgtctagtgttactagaatatgtgagcttagctattttccgtctctgtcacactgattgagattcagttcccttttagattagcttggttttacagtttccacctggctaagggtagtcagggcaaaacagtcccaccagaattcaccaatgagagagaagcaattcctcaaaagaagaatattaatgtcattgccaaaagatatgactagatacaggactgccaacattaaaaaatataaatttccactaatccccaacactttgtattgtgggaatctacaaagtgtttaggactgaaaagtactatatggaagagcttcagaactccccaaaacacccagttcctgcatatgcaaaagttaccaactgtggattgaacaccttcccccctagtttggaaggttattccaaaaacaaacagttgtaccctagttatgcgctgtgtaccccctctctctcctttatcaaatcctgtgacacaagcttctatctcctcgcatccattcatcatcaaaccctgtgcctcgctggagccttaaattcaagtctttgcctgatgaaatttctgggtaccaacgcagttagtctcctgaatcttggtacctaacattttcctttgatattgcactttatttaattgaggtggtatctatgtcacctacctcattatgcttagtgtgtgtgtgtgtgtgtgtgtgtgtgtgtgtttcagagtaaaatgaaacctgcaagcgaacattttcataccactatttactactaagtataatacagtctaatatcatgtatcctgagcttattataagacagagtttaaaaaaacaaaaaaaacaaaaaaaaaaacctcatcaaaccagtgaggaactgacaagtacccagggatctggtttctagttcagatttgccatgataatctaggatgccatggactctttacttatctctctggacttgcatttcctctctataaattagaggcttgaatcatagctggtctctaaatctctccctgcttttacattctatgatcctacagccagaccctctataagagctaaaaagaaaagctaaagcaaggcgagggaacgatgagaccacggttctaggtgaggtgccatagtcaagaaaggcctttctggggaggggcagtagaactgaagctgaaggaaatgagggagccgacatgtgagtatctggggtacgagactctaggtacagcctttcttaatgatggtaggtaatgctcttctcagcatgacaagaatttcatcctctaccatagttcccatccctgtcaagtaggaacaacgcatagagagagatatgccaacccaagacaggccccgcacaagctggatggggcacaacagggactgggtggtcccatgactgagctgaagtctagaagtcatggtgtagagggtggggacagtcaaatccagtgagcagatccaaacaagtcattggcttaaagggattattgaagaatggcatgcgagattgaatgggtcggggaaagagaaaagctgaagtcctaagttgtaaaccagaaattgtccagaaagctgtatttcgaaccaagagtaatgacctgtaggagagttattacatcaatttatgggtcatgacccgtttatttttttaattatattagaagagaatgaacttaccagtgtaatcacataaagggcaagtgattgttctgtgaaacatttttttctgttgtaaacatgtattgttgagtcattttgtagaactgacttctcattgtgagtgatagttttaaaaaaaattaaagccagtggcctagaaaaaattccaggtatggactgcagaggccagtggcagtttttctttaaagatttagtggatgggctgggtgcagtggctcatcccttgggaggccaaggcagcagattgctccagcccagaagtttgagaccagcctgggcaacatggcgaaaccacatcttacaaaaaaatgcaaaaatttgccgggcggctgtggtggcgcatgcctgtagtcccagcactttcgggctgaggtgggaggatctcttgaccccgggaggaggctgcagtgagccgagttcacaccactgcattccagcctgtctcgaaaaaaaaaaaaaaaaaagaaaggaagagaagagagaagaaaaaaagaaagaaagaaagagagaaaggaagaaagaaagaaagaaaaagaagaaagaaagaaagaaagaaagaagaaaaagaaagaaagaaagaaagaaagaaagaaaaaagaaagaaagaaagaaagaaagaaagggaaagaaaggaaggaaaagaaattaatccttacatatggagcttttttaaaatgttaagtatactagaaaagaaagagcagaatccagaataaaagacttctgctcccccaccctctgtaacaagggaccagaggaccccacctaccctcaccctttgtcaccactatcaccatcaccaccacccacaaaaagaacagcctgatcccgacatgctgggtaaagaattgcttgtaaactgaaagagagaaaactcaaatgcccaccaaatatgagaataacaagtaaatgaacctgaccaagtgtaagaaaaatgggaacggtgggactctggtggaggaaatacttaagccctgccctgcccaagaggggcagcagctactcagtctcagcagctgttgtgcaagaatgtggaccaagtgttgtcagatcttggtattttttcagagatactggaaatccaggtttttataatgaaaaacattttaaaacactgggtaagccaatgaaacatgtctgaaggcctaaacacactcacactacaccaagtgtgaatagctgcttgtgtaggtggtgatacttggggtcatttatattttcatttttacatttcactgcatgttcagaattttaacagtgaacatcattttacttttataatgagagaagaatgaaggttgtaaatatttaaaactctattaactaaacaggtagacatttgagttttctctttttagtttcaagcaattctttacccatcatttcagacaccaggctgttctttctgtgggtggtggtgtgatggtggtgacaaagggtgataggcaggtggggtgccctggccccttgttgttttatctgcattaagatcaggataaaacaacaaatgttacagaaattttctctgggtgaatgttacatgtgactaaatttttatgttatgttttacaacaaaagtttgcagtacatcacaaatatttcagcctaactacagcaatatgccaagtctcaggtttgctgattcgaggtttgtggcaccatctttggctattgtttgcccatcaggacttatgaaagcaattgcttgttccatatattattctcatttctacttaagtatttagcccagcttctataatatgcaagtcttctgattctggctagatattggaaacaaagaacaggcaattcttcccctggagtaattnnnnnnnnnnnnnnnnnnngcgaatttgtattttttgtatttttagtagagagggagtttcacccgttgctcaggctggtcttgaactcctgaccttgtgatccacccgcctcagcctcccaagtgctgggattacaggcgtgagccaccacacctggccagcattttttttaaatgaaagaaatggaacagacctgaacacaatagtgccagcagtgaagataaatattgtttattgaaatttgtgtgttgttttatatagaggtacgtataagtggcagttgtggaggttaaaatttttgaaagctactttactcgaccaaagttgaagccttggctttattttctgcattgagctcctctgtaaaacagagaaagaaaatgtctgtgtgtgtgtatgtacattcatgtgcatatactatgtgcatgtatacatgtaattatcctaaaagaatttcagaaaaagcagccaggtgcgtggcttgcacctgtaatcctagcactttgggaggccgaggctgatgggttgcttgaggcaggagttcaagaccagcctggccaacacagcaagaccccatttctaaaaaaaaaaaaaaatttttttaattagctgggcatggtggcatgcatccatagtcccagctactggagaggtgagacaggagggttgcttgtgcccaggagtttgaaggtgtggtgagctttgatcacgcatcacattccagcctaggcaacagagtgagaccctgcctctaaaaatcataataataatgataaaaataaaacaagaacttgagaaaaaggaactttttaagaggagagaagaaatccccattccccaaatagatggcctagatctgaagatgtttattccaagggtaaacttttcatactaatagtgtttactgagatcttattgcatgccaggcactgagctaaacactccacattaatcctcccaacaaccctatgaggcgaaaataaacaccaacaaaacaaagaaaccccacaaacattacagatttaaaatctacaggtaacagataaccctccctccctgactccccctctgtctcccccagccccactctacgcaccccctcccatcctttctctctctccctgttcatatttctggaaaagaaaagaagaatggtcaaaaagaagggaaaagggaaaagaaaaccacggaaataaaacagatgggacaagaggagaggaggaaggagggaggtgatcaaaaggaaaggaggagcatattgagcatagttggtgccgtaccatatactgccaataaattctcttttgagtacaaaaccttgcatgggactgttgaagaaggctcagtctttagggtggagtgagaaagacagagcggtgtggtgtgccaaaacaaactcctactttctcattctgctcaagtcagccttgacacactttcctccaatgtggcaggaacaccagctacagaaaaactgctccgtgaaaaccactatttaggtactgatattagcatcttgtgcagggtagcctagagtttgcattttctcctctcaggagccctctatatccatttgatttctgcgatgtacgccagcggctttggctcagtgttaatgactttgttctctttgaattcctgtgagattttattcccttggtgcccaggcgttgtgtgccacagtgatttctgcccagtaagacttctgctgtgataaaaagaaactgcagggaaggcctgctgcttgtcctctgccggttgctgctacccgacaaattactcatactcccattcagagaatgcgagagagtgattctgtttccatggcctcagcctgagactttactctctaataaactgagaacactaagccatgtgctaagcgcacatcgcactacctggaaaaggcaccttctggctagagccaagtggactaatcatgtctggatagcaaaaatgttgtgctcagcaacctagctctctctctttcccaattatgagacagaccacagagctggtaaaccacgttacttgtagacaccagcattgttgtttatgctatcatttcattatgttttgaactagggttctgttggcttgcttgcttcccccgccccatctccctcccctattgaaggaagaagccaaggtaggaaaatatctgcttgaattgttcatgaaatgtaaatttctactttaccatggaaaaccagattttagacactattactcatgctggctcagaactcaatttttaacctttctgaccccacagaaatcacagaagtatcccctttgcttctattcttctacctggggcccagatttgatctgtgtcaatgccactctgaatgcaggacctctattgccttgggccaagcaaaggtacaggaaaaaacttcaggctgatcactctcagcaaataacacaggaacagaaaaccaaacacggcatgttcttgctcataagtgggagttgaacatgagaacacctggacacagcgaggggaacatcacacaccagggcctgtcaggaggtggtggcaagggaagtgaaggcattaggacaaatacctaatgcatgaggggcttaaaacctagtgatgggttaataggtgcagcaaaccaccatggcacatatatacctatgtaacaaacctcacactctgcacatgtatcccagaacttaaagtaaaaaataaataaataaataaattgtcagaaacaaataacattccttaaaattaaaaaaatttaaaaaaaaacttttttaaacttaggctgggacaccaaaacccgattcctgatccagcctttaaaagcaccccaggccggaatggtggctcacacctgtaatcccagcactttgggaggctgaggtgggtggattacttgagccaggagttctagaccagcgtggtcaacatagcaaaaccctctctctactaaaaatacaaaattagccaggcatggtagcgcacacctgtagtcccagctacttgggaggctgaggcggagaattgcttgaacccaggaagtggaggttgcagtgagtcgagatcgtgccactgcatccagccgaggtgactgagcaaggactctgtctcaaaaaaaaaaaaagaaagcatcccaagagtctcaaggtttatataggagccgcagaaaaacagttctcaagtcaaaatgaattcaagctgctttaattaaatgccttttagcactgtgttgaaacagatgaagattttgttacaaatcaaaaaacaagtgattctctagtcttgtttttgttaccagcttcccactgacctattttaaattgcgtgaaaaatgtggccttccccgctccccctccttcctgtcccctctcccctgacctctgtacctcttctcccttctggttctgtcttccataggctctttcttctcccccacttatctcaggtagggtctcaaagctggtcttcatgttcccttcccccttctcccgatgataagaaccctaaccttgtgtcttccctgtgtatctctagaagggagatacccaatctctagacatgactttcatggatgttccaatcacttgaatccaaagggaccgcttatcccctttgctgggacaacctccatgtatgcctgttgttgtaccttattattaatagtgcaccgggcacggtggctcatgcctgtaatcccagtactttgggaggccgaggcaggtggatacctgaagtcaggagttcgagaccagcctgaccaacatggtgaaaccccatctctactaaaatacaaaaaatagccaggtgtgattgcgcacacctgtgatcccatctacttgagaggtgaggcaagaaaatcgcttgaacctgggaggtggaagttgcagtgagccgagattgtgcactgcactccagcctgggtgacaaagcaagaccttgtctcaaaaaaaaaaaaaaaaaaatagtgcgcactttcactctcacaggggtcttggacaatatattatttagtcattctcctaaaagcaggattttcttcctgaatatttacttgatccaacatttcctccctcagctactctttttctgaagctctggccttcttcccagcatttgcatttctgtcagtgcttctgacgtcttccatcttccagaacctggaagccccggcatcctgttgacgcctccctccccatctatcttagccatgcagaatggcgacaccaaggtcaaaggaactggacataactcctgactcatcacttaccagctctgtgcccctgttcacctctggtctctgcctcagtgctgtcattgtaaaacaatgagaacaatacattccttgaacagcgtcactggaagcataaataaggcacttctgaagggccactgggcattgtgcctaacaaaacaaatctgacttcttatttatgttttattcaacacatttattgagcacctactgtatgccaggcactgttctagttcctgggatacatccataagcaagacagtcaaacacatctgtcctcatagaactcacatcccagtgagaaatctgacaataaacaaataaagagctcctaggtcaagtagtgataagggctacaagagaaaaccagacagggtaaggggaacagggagtgcccaggtggagaagggctgctacttaaaacggtggctaagggtcactaataagatgacattcaagcagacacttaaaggagaaagaggtaaaggaattatctaggcagatatttatttatttatttatttatttatttgagaagagtctcgctctgacacccaggctggagtgcagtggcacggtctctgcccattgaaactctgcctcctgggttcaaacaattttcgtgcctcagcctcccgagtagctggagctacagcatgcaccaccacacctgattaatttttgtatccttaatagagacagggtttcgccattttgccaggctggtctcgaattcctggcctcaagtgatccacccacttgggcctcccaagtgctgcgattacaggcgtgagccgccacacttagcctaggcagatatttaagaagaacggcttgggaggccgaggcgggcggatcatgaggtcaggagatcgagaccatcctggctacacggtgaaaccccgtctctactaaaaatacaaaaaattagctgggcgtggtggcaggtcctgtagtcccagctactcgggaggctgaggcaggagaatggcgtgaacccaggaggcgagcttgcagtgagccgagatcacaccactgcactccagcctggagacagcgagactccgataaaaaaagaagaagaagaacaggcataggcaagttccctgaggaaggcctgatgtgtggaggaagtcagggatggcagcctcgtggagtggggtggatgcctagtagggaatgaagcagtggaagcgggattcccacacaggcctcgtagatccgagcgaggcgttcagcttgtctcggagtgcaataggaaagctgccagactgcaaagcggtacctgtgaagagattagaccccgggcaaggccagaggcagaagggttaggggaacattgcagtaatccacacaagaagtacagtcgcctggaccagggtggcagcagtagaggaggtgagaagtggacaccttcccttgaagtctctccagtttcccactgcatttccctctcacagccacagtcctgtccctggcctcatcaccttacccctgaattattgcactagcacccccactccctcactggtgctcacggactgcccgctgcccctgctctcctgttctcaccttcatcacatcattcccctgctcagaaatatgactgtgccttgcccatcgtccccaagtccaaattcctctccctggctctcaagccttccactgagttctacacactcaatgttcttctgaccataaaccagttcctaccagagtccagcaccaattcagatagtaactggcttacctaatgaccaagagatctgctattcatacccaattcaaaattaactggatagttcttttaattgggtcatagaaccagagttccttacaaaaacaattaacggttaacattgattaaatgcttactaagttccagacactaattaagaactttaccaacagcatcccctccaattgtacaacatccctatgaagtgggtactttattatccccaactttacagatgaggaaactaaggcacagaaaagtaaattgcccaactcacaaaggcagttgcgggggcgggggggggaaggaggagctgagatttgaatccagaagtctacctccatcgtcaacacccttaaccatggcactccattgcctcccgtacttggaccggtgtatcaggtttcttcatgtgaatcattaaattctaagttgtgtttacagcaaaacctcattactgccccccaagcttttgctaagcattttgtcttcttcctgtctctaccatcctaccatgtcttctacctatctctaccatgccaaatcccacccagctctcaaggtgtaatcaacttcctgattttccacaaaacttctctaaatacatgagacctcactgaacctccatcttccagctatttgaaatccacttcaaatcactatgtttgatttttttttccatgtgtttcccaactatactggatactgcttatgtagagcaaccataaattatgtttctttttattctctacagtatgtaaaacaatcctgagccattccgttcaacagacattttaaaataaacctacagtgagctagatcctgtgtggctcccgaaaacacagtgaagacagtactcaaaatacttgtgtgccagatgtggtggctcacattcgtaaatccagcactttgggaggctgagcgggagaatcccttgaggtcaagagttcaagatcagcctgggcaacatagagagacaccccgccatctctacaaaaaaaattttgaaaaattagctgggtatagtggcacaagcctgtgtcccagctactggagaggctgaagtgggaggatcacttgagcccagaaggttgaggcacagtgagctatgatcacgtcactgcattccagcctgagctatgatcatgccactgcattcagcctgtatgacagaacaagaccctatctctaaaaaaaagaaaagaaaagaaaagaaaaatacttgtagaccaaatgagaagatccagggaaatgcctgttgaaacataattatctatttaattaacctttttcatataaatgccatcagtgacacttcagatacaaacatatgatttcatgtcattttaatataaattcattgagcatctactttgtgcttgttccaaaaaggatgagacaaagccctgccgtcagagaatcctcagtctgtgttaccatatgtcttagggcaggttggagatcaagaatagaaaagccactaaaatctacttaggtaaaagagaacagaagtaagagagaactgacaggcctgctgtgggtgattggaacagaaaatgaccaaagatgttctttcttcattgccatgttatctcttcctctgcttccctcattttacatttctctctttccccaccttttctccctccccatccaacccattcccagattgccttcctttgctctcctttacaccatccacagtggcttacactggctggtgccctcagcttccaacacgtgctagtaccgtccaggtccagcattactgtctgttaacttgactgtctccattctaatcccaagttccagcaggagactccaaggggcctaccgtggacaggtttccaactctagccgaaacagtatggtggggagtggggaaaggatgcccaaggtcatgctggatggtatgcaagggactgtctttctggggctggactcaaaggtatgggatgatggcttctgtaaaatataatgtgatgggccgagcatggtagctcacgcctgtaatcccagcactttgggaggccgaggtgggtgattgcttgaggtcaggagttcaagaccagcctgaccaacatggtgaaaccccatctttataaaaatacaaaaattagcccagcatggtggcaggcgcctgtaatcccagctactcgggggctaaggcaggagaatggcttgaagccaggaggtggaggttgcagtgagcggagatcaaccattgcactccagcctgggcgaaagagcgagactccgtctcaaaaaaataataatttatatatatatgtataatgtgataaatggtctaatagttgctctacaatacatacacctcgattcacattttgcagacttcacgaattcatagaattttacaaattgtaaaggattccagaatcatttgacacaatccctacacttgagctcattgtaaaccaaagcctgagagcaaaaagggtggattccgtactctctgacttctagtctactccaacatttaccaaaccagagcgtttaagaccacctttgacatgtaggtgaccaaagatagtccacactgcatcatagcattggatttgtttgtcttttttagtataatttctgtacctactaagaactttcacatatatatcctatctagtcctcccagcaatcatgacaagaattgttaagcctattttgcagatgaaaactgagacctaaagaagtcaacagacttgcctacactttacagttcatatcaggcaagccaagatttaaacccatacgatttcacttcagacctccctctttctgctatgccatgcgccttcactctctgggaatcaatgaaatgtcaatttgtattgtttgtaatgtttttctaatgttatgatgttttatttatttatttatttatttgagacagagtattgctctgtcaccaggctggggtgcagtggcacaatctaggctcactgcaacctctgcctcctgggttcaaggattctcctgcctcagcctcccaggtaactaggattacaggcactcggcaccacacccactaatttttgtatttttagtagagatggggttttaccgtgctgaccaggctggtctggactcctgacctcatgggatccgcccgccttcgcctcccaaaaagctgggattacaggtatagccaccgtgcctggcctgttatgatgttttaacatcttaaaaatctagctcaggagagctgccccttttgggttagccagttcttagagatagcagagggctcatggagaatgccttgttatgaaaactaaccagtccagagccatacctcctctaccaggaggcaatattcctctccttaatcatcccaggctgcataccaggaaactaaagactactcctatagcccaaagctacaggaattattcaaactagccaattccagtttcctctgccctgtcttccccatgaaaacccagtaaagatgcctcctgtttccagaccctctggggataataaactttgttttcctggcctctgatgtgtggcctcttgtggccacaccccactgaccatcacataagagaacacaaacacaataacaaaaaaaaaaggattggaaaagcagactgagaagttcagaggatccttagtaatgttcaaggaattagcatgtacgatagaggagtggtcaaaccataatgc

SEQ ID NO: 5107 - DNA, 100000 bp, Homo sapiens
aatgttatcagtgggaacaccctgtgttgataaggttgtaaacaaacagtaatatgctgttctgcctgtgtaacccttccagatagcattgtggctctctgtggcaaaggccagtagggctgttggatcaaggaactccagttctacgctctacaaaggtatgctgaggagatcaataatagaaggaaaaagctgtatgcataaagatgctaattgaaccattagttctaacagaactagaaataacctaaatgtcccacagtaggggaatgggtttccaaataatggcccatcactatgtgatatatgaggtagccattaaaataatggaaaactttgagaaataagatgacttgaggggggaagggaaaaaaagggggggcatgaagccaaataccatgaatccttgaaagcaataacataacatctatagatacaactcagagctgtttgttcagtgattatatgaatataatttgtgatattacttagtattctaaagtgacctcagctaaactagcttggatatatgaaagacacaaagagttaatagacagggtattgctattttagatttttttttttttttttttttttttttacataagcttctaaaaatggtgcctgctggtgaacagaatgggcagtgtattgcaagccaagtctttctggcctagtgttgaccttgatgaacgtcatcaggcctcctcactggagttcaaaacaaaaccactcataaccccattttaaaaagcaaaaccacaagcacagccttcagtcattgctggggaatgcttcaatttcttgtttcctattgataagttgcgcaaggtctcccttaatcaggtgtgaaagtggaaactggccacctttggagttgaaagaacttagggagagagagggacttggaagaaaacgactgcagagaaactggcctactcttctgtttgggtggattctgtagcatcagatgagcgcgaagaactcgggatgttgagtccatagaaggtgcagaccaacttacagtcagaacaggagagagggcctattgagaaatgtaggaaggctgaagccaatattgctggataaatggcatgtacaaaaatgatttgtaaggtttaactggacatttcggtatcaggagaagagccagagctcattcttaaataggaaatcaactgtcttcccttgcagataattcacccattgtatgaatgtaatgtatatatgcttctagtcataggccacacataaaagtagtgtgtagtggaaggcccatgggcttcaaggcagatggactggcttcacatcctgactctgctgtctaccagctatgagactgtggagaggttacttttctctaaaactcactttcatcctatgagcataaagtgatttgcctaacccatcaactggacagagtatgctcagtaaatagcatctgaaattagaagtagcagatgacaccgggtgcgtggctcatgcctgtaatcccagcactctgggaggctgaggcagttggatcactttagggaggagttcgagaccagcctggccaacatggcaaaaccctatctctactaaaaacacaaaattagccaggcatggtggcgggtgcctgtaattccagctattcaggaggctgaggcagggaatctcttgaaccccggaggtggctgtggcagtgagcaaagatcgtgccgctgcactcagcctgggtgacagagcgagactccatctcaaaaaaaaaaaaaaaagtagcagatagagaggatcattattacataaatcatatactacaaatacacacatatatgtacacagaggctctcaacttactatggggttaccgtctaaacccatagtaagttgaaaatataagtcaaaatgcatttaatacacctaatgtattgaacatcatagcatagcccagcctacctttaatgtttcagaaaacttaagtttacctagagttggacaaaggcatttaacacaaccatttaacattagcctgatttattagagggttgaatgtctcatgtaatttattgaatgctatactgaaggaagaaacaatagtcatatgggtactctaagcacagtttctactgaatatcacttttaatcatcgtaaagttcaaaaatcataagtcaaaccatcatgagttagggatcatctgtatcatatatgtgaatatacacatatatatgcaatacatatatgtgcatatgcacatgtgcccatatatgtgttatacatctataatgcctgtgttttacatgtatggcacacatatttgtcatgcatacatgtacatatacacatatagatgtgcacatgacacgtatacatatacagagtgcacgacatatatacatatacacgtgcacgacatacatatacagatgtgcatgacattacatatacagatgtgcacatatgacaaatggggagaaatagggttggccatagaataactaaaataggaataataggaattatgccatgcacttgctcacctgtcaagaatttatcaagaaatagccaaggaaataagattgatgtgtctggcaagagaaaatggcccatggggacgacagtgtctgactgagtgggttcagggagaaatgggcatgagggggcaatcgctactgtacggggcctcagttcatcttcaagtaacgtagataacttctgataaagtggagtaggagttgtgctttgtgaggactcctacagacccaagatgtaaattcctttatagcagaggcttggaggggtttactttaaaccttgaatttccaggatgtagcacttggtatgtttgttaatgaatgaatgtatgaagccttggtctatatgacttggaaatcttgatttgggagaatcccagctacccttacaaagttccccgaggcctcatgttgtcagcctgcagatgtgaaccctcaggatccacagaggaggaagtcagcatagaggccctagacacggccaggaagcaggagccagcatgtcctctcttggttctctttgacattttgcacagcaccttggctgatgatacccaatatcttctttctcgtggctttactttcacttccaccaaatgcttgaagcataactgagtcagacccataaagtcacctctctgatcagcctaagattttaagatggtgcatccaggccaggcacagtggttcatgcctgtaatgggaggattgcttaaggccaggagttccagctagcctggtcaacatagcaagaccccatctctgtttaaaaggaaaaaagatggtgcatctaccagaatggatatagtcaacttatggaaggagcagtggcactggtgcaggcaatctcatgaccttgaaatcaaacactcctgggtgtgaactgcagctctatcaatttatgagcttatggacaacagcagattgacacttcttggcctcagctttttcatcagtaaaatggggaaaggggtgaactggcaagactgtagtcatattagaaatcagatgtaatagccaagcatgtagctcacacctgtaatcccagcactttggggggctgaggtgggtggatcacctgaggtaggagttcgagaccagcctggccaacatggtcaaacccatctcgactgaaaatacaaagttagccaggtgtggttgtgggcacctgtaatcccagctactctgaaggatggggcaggaaatcgcttgaaccggggagggaggttgcagtgagccaaaatcacgccactgcactctagctgggcaacagagtgagattctgtctcaaaaaaaaaaaaaaaaaaaaaaaaaaagccagcacagtggctcacacctgtaatcccagcactttgggaggctgaggagggcagatcacaagtcaggagttcaagaccagcctggccaacatagtgaaaccccgtctctacttaaaatataaaaattagccaggtgtggtggtgtgtacctgtaatcccagctatttggtaggctgaggaggagaatcgcgtgaacctgggaggtggaggttgcagtgagctgagatcatgccattgcctgcagcccgggcgacagtggtaatgtagcctgcttagcacagtgtgtggctcgggatcttgtcacaatgatggaaattattttcctgaacataaagcctagtcacccagaatcattcttcagtggttatttattaagtcagtaagtttgctgtgtgacaggagcagttcaaggtacgtggccaagttgtgaagaaaacagacaaatttcatggagtttcttatagtgggtagacaaaaaaatagacacataatgtgtacaataatattaagtgttgtggagaaaaaatagagggaaggggaataagaatggggtgacaccatgaagacagggataacgtgagcagagactaaaatcagtgaggaagaaaggcatgctggtttctggaaggaaagcatttcagcagaggaaacgcaaatatgcaccccttgagttgggagtgtgcttggcatgttcgaggaacagaggaagatagagtggcttctagtggataaagtgctggaagttgagattagagaggtagctggagacaaattataagagaagtagggtagaaaaaaattaaccttagtgagctgagaagctgtatcgttagcttttgctgagtaacatgtaatcctgaaacttagtggcttaaaataaacttttatatctttttgcagtgctgtgagtgaaatgtgcagtttcttctcctctgaattggcacagtggggctggatagtctgggatggcctcacttacatgtctaactaactaactgctggatgcggttctgggagtgactacgtgtctctcatcatccagcaggctagcccaggagccgttcctatgatggaagttgcagggttccaaagatcaacaaggaaaggcaagccccagtgcaaacactttccaaattggccaaggccagtcacatggccaaagtcagaggtcatatgggagggtgatcccctccaggtgtagattctgagagtggagttctgacggctgcttttgcaaatgaaataatgtctgaaaagtgacattatctgattcatagtttcaaaggtcctgtgataataagattacgtaaggaagactatagccagatgggaggatgtggcaaggctatgggccactgggggcaatggtgtttgtttgttcgactgctctgcaccacagatgcagaggcacagaagttaagacattgtctggcctgaagctgccatgatcaggagggggaacaatgacacccagcctcacaccttcctggtatttcagcagaagcattttctccgtcttgccagagtggactttctatgtgcttgctggaacgggctggaaagcatggtgtccatgagatgggatgcgcagataaagcttctgcacagctcccattctcaaacatagagatacccgctaatcaatcactaagtattgctaattgcaggggagcagaccattgaggactaaaataactcactgtaagtaagtaaaacaaaacatcttaaggtgaaatgaaacaatagtcatttttcttttttctttctttcttaacagaaaatatgctggcatgctaatcgcgtgagacaacttggcccacggacagccacaagcacaaaaacaaaacacaaactcactcagagaagaaacaagaatcgtgttttcctggctctacgagaagcgctttattagaagcgctttatttttcctctagatttcttttctaaaaatgaaaaacaaaaacaaactgaaacaaacatttaaagaaacaatacaaacttcaggtgagatattcaagcatgttcttttattaagcgtaggatgcgaggcacagcaggaggtttaagacaatgtgaaagcaagagaactgagactgtgattgacagacaaagggattaactaacgtttattctctgccccccaaaatatcctgtgtattcttaagtatatacgcttcccttcctgctttcaaggtatctaaggaatgatttgaaaaatttgttataatctctaaagaatttttttatagcattagcaaaggagtctatgacaagtactttgccacctggtagttctgcgtatttactccctctgggtgtcactgtcatcctcactggctgggacaaggttctgagatttgtcccccagcagttgctaagctggctcagtcttggtcaggatgaatgaaacaattatctcctgatcaatgcagcaaggagcagtgaacacttgctttttcttccctaagtaggagaaggccgcccctggctgcagtggtggccgtggtggtagctggatgggacgaggggacctcaggctttctataacagtaaaagaaagagaattgctggtgcttctccagggagatacggaacctaacgccaaccaggtttttactttcaaacaggccaccaccagaaagcaaagagacctatgctagcccagccccagaaaagtgatactttaccccaggaattccctgcttcccattggtactaagatttttcactctgttgtgaatgctcttatttcctttactcttgcggatctgtgttgagggacatttggaaggggcccagccctggcacttgcgtgaggggacacacacagggcggtgtgtgtgcccatccgctctgagctccacttagccggactggctgccaagccgttcttgatcagcctctcgctgagcgcccacagggtccgggccgtctcttcgctctgagcttctgtgagggcatgcagcggcagcagttgttgaagtacatccctcccagaccctccagttctggacagcagcacagtacacggtggtggcagctccctgttgctggaaatccaagaagaaagcaaaaaaaaattttaagaaaaggagtgatgagatggcgtcatttcgactgcctgggcatagcaggcctcccccacctggttcagtttcagctggatcttggcatagcaaagggtactggctgaaagcacatgactgtaaaaagtataatgtgactatcctggaaaaacgagttcataactccgcttgtaaagctggtgtaacttttgacacctcatacagggacaggcttggaaaaaaatacacatatcaatacgtcgtggcaggcgcctcttccacacagagaaaaagatggtaccttctgaacgtgcaagaacaaattcatccaacccctcgacttctccatgtataatgtattcgataccaaatcgtttgtagaaccttctgtctgacaaaccaaccactcttaattgtgtccatcaggtagaaaacccaagtggggctgctgccagatcatccctttatgctttgccccggtgctgctaggggaagggttggcaatgttgtgttaaaacatttaatgcacacacacaacacacacacacacacacacacacactcctcaccatacattcatacttagcacaaacactaacacattaattcatccagatcccatgaaaacctttttctaaatgtcatatttgacccgatttacaatgggaccacaggtaagggggtacatttcctcccagcccacttcaaaatgtagttgcaaagagtgcagctgatcactttcattcaccttttgagtaacagttggggctgtgctagggacgtgtgcagtgatgaggcatcatatcatccaaactgacagaatactgtcaggatgctataaagagggcaagaaatcactttgctttgcaagccataattaaaaataatagctgctgttcagagggagacatggtcggcacgtctctaatttaaaaccaatacagtttattggcatcttatgattatttatgtgtttcagagccctagctgcatccactaattttcagcgatgagagggagaggggttgcaagagaggaccggaaaaggtaactgaagataagctcgccccacaaggaaaacactaaggaactttgattgtgggggaaatggctttccgacccgaccaaagcttatcatttttctgcccctgcagggtttacattgtgaccatgcagggtgcttacagaggagtttccctcaaatggtctggtttgcaatcactatgcttgcattctaggatcccgggagagtcaggtccatactgagaaatagggtcccaaggaaggtgttacgacgtgaagatgtgccataaggcagacttgggtttgttgttgtcattgttgtttggttttagcttcttcgtgtcaggatatctagtaacaatggagttggtctgaaaactgaatggtcaaatgcagtcagtgatacgactctgggcggggtgtggaccgtgagtgagacaaagacttgggttttgatataactggctgcttgatgatactggacaagttccactggtcctgaatttgaataactgaatgacttgaacttaatagtagctggtttgttacctccccaatctccctccattatcatgccactccaaatagccagatattatcctggattcagctgtttcttttcccattgatttgttggctcaagtctaatggaaatgagttcatgtcatccaaatttcctttcactgaattattttcctaataaccctgagcttagcacctggcacatttatctaaacaacttcaaggggttttctggctcttctgcatcccatgtggggaaaagggaagcagaagtgcctctaaagacaaatggagaattgagatgctcatccagctaactcaagccaagtattattttggcctggaatctagagttctggtggagatggtgttttgtatcaacttccagatatctgtcatatattttcttttaccttgcagctgccaaaacgaccagagtggccaagtgacttgccattaactcccggtggtgggagaatccagctcacccatttcaagtccagcctcccgccctctatgccacaaggttatactattcagcattcaaacgtcatgacagactggcctttcactgttctgccaaggtgaggaaagaccaaagcagtccgtttgggaaagcaaaaagcagaattcttcctaacctataaaatattttgccactatgacctactgtaatgataccacgttgcactcttgcattacggaatggtatttttgctaagaaattctgcagtcccattgattcagaatgccattgttgcggagctggggacctaccttttccttccacggaatctaaaggcaattacaactggcttcattcatgccaacctacatttggctacaatgctgagagccatacctttttgaaaagcctaatttttatcaggagatggctttgattcctttgccactaggcttggggtgatttaccatctaattccatcacaagtggctctggctttgtagaacacagtacacaggaggggcacccgaagcaaagacgaccttctctactccaaaaatcaatcgtccacctttggcaaattctccttccagattcatgcttggtgctcatgggtactcactctactttcctcccttgctggacaattagcagtaacaatatcttgttggtcccatacacaccacacctttggtctcttggagaatttcagccgtaccaatggcaacctctgagtgacatcttaatatgatcagatgtgatgacagttagtaacaggttctcatttttggctcaccagcttttcggcctacatatcatcagaatagactgaggcacattagtgaaatctcaatagtaaacaagcaggtactgccaataaaagagaagcattcttaaactgattaaaaaaaaaatttaaagagcactttaatcaccatcagatgctttcattcataccaccttttggggcatcagttcataatgcagaaaagatgaaagagcctctaaaggaaataatgttaacaactccgttataaaatatctgaagcaataccttgccagtgtcatcaatgcttactgatccattgtgataaataataataccttgacatacaaacactgctggagctatgggttcccctaaacgatttttttttttttgagaatcaatcatttatcaaagcctgtaggttgtatatggttgctaatcatgggaaacgggggaggtgtctatcccgcgcaatggcaatgagttaggttgttgacgacacaggactgagaatttctgggaagcccagagaatctttttaatcatgcccgaatgccatttccgatctagtcaaacatttgtgagctgcagaggagaactgtgcaatcaatcttgagagtatatgtaaaattacccaggactcttgttgggattaagagtatcttggtaataaggattcatcattctctttcaaaaatcatctgtcgatttgcagcacaatcttcaactacagaaaggtgggatttagaaagcagttgctgtttattatagttgaggccctcagatctaaattatccatccttccaaaactcggtgttgggatgaaatgttaagtagctgcttttcatcaacattcatttgataactgctagccatcaatttaagttgtcagcacagaatacaaatgaatattgactcctttaaaggaaagggtacagaggttctgataaacaatatatggtaaagaaaaaaaaaagcacccacatattgatatttgtaatcattggttagtactctaatataatactcacagggacacatgttacaccgtgttttgcttcaggtttttctattttaaaatgcatgctcatttaaaagaaagaggagattcctgtcttaagtagacttaactatgagatatataaaaaatagacacaatatcatggcatatctatatatcaatgattgtgagagagtagatgttctaagattgctttcttacagggacattgcacagaaatgctgaattaatccacttatgcaaaaagtagagttatgaaaggaatgaaccctggagttagattaggcttggaacaccaagagcagggaaggagaacagcccttttgaagacggcgtgttcccatgactaacgtcccaggacaaagtggtgatctgaagtgagcaggtttggctaaaggaaagacacatacctcttcaaaccctgcctacttccattgttactcatctggtgttgttggacaaagcaaatacttctcaaatgcaaagccagccaccttatccactgactctggaatacaccactaggaacagaatcatttatcagagagctacatttatcagagagctgctcggtggagatgagggggtgagccctcatgtcacaggtggaatagatggccgtctacacgcctgtctttccctgtctcccagtaacactcccccaggagaggctataaccactctcccaaacagtgcagaggtcatctccagatacctcggtgcttgggatacagccattcctcacaacaattacagcttcaatctctcattggaaacacaaatgaaagcaaactgctccaaaaggcacttgttccctactcactatccaagagcaatcttttaggggacacatttgccacaaattcatttgttcataaagtaatgcagcctatacaggaatgaggctcataggcctccctggctggtgaccacaccagtaagtcaccctcttcttccaccgtgatacttctataatgaaattaacaattcaatttggaataagtgctaaccaacgaacacaccaacttccaccaaaatgatggaagcagcagacgagaacagagatgtctactccaaagtcctcagccctgcaaactgcccgctttttcagtgagttgtagccaacgagtactattcaagtgacatcaatgactagcattattgagaggttacgatttgccaggctctgcatggagagctttgtaagcattgttgcctaccctcacagagctctatgagccagggacagttagtatttccatttatttagagagaagctacctgatatcagagatcaaaagcaactcgtccaaagccatacagataattacgtagaggagtgacttcagactccgtgtccgttggtacatgaaacctgctccccaaatatgtgacaaaatatttgcacgtggcccatttcctcatctatgtcttccacggggctccggcttcctagcctctctgcctgctctgccgccttctcagccaggccatgtctggccatgaggtgatgcctaacatggcctaaaatgaaatgtgggggctgtcgtgtgttcacccgagaaatgttaaaggagatttttttttccattgatttactcatggagctaaattgaaatgatatccatttggtgaacaaaaatgaagactcagcacccccttcgatgatccaacagcaagtgacccttactaaaaggtcgtccgattcaaaatgccatctccaggtgccagatttgcagaactaagaaactactctttgatgatagaattttttcaaagcaccgacatcccatacaagtgaagtggacaaacccccatcttatcagttcccacgcatgtaggtgcgggctctggagtgtttcatcaggttgcagagaaaatactgatccatccctctgactccctctcctccaatgattcctaacacgtcattcctacaaattcctgacaactgactcccacaaaggccttcaacaatccagccttgacacatgcaaatacttcctgtaggtattgaaatgtaactttcttcataaacctttggggttttgctaactcacaggctattcttaacctttattatagaagaggaatgcactcaattcccaaaaagaaacaatgaagatgatcaggaaagcaaatatttgttttcaggctttagaatgtgagaaagtgttctggagaatccatttagatcccatgccaactcttagccctccagagagaacatgccctccctaacaaattagacgtggacaatgtgtttagatgttgatcttttccacaaggaaaaatatttctttgctagcaacaggttcacaaaggtagaaaaacctcaggtccttttcagttgcctctcccatgacaggtgaagagtgtcattccccaggtgacactaggacagtgtctatgacaggggcttgatggccgtggctcagagagagtaaagtgccagtcctcaccataaatgcaacaggttcaagcacagaccacaaccacaaattacaagggacacctgagagaaacgcatgcagggggaagagtgccatgcagcttttaaatgacaggcacgtgctacaggcttctgttcagagagaacctgtgagctgtcctgtggcctttcctgtttgcggtgagccatcccaaatatgatgcccccaaatccgagtctggctagaaggaagtgtcatacaaggccatgccattctccctgacaaaagacatgagtttcttgcaagagcactaagaagtttaagaggtggactcgaagagaggagaatgaattggaaagccagcaagaatgtggctcttatcctctgtgaaatatttgcaggaacgagcctggagaccagcaggttcaggatggaaagcggaaagaattctttcctaaaacttaagttttagagaaaaataggcagccagtcccaacccccaaaggcgtccaaagccatgtttgttctgggaaggccaaggcatgggaggatgttaattgggctatcagcaggattgaagggcagggtgaccttggtacgctgtcagggcctgtgttccaagtcgacaaactgttctgagcttttccatgaaacgagtgaagcccttttcataccccttcgtgttccagaattcttgccatcgatgttccaaaggatctgtgatagatttatgttagccttaaatgggacgagttgtaacattcagaattattttatctttctgagacctgctttattgtgagaccctagacatgctttgctggggttagggtgagggtactcctaacgaggaaggaaaaagaaacggcttcaaggcaatccatgtgggtcattacatgcacacttgttcctcttccatttgtgcctgcccaaagcgttctagaactgaccggacctgagaggctgtctcttagaactaagagaaggtattgttgatgatgtcttatatccatggaagaattccctgggattccctctgatgctgcctgggatacctacattgctcaaagtacagtttctttatgaatgggatgaaacatcgcattggggtatctattcttccatggttggtttgaaatagccaagcgaagtgccatagaaatttgccaacaaaataagcatctaactgatagtgtcgtccttctaatggaacaaatctgatggcatgtcactgaaattttccaactgggccaccttgatgcccggctaaaggactgctgggtgtttataagatataaaagaagatatttagtgtgtgtttattgaaacattttacatttttactctacttctttaacctctgttatggttatagctagctcggtactgcgtataaatgtatgcatctgtattcgccatctacaccaaaataaacctttgaattattgccaggcagaattaatgagctcagttctaacagcgcaaagaatatcttcatactcaggtaaaacaaacagcttctcccttcccttcttctgcacagaatggctctacgaagtcgcctgcaaaattacgtcttttagaaaaccaagtagctggctgttttgtgagcagggaggtttcaggacgaaccacaaacaagctgtttgtttagattttaaggttgacagttcatttaacgtatgccccataagtattctataacatagtcctgaaaaagcactgaagaaaaaaaaaaaaaaaacacaaggtctccgctggggccacatcatgggaaggaattaactcttaactctccttccagaaacaaattaagaggatgtactttgcaataattcagatctcacaggtaggccccaatgtccagccccgctatttcaaatcgggcatgtctgagttaggtgtgtggatttcatacagagctcactggaacagaccatttctcaggttccaagacgctggccttgttaatattcatttagaacatactgtggagagtgtctcatttatattacttccataattaatggtgtagcttaggcactgcctttacacagagagatctcttcacagtggtcgatgggtaatgagaacaatagatatttcattcaccagcagcgtgttgctagttagtaggaaatgatcgtgtggctgttgctttaattgcccgggtaaataattctgcctcggtgttagtgagcattttaaacacttgatgcccatagactagaaacaaacaaaaattaaccttgattatgcaacaccttacatagaaagttacaaaggtatgtctttttcaaagtttgcattctatcatgcaaatattactaaatatgcatgtgctgactactcatctactgtattttaggaaatacaattaggctgctttctcttcccctatgtagactgtaaataactgtagatctttctcttgtttccctatgtaatatatgtaaatactaacaagctatgcatgctgctattctaggcaatttcaggtactttataatatgaaggcatgtacttgaactcgtttgttaacagaggggaaaaaacgctctcaactctttaaagctgaatagaaattaaagatttcttcctagactgttgtggcttcttttgttgccttctcttgccggaatcgagtgccccactccagctctgaccttctcccagcaaagcacacagcacacacaggcccgggaacaacagtggaaggacttggcttgggctttttcatctttctttgggtttcctaaaaaacatctagaatcacaaggtaggtttctttggatcttttagcaaaagaatctcgacggaatgtaattcctatttgttgttcctttaccgtgtgcctttatcccaaaacactactgagggtcccgtcattcccatctcaacaatacggagactgagtaggtcaaggccaatgacaaaagtgacaacactactaagtgccacccaagccctcattcttcctgtatataataggtcagtaaactacttctgcaaagggccagagattaagtaatttagctctgtggcccatataatgtctggcacgatcactcaactctgctattgttgtgaaagcgccatcgacaacgtctacccaaatgaacgtgtctgtattccaataaaactttatttattaaaaaaaggcactgggccagatttagccggcaggccatagtttgtcaatctctgctctaacacgattaagactgttattaaagactgagagcatttccctttttaacttgtgtgtttgtggatcatggaaatgatttgatcaaatgaaaattcttctttttcctgcaagtgtcatgaataaacaggtgaacaaaaatgaaatcacctgagcttataaaacaggctgccttcctctgcaaattacattgtcaaggtttcaatttagttatctttttgttttcataaatagggatggagaaaaaagtcaggaagacaaaagtgaaaaaaaaacaggaaaaaagtaactgagcaacatcactcttcaatgagaggaaggaggctattacctcaggtatccatggaaaccaagcagccataaactttttaatggttggaaaacagcgtttgcgtttgaagatgtttttcccaaatagatgcttcagtgtaaatgcattaattgacagtttccttcgggacttttttattgaagttccaaacttaatttgatggcacaagggactctctggagcccttgaagaatgctgcaaagtaggtctttagaaaaccgagccagctcaggcatcgtgtacaaatccaactctcttgcaaacaaatgaagaaacagatcttattccctgtaagtttcccatttaaaaaaaaaaaaagaaagaaaagaaaaaggaaaccctctctattcagctagggaagggagaggccctttctaaccttatcaagtgagaatcaatatcatctcttcagtcctggagggagctgagaatcagcaggagaagatagatccaggtatttttgcagatggggtggcaatatgggatggtaggaaaatccctgtgctgaagccagaagtccttacattggactcctgtctttgacacctatgacaagccctgagcctcagtctcctcatctggaaagtcgacataataatataaccttcatgtggttctggaaggatgagtgataacatttggccatttcctgggcacacaacaagtactagttcaaagcagctataactctgatttttacaagtttaaagcagctataactctgattatcacaagttaaagaaggaagcatacacatcaaagtatagatgaagcctgcacctccattttttgggctgccgtatagagactcgcctgtcacctggccccagcacctctcctttagccagaccacgagcccaggtacaatatcagcacagaggcacttgccagtcctttcaccatttctagatccccttccaaatcatccagagtttttcatgtctttgtccagggagtgtgaggctcaatagtgcttagggagggttagtctaatcccaactgtaatggccaaaaaaaaagacgacgacggggtgatgactgctggttactgagagtctcttaggtgccaacgacctgttattacttctgttcgcacaatatcctcactccccaccaggcaggtgttattgtagtggaggggagacagagctaaaggaggtgaagtaactcacggccaagcaacggggcagtgctggaactcagattcaactgaggtctgggttcaaaacccatattcttgttgacgtgtaatgttctaactccatatctataccctttgtagcaccccagaatcatgcatacacttgaaaatctggcctcagatcgagagcgggatacttatttcctgcctgggccatttgatccctctggtggccaaggcccttccacagaccagcagggacctttctcctcctttctgagctccatttctagtgcctaaaacctggcttcccaccaggcctctggcggatgtcatgtgattttgaacagtacagaccagaggggtctatggtgcctcccctgcagtgttctcttctgcaaattgctcttcgtgcaaaggggtcctgaaggctggcagggctcaggtgaggagcttggcatttgtggatcatctggcagaaccaccggggcagtctcacaacaagccagttgcaattggaactctctgcccccacagtaacagaaatgatgaactcatgacaatggggtacaccaaggaacatcttattcttctcccgcccctgccctctggctgccatacctgttaggattcatcctcttagaaatgcctggcaagggaaggcacacaaatgcacattgctactcagggaggtgtcagcgaggaacacaagccattgtgtagctgaccttcgaactgtcaaggggttgaaaatctgtcctctaccagtacacctctggatccctaatcaaatgactttacaaggcagtcctcttcatgtatgaatcccatacggggccaggataccttctgtgacatgttctaggtggcaaggtggagaattttagctgaatcttgcaagagccctatgaagttactacagtctcattgtattaataggaaaactgaggccaagtcagtaaatgacttcataacataattctcaatgatgcagttttgattttgtgccactggcggcctcctgctaagagattcgtgtgtctttgacgctttctgtgagggtccacctacgcatgatagatcctttagggggaattctgcacacattatccccagttaaagacaggaaggcctggcaccatggctcacacctgtgatctcaacactttgggaggccaaggcaggtgatcacttgaggtcaggagttcgagaccagcctggccaacatggtgaaacctcatctctataaaaatacaaaaattagccaggcgtggtggcgcacacctgtagtcccacttacttgggggctgaggcgggaggatggcttgaagccaggaggcagaggttgcagtgagccaagattgaccactgcactccagcttgggtgacagaatgagactccatcttgaaaaataaaataaaaaaaaacaccggggactgaagcccaaagaggcaaagttttctgcctaggtcaaagagcaatgacagagttaggagctgaaccaaatcacatggctctagacacccagtctcaacaactgactatgataaataggaacatgtccacagcacaagtgaagcaggaacatagcacaccttcggtcaggattttgagccatcatcatagtgacctttcaacaacaaagactagcaaacatttatgagggtttctggttcacattaagtgtttgatgggtactatttacaatatttataatatatggtatttccatctaaccaatgtggaatcaaaagtccagaaaagttaagcaacctgcccaggtcacacagctactacgtaggggtggggaaatttggacctgtgtcatctgtgccttgaccccactgctactaagcatcctgagccacagaaatcagacactcacaatgcattttcaattatcccgtagtatgattaatgtctctagttaggttgctccaccaaggggcacctagactcttaggtttgatgtgaaaactgcagtggaggccagggctttaattgcccatgggaaataataactcaaaccagtgagcagaggatgcagccatacccatgaaggagcaaaaaagcgggaggatttattttctttacttgtttttaatcttactcttttcttttctttactttctctttttttgagacagtctctctctcactcaggctggagtacagtggcgcaatctcggttacatcaacctccgcctcccaggttcaagcgattctcctgcctcagcctcccgagtagtgggattgcaggcacatgccaccatgcccagctaatttttgtggtttttgttttttttttagtagagacggggtttcaccatgttggccaggctggtctccaactcctgtcctcaggtatccacctgtcttggcctccccaagtgctgggattataggcatgagccaccatgcccagccattttctaaagctgctcttgttcctcagattttggtagatgaccaattgatttaaacgttgtacacataagggaagatttataactgccccagatttcagttctccttaactcctagctttcctagaggctgggaagcataacttcctgctgattggaaagtgagagccttatataggacacaagatccctggagtcctgatataaggacttcccatcatcatggtgggatgaactgcctcccatcgtcatggtgggatgaaccttgccctttgtcctgggtgtttgtgttttaccacaatccgtagcaaacattgggaacaaataaataaattaccaagcaatatgtttttatgtcattacagaactgcctttctaaagcgatcaaaaaagcccagattatcaccacaacacctgtttgtggcagtgaggaatctaatgaaatggtctgataattaaatttactttccctgaattgctttgcttaaaggacatgtctacaaaaagcagggttggtgacagtggtgtacagtaagtgttcaagaactcgctcactggaggggggcagtgcagggggtgggtttgattccagtgtctgccaattcccatggtatgaatactctcaccacaagcaatttaaactgaatgagagttgggaggaaatgtacacactcagctcttggaagctgctatgatccagttctagcgtcccttggtgatgacctgtggaatacagctgtaagaatttttgaggaagatcaagagcatgataaaacagatcaggacctcaaggtcataaagccattgggatgtggtaggcactgtggaatgtataaacccaaaccagcttagggtacctgaaggacagaatggtacagacttgtaattttaagcatgtttcaacttggtccctataacctaaaagttgactccactcaggtagtcccctggcccaaggtaactatacttcctactgggtcaatatgagccctaaatatcatttagaaacggtgcaacgttgcctcagttaatactgcagcacctctgcaggtagataataacccatttcagagatgaggagactgaagttcaaggaattgaaagatgctcagggtgacacgaactcccgaaatgcattgccaggattcagatccagatctgccagaccttagacttcatatttccctagctctccagggaattgtgctccctttgagctctgtatccttgaaaatagacatctctacaacaagtgaaatctacatgttgtaacaaataatttggctccccctaaaaaaaaagtctctcattgggggagacaggatctgaatccctgggggtctggaggtagtgtacggatgagaactggagggtgggggaagaaggaatggagactgggtatgtggagtatcagggaagagaggctagggctgcttatgggattggaaatcttgcgatttaaattatttctcagcattaatggaagttgggtccgaatagactcagcattttctccttttgcccaacatcacaacctaagtgagcagagataaccctggggcctccaggagcttccagcacacagagcacatttcctcagctgaaggtccctcggttcaaactggtataaacccaaaccagcttggggtactggaggacagaatgatatagacttgtgaattttaagcatttttcaacttggtctctcatgtgaaatctgcacgttatgacaagtaatttgtatatgtgtaatacacaatgtatgttgttacatgtaatatacaatgtacatgtgtaatttccgagtctctcaccttggtctctcactttcaccaacaggtgaagaacagagaagaggatgatttttgctcacactgcacttctgtactttatcagaggtgccaaacctcgaagctacttttggctttggtacttcctcaaatgaaatgcaaacaggttcctactgattaaattgcatgagaagcgtcagtactagaaattagtatattattgtccccactaacagaagaatattttaaacaaaggcatctttaccacctgagaaaccaaatttttcccacttgagaggaacagcatctccaaataagaaaaacagtgacgcagaaatgaaaaactgaaatgttctttcccctttcaactataattcctcacacatttgcattacaatgtcaaactcacccagtcactgatcttgtgctaggattctatgtaccactacctgagtgtttccccaaaacacacttcttgaatctgacttaaccattatcattgccattcctcacaaggagctagctcccggtctagacaagctggcttacctttgtagctttaccttctcctttcccccatccctgcacctcacttacatgaatataccctgaagttagagaggcatggttcagagcaagcccaagaaactgtagtggatattgtagtgtgctgctgagatcccccatctgggccaggaggcactcatttcctcagatgctaggctgtcctatgagtccctcctcagaactgcccacagccaaagcgagctccctaccaaagcaacacgcactccaggagggagccacatcaatgacttcctgacctccttgcatctctgaagaataatccagcttcagagtttcttgggattgactggagcattcgcatctcccacagcacagctcaatcctccctccacccctcctgcttgctacgttcccctacaggtgtggatcctagaacactccccagtaatcttccacatgccaatctcagttgcagaatctacttcctggggtacccaacctacaacaaacaatgctgggggacttagagaaatatacataaccagtctgagcctctgttttctcctctgtaatctgagatacgggtatgctcacactttagccatccggaatgaccaaatcacaccatatgataatgttctcatatggaacaggcatataatccatactcagcagaagacagcagtggcgtagtagtagaactgacagcattagcagtagcatctactcatctcattctgcctgcatggtctttctcatcctttagtttggggagtatggcatgggggaaaaaagcatagactctggggcatctgcttagacgtggtagattcagttaggcgtttttgtatgcactctctccagaaatctactgaatgtataatacggggaaaaattatttaactcagtgatcaagaaacatcaacaaaattttggacgatggaaagcagatggagaaagtagcacctcctgactcagcagagcggggctgtagaacagaaaggcagtgagaaatgagccagttcacacaaggggagcctgggactgaacgggggtggagaaggatggaagtgggaaaaggtaaggtgaggccccacactgctcctgtaacgtcggagccgagatctcatatgggccaggaaacttgttaaaccacttgtgtcttacaaagttcagccgtcacttcctctgtgagttcataaccagaacctttcttcatctcacagtccatctatatttcatagttgggtgtgtgctgttagactgtgatctcactgagagggttccaggtatccaacccaaagcttggcgcacggtaggtgcttagagaatatttctcaaaaggatgaatgaatgaatgctcaaatttcctttgaaggccaaaggaaaaatatatcatccaactcagttgatggataaacaaaatgaccagtcaaattatttcctttccaaatcgttttggtgtggttttgacatagctgttctctacaagtaacaactcacattggagctacactacataatatgcattacgtgccacacgctgctctaaactttctttgtacacatacacaccacagacacacacacacagaatcttcataacaaccacgttagctagatttactaagatttccccagtttacagaaaactgagacaaagagaggtccagcaacatgtgcaaatctacacattactaagtggcagagctgggatccaaactcacgtcctgtgactccaaaggccatgtttacagaaggcaaggagctagttgcttctgtaggttactggggccttctcttgtccctgactcgttaaaccacaatcttgtctgtctactgattcagcttctccccagctgccacccccttgtgaggagctgggctttgcaatcttcaggtatcctaaattgtttttgcccaagtgggactttcctctccttcctccaaaccagtgggatctcacctggggtctttgctggctaggtaccggcagtaagaaaagatgtgcgagggtcaatttgcaatatttttaaaagttgaatgaacgcttactttatccacagagaccacgcagatggatgactggactaaatctcatctgctggtaagcagcactttcataccctgaggtctccctgaagaagggagcagaaggcatctcttgacgcaagacccagcagtactgcccggtggcaaagctctttttcctccagccgcttttgattcaagtttcagtgaggcataaagaataaaagcagtttggggagatgccctacatcgctgaagtctcctctgttccaggcttagtgctgagatcttctgtgcagacaacaaagagtcttccagtgagcctcagaggtgcttactattatggtcattttacagggcccccaagggtagcaacttgtatgcagagggaatcaaatttggagatgaactttggtctatctgattccaaacctgtgctttctgttctgtattgggagattccagcagaaagcacccacaagagaatgagtctaatggaatggaaagtgctggccttgcccctgggatcacagaggtcaaagatcgtgagaattggcaactctttggcagttcacagccatggacacaaacttctgtctccttttgtgagccaaagagaagtagcagaaaggaatgtgagacaaggagtaaaacgaggcccttcctcattcaccttttcttcaaccactgtaccagtgacagcaggtccttaacctcagtcctgggccctgtgaggaaattagagctcagagaggctaagtgactttcccaaggatgcacagcggtgaatgacagagttgcgattcaaatgtgaaaagggatgggtgggctctgaagttcacttcttctcactctactgcctcttttgtgctgagaataagcaaaggggctggactccacaaggaaataaaaagtgagaggcaaaagaaataaagcaaaaatgagggaaaggctccactttaagcatagggccacacaaatcagttttaggggtgcttctgaatacctaggcaccttaaagaaatctctccatgctaaacctttccttgaccaatagagaccttaccaggtacaacctacatctttttcagttgttaaattatttcttgcactaacgagatgaggctaaaatgtgcacaggcaataagctccttgaaaatgagattttgttcacacacatctccccagtatttggcctgggtctggtatacaggggtgatgagttgccatgtgatgagtgaatgaatgaatggatggtggatgaatgaatgaatgaatgaatgaatgaatgaatgaatcactgcgaaaataacactgtttggggcactttctgccccatttcacgccaaagggaggcgtattgtggaaatgaccacagtgcttacccagactttaaaaatacacacattccctattagagctggcaggagcattttggtcctgagagcagagctccctgcccacctaatattacacgaggtgttaactacatatctggaaataccctatgactaattccccatcccttatcttgaggagaagaaaattgttctaacgcgaatgccccagattcctggtcagtttatgtaaggcgtttcaagtgattgcgtattttaagccatttttagcttaaatcacctgatgtgtggtgagcccagaagacctgattcttgctcccttaaactccctgtttttccactaattttgtttaaactacttatgcgcatagtaattctccattgaagaatgggcttagaagtgtatatcccctagacgctatgattttttaaatagacatttattcagtggattttccagtcacatctccctgagcttgaggctccatacttttgggtgagcacacatttgccaggttggggtaggtggtatttattctttatcatgcctatttggtgcttctctagtttgaaaacatttcactgcagtccaactaggatttgatgaaaccttctccaaattatgtctcaaatggtcatcagtgattgagaaaaacgtgagctccacaggaccttcgaccagctagaagcaaaaacttggcttttataaagtagcaggagaggcagcccattctttgtgcagttgtagctactttgaaataagcaaaatgtatggaaatgcaagataaaggtgttagatttaatagaatccatgtcctgatgtccacttactatctcggtgcctttctctcccatgaagagaagtcatgggctgggcgcggtggctcacgcctgtgatccagcactttgggaggcagaggcgggcagactgcctgagctcaggagttcgagaccagcctggcaacacggtgaaaccctgtctctgctaaaatacaaaaaaaattagccaggtgtggtgcaggtgcctgtagtcccagctactcgggaagctgaggcagaagaatcgcttgaacccgaaggcggaggctgcactgagccaaggttgtgccactgcactccagcctgggcgacactgcacagagcgagaccccgtctcttaaaaacaaacaaacaacaaaaaaaagaagtcatgcttgctcatcttcccagcatcttattatacacacatcacctttgatacatgattttatttgatgtgtagacaaatgagagatttagccacaattcacaaaatttaggtaacaccaactaatagctgtctaactcaagagtcctcaaatttacctgcaaaagggcagatagtaaatattttgactttgcaggctctacatttataagtactcaactttgctactgtagtgcaaaagcagcatagacaataggtaaacaaatgcacctggctgtgttccaataaaactttatttacaaaacaaacagcaggcaggatttggtccatgaactgtagttggcagagccctcttctacctaagccaagtagttaatcatctaagtaacaccaactagttcatcttctgaatgagttccctccttgacaaaatggacttgacatttgactgaactgtcgtgccagtttaatccaagttggaacgtgaagtgaatttcagtggagccagagggtgtgaggcctctctcttggggcctctcttagcggggtaaggcctctgtgggtctgaattttcagagacctacgaatattccaaagtcagtggtctttggaattcatatccagaccttaggcaggaatctacgcctaatagctacacctaattcccgattttttttttccataaaaaaggatatgaggccgggcacggtggctcaccctgtaatcccagcactgtgagaggctgaggcaggcagatcacttgaggtcaggagttcagaccagcctggccaacacggtgaaaccctgtctttactaaaaatacaaaagttagccagcgtggtgttgcacacctaaaatcccagctactcgggaggctgaggcagaagaattgcttaacctgggagactgaggttgcagtgagccgagatcacaccgccgccctgggcgactcatgagactctgtctcaaaaaataataataataattaaaaaacaacgcgttatgaaaacattccatgggaagatgataaaataatggagcaatcaaatgcttccaaattaatatctttatcccccccccttccccaccccataccagctgtcacctaaaactaggtagaatatgaaaccctggaagtttttaaggagttaaactacctactaaaatcactcagctcctatcaattgcagatgccaaataaatatcccccccctcccaccgggagcaggtaacaactgcgtattcgcatttcaggacagccaagcaaatgaacacggcgggatgaaacccctcccttgctccatttctatctctcctagctaacatctattgtcaaaagataacctcaaaccccttagattagaacgaaattactagaaataattattcctcaaaaatatgctttcctaggctgggcacagtggccatgcaggtaatcctagcactttgagaggccaaggtaggaggatcgcttgaagctaggatttgagaccggcctggccaacacagtgagaccctgtctctacaaaacacacacacacaccacacacacacacacacacacacacacacacacacacaaagctgggagtggtggtgcatcctgtagtcccagctactcgggaggctgagacaggaggatcacctaagcctgggaagtcaggctgcagtgagccacaatggtgacactgtactccagcctgggtgacaaagtgagatctgtctcagaaaaaacaaaaagaaaaaaaaaagaaataggctttcctaatagatgcctgtccaaatgctcaggcaatttttccaaaattaaatgccattatggaagacgacagaccatgtggaaacagaaagtccaatgtcccaggggcaataccatctctctccctaggtttctagcgacaagtttttgtctttctctatatatacacgtatctgtattttttttcttttctttttacctgcaaatctctgtcaactcttccacacagaatccaaaagctttccactatgtgtcaaatatagatttgcatgcaataaagactataattattgagcatttatgagaagtaatatttccctctggtgcatgttagctcagctgctcacacacaagtgtgaatactaatgccttcacttaccttggcgccacagaaatgcaaggtgagagaaccgagcagccccaggaaaagcaacactgaaccccaccgttgtctgtagggaagaatgtggatttcgaggagaacttggaaataaggtggcaattcgcttgcaggatttaaacatcaggactttgtgctaagagacttggagacccaacccagcacatgcaaccaagaggtctgcagatcctgcctagcaacagatggctcgaagaaatgaattgctagataaacatttaactgagagtttgacttcgtaagtgtggaaataggtgaaacaaaaggagaatgattctgaggcattccaattagtcatctgtgatttctcggcaatgcgtgctgaacctcctactggtcctgacattctcaaagaaagaaattttggaatccgtgaaaggaaatgtaaagtatctaagagaactttagtaacacagttactgaaaaaaagagagagcatttgcaagggaaataggtcttggccacaccggtcacgactcaaagctgttctaaaaccacaaacacgaggccagcttgaacgcctgcctccaccgacatttccttttggtacagagggcaaaagtgtgtgtttccatttttatcccatgcagcaccactaccgcctccaccttgtcccttctcccatctctgcttcgtttagctcaagacttcgtgggttttcttcgtggcacattccaggaaggagatgagaaaaatcaaagtgactctacactgtactgcccaaattagcaacctcagggaagaaaagagcataactacccaggaagtgggagaaggaattttgtttgaagagcacagcttgactccccgtgcatgggagagagagtggacatttcgagatagagggaacattatcaatcgtgccttgccatccatgcctggtgcacaggaaggactcacgctcagaagaattcattcataattctttctttctcttctcaaaaaatacaagtgaaaggggccaggcatggtggctcacgcctgtaatcccagcaatgtgggaggccaaggccagtgcttgcttgagcccaggagttcgagaccagcctggccaacatagtgaaaccccatctctacaaaaatacaaaaattagccaggcatggtggcgcatgcctgtaatcccatcactgtgggagctgaggcaggccgatcacttgaggtcaggagttcaagaccagcctggccaacatggtgaaccctgtctccactaaaaatcagctgggcgtggtggcggtgtgcggtgtggaggggccgtagtcccagctacttgggaggctgaggcaggagaatcgcttgaacctgggaaatggagatgcagtcagcagagatcacgccgctgcactccagcctgggtgacagagcgatactctgctcaaaaacacaacagaacaaaagcaagtgaaaggagtggatttctagtacctggttcgaggggcataggaggtatttgatcaatgcttgttaaatccatgtttgggggcaccacgatttctttctagtaataataaccactatagataagcacgtttagctttctcaaaaactatggataagtgctgatattaacccgttttacaggggaggaaaatgaagtacgcagcatttaataactttctcaaagtcattcaattcgtaagtggtggagctgggatttgaacccagggggtcggctcagtgtctatgattttctaatgacccccctaacaaacacaatacccaaagagtattctacttcctgctctgcacatttagggtgttttcttttactgcacaatttatatttttcaagcacttctggcttttgaaattcttcatattatgatatagtgacacctgtcactcccatgtctacttttgggcttgggagtgaacattcactgcagtgagcatgtggtgaaaaacaatatgttgaaaaactggctgggggatgggagaaaaggagaaaaggtgagaaatgtggataagcttccctgacccccagtttcctcattactagaaatgctagcgtgaggattggagaaaattcccagactaatgtcccaagtatactagatacttgaggtatggcaactgtactgttacaggagtgagatgattactagtattacttgttataggttgaatcatgtcccgaagaaatatgttcaagtcccaaccgccattgcctcagaatgtgacgttacttggaaatagacattaattagattggaatacagagttaaacagttaagatgcagtcagactggaatagggtagcccttaatccaatgtgaccagtgtcctgataacaaaggagaagagatccagaaacacacgggagaaggccgtgggaggacagacgcagaggtcagatagttgcagctgcaagccaggaacaccaagcgttgccactgaaccaccggaagcgagaggagcaaggagagttctctagagaggagcatggccctgtccacactgtggtctcagacgtctggcttctaggactgtgagatatattcctgttgtttgaagccctctaggctgtgcagtttgttacagcagccatgggaagacacactgaattattcctgttatcatctggctcatgtctcttctcagccaccccaaatagtcagcacagtcctggatgtatcctttaggaacatatgaccatctgtgtgaacacagagcccacagccacaggcagaaaacacccaacatcattttttgacaatacaggccatgtgaaaagacttcagaaaattctctgaatgtaccttctcaaggccagcagacatattaataataacacacacacacacgcatgcacacacacacacacacagacatggcatctgttctaaatgatgccttaccgtatttttcctaatatcaggcctcagatatctgagcactaaatttatctttttatagtacttcctagaaaacagatgagtcccttctcacactaggcagtgtccgatgattctaccctgagaaccacaccctctcgtttatcctcactctcatttctttcctgattcctttaacctgccaccttctctgctctcaagacaacacagaaggaaatctatgatgtcttgcacaggctctgccaaacgctcatcggcaggtgtttgacaaaaggccctccctgcatccgacaacccaagccgtgaaagacagacgcgcctgtctttgacatgagatctgtgcggcgactctcaatccgttctgaggctacctggatgacaaatggatcttggctggccaggggggcggaggtgtcacatctcctttaactaacaagtaatatgtccaaaagtaattgttaaagaaaaaattgtctcccagttagaaaatatggtcaaatacactttcaagtattacctctttttcccctcaaactgtaaataagtagaggtgagaagatgaactgcctgccaccaaagcggagatgggttgaaattttgttttttattgagactgcctctgctcttattgaagagaggcagttcctgtctggttcagggggcttcaccaggaaatgatgctatttgggactgtaagtccaatattctgaaactaggagaaaagaaaaacaacttttccctatatttcacagagggaagggcctctccccctcagccattctcaattcaatagttcagtaaaattcatccacagtttttctatctcaagacctctcaaatcacaaaaggaccagaaggtgagcgttaatcaaattattttgtgtttcctgatttttataaacagcataaatgtttcattgtcagtgctagggacagaccaacctcatccctctttaaaatgtaaaggagaatccctacagccaatgattatccaaaaagtaacacgttcttgattgttccttgactgattcctttttatcaccttcctctggagccactgtctcactgccaagagcatggggaaatcagaactaaattagctggaggaattaacacccaaattgccattggtgcctcctcttcaaactcctatcttggctatttgtcttcctagctcccactcttctgggaaaggtggaaaattctcagggtcagatatgaatcaccacgggggggagacttcaccaaggctggatgccatattgaccctcaggagaggcaggtacaggctgcactacagggctggagcttggagagttgcagagtgggtgcacaacaccagagtcagaggagggtcagggaaagatgctaaaatccaagtggacaagagtttgtcttgtgcttttggtcgtctgcagcaaagacaacagaaacatacaaggcgtggaaattggtggtctggtgaatttcttacatggtgactgattattccaggtctctgcccccatggacacactttgttcctacagcattgccactgtctgtcacagtgatgggtgttcaaaagcatttgttgaataaatgaatgtaggctctttgtgcaaagaaaattggactcttctgtgtggactctacaaactaatagttacactgttactatagactgttacactaactgcatctgactcaatgaatttgaattagtaattcaacagttctgagcatttgggggagggtttaatttacaatccattcagaagattttcagtgattgtgctggcaattgctgccacttttccccattttgagtccttttgacaatgtcatgcttgcctcctccagcaaaagcactaataaaggagagttataaagatgcagtcacgaggtgaggagagttgagaaagtgacaagggcaaaggcaagcacgacaccaaagcgtgtttcttctggagtcatctgagtggcaggtctcgaagctctaagtatagagaccagagcaggagaaaaggactgagtgacagtgttagtgtgatgcagagataagaatacaaatttgggagcacagaacctttggttcaaattccagctctgggacctagggcagatgatttaacttttgtgcctccattttctcatctgtagagtgggtgcaatagtagaaaccacctccgtaggtatgggtattaaatgggctgaaacatgcagagttcacacatagttatttgatacatttgtttaataattattattgccacttagtatgttattaagtataaggaacacactgatttactccagcactggagagggagagtaagaatacagtaaattagcacaatgattatggttggatgcaattcagagacacagaaaaaaataaaatgtgtatcttccaaaagcagaaataagacattaatctctttgagcctaagcttttatgtctgctcacagggcagttctgaacgtcatctggctagcatttcatagcacggtggctgacaaaatgcatcttcttttcttgtgtccctccccctctcatttttttccttctgggaggacaaagactagaaggttgaaggtgctatgcaagctcacagggagccttgaccttgtacctacattaggtttgcaagaaaaggaaaagagtctgctggtcagccacagacagtgggcaaggctagccctgcctcatggtgcctgccacctgcctgctcacgccttctcccctcggcttgggtcttcccggtgtggttccacctgcatgaagccagcagtggagtacccatagtgggttgccagagaagagcaccccaacatggaagacggaggggtgacccctcctgaaatatgtgtgtcagacgagggccaccactatgctgacccgctagtacatgtctttaccttcttagtcctgctgccttaaaagagctccctcagcctacttctgaggatgctcatcagcccagaaggcttttgttaaatatgtctttgcctagctggaatacggaaaacagaaacacacccacccacatatatttctgtaacacacacacagtgctcgtctgtgccaggcacgaagtgtctcagaaatagtgactcatttactcctcataacaaaacttgcagtaaaaactataattatcccatatttatagtaaaataaaggcataaagaggttaaaacttgcccggtgtcacaagcttgcaagaggaggggtcaggatttgaacccaggccttcgactccagaatcttggcttttaaacaccctgatattctactttaaaagcacaaataacccaccaaccccattataacaggccccgctaattactttccctccttctgatcccttccaacccagtgaagaatcactgcattctcagagagttcttacaccaaaagcccataaacaaagtggcacatatttagataacatatattaacgggataaggaaaaatatagatgtgaatatcagaccaagggctgacatgttaaaaagggaagtagggagacacaaaaggcatttccggtcttttgatgacaacatggcgctggtatatcatggggcagggccaggaatcctggatacccacagtgtgcagtacaaagacgtgtacagccccagatgctaatggtgcctgagtcaggtgcacagggcatgacctgaagatgaaaacgaaccaccagaaagaacaagagtccctcccttccaccgagaagtaatgctctaatgtctccagctggctggtgtgagcaggaatcatccttgggtagggtggggatgttggaaggttcccctgcggtacccttcagcacacgataacctgctgctgcagaatccacaaactgccccgggattgtcagaaggttcactaatgagctgtgggaggctggataaagctttcaaacgaatgatgtttgtaaaattatattaataacaatgcttatcccagtggggaacagaattattcctagggtttatgctgtggtttgtaaaatgctacgctgcaaatggatgaaacatgcagcctaaacctgcagtgggattgtttgcaggctgagattaaaagacctctccatttgtgacctccgacccagtaattccacttctagaactccaagatgtcaaaagaaggaaaaagagccatgcagaaagatgttcatctcagcattatttatcaagcaaagaactggataccacccaaaggctgagtaataagggggatgttaagcaaactttgtacaactatatgatgaagtgcttccagccaattaaaaaaaaaacccctaccaagagtttcaacaatacgaggaaatcgttctgcatagtgttaagtaaaaccacaggatacaaaatttgtcacctgacctttgactcagaaatcccatctgtcctacaaaattaaaaccagcagtaataataacatatattgctgtagtattcataagggctaaaacaacaataatatcaaaattaaaagaaatggaatgcccataaacagaggaatgattgatttaattagggctactccacacacagagcagtatgcaagcatttttaaaaatttttgtttgatctatacgtgttccgtattcttgaccaaataaagcaagttttaaaataatggacaaaatattacgctattaagtcactacattccactcctatagtgcatgtataatctgcatgtttgcacggtcacagaaggtccaaattgccacttagcaaagggaagaggtagagcataaattacgagcgttttcttcttattattcatattgtttgacttatttaaatgagcatgtattaacttaataatgtaaaaaatcaatacgctaaaaaatcagacatacaatatgatctcaactgtattaaaatgcatgtgcctgaatagggaaaaagaccagacacaaatgtccttgtatgtagcagtggttattattaagtttggaattagaaacagtagcaattttgtcaaggtttcttgcattttcctagtttttcatttgtatatctatattaggtttctattcagagtggataaatggattgatgaatggatggaggatggatagatgaatagatatacacagacagatagacagggagacaagaaaggaatgagaaatggagggagggagggagaaagagagagagaagagagagaaagaagaagagaaaaaaaagaagcaaattaagcaattgaatgaatgactgaccttccttttctctttccacttctcagggtttctaaggttcctatttccccaattcctcctgcccctatctccttcccacattgagggtccacaaggaggctcacgaagacacacagctgagcctggttacagaggcagcacatcaccaccccaggctttatgtccattttataatgggtgaaaccctctggaattaatattgatgaagaaataaacctgttaacggatagatttatagtattcaaatcactattgatccttcagtacacaactaataaaaagcttccttgcgtgaccttccaccttgtgcacacttaacaaattatctgtaataaacaagtattataaggacccaaggaaaatgtcagcctataaatactgatctctctctctctccttctttgtctggaactagaagttaggcaccagcgtcgtttgatgtacccgtgaccaagactctggattccccagagtctcttctaacatagcaaagatctttcttgttgaactgggcaaaagtgcacaatagaatctctcaaaaagcaactcagtggaacctcaagacaacaaccatcttctatgggataaggggaaaaaaaaaacctggtctaggatccagtaacatggacttaagtcttgtatgtaaacttcatcacctgtgtgtccttggacagtcacttcacatctatgctgtaattccaacctaaatcaaatgtgttcatagggtacttgactcatttggttaagttccatgacagctgctgaaatgtttaaaaacagcttatacatcccattacacatcccaaggagttaagggattcaaggttgagatctttcagtcctttcccatcaaacatctactggattcactgagcctggccatacccaactaaagaaggatctggtaagaaagatcaggtaatagatttccagtggctcaaatacaatggaagggaagctctgctcccatggtcactcaaggaaccagccagaagctacattgctttccacacctagattctaacacattctgaatgttgccttcattttagctaggctgaaggaaaaacaaaaacaaaagcatgaggattgcatgtttgcaggttttcccttggttcggactggagctgccaggcgtcacatatgcattagttaggattccattagttggtcaggcattactgctggggagggtggaaagtgacccaagaagtctgcctaggaataaggcgtgatttgctaagagtacctctcatggctggttcagaggaaacataaaaatggaaaaatgttgtaatcggtttttatgttcattcaccacctggtccaagtcaagtaagcattgcttacctggcatttagacacgttgttttacatctcgagtttaatgctacacttttggaagacaggacttttaattatgtcccttccaggttttggagtttaaatgagatgatgagtttctggtagttcccccatgtgtccttagcaggaccttgtcccctaactcttgacctccaggctcacagaatattgctgaggcagggccaggtttagacagtagactgattcttctcactgctgcatttaccttgcaggagtatgataaactcacattccctagaaggtcctgcatagtcaatgggaaatataatactcagtcttctaactaaacgctctctgtgccaccatgaagttatttcttaagtgaagtacttcaagatatattaaacaaaaaaattgtttctattattcaaaagaaagcaaagaggaaaaaaattgtagttggaaacgtcataaaattagtcgaccaaacgtttttggtaatattctcccatccaggaagagcattggtaggcacatcccatacctttggaagacaagagctacttaaaaatggactacggattctcgaagattggagagatgaaatttttaatatgtaaaacaggaatcaggctgggtgtggtgctctcaactgtaattctagcactttgagaggtcgaggcgggaggatcacttgagctcagagtttgagaccagcctggacaacacagtgagaccttgtctctacaaaaaatttagaaattagccaggcatggtggtgctcacctgtcatccagctactcgggtggctaaggcaagaaactgcttgatcccaggaggttgaagctgtagtgagctgtgaccgcaccactgcactccacctgggtgacacagtgagaccctatctcaatcaataatattaactaattaataaaacaggatcagcaaactgcagcccatgggtcaaatcctgcccactgttttttgttttttgtaaaaaaactattagcaaatagtcacttgttcatttgtgtattgtccatggttgttttgcacttgatagtgctatggtctgaaggtttgcatcctcaaaaaattcaagcgttgaaaaggaattccaatgtgataatattagaagatagggcctttgaaaggtgattagatcacaagagtggtttgtgcctttctaaaagaagccccagagagctgctttatcccctcccactaagttgaccagcaagaagtcatcatctatgagccagggaacgagccctcaacagaagctgaatctgcgttgctttgctcttggacttcccaggctccagaactttaagaattacatttctgttattataagctacctagtttatggtatctgttatagcagcctgaacaaagtaaggaaaatggtacatttagtacttttgacacaggccctatggtccacaaagcctaaaatatttactatcttcccttttcagaaagtctgctgaccctttttgtaaaagaataagtaaggctgggactacgaatatggctcaaatgtaagtgccaagcatgagccagaactgaacacacattgagaaacttagtccaaataaagtgggttttcagctgatgctcccacttttttcccccactccatcaccattttcaaataaaagagccggtgaattgattagagacaagagaattattgaaagctgaaggagagggatttgagggatctgtaatgaccccataaaagctttgttgggttgctttttgagcctgaccataagaggttagcggaagtgtgtaaaagccttgccttttggataaatgatatccaaacccagccacggagggagagtggaaaaaagggaaataaatgacaagtacagactttaacagggaaaatttcctccgaaacgaagcgagcaatgaggccaggcgaggaataatggtgtagaaatgacagtcgcttttcagtcggccacaacggcactcgcggctgataagtccagcatgtgtcagttgccacgtctctcttttcacacttcaatgtgaacttcacagcaaaggggaaccggaggcagcgaaggggaaaacagtgcctcagaaggacttgtgcactgaggtgaagccatttcaattttatattcgaaaggactttgtaggtgatcccatgaatgcaatatgcccacctaataaaagcaacatatgctaagacaattaaaagattttattatacatctttcattgtactccattttcagcaggaggggtggaaactgatgagagggaaagggtgcattcacaggaaggggagccaaagtcggcctggattatgccagtggggaaataaatggatgagatatacttttcaaataaagatgaattactatattactcttttccaggggtcttttcgcttacaaatgccaaggctcaggtttcctatgactctatattatgagaaaatacagctgaaataccactatgcctccttaaagccctcggtgttttgtattcaatcacaaaatgaagaccccaaactatgccagaaagaaaaagacatgtccgtagattcaaagtttaatgacatgaagcacacagacatcagtttaactttctcacatccatacattctatgtatatttatcagggacaaagagaagactcaagtttataccagagactggagatgctaatggggagaaaactgtggtatcctcaagtagctcctgtgacagactgccagcttcttaacaaaaatccatttgctctcttcctgagcaaagggctagaggatatttgacatcctacttttcagtgggagatagcctgtgactagtgcttaccaatagaatgaggttaaggctggtaagaaataccagatgactgatgcagatatcagcagggagaatggaaccactaagtgtctgcagcctggatccctgagtactttgtggaacgtagctgccattggccaggactacccacttatgttgctttctgtgttgaaatccccctttgggggtttcagctataatgcattttgggggctatttcttactgtagtcagcctatcctaactaatacatttgcaacacaggtgtgcaaacaatccatataggggtacttcaaactgtaacagctgctctaatgtgcagcttagggaatggagacaaagggaaaaccagtttcatagagcaggtaacatttctgctaaaattcaaaggcatgaagctaaggaattgacaggcaagggtggaggcaggaatggaactcaggtagagattacagcatgaccaaaactcagaggtgtgaaaggatgtggctgttagtgcaatcatgagtaattaggggagtgggggcaggatgtgtgggaggaaggagtgagacaaaaagggcacattgggaccaaacagagttgagctcccatgggaatgtgtaagtcgtatgagtaactctgaaaggatcttttttgttaacatcggtgccaggacacagaacaggcacacaggcctgcctctaatgctaacatccttcacagaatcagagcacgtcctcatcacagctgagttagacacagtccatggaaggtcaggaccctatgaactacctacattttccactccctgggattctttcacccaggaatgaagatcaaacaaggacaagtgagaaatctacctagtaatatccacggagctaatcacagacacagttgtcacgtgattcctgctaaagagagtcagactgaccagagccacagctttgtggccgcctggtggccatgtgtaaacatgaacaaagctcatccaaaatatatttaaaacccacaccagaagtcttagataccttacagtaagtgaaaaggtctgtctttaagctccagagtataaggctttcttatgttgaataaagttggatttcaaactgatctgtaacatttcatcactggaagcacttcagcaattttcaaatgccttcgttcaattcaagcaactagaatgaggcatttaaaaattagcgccattaaggcagagttgttcaacttttatggggtcatagctagaccagtaggttgccccaaatcccaaacactagagaagtgatctgcacagttgatgtggttgtctggcagagattggtgggataatgagagggaggttagaagttaataagacacggtatgcgagggagagaacgcgtgcatgttgatataagacacatccaggtaagaataccaagtcctagggttactgctaatattagatggaatacattttgcaaaatgacaaccatttatgcaagtggcatctagtaaaggctcaataagtgaagctactttattcatcatctttttactcttattagtattaatatttctgttaaagttatcaaatatatacttattagcttctaaaattaacatgagtactgctcactcatattctaaaagaaccatctaggcttcatttcacctcagtgttagggcggacatagaaattcactggacatcagtccctcttaatttttgtttttgagatgagtttcactcttgttgcccaggctggagtgcaatggtgcgatctcggctcactgaaactctgtctcccaggttcaagtgattttcctgcctcaggcccagagtagctgggattatagcatgcgccaccacgcctggctaatttttgtatttttagtagagacggggtttcactatgtggtcaagctaatctcaaactcctgacctcaggtgatccacctgcctcagcctcccaaaagctgggattacaggcgtgagccaccacacccggctagtcccttcttaatcttgaaggattgctgtaacttgtctggccaaggcactaattattgtatttgggggaaaagataattttcagtaactgcctgacaggtaaggaaacagaaacaaagtgtacagcattggtggccaagagcatttgccactgaaaactgggctgagggaagcttgctttatcaacctgtctacaatactgtcccggtatcgtcactaacctgcctctcaggacctttcactctacaaagccatgggaccaagccctcacaagatcaaggtcaaataaacattctgactgtatgtgagcaccacttaaattgcgtatcttgaaaatacagtatcctgccagtttataagctgccacagatttcactgggaggcattttaagttagacattttcaaattctaaaggctgtgcaacacattaaacacttgaaaagtgaaaaaaagtatctatgtagataatatatcacccaccgtcctctcccccaccatctttcttttaatatagttctagtcagagagtatctctcattttgaaccccacttttcattaaaccttttatcataagtattttttccaactgtcattttattttagtggctaccagtattccattaagtgaatatactatgatttatggaatcattcacctgctgttgaacctcaggttgattctaaggtttcactaggtgggttttttttttttcttcaaatttttcaagaaaaggctttatttgataggaaatagttatttccagtggctttgactgtgagtgttgtgactacagtctctttttgtgtggctgaagacttatcaagggaaactgcttctcaggccatcgaagccaccagttcaactgcttgcttagaaccacagtgagcttctggtcccagtctctgctgtttgctcacttgggtcatgcacgtgggtgtgtgaaagagacccatgtgggccatccaagaatcacatatctgcaccaatgggttactgagttgtaccccaaacatacaaagtgttttacgtctctaagatggcacatggcacatggcacatggacatgcagggttcccttcctgggaatgtgccactctcacacccctcaggaggcccaggaggggagcaggtgatgtgaaccaaagggttcactctgcagtgacgtagatgcctatggacacaggcccagagacatgggcaacatgtgtgtcaaatgtgattaacaatggattttatgttgggaaagattcttctgcagaaatcctggaggtctttccaatgcaatgaaatggattcacagaggcatttatttacttattagagatggggtcttgctctgtcacacagcctggagtgcagtggcaccatcatggttcatgcagccttgacgtcccaggctcaagcaatcttcctgcctcagccccctgagtagctggactacaggcgcacaccactacacctggcatttttttttttttctttttgcaggtagtcttattgccctgactggtctcaaacttctaggctcaagtgatcctctcatcttggcctcccgagtgctggaattacaggcgtgagccaccataactggccgtgaaggcatttaggttacattttatatttccatggcctttttacacacacacatacgtgcgcgtgcacacaaacaaaaaacacctcacagtttgtctttgccattggtagtgagatcaccagattccgagggagggcaaaacacactcctaaagaggctccacaggttctttcccagagtagacatgctggatgcattcatgcagccactcagtgaggaggagcaaacatttatgtagggcctactctgagccagcacagggctcgggactacaggtaccaagataagtggttgctgctcttgagtttgcagccagagcagaaacacaaggcattgaagtgactcagatacaggtttaaaagggctgcctgcttgaaatcatggatctttgaccaaatctgaagtccgcgcttcctgcacgaaagcagctgctttaatacattcctacgtgccaagtgccatgcaaagctgtgggatatacacagttcctgtccctaaggctcagtgccaagtggggaaataaaacaagggcattattttggatataattaggaaatgagagaagttcatggggcgtacaactaaccaccaggaacccaagaaaatgtattcctggcctccacctgctacatggtgacagaggacagtcacgtgctaacacaggggagatcccaacttgccctcgctccacaggcttctgcaggagctccgtgttcctgagagtcagatgacctgtctgactcatggcaaactgccaactgcatctgaaacccaagcttatgcgtaatcgaaatgcaggaagccatcttaaaaggatgcactaattagcttcctgggatttcagatttaaaagcttctgtgatcatatttgttttggtaatttttttttttattgaaaaggattcgaagattgattctgctgtcaggacatcagaaaacaaaacaaacaaaaaataagacaataactttactcgtttccatagcgaagtgctttcaacgtgaatgaagaaagaacatctgctattggatgataaaaaagcaaaatggcattaaaaggccatgatgcacagtgaagaaccagctcccttgggtggctggactcaacactgagatactcttgaagagcatttgtaagcccacgtgaaatcagcacccactgttaggggacctgggggctaccattcttatttcaaattaaacagcagcaaaaaaggaatgtttaaattctgggtagcaaactgatgtgaaagatcacaccacaaaaaacttcttataaaccaccaaccactgttttcattaaaaatggagagagctaatatggaaagggtgtatatgataattatatttgttcagtgtgggaaataaataacaactatgtgctacactattaagagagtatgtaatcatgttattagatatgtcctataattgaaagcattatcagaatacttccttatagagttaattcctcctctgagcaacccctaaacctcgctacattttccccgggtgtccctatgttgtaattatctgtcgctatgtgtgtctcccaatcagtgtgtgatatccaaggcaactcctgcaagcattccatccctctcactctcacgtgctagcactgggtcagcaaataatcaccactgaataaacatagttcctcttaaagttcactctctaggctgactaatcctttggtctattcttggaaacatttcccaacatctcacattttcttagattggggagtgtgcatgcaggaatatttagataagtcaatgtattaaaaattgtaggcaaggcactaataatcagcacacaggaatccacgaaggtttggccaaagttgataagaatcacgagctatcaccctcaaacctggaaagacctcatctcctgcttaaatttcttaaaaaaggatgaccttgcaaattacctccttgtaaatgtaacttctaaatttagaaactacagaaaaagaaaaaaaaatcatgaattgagcttgcaacatcttaaagagcgcatttatgtaaaaaaaaatagaagtaactcttgactgtgaaagtgagttccattttttaatttgttggtttaagtaaaaaatttttattttctacaatagaatcaagcaatcatttgctcctaggaagtaatttacagtcagatttcattttcttaatctggcataatttagggtatgaaactattgatttatgagagtggtaccatttttaatccaaagataacattaagtggtcttaacattgtattgcaggatgctccctataagaaaatgtattaggaggcaaaagaggaaagtgctctggagtcagacctgggtcaaattccatctttgctacttcctagctgggggaccttgcaagatcacgtagcttctctgatcctctatttcctcaactataaattggagatgacactatagttttgtggtgaggattaaatgagatgatgtttgtaaggagaaatgtgcaaaaggaactaggacattctaccgggaatcatttccactggaaaaacatggttagactgggttattgaggacatgatagcaacttttccagagatgatgaaaaatactcctgtattttcaccagacagttaggagatcctaacttgtttgagctggttggcgctcattataaaatctccttttaggggggtaatgaaggtgtcctaaagattgcaatgccctgcaggagagcacccaagcctggtaacagagccagttctgctgagccactgtgcatggccatcaacatagagggttgttttttccatcttgatttctgggcccatcaagcccgctgtaagaacttccctgcaatacagcaattcaaaccagacttttcccactatttagagtcaggaaaaacgtctggggaggaaaagggtgtccctagagtgacaaaaggaggctgtggcaaggttgggcactggcgatcccagccatctgcccacccacccatttggcaggtccattctaaactgcaatttgtcttggacaacctacttcctagttgttggttagggcttgtgccatcatttctgtctttagctatttgtgtgaagaggaagcacattctcaaaattcctcttccccatccttgattctgggtgctggggactttccctggctttaaaaggacagccaggaggtggctgaaaggaaatgcaaaaaaggcttacagcccagcttttaagaattccaagaatagtgctcagtgagaccctctgcagctgcagggagcactgcatttctccaagttcctccaacttgcagatgaagacgtgacaggcagccacgcgttgttgtggtttatgcagtcatggccctctggggcttgatcttgtgatcaaagtccttgtgctttctaacacatcacaagtctcagacatttgatgtgctaaaaacaaactactgtcagagtcagaaaaacctggagccaaatgcccctgtctctgaaatgggagactttggacatttatttaatgtttcaagtcttggtttcctcctctctaccatgggccaaatttgttgactttcagaattgtgaagtggaggattaagtgggatcatgtttataaaacagctagcacacgcttgcccgtattaatttgtatctaatagattctccataactttcactttaaaggggtgaaagatttttaaggaagctccggaatcaagatttttacagtgggccagttttcaaagtgaatagtttgtataaggaaaacctttaactttctaaagggatttttcccatgcaaaagtttttgttttaaaaaatgttaaggaactcgaggccacagctgatggaggtgtggagagagtgattctggtctcaactggatctcagctggatacaaacaagctccgggatcttgggaaactgaatgactttcctgggacttggtttacccctcccccttgcccagctttcctcctcttcctgaggggcttcacaaaagccaggtaagagcctagaggtgaaagtacctggaaattctagcgacaagtgtagatggcataattatcactctcttgcctccctccacatttctaggcccccattgtcccttcctgggtaatatggagcttcagaggtgtgggcagggaggcggggagagctgaaataacagggactggatgcctgccagatatttcagttgcacatgcacaacttgagaagtccctgggggttgattatagttacctgagaacactccttaactctttctgcagaaagaacttaatgaaaagcctagtgccttagaacacatccagaagtattaaaagcagagatttctgtaaaatggtacaggcagccactgtggatagcagtttgtcagttcatcaaaaagttaacctagactgatcatatgacccagcaattccacccctaagtatatacccaagaaaagtagaacatgtccacacagaaacttgtatacaaatgtttatggcaacacaagtcattatactagaaggcggaaacaacccaaatgtccatcaatggatgaacagataaacaagatgtggttatccatgcagtggaatactatgcagccataaaaaagaataaagtactgacacatgccaaacttagacaagccttggaaacagcatgctaagtgaacggagctagacacaaaaggtcaatattctttgattccttttatgtggtatacccagaataggcaaatccacagagaccaaagcagagaagttggaagaagggaatggggcagtgatgactttatgtgtatgcttttctgggtgatgacaaagttttgaaactaaaaagaggtgacggtggcataacactgagttcactaatgccactgaagtgtacactttaaaatggttaactgtatattacgtgaatttcatctcactaaaacaatgtttgcagggaaacgaaacaaaacaaggatacaagggtttttgaagtcatgtggcctgaatttgaatctcatctctgtcttatttgacttggataaccttgggcaagtacttgggcactgtgggcattcgcttcgctgccttaagctgatgggaattacgatgcgtgaggccatggagcattccaggagactctggaagcaaaacatctagtgcaggtcagtgcatatggacacaccagagatgccagctccttacctcccattccttcactaaatgtctccctgctccaaggtcagagccatctgagccctcagtgtcatggagggaaactacacactacagaaaaaaccaaatactaagaataatataataatcacacttatactcaccactcagaagttatagcattttggaattgttagcattttgtcatatttgcttctttgctaattttttaaaatgtgaaataaaatatttctgatggccgggcatggtggttcatgcctgttatcccagcatttgggaggccgaggtgggtggattgctcgagcacatgagttccagatcagcttggccaactggcaaaaccccgtctctaataaaatacaaaaaaattagccggccgtggtagcacacactgtaatcacagctactcaggaggctgacgcatgagaattgtttgaacctgggaggtggagttgcagagagtagagatcaggccatgcactccagcctggatgacacagcaaggctctgctcaaaaaaaaataattattatatatatgatgaagttgaaatttaccgagtgttgtatattagcttaatgtctcttctgaacaaataagcaagttcactaaagaattaatacatggaaaatagtttatttgttcaactggtctttattcagggcctactattaacaagatatatactaagaatgcaaacacagtgttaaagagcttcattgtaatgaataatctgagcaggtgctgaagtggtagttcagcggtcttgagggacagtagtcaccatgtgccttggttagctcatttattaaatgaaattggtagtttgcttcctaaacttggattgcagttaaccagcacaactgaaaaataagtctacctgacatagtcaattcaattgttagctacctaacaattgtgctgtaggaaatgttgaaaatgcggactactgcccgtatggtgtggttctgaactctcgttgaaaataggatggtctatgaaagtacacagtggctctgtgacaaaggagggaggatttatcttggaatgaactaaagaggaggcaaaagggaagaaaagctgcaaactaagaaggatttaaacacaatctttgtggtggaaataatgtaattccatcctcctgtgtcagagaaattaagcctggaaaagccctggctgaaacacccaggttgctgagttgggagtgaggggaatgaggggggaggcaactcagtgctctgcctccagaagtgattgaagtcaatttctttataatttatgttttcctaaaaacaagatgatttgtttgcactattaaaaaaagtcaagaatggactcggcaataccccaacttgtctgaagactacgctgggaggtaaagctggtctatgctgctggacgcagcctttttaaaggagatcactgtacctgaaatgcagatagttataaaaatgaattaatttgcttagaccgaaagattttcacaggagagcaactaccagaaaacattatgaaatgtctgagagggctggtaattgagttgattagtatgaccttggttatgaaggtaataaagagggacgggtgcttagactgagttataaccctgttcccggttcggcgaccgagtgaggatgtaatttgttcaggctgactcggagaagccaagcctgcctgtgacaaagtaatgcttgactagccgagcttggcctgtgcttttcaccctgacagagtaaacaggacagagtcaataagaaatcatggactgggtttgtgtgctacttctctgcgtaaaaccagctgtaggcaaatcttctggacaatgagtcctgagaagcacgctttcactgcctctgaactagcaaagaggaacagaatacaactgcaccccagctgaaacaacacaaaacaaaacaccaacataaacaagaataaacatcccaaggaggtctatgctgaatttgctctgattctatttttcgtattttttatagacatttatgaagcaatatgctaccggctgcagtgggaaatttagctgcattatcataagaaaggattccatgtctggctctaaagcccatgttgtttccacgacacctgctcaaacaggcaagtttccctctgtaacatatacgcacccatgtgtgcacacacacatgaattgacctccgcaatggcaaggtcattggatgccggaagccgttaccatgagtatatgagtcactagcgttgtaactacttctacaaaagttcatgtccagggagatttatctagttttttttttttttccttcgttttaatctgtgaagaccttccatatcaagtttaccctaggaagagatcttacatggaacgtaggataagtgatacttcagaaacaactatggtcctcccaagaccctcaaatagaggttaaaagtctatacataagggtgtggaacattttacacttacgtttatacatgaattagagagttgtactgggtgaataacaacagggtatctttatgcacctttgcctcttctctgtggtgtgtgggtttgcctggtttgtgtttgtgtgtgtatttgtggttttatgagtctccgatttcagggctggtgctacataaatgacaaagggccctgaatccttgtctccttgcctctgtcactgagtttgctgaccctctagtgaaaaggatctgaccccacatgcgagtggaataaattatcgctgacactccagtatttaattatgcagctgtcaagcggccctttcgaaattcattttaataaagtgggaactttccctttcaaggttagagtaggggagtcacctttggtgtcagccggaggtctccaccatgagctctgcattcttgctcggacgcctgtcacttggcctgatagaaggtcctgataacagcgctgatgcctggtggccccccccatccccccatccctgcctgaatgaacatccttcatttaaacccacaataatgagacctcaaagtcagagaggcgggcacaagggcagcctgtcggggaaaaaatggcttcttttataaaattcactcaatgtggaagtggcaatctaaaagcaatcatggccatctccccgtttaactggttaaccagcaacatttcacatggtggaaggaaaaaaacaaactctgagctagtggcgtggtagtggtggggcatccagacactggcaagcctcaattgctgtagctcccaacacgtcaaacagacatgaaagtattgatttatatttttctataaaataaaaagcagtttaaagtttttgtagccttgtttctgggccataaagtggcaccgaggaaaagcttttattggcaaactgaatgggtgaacgcgatcacgcctgcctattatgtatatgcctaaagtcttgtttagcttatacttctcactgtttatttgcaaaccatgcccacagacaccctgcagaggaaaaccgtgggctgggctagaaacggcagaagcaactcgacagatacagccagatcattccttttttttttttttttttccaattctcttccttactgttgctttcactttctctctttccccctctgaccttattctctctctctctttttttttttttgaggtggagttttgccgttgtccaggccagagtgcaatggcacgatctcagctcactgcaacctccgcctcccattccagtgattctcctgcctcagcctcaaaagtggctgggattacaggcatgcaccacttgccaggctaattttgtatgtttagtagagatggcgtttctccattttgggcaggctagcttgaactcctggcttcaggtgatccacccccttcggcctcccaaagtgctgggattacggtgtgagccaccatgcccggcctttctctaacatcatgatgaatatgcattgattactactgtgtgcaaggcactgtccaaagttttctgtatgcttatctcttatagagctcagagaacttcataaatgaggcgccttaatgacgattcctacttctactaaactgaggctcaggagactaatgggcttcctcaagaccccccagttagtacatagctccaccacgcagttttcatgcttggatgtttaaccaccctgctaatgtttatttcttttctctttctctggtctcttctcactaagcctattcctcactttcttccctcctcccaatctctccctcctaggtttgatacacagtgtctcccccagcatatataacagctccaagtaaacacacacaatgagccactcctgcacacaaatgtcgcttgtcaacaaacactggtttgacaaagaggcctcatccttgtgtttggataaatgcctgaaagaatacttgcatgtgactgttgaaaggcgctttctcaaaccataagcaataactaaatctatccataaggactttttctgggggacaacattctctcccagagatgggaaagatggttgctgagatgaattacagagcaacaggaggcagagagaacacctttgctttggcttagaagctctctgggaagacatggtttgcagaaggttggggaggacctccagatccacctgaagtctctactggctcccccagcacagcttccagggcagaaatttgcaggatgcccttttgtctcaattcttgagcctctgaatggggactcaggaagcggtgaacacaggaccttggcatgatctgttgagagcataaggatgaaagcagaagacaggtccaagggcaaactgtttgcatctcccaaggcctgatctttattgtcctgtccctaagtctccgccccaagggtatccctgtgtcttcagggctagaggtaactgaggccttccatactttctatgtttaccatcaatgttgcctactagaggaacaccagtggcatcaggacagtgagagtcagcatcctacctacggaatccagaagaagcccctaacttgaatcaggcaacagggacaagagagagtattacaacctgtgcacgtaactctggtctgcgtggccttaactcaaacttgcaaggcaggaaactgtactttgaagaagtaaattcctccttagagccccagatctgtcacagaggcagacttccgtgatgacttactgaaagaatggctgaacgaatgatcataccagcatctcatcaacccaaaggcaaatataaaaatatctcttgggccaagaaaaacttgtgcaaaaccaggcaccctttactcacaggtaggaacactcagtaaaaaatcaggaatgattcagggggtagccagtgaccaattcaataactacccgtaacttcaagctatccagaaaaggacagatctgggagacaggtgtcctggttctggtcctggccactgccaatttctgagacactctgtgtaggtggattcctatctccaggcttctcttggcctttccaaggctgggagggaaaattaaagcctcatatttcccctcaaagaaacaaatccaagacagtccaggaggtgacagaaaaagcatttcttaaagtgaaaaaatctcaaccacgtgaggtggctctgtctgtaatcccagcactttggcaggccaaggcgggtggattgcttgaggtcacgagttgagaccagcctggccaacatggtgaaaccccatctctactaaaaatacaaaaactagcgggcatggtggtgggtgtaatcccagctactcgggaagctgaggcaggggaatcgcttgatccgggagacagcagctacagtgagccaagatcacgccactgcactccagcctgggcatggaacaagaccctgtcctgaaaacaataaaaaataaaaagtgaaaaaacttagacatacttattcagaaacattttcatttcctctcttctctccttctctcccctactcctcctcttctttagtcagtattcatcgggtgcttattttatgtgtcaagcttatgctgtggactttcatttcatccttaacaacaaccttaggtgggatgaagggagtacaatgacgtccatcctgagataagctgaggcttaggaggtgaggagccagcacaaggtcatttagctgggaaaagcagagggaggatttgaaaccaccttcacttgcctgtgtgcactcaaatgtcatgtcatattttaccaaatatattggtacttgtctttgccttctatcctggaagtgagtccagaattccttatctaatccatggcaaacctatttcatgaggtctgtgttaaacaatacctagagggtttgtgcggaaaagtgatctcctatatcagcagtgttgccatagtcagagtaatggaattgtagtataatcccagcaacattattgaaccaaacaaggtgccaggaaacgtgctacatatatatagcatgtatacacatatatgtacatatgtgtatcagaatatatgtattgtattgtatatgtatatgtgtatgtacacaatttatgtatgtgtgcgtgtatacgtacacacagcatctatacatgtctacatatacacagaacatatacatatatgtacacacagacatataatgcacaaatcacatttttttctctaatctgcaccattactactgttcccattttatcctaaatcgatggaattcagctaagtatctgccaagattgtatgggacgtgatcagtgagcgagtgtgggctgcagatctgcttgacccatagctcttcaaaaaaagaataaatgaaataaataaaacaaaataaaatgcatccataatgcctccacttcacctcagaatttatatgaactttcaagtaggttacatcattgtatttaatccttagagcagtcctatgatcggctctattgatattaatatcgagggttcatctgatctctgttttacagatgatgagatcaaggacctgaggtgctgtgatttgtctaggggaatgcaggtgacagtaggtggagccgggactagtagcaaccctccacctcccgcttggtgccacacccactgtgttgcatggagtctatctccttctttctcacgaaatagtctgccttgcttggtggctctgtggaccagggatgtctaacatcaaaacactcttcccataggagctctcacaactgacagctcccatcttgaacaaaagaccagtgttcatttggatgttctcggcctcacgtggcacccactccaacggcttcttccgagtgaatttagacaatgtgcttgatgccagcactctcactgcaaatgggaacagatcacagagcacccagcagcagacatttgtcaggaattttgcagtcagaaataatgacgggcaaagtcagccccaaatcccaaagccccctaggtatgaatcccggtgctttcacctgggagggttgggagtcagatcacccctccaaatgaagatcctcttcaaagaggaggtgcggctacaccccaagctgacaagcccaggctagaaggcgagaatggagaaataaatcctgactaactagaaggattagaaagtcacctagcatgaggagaattcgcactccacaaatttttccgactgagtaaatttgaagaaataaaactagattgagcatgcgtttaatactgcctgcttctttccccctgttctgctcagtggcttgttaaatatgaaaagatttgtcctgcaagggacacggggagagacaatctctgggggactcatcagctaccctgagcctcctctttgtaaccaggtaagaaagagagcattttccaattccagcatctgagtgccctggtcttgtgtacagtctcaaatataatcagtggtataacaaccgtctcccagtagaaggtgtgatataaaggctcattcgagatgccaggagcttccctttctgaccctggctgcctgagaggcaaattgattagaaaatgacatgccattcatctagccagtacttgcaggaacatttagctaattaatgattaataaatttaacactgctttataatttcatttagctgtgttggaaatcacacgggagctgcgtatgcaccgaatgagattaggtgggagtgagggtttcagaggctgccctggaattgagattagtctattactacagtgacctttttaacttttatattctcttgttaaaggaaataaaattttattcacttttaaggcatatttacttagagaaatttacatgaaattaagaaacaccaagcccagaagcctactggggctggaatccatgcactatttctttcgtaatttcagagctgctttaggaaattgttcttgagttggctgcaggcagagtgaagagcaattggtttttacactgttctttcatctattcaataaatgtcacgttcctggtgtgtcctggcactgttgtaggaactgggactacagcagtgaaaatgacctaggtccttgttgtcacaacttgagttctagtgggaaaatacagatgacaagcaaatgaataaacaacaaaataaacggagtgagaagcacagtgctgagaactggaggaggtggcttctttagactggagagttaaaaaaatctgtctgtaaaggcgacaattaatctgagatctgacttacaaaaagcaatcagtgtgcaaagctggggaggatagcaggtggggacagagaggctgaaggtgaaggccctgagcgggaatgcaggaacttggtgtgttcaaggaattgaaagaacagggaggcgtgaagtgtccagcatatgtggaaagggtcagattaagcaagcccctgctgacaggataaggagttgatttgtaagtgtggtgggaagccatgaaggggtttaaagcagagttaaacgccatccgcgggtgattccatctaaagcaagtgatcctgcagctgcaattcagaatggtgttaaagccgacttggtttcccttaccttcagtctcctgtccaacgtgtgatttttccacctgaaaacctatttgctagtcttgtttctctgtctttttcttgaaatgtggttctttgtttgttccagtattttgaaaatgtttctgatcatctcctccttaatagttcttcccggccaattttttctcacctcatctatgaaatcccaacatatatatttttaaacttccagaggtctctgtctcttctctcttgtgggaaccatgctgtttcttttctgtcctcccatgctttgacatctggatctcccctcccagggtcaataaattcctagaggcagcaaacaactcacttgggggcacccttttgaatgcaacccaaccaatccagaacttacaccccaccacctcctttatttctctgccccaggccaccatccaccctttctaatcacccagggccaggtaccagaaaaataggacagcccctcttccccagagcctgctgaacttactcaaaccctagtctacttaccctgctcgttcagtcctccccacagaacccacggtttgaccctctccctctgcctcttgaccagcctggtgcctccccatgtccctccactctgacatagcatgtccccttcccttgcaaacttaaaggacacagatcacaatcatcacaactctcacaaactgtcttttcagtggtcattgctcctgatctgctggtcttagcatacctaaataataataaaacctgtattttaaaacattccagatagccagtttcatcgtgcaccaaataataaaaactactgattactgaggttccctacatgccaaatgccttagagatgtgattgacttcaacctattctagttcaaccttccttacacaaccctgcaaagaaggtatggttttgtggtttctttcttttttttttttttggcattgtataaatgaaaaaactgagacacagtttatgagacttgaccaaggctcactgtttctaactgtgagagctaagagtgaagcccagaatagagatggtatagttcttaaaatcaaaaaagatcagttttcttgctactaaaatgaactaaaggccaccacttcctgacagactttgaatgctcttgttttgtctttttggctcatccagccaaactggtttggaattcatagcacaatttcttgctcactttttctcttctccctgctttgcctagtgtatcatcaggaattttctacagaattactctgtttttcctaatactttctctcaagttaatataagtacaaaaaaatgtctaaaggaatggccagggccattttaccatgtgccctgtgccattcttctacacaagggccagttcttcagggtatctgcaacaatcatcaaagaacctcattcttctgatataattcacatattgtaaatctacatattcgacatgaaaagtttttctgttagttgttattttgttttttctttccttcagcctgtagagaagatgaaataaaaggtcttctttcagcagtgtttaaactacagtagtttcaatttcaggtaattatgcatacatcatacatcccttgatattcttaagactttgaacacaggcccccacccccctcttaaatttgaaatcctgtgtacctgctgtaaaccctaaaatctgtgagcaattacctctgtaagcagtgtttctggaaataacagctgtgtgtgcttcacaatttttttttaacttgttaattgtctggtttttaacctgactactaatcttctgaagcttaagaattcctaattttccttccaacaccttctactggtgtggcaaatttgaacccacctgtgtaatattttctgcctttaaaaactgcaattgtgctgggagcggtggctcacgcctgttatcccagcactttgggaggctgaggcgggtgaacacttgaggtcaggagttcgagaatagcttgagcagcatggcaaaaccccatctctacaaatgcacaaaaattagccaagtgtgttggtgcgcacctgggtcttagctattctggaggtgacgtgggaggattgcttgagcccaggatgcaaaggttgcagtgagctgaaattgtacactgcactccagcctgggcaacagagtgagaccttgtctcaaagaaacgaacaacctccattgctagacctacagacaatcacattagcactgttagtagtaacagatgggcctatgatagtgagactgtgcaaattccagtcgttgaagaggtggtggtgacctgtctgatttcctgaaattgtaaactaactatttttctcttttaatagtgaaatgactaagtgagttatgaggcttaggtgctttaagtatttccttcatcttcattcgatgtttagaaatcaacagagagcttgtacctagattaaaaaaaaaacaactggaattcctcctccctccctttctccttctatatgtattagtcctctataaacctgacaccatgctaggcaccactggtataagacaaggaaaaaaaaactctggctttttgcataatcctttctattcaaaatgcgatccatggatttcagcctgttaggagcttcttaggaatgtagaattgaggcccctccctgacctcctataccaaatctgcactttgtacacaatcccccaagcaattcatgcgcactgtatcattgagtaaagccctgctggagatgagggattggctctctatgtcaacttggccaaatccagccaacatgtagtttttcctgctgtttttttatggtctacgatctaaaagtgatttctacatttaaaatgattacattttaaatgctatatgaatacctacataataacctcaattttgtctctagacttcaaagtctaaaatattttactctctgcccacccccccaccttttttgttgttttgttgaaacagagtctccctctgtcgccaggctggagtgcaatggcgtgatctcagctactgcaacctcttcctccctggttcaagtgattctcctgcctcggcctcccgagtagctgaactacaggcacacgccaccatgcccagctaatttttgtatttttaggagagatggggttcaccatgttggccagaatggtttccatctcttgacttcatgatctgcctgcctcggctcccaaagtgctgggattacaggcgtgagccaccattcccggcttgccttcttaagcaaagcttgccagtgcctgctgtagaatctagaagaatctagaaccctaagtctgggtgaagcacagatgaagctatcttttgaaataagcatgacatcatgaccctaattccactgaaaaacttgtcagaggaatgacagctcttcctcttctttctttctttcattttttccaaaacctgatatgtattaaacaggaaacaggcactgagagcctaaaccttggatcaagtttataaagcacaggtgtaataggaatttcatggttcatgctcagaggttcatgaggacctaaaaatggttatcttcagactcaaaaggacccaaaagacatgaaaactggtttaactggctccaccacatacactatgaaagtgattaacagtttaccaaacgtggttgttttacagtgtacaccatcagcataagggttgtattttttttaaatgttgcaaactttttagtttttccaagtaagaaaacacaaaattgccatcgaatatccccatcacttcagaaaagagtggctatatctttcaactaaattcacctctttttttttttttttttgcaaaagaggattttaaaaaatttttatatgtccatgtctatctttgagaggtagatttagctgaggaagtgaaatgaggggcagtattgaaaatggatgagagtgaaagaagaggagacaggaatcagagtcacagagaaagagaactggtgtctaggacaggcaatcttcagaaaaggaaactcagctggaaacaaaagctttgttcctgcccagccattcccacggtgacctcaccggtgtccagggcagaggacattacacaaatacttgttgcactagactaaattaaaaggatttagtgggtgtcgatctgtgtggcatgacccaagttgcctatttttcataccatttagggctctgacattgaatagatagaacttgtttttaaaagactatccatgatgcatccactcagcatgttagaatggaggcaaagggagccaaagttgttttggatttgggcagtatgccttgctcctttttctcccaaatctaaatgcttctggggtgcatccatggctagcatcacgggaggcaggacaagaaattgggacagtccagcctggcctgacagcaggcctggaaaacgctttcaaaccttaggggccaaccttgccaagagcatctcttttgagtgtaggttacaacctgttcttatttgaagagattccctaaaagagcacgcattctcctacccataaacagctaaacaacaacaacaaaaaacccccccaaaaaacagatgatactaaaggttgctttcactaacctttaaatggtactgggggaatagaaaagtatgtacaatgagattaaggccttctatgatccccaatttatgattatatggtgaccacaaaatctagaggttctttattgctttttggacaggcaactgattgtggcaggtattattaggattgttactcagtgtaatccacagtccgaatttccacaagtgcatgccgtgggctgttctccaggggtctagacataacgacaaaaggcattcccgatgtaaacaaatgacttggtatgaccccacacaccagtggctacctgaggacacctccacagttcctaagtaagtacccacagcagaggagggctctgcttggattccttcgcactgaaagggcgcttggcgtgactcatgtgactctagaccctccagaaaaattgtacaggggagtctcacactggagaaaggaagtcaggtaggactggggtcaaactttagtgctggaatcttttcgcagccactacgctgggcctgaatctcctcctcctcacatggagatgataaagctgcctctcagatttcttggcggttgaatgaaaaatatagcaagcccatgaccctgagcgtgtactcagtgagtttggattttcctgccctgtgcttcacagaaaccaggcctccgctcgctctgcagtctccttgcccggctcttttgagctgcctgcattctcttccttccttgtatttcccccgcaagcttccctgacactctcacgctaggagcagtcctctctttccaccgtctcctagaccggagcccacttctatccctgctcttccctcagtgcaactgggtactccgttctatctccagggagtgagctcacaagctgtctcggcctccaccccagtgctggcccacctgacacaagaaggtgctagatgttagctgcactgcagaataattccctgagctctgcccacactagctgactgctggccactctgtttgggcatggctgggcagggcaggtttttgttttttttttttttctttgagatggagactcactctgtcgccaagctggagtgcagtggcgtgatctggctcactgcaacctctgcctcccgggttcaagcgattctcctgcctcaacctcccgagagctgagactacaggaacacgccaccacgcccagctaatttttgtattttttagtagagcagggtttcaccatgttggccagaatgatctggatctcttgacctcgtgatccgcccgctcatcgtcccaaagtgctgggattacaggcatgagacactgcgcccggctgggcagttgttttttaaagcttaactgtcttccccttggcttcaccccagactcctcttccactcctgttcaggaggaagcctgttccacctgcattccccatcgcatggtccagccagcctgtaccttctctgcctcatccatcacccgttctgccagcatgggtcagcgaatcccgctcctcaggcctcgcctcgcgtgggggagggatgcaagcaagttccaaggcagtgccgacagaaacaaatcgatatcttttactctacaggaaaaagtagaggataaacttctcaatagtattagagaaatttaacaagggatatggtaacatcaaggtcttctatgattcccaacttctgcttatacagtgacaatgaaaactagttcccccttcgtaacagagacctttctgttgccttttaagactcagagcccagatatcctcggctatttacatgtgatatttcatggctaaaacaacaaaaaagataaacaaaggcaagtccccagtcaaagaaaagagaattatcatcacattaggtcaaaacttcaacactggggctggaggccatggtttttcttgccattacagcaactccggatcaaataggcccattaggtggctctggctgtcaggcaccctggcaggccgttcggaactagcatgctctcaacacgagatagggtggccactttacttcttgcctatcctctagccccctgatctgcaggcatggcctctgcattctgcgttatttcactgagaaaggcatgcacccataagcagagggtgaggtctcagctctgtcgccttctaaatcacaacataattggaccctgtttgtcttcaacctgaacactgatcatgtagaaggagcggtattggttactgtctctccctctgccacctcctgccaatgcaagccagtgctgaggaatgtctggtccagggtaccaaaaagaaggcgcacatactcttcatgtctaggaaataagagcctacggatttggggaatccacacaacacctgctggagacgttttgttagtgacctccaggagcacaccacaagaataacgcctttacttggaaagaacctcaaaggcagtgaaaagtcaaccaccgtaggaagaatgttccagatttcaaatgatcagaatagctggctgtttaagaggtggtgccactttacagttaactatataacatatggaaagcaggaggggaattttctggggaaatgagtcaatttgtgtttcctctttagtattaaaatgatagctttacgtatttcatagatgtgccaaagcagagttgcactggtaaaatgaaaactaacgtttaaaagggaaataattcctgtgcacgtcctacaaagcctcaaatcagggagaaatgaaaagagcctagaataaactaggctgaaaagtcttctacaccaatgacagcagaatgatggcctgcaggttgaatctggactgcagtgtattttatttggctcactccaactggcctacgcaatgatttcattgccaccatttacaatcggataacttaagctggatgcagtgacacacgcctgtagtcccggctacccaggagccaaaggggtaaagtcacttgagtccaggagttccagggtggcctggacaacataaacgtggcctgggcaacgacgtgacaccatctcaagaaaaagggatgatttaatatttaaaaaatatgaatttctaatctaatctctccagaaaaactggaggttctggcaagtttatagctatttccacgtggcaacattcagctggacgtcaataatggctgccccttagagatgaggctgcacactatctttggcactttctcctgtcttccctatattggggacatagatttagcacatttatcatcgtatacacagcaacttcattcctttattctacctacctggtagttgaacatctgaaactgccctatgctatgctatataattatgaattattaacagggctttatctcaagttcctgatgcatgagtcagagaggtgaaatcccttgtttagtgtgaattatcctcactggaaaaattaaggcattgagtacaaagttcagtgctgctctttgacagttccatgatctatggtttgggaaaggatctcttctacctctaacaagaagagttttcatttttaatctctgctaaaggtagactgagcagagctaagcttggtgaaccagagccattgccagtgaacacatctgtgagtcttctcaactgccttaaaatgagaggcctaatcagagaagaacgtattgaccagaaaagcatttccttcttaggttcccataaaaaacataaatgggctcttttggcccacagatgtggtcttactggtcatcggcatctgagagtccctttttcagtgatgtgatgggtgggttgatggatagaaggatctgaaccctcttatctgaatccctgtgtgatccccaaacccatactgcaagatggctgatggggtataggaggagcatccatgccaacagaatgagtgatgtataccaagcaacgtgaggccagaacttggagtctggtctcctgctgtaaccactggctgcggtcctaaatgtagtctgtggcagaatgccagctgagagaagtacagagaaaatataagcaggcagattatttatgagacatgaaactaaatgctcattggttcttagcaactaaagctgagctccctggtggctgatggggactcatttgagaccgtccctaggagggagctatattcttctcctaaccacaaaaatggaacccacccaacaaacagtatgcttccttgttgggcactaaactgagacggatgttttctgaataaaagttggtgagctatccaaaaatgttagcaaactgtatccaacaatgtataaaaaaacatatatgccatgaccaagtggatttattccaggtcttcaaggctggttcaatatttaaaatcaatatagtccaccatacaaaaagctaaaggaaaatcatatgatcatatagattggcatacaaaaagcagttgataaaagtacacacccattatcattttcaaaagtttcttagtaatttaggaattgagaagaacacttcaacttgataaagaacatctacaaaaaatttacagctagcatcaaatttagtgggaaatggtaaataacttccccctccctaagatcaggagcaaggcaaggatgttctcactctcttgttcaacatagcacaggaagttctagccactacaataaggcaataaaaaaagggacacatattataaaggaagaaataaaattctctatttgcatatgacatgacaggctagaagaaaatcccaagaaatctcaaaaaaactaacaaatacaaacaaaaataaaaaactcctgaactttataataaatgcaatcagcaagctcataggatcaagatcaacacacaaaactcatcatatttctagatatatgtagaagttggaattaaaaacacaatgccatttacaatcgtccaaagaaaatgaaatgcttaggtacacactccagtgggtttatactaaataaatagattacataccatgtccacaaactggaagactcaacatagtaaagatgtcaattctcccgattgatctataggtttaatgttagacctatagatttaaaccccattaaaactgcagcaagcttctggtagacatagacaaccatattgtacaatttatatgaaaaagcacaggtcttagaagctaaaataatcttaataaaaaagaatacagtgagaagaatcactctacctgacatgggcttactacatagctatagtaatgaagacagcgtataattgtcagagagacagacacaagatcagtggaataaagaagccagaaagatacccacacaaacatgctcaattcattttgataaaggtaaaaaaattctctggaggaagatcattttcagcaaatggtgctaaaacaatagatgttcctaggcaaaatttattagacttgaccttaacctcacatcttatacaaaaataactcaaaatttatcatgggcatacatgcaaaatgcaaaaatatatgacttttaggaaaaaatattagaaattatttgggatatatggttacccaaagaattattagatttggcaacaaagctcagttgatgaaaggaaaaattgataaattggacctcattaaaactaaatactttattttgcaaatgtccatgtaaagatgatgaaaagacaagctgtagattgagagaagatattgcaaaccacatatccaacaaagaaccaataactagaatatataaagaattttcaaaagcaacaataatacaacaattcaaatagaaaatgagaaaaaaacattaatagacatttcacgaagaggatatatagatgacaaacaaatgaaaatatgtttaaaattattagctatcaggcaatttaattaaaaccacagtgaaatatcactacatgtttaccagaatggctaaaataaaaactgcaacaccaccaaatgctggtgaagatatagtgaaactagatcaccaaatgctgtggaaatgtaaaatagcatggaaacagcttgacagtttcttatacaaactaatcatgtattaccctacaacccaccaattgcattcatgggcatttatcccagagaaaagaaaactttatttacacaaacacttgtgtacaaatgtttataatagcattactttcaatagccaagatagatttccttcagcgggagagtgattaaacatacgatcacttatatgtacaataccatgaatactactgagcaatgaaattaaacaagctaccgacacgtgcaacaactgggaagaactccacggaattgtaccgagtgaaaaaagtcagtccccaaaagattacatactatgctatctgcttatataataattttgaaaaaacaacattttaaaagtggagaacagtttagtggtgccaggggtcagggatgaggcaggcgcagaaggaaggtgggtgtggtttgcaaggcaagcaagggaattttgtggtgatgcactgttcactgtcttgatgtagttgtgtataaaggagctacacatttgatgacactgtataaaactacatatgtagacacagacacacatatacaacttgagtacaggtaaaatgagaaatctgaataagatccatagattctgtaagtgtcaaactgtgatattgcacaattgttttgcaaaagctatcactgggggaaactgagctaagaaatgaggaatcattgtatattatttcttacaactacatgtgagtcttcaattaaaatttcattaaaaaatcagtgaactagacatgaagggacacatgtagaagtacaagcgaaggtgctccaacctccttaaacctcacacagtatttgctacttctgctggggtctccaatcctagactaaaatctcttgttcagtagtcttcgcttcctagaatgtaagctccttgaaggcgagaccacacctttctgaccacctaattctcaaaacttcccataatataaaccagatgcttataagcacttgctgagtgaatgaaccttaattctcagggtactggctgcattctcccactaaatattaatacgaactctaaaatggctgttattatccttattttatcctgtgtgggagggaaatgaaggttcagataggttaaatgacttgcgcaaactgtaatatagttatgagtttgaaaactcgttacgactccaaatctcaagacccttctactacgctgcccaggtcagcccagacctgtgatcggatgcagcaacacaggatgatataagccagttctggaggaaaagttctaaaatagaagcctcacagatgggaaaacatggcaggttgaagacggggcatcaaagaggctctgctggtaggagaataccttcagggtcaggctgacattccaagaaaaagggactattgataagaaataaaaatgcaaaagactctttttgttttctcctctgcattatattcaggtaacataatccaagagctcatctgactaaattataagcctacttcatatcatacactccttccttgaaaaatgcaagttaccaggaatacagataaaacacagcatgttactttattgaaatattccaagttctaccggtatttatgttatcaaagaactaagggttagaaaatatcttaattcacagctgagcttttgctgactgccccctttttagctgatattttatggtaaattatatcattttatgggtgactttcaaaaaattcctttcaataaattatataatttaatacaggtatttgatcactcttatacatttattcttaaatatctgatagttgtgttaaattttgaatggggtttttttctatctccatcttaaattataactagtatataccagctatttgtgtatatttaccttacatctagccaactcttcaaattatttcattgctagtaattttactgaatattttagcttctctaggattataattacagaagtttaaaacaaagaacatttggtttcatcccattacttaagactttttttgtcttactgtatttgttaaaacttctaaataatgtgacaattgacagctatcatgaatattcttgtctagtttctgattctaatgcaaacatttcacgattttacagtttggaataatacttgtgggctggatgcggtggctcatactgtaatctcaacactttgggaggttgagatgggaggactgcttgagcctaggagatcagaccagcctgggcaacatagtgagaccatctctaaaaataaaaataattaacaaaaaatccttgactctactgaaagtgttttcctttctcccaattttagttacaagtattgctgttcgttggttggttggctttatcacgacttctgaatttgagcaaatgcttttttggcatcctgatagaaccataaaattgttctttaattggttgctgtaataaattacactgatagagataaaaacaataagtaaagaaatgacatgaaaatttaattagttttagtaaataatggataataccctttcaacaagctctgacccataatcagtggcaccattcaacaaaatccaagacgcgctcacttacaggcaaatgtatgtacagtagcctccgcttctgcacaggggatatctccaagacccccagtagatgcctaaagcctcagatggttccaaaccctacatatatttatttcttcctatacatacatacctacaataaagtatacttataaattaggcacagtaaggatgagcaacaataatagaacaattataacaataaattgtaataaaagttacataaatgggtctctctctctcaaaatatcgtattgtaagtaatatatttgtaccacagttgacaattataactgaaaccttggaaaccaaaactgtaaataaggactactgtacagaacattaggcaataaaatttatataagaatctaagagagatatgaacgaacttaatattataaagtcaaagtagggtttttcctccctaagaaatattcctttttccactcgatattttttttaatgactccaaaattcaatagcttagtgcttaaatcatgttacaaacaggaagctgaaatagatagaaaaggaactagcaggaggcaagcgtgaagccaggtcttttcatggacattattatccatttcatcttcagaatgttccagttctctctgtacaaggagataagcagcagctatccctgagaagtgctgggcattcgtaactcctgggtcccccaaaaagctggccttctcaggaggtgctattaatttctcccatctatcagttgaagggactgaagtcttgacaggctaaaaggttgaccaggcccacacagctgggggattggagagctgggatgaaaatcctggtgtgtggagtgaaaaagctgaccttggctgtgtgcagtggctcatgcctgtaatctccacacttgggaggctgagacaggaggatcgctttgaggccaggagttcaagacaagcctgggcaaatagcaatactccatctctaccaaaaaataataaacttagctgggtatggaggcctgtgctgtagtcacagctactcagtaagctgaaaatcactggagcccaggagttcaagattgcgtgagctatgactgtgccactgcactccacccagggtaacatagcaagacccagtctcaaagaaaaaaattaagctcatcttattttcatgactatgggtgggtataacatggtggctgctgcatcggcttcatatcagcagatcgagactggaatattggctaaaactcctaccagtgtgtgttcttgggtcacttacttaacacctctgtgccccagtttcccatgggcgcataagacaaaccggcacctatccctcagggctgctataaggttcaaatgagtcaccacacacagacatagggtgtgaaacataatgggcactctatacatattggcgaatactctatttatgtcaatattattatcataatttttatcatccctaaaactattttttctaacggatctgataaatcattggtatgtatcaagaataaaactccaacagaagccactcaaatggtttgtctagctagtaaaatctattaaagtcgaagaatccacttagccgagccacagaatacaccacgttcaggtaagtcataaagccttccctgcagctgttacaatgattgatcttcaggcacgttaaaattcaagaaatacactgacattttaatagaacaaataatttaaatacatttaagtgttaggcggtaacagtttttgtaatatatactgacagatttgggaacttcccaaaaagagtgtagagaaagacttcatccaggagggggaagcagggaaagacaataggattgacatctttgagagaaactataaaatctgcagctacctggaatgaggcattaaatttggaagacagaccccatgacaaacagtcccttaaacttttttttcaaagccaaatacttctgaacctaaacttctatgagcgttctctttcctttatttttttttctgtcatctccaaaatgctattaaaaaacagataaatggctgggtgtggtagctcacgcctgtaatctctgctctttggaggctgaggcaggctggtggcttgagcccaggagttcaagatcagcctgggcaataagggagaacttgtctctgtaaaaaaatatatataaaaattagctcagcatgatggtgtgtcctgtagtcccagctacttgggagactgaggcaggaggatcagttgggcctgggaggtcaagctgcagtaaaccataatggtgccactgcagtcccgcctagggaacggaatgagacccttctcaaaaagaaacaaaacaaaaacaaaaactgatccaggcacttcttatatttctattacgttgaaaaaatgttttgagatatactgactcgaagaggagaaataaatggactctgtatttttcatgctacaactgaaattgaaaattctctctaataacaattaagatcaatgttcctcttcccagatgccttccaggtatgttctagaaaatgtttaatgatcagctttggtgggaggagggagccctgatgtgtagcatgtgccaatttccgtggtgaaaatattctcacttggctgaaatcaagctatcaacatgatgtcactaaacatgggagatgggtaatcattggtcctgctggtgcagccagttccagcacaaaattgagccatttctactctaacttcccattcactaccctgttttatatgcttggaggcacccgtcactaccaggaattatcttctgtattgtgatttgtgcttccttagcctgtcactatggccatgtctgcttggtcacctccatcctggaatatctacactgtggcctgacacagagcaaggactcactaaatatctgtgaaaaaataaataaatgacaggcaggaagaagtaagggcaggagatggagaagaaggagaaaaaagaaggtaagatatatacctcttaactgggccccatcctgtccttactgctcttttctggcagtttggagaacaccgtgtagacatctcctccctgctagacgggcttatcacaatagcaagaagcactggagagtcatactaacggacactgcttccttctggcccgccctgttagcgggctaatcacaacgccaagaagcactgaagagtcatcctaatggacactgcttcctttggccctccgtgctagacgggcttatcacaacaccaagaagcaatggagagtcatcctatggacactgcttccttctggccctccgtgctagacgggcttatcacaacaccaagaagcctggagagtcaacctaatggacactgcttccttctggccaaatatgaacaagaaactgtatgtgttttcaccccaaacttctttggaggacatttttgaatctcttaaatttggagaatcgaccttctacaaagccaaagagctggtaaaacttccttccgattaaaatgagacttgaaacgggtgctatcaccactgacagttcatgttgacaggtctgtgaaccctgaaaatctagccaggtctcagctaatttagaaagtttattttgccaaggttgaggatgtgcacctgtacacagcctcaggagggcctgatgacacatgcccaaagtggtcagagcacagtttggtttacacattctagggagacatgagacatcaatcaacatatgcaagatgaacactcgttcgtctggaaaggtgggacaactcagagcaaaggtaggaagacttgaaatgaggagggggctccaggtcataggtagataagagacaaatgtttgcattcttttgagtttctgaatagccttccaaaggaggcaatccgatatgtatttatctcagtgaacagaggggtgacttcgagtaaatgggaggcaggttggccctaagcagttcccagcttgacttttccctttagcttagtgtttgggggcccaagatttatcttcctttcacaggtcctttctaagcgtacgcctatattttcctttaattttgatttcctcctgttgaaagtcagaggtccaaccatctctatttcaatcccagacatcagcatccttcccaacagagacatgcagaacagaggtgtgaaactgacgacggaaactgtttgagtgacaagaagactctccggatccccctacttactcagaagtataacgtcagcttgatgaaacaagcagacttgcctctgcacaactcaccttgaaagcttattttaacagacaaaagaccatgtcccattttgtgtgaatgagatgttttctgaagccaacggcctctaaatccagatctagagaattgggagcagcgcttcttgcttcttaattaccactggtggcttgcctgcctcagggcacccacccttcatgcggtcaatgctgagagaggtttcaaagttcaggggagatcaagaggaggctgcattgttttctgctgattttccagagacaggaatctactgaactccaaaaggactggacttctcaggtgtcagtgctgtatggtaggaagaaagcagctaaaaactcaccatcagcaaagggcaagtgattataagagctggcggatctgcggtggaagttcgattcaattctaactccctctgtacaaatgaagggagatgtcactgcctaagaatgtagcaagtccaagaaatcggccacaccaccgcatccaatagactgctagagcgtgcatttcagggcagggtctgcaagtttatttttggtttagccacgagttagatgttaacgtaagtcaatttgttaggactgcagataaagtcctttaccagaaagaaaaacataacaacaaccacaaaacacaggtaaggagcttaatgttctcaacagcattgagaccagggggcactgtgagtaggaaaaatccaaaaatgctttatcaggccccatggtgctgacacgcagcaaagctcagctggaactgtggtcggctgccagagtttgaaccaatgttggtgcaaaatgatcagaaatgtacaagtccgtatttggagaattacaactttgcttctttcaaaagtttatggggagggtcttgggtatgcgccataacacgtaacagaattagtatcagtttagtagatactgtcactaaagtcattcgggcaagtgcccagggacatttttcaagagcccttctgcctcttttattggactgcccctctgcccatgatgcatataaatcattctggtgaagtcagctttcataagcaaacaccctaaacctattttattatttggagattttaaaaactttcaacaagatcggcctgcttttcttctgtgatccttaaaaaaagaaaagaaagaaagaagaaaaagaaaagaaaaaagaaaaagcccacgtgacttccacagctcgattccaaagagctaaagacatcgtgtttggacatcagtaaaaatgatggacaaatctttttgcaaaaattcaccctggcttgccttgaaaaatataaagcagctctctggcactagatgtcaaattaatgcaggcaaagtgtgttacagtaattcacttggcagtttaagcaaaaccaagagaacaaattaaagtggatccccacatgccaacggggcaccaacactttgcttctgtagctggaattgactgtaaatctctcctggcttaacgtgatcagcagcagcacaaagaaaatctgtcctctctctgcattgtgtaaaatggtttatttgccctcttaggaggcacgctgaaatataaacccaggtatgattattattattttgaactattattatgagttactattattactttcctagacagagggaatggggccggggaagctggtggatgagacggaaccatgtgtgaacgctaggggggaccatctatcttcgttcagggcagtttctgtaatatttcaggagagaaaggtatcaatactaaagggagttatatgtgtggatgggggaagactctgcactgaatggattgctgtaagccttaccctggtcgaattctccttggcatccagcctgctgtgctctctgctctgtggatagcatatctttaaggcatctatggacaattccctcaccctgccacatctggtagtccctactgtgggcctgcatctctgctgtgactgcaaagagaaatgagatgtcagtccaccctctggaggctcacagtctaattaacagcagggcagagacatctaaacaagtgtggcaagcaagtgaccacgttagagagttgtgatcatggctgtacatggaggacccctctagtgttgggttaaaaaggtgcatccctggcacaggtaaacttacttgcccagagcaccctataacgggcctaatcaagactgcctgccaggtctgatgccagggcccatgttctctaactgtctatggcacagtggggccacaggagtgaggcagttgttccaacaggaaagagacgagaatgtgtctggcaagacttcatagaggaggtgatacttaaactgtggcagaaaatctagtcaaatggggaaggcactgggcagcgtactgaaggatacatcatgagtcactaagggatcccaagttgagaagtggaccaccgccatcctctccacacaaaaggatcatgacgaattcacattttcctatgagtacagcaccttgctcttagaacataaaaccttccccaactggatgactccctgaaacaatttctggcctttggaaagtggggcatccaagaaaaatgatcaagaccatttgaaggcacacgcagtattctcggggaattatttctggctgtggcccctgcttggatcacagggcttgggctttcaatcacaaggttgaacagtattaacaagaacccacaggtccatggaaacagtttgggtaaaacatttcccttccttggaatgtaaacgggtctatttcatctagaattatttttaccaatttcatcctcaaaacttcaaagttttttttttcttctctgatgttgtacttctggagtcccccaccccctaactttggtcttgtgtttgtggagcacagacccagcctccccaggacggggccagaagcctgacccagcaggcacacctggaatcattaaggatacaaggaagaaggggaggaacacagaggggacagaggccaggctggaggcaggaggagtgggggcaggaaggggatggaggagggtcgggggaaggagacggaggaggaggagaaaagagaagcagcccatttctttcccaacacattgacactttttttccatgaggcaggtcagagccaaaggtgaacatgttcaaaacaaacagctaacagacaaacactcttaaaaattccacaacgttgcctcgggacaatgccacgggtccaacatgtcactccaagtagagaaaggaaactacctgaagagaatcctaaactttctgacattttagaacattcatagtgaattctgtctctaaatgcttacatctccaagttatcagctgtgataaaaactgaattaataaaagtagtgttaacttaaggctaacacatgaattttcttttgataagccttgccagattgtcaagctcctcagctcgttctccatgtgataccatcattttcttctaaaaggagcatggtgatttctataaggtctatcgaggaaatagagagcatgggtatggcatgcatataaaaccgccacattaccagcagggaagcactggacgttgcatgtgcctgctacagagaccataacattccaagaatttccttctggaagcgtgagaatattcatattaatgaaaccgaattagctggcagatggagggctacgactaacccttggcagtttatggtaataaaacatacaatagcctcctctcagttgtcttttcctccaccttggagctctattttctctcctatctctgtaagatagggggaggattaatcacatgtaattgattgatctactgcctcctgcagttggacagtttacacataatttcatattgcatgtaacaaatatgattacacatattctgaaatgttaagaagttcccggcataacacaggcatgtacatggcatgtgcctattgaatttgttggcttcaagggatattattactcctgccatatgtcaggaagctgaggcttagcccataaagtcacctgccccaggtcatgcaactagaaaggacccggtgaggaactggtgccaccctgtctctggaatccatgcactgaccaccagtgaagggcaggtagctttcctctgcggctttaagttcctgttcactttttcctcccaatcacaatttcacagaaattagcctaaaagtgacatcagggccaggcatggtagctcacgcctgtaatcccagcactttgggaggcgaggcgggtggatcatgaggtcaggagatcaagaccatcctggccaacatggtaaaatccgtctctactaaaaatacaaaaattagctgggtgtgatggtgcatgcctgtaatcccagtacttgggaggcggaggcaggagaatcgcttgaaccagggagtcaaatgttgcagtgagcgagattgcaccactgcactccagcctggcaaaagagcaagactccgtcttaaaaaaaaaaaaaagaagaagtgacatcagtatgccagttgcaccttcatggctttcctgactctcactggacgctttcaggtataaatatttcctgttcaggcaacattggcagttggacgttgatagctttggaaaatacaagacttaaatggtattctgccaaattcactgtgcattcagagatatttgaatatagaaagttaaaattgctgcacaggaaaaaattacaaggttgcaaacaacgacaaacattaaaatatttacaatagtcagccattcgaaggtggtgatggtttccttatttacacagagctctcaccagtaaatgagagcaatcttatagaaagctggaccgagaaatggaaaggcagttcagaaaagaagaaatgtgaatggtcaataaaagtacaaaaatctaccaacatcactcacaattacaatgtaaaattaagaaataatggtgaggattttttttaccgactgatagctatattatttttttaaaatggtaatactccaaatcagcatctgtgtgtacacagacacttagatttggtgggtgtgtgaatacattttgggaggtcaatactgaaattctgttaaaaatttgaagtacatctcattggtccacaattgaatttctaggaatatacttacctattgatgtatatgtcaaagaaagtcaaggtataagctgaaatgcaacttataattgcaaagattagaaataacttaaatctcttttaatagatggatagatgaatagatttatttaaaattatttaacagatttattacgtaagtaaatgatggtgaagacagacaatgggaaacaggcagccttttaaaagaattaactaaatatacagaaatgaaaataaatgtaatcctaaaattatgggaaaaggaaaggtatagaacaatgtatataaatcaagacatacatgtaattaacaagtgtactcatacacaaaatatgaatgcatatttatgagtatgcatatttactgtatggatcaaaaataaatatttttttctagcaaggttaacaatacactgtcaacagtgttattttggaggtataagaagaaaacatttcctgagaagaagaaaaaaattgttagaaattcaagccacagtgaaaaacaatgtttatgtattatttgtatatattttttatttatagagagaaaaattaatccaatgaacagcataagccctcatttcaatttcaaatcatcctattttcaaatgtatgtagctcctgtctgcaaacacataccctgtttggaactcattattgtggcattcactccactttgctacagaacaccttccagtgggaatgcagttgctttctccttccaagccacccctggtggggacccattaggccatcccgtgtcaaatgaaaagaaacagcaactggagccatccctgggtggatttctaaatcccctggctaagtactgtacagactagctgagttacttcatttctctgagccccaagtcccttcatgacatgtctataagaatgccttgtgaagaaatcgcgacctaaatgtgtatatgtttctgtgtgtgtctgtatgtgtggtgtgggtgtctgtatgtgtctgcatttataaaaaatctactgtggagttctaataagtagcagcaatgaggaagaggccccaggtaggagtgggccccgggtagggaagaacaacaacaatccgcaggcacaatgacctcgacctcattctgcacatagctccctccaacaggacctgtataacttcagtccctccagcccctgcctctttgcagacagccccttccatgctgggtgcctgttgcaaccttacagtgtactttcttatcttctccaataaatccacctttctttcctacaactgtcttggtgaatcctttactgcctgtgccaccagtcccagatagtgactactgcaacatgtactgccctcagcagttatttataacaaattggattctttctttttccttgtaagaaaattaaagagaaaaaaaaatcataagataatcccaattattccctccactggaatagcaaaatgtgacctcacccagatcagcatatttttaaaaaaaaacacaggcccatcttcatagtgacaaccaaacctctatggccacagcaggaagaaacaaactcttcctactgcttgcttagatagtccagcatgagatcctggctcacatatttgctccttaaatttttttcttgaggacttgcctgaattcactgagtattatattaatctcttccctgacaaatgccccaaaaaaatctacctccaagattttgcacattttttgtgccaagcctttgaaaaaaaatttactgaggattgaccaatgtcatttcattacatcctgcatttcccctcaattctatcgcctagttaagtaatacgtttgaccagccaccattaggaaaacttcttcagctggtagacacttgctggcttttaaaattactgatacaatatacaactccccagtgcaggccaccgcaaggacagcagaaatataaagtagcacttagcttttataaggccacattctacatcttaaaaagactgcaccttgcactccattaaaataataaagaaacagaatgaaggaaaaagaaagaacatttaaggacctgaagtttaaatatactaaaatgagaaccacctgttctgtacttactgttagagaccgtactcgttctgtgtaaggatttcttaccctttctgcaatatgatgtgtgtcctagtttatattgacatcaatctttgctcccatttaaggaactgatattggttccccgttaatgttgagggggacctcaaatttggcaaggtggaaaattgttaagtggctctcattgacgaaagtaaagggctgtgatctgaaggggaaggtcagaagatgaagggcagaggaaccatgaaatgcgtttcattagatcaataaaatgtatgacttcactcgcttaatacataaataaagttgttaaaaagaaaataaactcgggcacacaccatgctaaattagcagggctttatgtaagacgaagaaactagaaacaaccctagaaaggtcacttgcatgtatggttttcttttcaaaagcttcatgcaaagccagaaggaaaatctcacagagctgtgtgccgccaggactggtaagatccaagtgacagaacagacccaggcaagatcgaggaggcgaaatcagatcagccaagaagccccaccactaatccagtgctccatccatctggtttaaatcgggtttgaagcatatttatgtgataaagaattaaagctgtttctcttggccacctaaatattgggacactctcttttgaaaagtcattgacatcagtacaagcatattcaaaactgaattagaattaaagaggcttgagtgtgcttaacttttttaaagtatgccagagcctctttccaagttttttttaagcgacaatataagtaataacttagcaaggtcctaagggatttattctgttttaaaaaaagaaaagcgatgtttgagggaaaaagagagacacagagaaaccagacgagagcaaatggaaaggttgctgctatcgagatcaagaaacaaactcagaatattcctgaaagactacctcccaatcatctgaaacgtggcaagtaactctcccaaataagtaccattttttaatcacgaaacactatttctgtaacactggctgtggctttatttaggttgtctctatgaagcgttagacaaagagaaaactattcttgagcaaaatccaccaaccggaagtcccatactgggacctaacaaaatcttgcctgaaatcaaagcctaggtgccctcttccagcttaccactgctgcctttttatgtaaaatgtaacttataaagtcaactaaagttccagcagcatgatttaaatatgattgctttccaagtacagggatgtaggacgtaggaaggggtgtgttgtgtgtgtgtgtgtgtgtgtgtgtgtgtgtgtttctgcaagtgttgggtgggagagtgtacggtttgactctgtgtccccacccaaatctcatcttgtatctcccataattcccatggttatggaagggacctggagggagacaactgaatcatgggggtgggtctttcctgtactttctcatgatagtgaataagtctcgtgagatctgatggttttaaaaacaggggtttcccgaacaagctcactctctttgcctgctgccatccgtgtaagacgtgacttgctcctccttccttccaccatgattgtaaggcttccccagcaatatggaactgtaagtccattaaaccgtttttcttcccaggctagggtatgtttttatcaagcagtgtgaaaatggactaatacaagagtaaagagatatactgctgcttgatcacccatgtcctgtttttgaaaagttaagacacctgtgttaattcactgatgctgacaccatggcagagataaagcctcaatatatatcctccagtgtgactttaactatgacaaggttatcacttaatacaccatcattcaagagttgattactggctcctgggtgtccccgtcttgcactcaactctcaactttcctgggactaggaattcaggggtattgcttaacatttcataaattgcataagagtatgtgatagatctaattccataaatgaacacaaacaacattttttttccctccgaatcaggagggaaaaaaagacccaaagcctcctgcttttcaggctctctttgtgtcctcatgtgcaaactaattttttccagcacataactcactcaaggatccatgcctcttgggagtacagcttcttcttttgcttctatattttgtgtctcactctcacaaatggccctggaggaagggagagaccagcagtcttctgctgaatcaccttgcttgttacatgcagaggagagctcatccctgcttgggaaggaagcccgggaggcaggggcagcatggagtctgtccaactctcacagaaagcccacttttcagagtgaaatcaaacaaaaaaagagaagcctgctggtcattgtgtgttctggttgtgatatacttcatccaaaaaaggattatgtcaatgttctttttatgatatcccacacatctcactgtttcacttatggccaacaatgcagtggtctcttcggttggcatgcagccatttccccctttctatttcaagggtcacagggcccccttggctcacacacccgcagtagctccgcacttgcggagaacatggaaatctcaaagaactgctggggagcatatgtacttgatcacagccaacaagatgaagactctgcatctgtaatacattgtggcgattacaagtcaaatctggaagacgccagtaccgcagcacttcattagggtctaattagtcattgtttcttgttgccctggttaatttgttcttggcttcctaagtgatcagcataggagtttcaactccatgggggcacctcaatgtccctggagtcttctgagcaatgtaagattaccaggatgtgaatgtacaggtccacagtccttgagtcctgatctctggagtctcaagactcagctcaaaggacatcttcctctgaggcctttactaaccctgtttttacgtagaactgaccctaccctcctcatgatcgtgctgtacttcatactgtcttttgtgcctataatactaatgcactatttattagttgtttaatcatcatgctgtatgttattttatatttaattatccaatgaaaacaatatattttaggtctaagtggcaggcactatgctaagcactttatatagaaattattttgtcccctctttgtatgtggtactgaaggaagagacaagagcacaggttcaggaatcagacactctgggttgaaatcccaactccaccagcctgtgactgtgagcttgggcaaattccctttctattaacatctcatctgtaacacacagatggaaataaaaatggcaaccttacacggttattccataaatacacccattaattaatgaaaactgctaacaaggagtaagctctctgtaaatattgctgtttttattacctctattttacagatgaggaaacggagacttaaagtggcaaagtgtaaagggacctaccaaagatgactcagccagtgaacagcgacgcttacacttcactccaggagcctgacccctgcctgtgtgctcagcaccaatttgacccaggctgtcaccctccttgactggtccatgagctctttgagggatggactgtgactgtctttgaatgagctagataatcaatgcatggattgaataatttatttattaatggctttagattttaataaatcataggacagtgccaggcatggaatgcagtccataaaggaatgttgggatgcaactaatgtgaaagaatttcatttgagaatttattttcagtgtatgctttgcttgtccctgcaaatataccagtagaggtaatcctaattatttaagcataaatacagcagtctttcggaataaaccgccatttctgcagcttaaacctaatgtatgtagcttttaaaacacaatcatgtactcctttataataaactttttacacattttaagtggtttttctcccgtgtttgatagatacatcaagacgttccatacgagatagactgcatcataacaaattttaaggcactgagaggtgtgtgacatgtgcataacgaacatatcaggaagtgtgcccccctcatttatacaatcttttaatatgggcagcacgctaaaactacatctctattttgcgttggaggttttccaatcctaggcccgatggtctctccccaccttctcttagacttgtcttgatacttgatgaagttcaaatgctgaacagtgcctactgagatacaggaggcaacattttataactaccgttgtttgcaagcatcctatcaagatccatacttgcaaactctcagcataaaagaagaaacagagttctgtgtaggacaatgaacttggactgttgtttaccagcaaatggaaaacaacatttctaacccaggaagggacgcttggccccctttggtgatgcctcagctcccttcacactgggcaacaatgcgcctttgtgcgggttgtgggatcgtgacaccagtcaggccttactgcttgggcaactgatcacaaccttcatactctgcagagtgttctagtcccattgtgaacaaaatatgtaagggacctagcctccgcccccggctctgttatccctgacttcagattgaatcctactggcttcaaatgcacttttcaaaccttggcaaattcaccccaacactttagaaataagtaggatgtgttaaaacattagaattcctcagttgagtgaaatcattctttggaaataaatgcccagcccttctgtgccactgcatttgctactgaaatcaaaccgttataaagctcaggatttaagttaacctgggtccaagacatggtaccattccttaatagctgtgtgaccttggccaagtatttaacctctctgagccttaattttcttacctgtaacagggggatgataatgactttaagggttgctgaaagtgttaaaaggacaaatttggggtttagtgtttttttttttgtttttgttttttgtttttcacacttctaagacctatttttttttaactcttagctattaggggcgttgtactaacaaaattagtgtttgtctgaacacacgtggattggaagtgataggaaaatttctccaatgggatcaggagtaagtgacattgccacaaacaacattaagcttttgctaaatgattctggcagggcgttttatcttcatcaaaccacagccattgtcttcttcttaatctcttcttctctcctggtccttactggataataacatcagtgggtggtgggggatggaaagggggtaaccaaatcatcagcatctcccctgctccattcctcacatccagtcactcacaatgatgggtctttgccatgcactttctctctctcttgttcctctatcagaccaggccttgcgtaactgtcacgtggactactgcaagttgtactgatttcctgccctgaatccaatttctccttcttgcagtctaacttctgtgtcccaacaaaatatttctccttaaagcacatttgagagcattcacttgcaccttcccatccacatgtactctcagtccacccctccacccgctacaaagcatggagtcaggaaatgccaccctaactgtcgtatgttgcttagtgggaagtaaatcagaacaacctccgtagagggcaatttggcaatatctatgaaaacgaccggaggcatactctctcagccgatgctgctatttctaagactcaatcctgcaaatacatgcatgacgtgggaagcgatgtcggtgcaaggttacacgttgcggcacaatttgcaatagcaaaagctgggaacaacccaaatgtctatcaatagggaattggttcaatgaattatgaaacatcacacagtgtaatactcagcagttgttaaaaaatgaagaaataatttatatgctgatttaaaccatctctaagatatattgtcaagcaaaaagagcaaggtgtgtatagcaaagtgaagggagggcagaagaatatacaaacatattgccttgtaaatgcataataatgtctagaaggtgcaccaggaaataacatcggttcagaagaggaattaggtgctaaaggaaaggggtagaggagattttaacacacataaagaaaaacataggtgtgtgtgtgtatatgtatacaaggatttatatatgcacataggtatataaatatatatacatatacaccttgtttttatcttctcttttgatttttgaaccatataaaagtattacctattcaaaaataaatattttatgtgttatgtacattttttaatcctaatttaaaaaaaaataaaattaaagaaataagtttaaaaaaaagcagtggccacataagccaggcacctattttctgtcttctctaggcaactgtgatcataaattacttcccactctctccttttctctgtcttacacacagaggctgtatttacccctcaaaattcagctttgagcacaatttcctgttccaaaattccctgtggctttgcatgcctataggacatccagtcattctgcatggagtctacatttatgtaggctggagtctaaattcttagtctaaccttcagggtccaccactgacccctcaactcagttttccagcctgtgtccatcactgctcccttgctgtattagtctgttcttacactgctacacagaaatacctggactgggtagtttataaaggaaagaggtttaattgactcaccgtttcacatgactggggggcctcaggaaacttaccaccatggcagaagacgaaggggaagcaagaaccttcttcacaggcggcaggagggagaatgaacacagaacgaactaccaaacacttacaaagccatcagtctcatgacaactcactcactagcatgagaacagcatggggaaaaccacccccatgatcaattacctccacctggtccctcctttgacacgtggggattacaattcgagatgacatttagttgggacacagagccaaatcatatcacttgatcagctcccaaagctaaatcactcatttgactaggtgcttacccttcttacctctgtttccagcattctgtcctcccagcaccccaagcccaagctctgcttggttccaagcctcagctcacatcctctttccccatcacatcaccagaatgacagctcacctccatccccaagctggaagaaagccccttcttctgtgaaacccagggcacattatgttgcttccctaccatatttaacacaagggatcataattttgtactgtttatccattcattcagtaaacatctactaagcacctactgtatgtatgtactgaaaaggtgttagagtaaaaacaccaccagccggattcctgcactcacagagatgacagtctctggagaagacagatagtaaagaaaccacgccttcgacgataatctttgataatttcaactggagaagtaaaaagctatggcaaaaatgctaattgtttgctcaaagcaacaccataattttcaatttagcacaaggggctctgaagtccaaagaacccatattaaatcctggcactgcccaaagctatgttcctccagatcagggattcacaatgtcaacattgttgacacttggtcatggcctgggggttggggttgctctagagttatggcccagaacttgtctccttgggagatgcaggaagggtcttcatcccaagggtccagctacatttgccacacggatggattcaaaagttgggactccctacacttggatgtaggagttgaaatgtctatcatttgagcctggggtactggatcccataaaaatgccacatgaaagaaagcgtaattaagaagctgttacaattcaggcttcagataatgcactctcttcaaaggcttattttgcacatcccaaattctcctataaaccatttactttcccatgctattggacgctatgagcatttaggaaatgttctcaggtgtttgaaatcaacaagacaattacggaggtttggaagattctaaaatacaatcaacatactctggaaatgccaatcgaattcttggcctggcagactacagctgtaatatacatcttaaggacattttaagatgatgttaaaatgaatattcatcattctgaattccaggatttctttcaaactgagaaatggatagagggatgggcagtctctagcaggatctgcatatagttgggagaaatttatccctaaaaaaaaaaaaaaatgggaaaataggtttcagagtcagacagcatggattataatcccagctgtgtaacagaaatgaatgtgaatgatctggagaaaatcttaactctctcagagcttggttcttcagcctgaaaatgaggacagtaataccaccttaattaaaatatgtaagggtctggcaagatgtctttgcaaaccttcattttcattcctcatccctttagggaacagagtccagactcattggtttatatttttataaagcttgcaaaattgacactttctaaccaatttagtttctcttgaccaaaacactttaagacacaaatgtttcaatctgttttgctccactaaacaatataagcccaacccatcacccttcttttcttgccataacagcctccctgaacatattcatcattccacaagaagtctcgcttaaaaataaaggcattctttctatggctgggacagggccatggaatgcacttcgggtataacaaaagatgctgatctgaacaagaatgaactcagtcctaacgtgacaggtcagacagagccgcctttgtgcacaccaccctcctgccctgtcttcctttcccttaacgtatcatgatgaggaacctcggtgtattttaaaaagcataataattacttatacttctctatggtttccaataaaccagtgattttttttcaaaaagtccatgaataaaacaaaccccgtcaccattggaaatgcatttcctgcaagcgcggatgcttttaagaccatttgccgagcgctctgcaccgtttgaccagttcggggcagggggcacgctctaattactgattgtggagtttggtatctatagcaacgggcaaattgacaacaggaagcttcaccctctggggcaccatccgaagtttataaaatcaacttaggccaaggctatagttaatcaggagggctttcagagcacgagtgctccgagtccacactaagaggcaaagaaattatttaataagacaatcaggggctcgagaaggcagagtttattagcttggctttgcagtgcctcttgtagtaatttatcctaatggtaccaattcgcccatgtttgatacagcaggagacccagggtatcggtttaatcaaacctccatcgatgctgcctgttcttaactattgttgctgtatatcaatcagtttctcttgattcactaatcggatggcaggggatatgaattgtcctgggattcaagaaatcaggttgacataattctttataatgtgctgcttttaaatggcattatttcaccccactcacattatttcatgttcctacagctgacggtaaagggtccagattgcaattggctgtgggtgagaaagaaatagggaaaaagcctgggccttggggtcaaactattttgactgctggctctactactgcctgttagatgagaccccctgggtctcaacgtccttaatccttacataaggacaagaatctactcaggcacagaactttatgaggatgaatgaactggtgtatgaatgagcctagatcagtgtctggcaagcaggaaaagagcctcaacaaacgacagattcactccccagctgccctcatttccactcccgaaacctggggagttacgaatgtatctgcattatttttataggtaagatgccaagatgtgcagattttatgggcctgatcacgcctacgttggtaatcctaggagggcgtctaaacttagatcttatgctcagctctcctgtccccaccgaggacagagtcaggcaattgccatcatgcttattcatgtggtgctggcctggctgttgagcacagaccagcggtgtcctccctctcactatgggtactctgttgcttccctacccaaaccttcttccttatacagcacgcacagaccagaattacaagaccagaccttttccccttggaaggcagcaacttttgaaggcggagaaggccatcctcaccttgcgttcacattgttcaagagagaagaaggaaaagggcaactggaatccaaattttgaggcaatgaccatgtggatggcgaggccccggcaagggtcccattgctgctcagagacctaaaagttgaggtggccattgcaagcctcagtacaacagccctcagttgcgcttctgtaaaatgggcatatgaagatgtatttcattgagctcacttcccaaggcaaaatgggcaaggtattctggccctttttcctacaatgagaactaaatctgggcctttcaccatcagcttagctgtacaaattttacctcagttatcctagcttacggttatttcctgcgagagacccaaaaacaaattaaggaattagcgtgaaaacaaagggaagggaagaagaaaagtgagagtatgggagggaggaaagaaagacggagaaagagagagggaaagaaagaatgagggaaggaagggacaaaaaggaaggatagagagaaggaaggaaggaagggaaggaaaaagaagaaaggaaatagcaagagaaggaaagaaacagaaaaagaagaaaaagaaagaagagatccgtgcttgcccacaccttttccacactccttttctccgttcttaatattggaggatttgtgcggcttttagaagcgctattgttccaatagccagggtaagggggttaatgccgcctaacaagggactcgttgcttcctccctcccacctcctcccttttcttttttggctcagccaaatttctaacactacctgatgaaatgtagtatacagcttttaattgtgcccagaggcgtacaacttcacagaggtttagaagcaagtggcggatgatttgagaaacagctgtgttccggcccacgcgctccgaggtggaacagccccgtcagcacctgtgcccgctgagcacacacctcacaccctacatgcgtgtgcacagctgggacccatcagggttgtaaggaattaatgccttaacttggtattttattgtacctagaggagcctgacgctatattaaatccgtagcactaagtagggttttgttcaatcttagggttactggggctgggggctggatgggatattaaaaaacacaaacacacacacgacctcttttctgatgctgagaacgaattgttttaatatccaatgtttggtttatttattattagggatgagtggccacttttaaagagtaatggacctatctggcactaacctagttttcccaattgaatctatctcagactcccagcaattgtgggagccaccagttcggattcttttctcttcccaaagcccagcttcccttggcgcatgccccaaacacacctcccaccttttggactccatggagtctttgaaatcctactgcaaactccactctcaccagcacggtctcttgttattcaactgcaggcctcccgagtccctggaagttcagtagacgagtgtctatgtacccatcccacagccccgtaaacagagccgaacagaaaccatgcccaagtcatggcaaaccgacatcggaccttagaattccatctactggccataagtaaacactttgtctctaagccatgttatatattctgttgtaaacacaatgcgtaaaatttttccacagcagctggtactgactgcgactatggagaagatatcatgagcgagttttcacaatgctgtactcatgtaattagcaatgcacctcagtatctgtggtaggcagaaaagtgcccctgccccagaggatacccatgtcaactccccggaacctgtaactgtgactctatttgaaacagggtatacgcaggtgtgagtaaacattttttgatacgatagttctggatattccagtgggtcctacatttaaagacaagtatccttacagaagaaacgcagatagccaggcatgtgactcacgcctgtaatcccagcactttgggaggccaaggcaggtggatcacctgaggcacgagttcgaaaccagcctggccaacatggtgaaacctcgtctctactaaaaatacaaaattgaccgggcatggtggcgcacgcctgtaatcccatctactcaggaggctgcggcagagaattacttaagcctgggagatggaggatgcagtgagccaagatcatgccactgcactcagccggggcaacagagtgagactgtgtctcagaaacaaacaacaacaaaaaataaacgagagggaaatttcagacagacagaagggaagtccaagtgaccatggaggcacagatagataatgtgaccaccagttaaggaatgcttaccgcgacctgaagccgggaagggcgaagaaaaagtctcctctagtgtccccagaagcagtgtcaatttcagacgtctgggctccaacacgtgagcaaatgtatctctgctgttttacgtcactcagtttgccgttattacagcagccaaaaaaactagcacagggtcctttgctctgggcaccatgtgagatatattttgctgctaagggggctcttggcaggaggggcgcctaaacttcgggtactgtggaagtgcagaaagggcacattgcccactgttaccccatctgtacctacttttgaggaaatggtagttcagctctgagggtaaatgcgcctgacagcaatagcttgagcataccttgagaatgactctctgaaggtatatgtacctgaatgtctgttcctagctagggaatctgggagtggccaatcaggagatcattccctgtctatgaggaacaactgagccccctggcctcacaggccgtatggaaaatcagtccctgagttttggattaaataaaggttgccaggtggaggtcattaacggcaggatgtaagtgaaaatgttatctaaataaactgcactcttcctgcaggcagttgcggtttccctcccaggccacggccactgggctgtgtggttatgttgtccagccactgacactggactgtggaaagtggagtcttgtccattccacggcccctgaaccatttctgtacataaggcagtttcctgcccagcccactgccactaaactctctcctttgtaggtaaacccctaataaaacctatgtcttgtttgctggctctgggtctcttctctggcctcttgatcctagtgtcttcccatgaggttaatagggttcagcacaacagcatcgtggagaagccagccactgccatcatgttcaaaccaaacagttctcagagaagggtacagagggaggtgaaaagcatactgtcctccggctggacagtcccgttctcttcgtggctggaccatttgctatgtgtgtgccgctggccattattgaatccatgccttagttgccttgttggaaaaatgagattctcaatgtaaaaccactttgaaaaaactgcaaaacatcatatgaacgtcactcatttgcttcaatccatattataaagcacctacaaagtgtcagactcatggagcgcggatggcactccgattttgagggggacacaatctctagtaggtattattgcaactttctccaaaatacactttttcttaagttccacttgtcatccattaatataacgaaacctctttagaaaccctccaatccaaaatgcgggttaatgtagcccataaattgaatttccgctgtgtttctctggattctccaaatttgttctttcaacccaacaataacacaccatttgtttgtttatcatattagtaatgatttttttttttttaatgagcactcaatactggttagacgaaactggacttcagtgctgcttctgtcatttaaattgctacaaaccttttggagagcaatttggcaatatgtctcacaaaccttaaaaaatgtgcccaacctttgacctagtaattccatttctgggaatctatcctaaagactaatgggaactatagaaactgctttatgcacagagatgtttatcacaacactccttatgcaccaaaagtatttaaaaccatataaatgaccaacaacatagaaatggataaataaacacaatgcttcccctctgtggactatcacaaccactaagaattgcagttaagaagcatttaaacaacatgatgaaatgtataaagacagggaaaaataagcaatgtgccaaatgggcgtaggcaatgatctctatgtgggacaaacaccacacaacacaacacgtggtaaaaagactggaggcaggcatgggttaattgtggttgccatgggcagcagaattatgagtgattttcttcttctttttaaatatttttaagatattcttcactgagctgtatgtattatcggcatacctattttattgcatttccttttattgcactttgcaaatactgtgttttttacaaatcgaagtttctggcaactttgcattaaggaagactatcggcaccatttttccaatggtacctgctacttcatgtctctgtatcacattttgataattcttacaatatttcaagcttttaaattatattatatcagttttggtgatctgtgatcagtgatctttgatgtccccattgtcatttttggggcaccacaaactgcacccatatcagatggcaaacttaattgataaatgttatattatgaataccacactggctccagcaacctgctgttctccttctctttccccctccttgggctccctattacctgagacacaacagtattgaaattaggcaaacttacaacccttcaatgcttttcagtgcccaagagaaagtcagagttgcatgtctctcactttaaatcaaaagctaaagtgattaagcttaacgagaaagccatgtcgaaaactgacataggctgaaagccagattcgtgccaaacaggcaagttgtgaatgcaaagaaaaagttcttgaaggaaattaaaagtctattctagtgaacacacaaatgatagaaaccaaaacagcgttatcacccatatgaagatgtttgagtggtttggatacaggatcaaaccagccacaacattccctgaagccaaaatcaatccagagcaaggccctcactctctataattgtgtgaaggctgagaggggtgaggaagtgcagaagaaaacttggaagctagcagaggtcggttcatgaggtttaaggaagaaagcctctccataacaaaaaagtgcaacatgaagcagcaagtgctgatgcagaagctgcagcaattttccagaagatctagataagaccactaaggtggctacactaacagattttcaatgtaacaaaacagctttctgttggaagaagatgctgtctaggactttgagagctagggaggagaggcaatgcctggcttcaaagctgcgaagcacaggctgactctcttccctgctggtgactcaagttgaagccaagctcatttaccattcccaaaatcctagggtccttaagaattatgtaaacctactctccctgtgctctataaatggaataacaaaccctggatgagaccacgtcatttatggcatgatttactgaataatttatgcccactgtcgagacctactgttgggaaaaatttgtattcctttaaaaatattctgcttggtccagtgtggtggctcacacctgtaatgtggcactgtgggaggctgatttgggcagattgattcaccacaagttcaagaccagcctggcaacacggtgaaattgtgtctctactaaaaatacaaaaatagcccagcctagtggcagtgcctgtagtcccagctactgggaaggctggagtaggaggataatttgagctgcagtctgccagtgcattccagaccaggctgtctcaaaacaataacaataaaaaaaataaaaatatccacttgttgacaatgtacctcgtacctaagagctctgatggagatgtacaagattaagtagtttccatgcctgctaatacaatgcccagtctgcagcctatgtatcaaaga

SEQ ID NO: 5108 - DNA, 13310 bp, Homo sapiens
ccattagaaaggacaattggactactgatgatttccgatcaagtagaataaatcaatatgaatggctcatcttggctaaaattctgtgacagtctctggttatgaaaatttaccatcagatcctgttcacataggacactttattcagcagtggggagagtttagcagaattctcttctgcacagtttaagatggagctgggaaaagaacccaagtttttagatacagcagtctgttgctacttgaatcttttcttctccgccataccaggactggaagacatagattgtgcccatttctatatcctaattacctaccagaggattgggcatgtaaaatattttcagaggggataatggatgagaaatattgttcacaggcttagaggtatacactcaaggaagattttacttttaacctgaaaattgcaaaacaggtgcttgtagagctgtacccacagcagtacattgattcgcaagtatcggggcgggaaaaactacaattgctgcgtggggtggggtgggggtgacctagttccctttattagccagagatataagtgacaggagtctaaatgagaacctgaagccaacaggaacatttatttgatcaggtaactaaaaagttcagggtatctggcttccagcacgctgaatacagatatataacaatgtcttcgagaacgtcttcctgtacctgggctccgcttcctctgtcagactcagtctttggcagattctccttaagtgatggcaaagataacaccaccacaacagatgttcatccttcaacttggccacctcagaaggaagaggggctccagagatgccccaagattatcattggctggtccagtgccatgtgctcatctctgcacccatcaccgggtctccctctcattgttcagaccaagtcacttgtgcaccattagcacaaggggtgccagtccacagggataaaggggcaagcagggacaattcttcagtaaaaaactagaatggatcttgatgaggaaagatattctatgtccactatatttctattgtcattatggaatgaaccgtgtattttttatcttaacactcatttccattcttctggtaattgtatgtaatcaatcttgttaagccctctccccagctgtagcccctgagctttttgtagagattcctcctggtgcgagatggagcatatggttcagtgctggaacaatgtggtcattatatgctcctggtcccttgaacagttcggggatggttatctggtccaggaagacccagtgaggtgaaatgagacttacctcaaacttgagtaaaagagattcttttttcaaaattaactttttattatgatgatttccaaaatgcatgaaaatagaggtaactctaatcataagcagagataactctcctataccaccatccagcttcagcatttatcaactcatggacaatcttaattcattttattgccaccacagtagattattttggagcaaattcccaacatcctatcatttcatctctatacttttaatatgcgtctctaaagataagagctcctgggggaaaagacttggtattttctattaaagtgaacctgaaaagatgtagggaataaaatcactgctaccatcttgcttccacttggagcaacaattggagccaacaactagagccaactgtgtggcagcagaacagcaagaaggaggacacgaaatccagatgacagattttgggtcctgaattcacctgtgcatggagtaagcttgctactttttttttttttttcagtcacttgagctagaatattccctgtagctatgttgtgatgccccactcatatcctcttggcccaccctgagggtcacctgaagcttagatggacattcccaacacagtgatggcttctcacctcaagcacaggcatctctctgcctaagaatgtctctggccatacgattgtgtttggctcctgcatatggcagacctgaagtggcaggggataataaatgccccccagaactgtctttaatgatgagggatagaagttggcataccctggctctttgctgctcagggagacagtaatgaggtgtgtcctacactgttattggagggccctgtggggttaaatccctgttatccccagaagtaaccttcccatgaatttccctgctgctgcttcttttcctttcctgtcttatttttctacttcctcaccacacttcctgtgatcacctccaactaaaccatgtccccccagtttcttgctttagcatctgctctaaagtaaaacttactgaagtaattcccctttgcttcattttgcttaagcttccatggttctatttcctttttaaaatttctatttaattttaagttctgggatacatgtacagaacataggtttgttacctggtagacatttgccataatggattgctgcacctctcaacctatcacctaggtattaagcccatatgcattagctatttatcctgatgctctcccttccccaccaccaacagactctgggtgtgttcccctccctgtgtccatgtgttctcattgttcagctctcacttatgagtgagacatgtggtttttggttttctgttcctgtgttggtttgttgaggatgatggcttccagctcatccatgtccctgcaaaggacgtgatctcattcctttttatggctggatagtattcctaatatgtatgtaccacattttctttatccagtctatcattgatgggcatttgggttaatccatgtctttgctattgtggatagtgctaaaataaacatacgtgtgcatgtatctttagacggaatggtttatattcctttaagtatataccctgtaacgggattgctgggtcaaatgtatttctggttctagatcttagaagaatcactacactgtcttccacaatggttgaactatttacattcccaccaaaagtgttcatggttctatttctggtcattcttaaaacaaaaaaaagtcctgagtaattatgctccatatttccatccccagtatttgcttgagaaatgaaaaatgaaggcttctgagaaacagtgtccccacgcccccataccccattcacacaaaatgtttcagcttgagaatacagttgcggaagccaagttgggtctcaggaatatctggtttgcataaatttcacctgcagaattataaaattcaggtgctgttgccttgggcacaactgctggctctgataagtagagtgggtgtcccagcagcctgtcctgttggttcagataatgatttagggggggcgcaggccccagggtgtgcacatggatggatgctctgcttatcctcctccagtaggtttctggcatctaagacaagagaggagtggggtcaacaaggagagcttctgtctctcctgtttaagcatctctcctactacctacaaatgaaaacatacaaatactatgttgatgtatagcaagtaactttaaagaaggcccccagaaatacttcactaattggagaccagtttccagcattttgaaaccataaggaaattacaaagtaagctgaaaaaaaaaaacttagatatgcaaaagagtggtcaacaaagtccatgtattctacacaaaggagagccgtcttaagatgtctctccaggctagtttacttttactttatacacaattgcaacagagcattgaaagcgcacattttaagcagggaaggaacatgcacagcaagggctgcaaactcaaaaaattaaagaaccagagaataattttaaacaagtgaaagaggccagttgatggattaatgccatgtgggacgtgggtccagtgttgacagttcttccatgttttcaggaagaaactgaaaattggattttaagtgaaataaccttagttttacatagaaaatatctaaacaaaaaatttttaaaaagcatgcagacctggcacatcgggggcgtgactttgccccattaaatgaagcataaatttctattttgccagtgttcctatttggctcatataggacactttaatttgtgattctttgttattagatcactagctttttaagcacaggctttgggctctgtttgccttcttgggaaaactgtcagaaatcagtgggttcataaccttttgaagaagtcactcttattttggttgaggggcagtgttcttagctacccaaaacaaactagctattcacttcctgggatcgctgggacggtgcctgcgggtttctggggacacagaagatacatcttcctcctccctctcctgtgttacacaatctgctttgaaaggttatgattcttctgtgggcgactggcctacagcatctgctgctttgcttgatttggttcatttcacccaggctggcatcttcgagtctggggtcctttggctttacccgcacataatctcttgggtggatcaaaacctcttcaactctctcttgagttccaagcaggctcccctgtggggcttttctaagagtgtttagcattggcattgctgcaagcacagtctcactgtgtggttttatgaaggatttgttttttaaaatttattttctattttgtgtctttagaggcagggtcttgctctgttgcccaggctggagtgcagtggcatgatatagctcactgcagcgttgaactcaggctcaggcaatttttcttgcctcagcctccagatagctggcactacaggcacacaccaccatgcatggctaattaaatctttttttttctttttttttaagaacgagggtctttgttatccaggttggtcttgaactctgccctagccttcgagtagctgggattacatgtgtgagccaccatgcccaactaaggttaaaaatcttaagagcccttcaagactctactcctcaaggtcatgaaatagtcttttaaatttgttaaaaatatgctgagtgtattttattttcaactcaataacgctgtcacacatattaaacaataatggattttcccatttatttccttctgcatatatatgtgtgcattgatgtgcatgtgtatgtagtatctgtatttatacaagtacataagatataaatatatccatacctatttgtaattgccacaatttatacatgcagtagtgtataagctgcatgtttcacttactatcaaaatctcttaagcataatttttatttattctgattatttaatacacagtgatgtaactgtgatcccaaatgtgcaaagttaaagccttcaactgcagctgaggagagggcaggaatggtatatgggacggtggtgagtcacgaatgatgggcaggcggccatgagcagggcagcctcctccccgggccagggacaggggaatggcctaaggagccaggacccaagggtagcccaggaccggggagggggcagagacctccccttggcctaggtcaggagctcagaagtgccacatggctgaggggcagcggcccgggaagagccagaggcagagccaggaaagcaccatttcctgggggggcgggggcagggaggtaccctacaggagaagccaggtggggcctcctgtccctggggtggggccatgctggagcatgctgcagcaagaaagacctgaggcaggcgcagggcctgagagccggctggctgggctggggggcgcccccaggcagcctggcccagggagcaggcccgactcttaggggatgctcagcgaggggctgcagagccctcaggacctctcctcctctctccctggaaggagctggggaacccgtagtgcaaatctgtggaccactcagttatggagagaggttggcccgaaggtggacactggggtatgctccctccaccacctcatcctccactgctatcctagtacagctgcttctggtaagcgtgcaggccatggacgccaccctcgatctgggctgactggtccacttctcaaatttgagctctcctgagtacatcatggagccatgctggttactcctatgaggtagggcacaaacttctgaatggaccctttgtcctggatggaggccgagacacctgcacaatattcaccttttccccctcgctgaagtatcgtttctggctgctgctgctctctccatggcatctagcgagcccatgccccagtacttcttgagctgcaccctgtctgagagaagtactcgccgctgggcctccgtggtggtggccagcagggagcccatcatcactgtgaggctccaagggccagggccttgaccacgtgccccacggtctggatgccacatcggcttgatggacacaccaaagtgctgagcgtacttggccaccttgtacacagcagtgccctgggctgaccgcaggccatcacttcctgggtgatgcagatagagctgcagcccataactacagcagtccatccacaccagtgtcaatcaggttcttagcctgggctgctgtcaccacattctcccaatcacctggaggtggaggtacttctgtttgatgtaatgcaccatggtgatttgaacaccgagttcccttgggaggagtccaagactatgacgttgatgcctacccaggtgagcggtccaggcagtatttgtcatcctcatgggtgcccacagctgccctgcacagcagctgctgtgggaatccttggaggccagaatgtagtctcgattcttcttcaggttggtgtgggagcgatggccactagctcatggcgatcattgaccataggcagcttcccttgctaggctgaagatctcatttgcctgtttcaatgtcatgcctgctggagccaccatcagcttgatccttgcgtcatcacctcactgaggagggtggtgtggtccttctcagcaagaaagttgatgtctcggaggagatgatgcccaccaacttgctccccatggtgcccatctcagtgatgaggatgcagagaagccatgccggatcttggcctccagcacatcacccacagtgtgtgaggggctcacaccacggggtccgtgatgaagccctgttcaaacttcttgaccttatgcacctcgttggctggaactctggggtgcagttgtggtgaatgaaaccaatacctcccatcagagccatcggatggccatgtcggcctctgtctcagtgtccataggggaagagatcagtggtgtcttcacatgatcttccgggtcagggctgaagttaggtctacctcatcagctatgaaatctatgaccatgggagaatcaggaagttgttgtgggtgcggcagttggcgccgaggaagagctgctcacggtgagccagtcctggggcacgtagccggtgccgccactgatcagatggtccgccagctgccgcaaggccccgcgaagcgacaaacacccgcgcggccgcctgccgctgctgccgtgctgctgacgctgtgggcctgggaactgtaagcataatttttaatgcccatagtggtgttatttaaccacttagtgttgggtgccttggtcattttcatggaaacttttgctaatataatgccactgataaacatctctgtgcataaacctttatatttactgttattttctcagttagattccttttagaaatggaattgaacaaatcccttgaaagcctccaaactgtctcattcaatcagttcttttaagagctgaagtaagagtattcttagctccacttaattggtcgactgatatactagctttttcttgatttttgtctgaagtaattaggttaagaaaagttagttaacacatacatccctgaatagcagaaactgaatccaccacagatgtacttcttactcgctgaagtcaaatgtggatgtttgtattcagagggcggccctctgacaagtgacgattcagggctcagctcctttcatcttttggttctgccaccttcaacatatggcttctaaggccatgacatcatctgtgttgagctgtgaaaggagtggagcctgggaagttttttatggactaatattcccaggaggaaaacggagtaggatttatgatcacttatccagaacctgctacaaatttctccttatctcatacttgcagtctgtcagcaaatcctgttggttttatctttgaatatcccttgacttacccacttttctcccttgcccatgcaccccccagtcctggctggcgcatcactcccctggatcactccaatagcttcctcattggtatctctcttccactttgccccttgccacttgcttctccatattctgttaagaaatctttattaaaacaaacagttccagacattccccaggtaaaaaccatgtaatagcgtccattagaatttattaaaaaatccaactatttaccttgatgaggtcctgtgtgatctagccttgtctattctccagtctcatccataccacgttcccctaactcgttaaatgctattccaaatggtttccattcaacttttcaatttgccaagctctttcttaccctgtagcctctgcgtgtgccactccctttgcccagaacttcttgttgttcttcacttgacaggttatttctgtttttatttaaaattctttttatttataacaatgagaacacatggacacaggaaggggaacatcacactctggggactgttgtgggtggggggatgggggagggatagcattaggagatatagctaatgctagatgacgagttatggatgcagcacaccagcatggcacatgtatacatatgtaactaacctgcacattgtgacatgtaccctaaaacttaaagtataataataataaaattaaaaaaaaatttatttttttgtgggtacatagtaggtgtatatatttatggggtacatgagatgttttaatacaggcagcaatgtgaaataatcacatcatggaaaatgaggtctccatccccttgagcatttatccttgtgttacaaacgatccaattatatattttttgttatttaaaaatgttcaattattgatatagtcaccctgttgtgctatttattaaatggtaggtcttattcattcttcctatttttttttttttgtaatctgattatttcttgttctttggatttcagcctaccttcatggtgtaacgtacttggttataatgcattgccttttgttacatttttctatttgatctgctcatatttgtggggcacttttgcatgtatgtttgcgaggaaggttggtctagagtttccttatatggcttcctctggttttggaatcagggtaatactatcctcataacatgaattgggaagtttgccttctgaacactagtttctgaaataatttgtgtaggactcttttttttttttcctaaatgttttatagagtgcagcagagaagacatctgggcctgaagtttactttgtgggaggttttaaactatgggttcaatttctttaattgatacagggttggtgaaggtttctattttttttgaaaaagctttggtaatttgtatctttccaggaatttgtccatttcatctaggtgtcaaatttataggcataagggttttttaatccttttaatatctgaaagtctgtagtaagcaccagactttatttctgatagtctcttttcttcttgatcagtctacctaggtttatcattttgtttttttttttttttttaaagagaatcagctttgggtttcattagttttctctttatttcttaattagcttctcagcctaaatgttttctcagaaaggatgtttcctgaccatctacctaaggtggcttcacctttctcttgccttctcctctgattatttgttttctacccaggtctatgtgtaattattttatgtgttatgtgctttttttgcttctatgttacttgcgatattgcagaatagtaataagtctgcctaacatggtaatgtgcttggtgaatttccaaaacatatatggtggtttccaagtatgctagcacagcagtatctatagtggttaagagacagggtctagagttggctcatctcagctttaaccccggctacatcgtacactaagtgtgtaccctgaacacgtgtaaccgtgaacacaaattctgattccttctgagatgagggttgtgaacatggcagctgtgatcaggaggcctggggtttgagttctggctctgttacctgtcagtgtgtgattcttgaggcaattacttctctgagacccaatgatatggtttggctgtgtcccactcaaatctcatcttgaattttaactcccacaattcccacatgttgtgggagggaccagtgggaggtaactgaatcatgggggtggatctttcttatgctgttctcacaatagtgataaggtctcatgagatccaatggtttcaaaaagaggaattctcctgcacaagctctctgctttgcctgctgccatccatgtaagacttgacttgcaccttcttgctttccaccatgatgtgaggccttcccagccatgtggaactgtaagtccattaaacctctttttcttcccagttcagttatgtctttatcagcagcatgaaaatggactaatacactcaattttctcttcttaaaatgatttgatgcaaggagtacctaatcttgggattattgggaggaactggatgagaatacatgagtaggatctagcccagggttggccttttgcatatgaggcattccctcaaacgtactttcccagaacttcagctctccccaccagagggtaagcatcactgtagcaggcacttgcacgttttgtgcacctctgtaccctcactgccttgatcagtgtggtcagacaggcatgaaaaatgcctgtgaaatggattcttctttttgttgcttatgaaatctgcaactgtgattgagtgtcctgaagctcagcagggcaacgatggcttcaacaatctggcccttgcttgttcaggtgagctgctcctttccctttcaggaatcttctaaactgctgggattcccaggggaggacgggacctttagggatcttgcaaaccccagcagaatatcagttttcttcacagaacgtgtctaacttccttcagccctggtctgcaaattccagacatgaaactgtgctatttgtagcttggcctggcaggtatttattcaaaggctgcaggactccatgatagagagtagcacagagccagcaggatcctgtaagtactcctcatgcaactacctgcagtggatttaaagtagctcagggcagtttcaacaccagagttggaggaaagaggttgtgtgtacattgtcctcggggactgctgctgtttatgccttgtggtttcctttgggggagacagatccaccctgcttcctcatccatcttcctacatggatatatcttgttatctagtgctgaaatggcatggaccaggggctgggactagtgctgagatcttccgcttagctcttccaaatacagaaagaactccctgtgtatggttaggattgaagtacatgtgcttggttcaacattccttcaatcagcagaaatccagtcatcatcctagccctccatttcattctttgtcttgcttcatgatgtccctaggggtaaagatttctgaattcaaagccagctgagctgggttcaaatctccacatgtcatttatgagatgaacatcatgtcttctgtctgattcatttgtcttagtttcttcctctgaaatggaggtaatggcaatgtctattctggcatgttctcgggaggctgaaataacacccggcttgctgcttattgcacagcccagcttccctgccttccttctctcccttcatgaatcctccatgtcctgctctacctgttgcctttctgttcataagagtattttgaattcctgcctattctccttttttctctagaagtgaaggagccaacttccccaaagtccgtggaatgccttttactttgttaggaaaaaaatcactttttcttatgtgcattctcatctatccattcacagacgtcatcggagtgccttctgggggtcaggccacttccaggtaccagggattcagaacaaactagtcacgctccctatcttcaagggacttagaatcatccccagagaaggatgcgtgaacaacctcacgtgtgatggtgtggccactttggttgtactagagtggtgggatttggagttttttcttatttttatttatttattgtaaatttttttaaattaaaacaattttaatagagacagggtctcaatatattgcccaggttggtctcgaattcctggtctcaagcagcctccctctcagtctcccaaagtgctaggattacagatgtgagccactgtgccagaccatttttcttatgtgtaaattaaaaaagaatttgaacaggaatgaaagataaaaagaaaaaaaaaacacttccccaaacaaaaaaaaaaaactctttcacttataagaatggtcatcatctggctatttcagatggggaagtacgcatgcctcattttatccaagtttctcacagttcttaagtcttttttcacacacagttccatacacaaaaggtggctttgcaaaaaacttctttaacatagctggcaggctatactgtacatatatctatacacatgtatgcatgtatgtgcaatacatatacctttgcatatatatgtttatgcatacattttattttgctttatttagaatattatttttggagatagagtcttgccttgtcaccgaggctggcgtgcagtggcacgatttagctgtctgcaacccccacctcctgggttcaagccattctcctgcctcagcctcccagtagctgggattacgtgtgcgcaccaccatgcccagctaatttttgtatttttagcagaatggggtttcaccgtgttggccaggctgatctcaaactcctaacctcaggagatctgccacctcaactcagcctccttaagcgctggaattacaagcatgaaccaccatgcccagcctatttagaatttcatagggaattcttatgttattaaaactaagggttataagggcttccaatcgctgtcatatggctggtctcaaatgcatttaaacaccccctcccccattgatttttttttttacatggttttcttatgtttgaaaatttgtagtttctctattaaacattgggtcgctgattctactgcccaggagacccaggcaacacctcaaaagtccacaactctcttggcagatgtgactgttctatttcccagctcatttttct

SEQ ID NO: 5109 - DNA, 12324 bp, Homo sapiens
ccagcctatggccaccggacataaaaagtggggagtgagcaagaatgtagtgagaagaaaaaatcaccccattaaaatagcgtccttcatagaagccaaccagaaaaagctggaatggttcagcaacagaataaatggaggtattaataaatcaaaaaaaaaaaaaaaaaggaaatactgtgaatctacgctaatataaagtaattgaatcagaaataaacgggggaggggccagggctgtagctcacacctgtaatcccagcacttttgggagtccgaggtgggaggatcaccaagaagaggagtttgagaccagcctggtcaaagtggtgaaaccccatctctactaaaaattaaaaattagctgggcatggtggcatggacctgtaatcccagctccttgggaggctgagcgggagaatcgcctgaacacgggaggcagaggttgcagggagccgatatcgcaccattaactccagcctgggcgacaagagtgaaactttgtctcaacaaaaagaaaagaaaagaaagaatgggggagaagggatagctctttcttcagaagaattccaattactgactataaaaaggtaagggaaatacatagtcaccactagccaagcatcatggtaaacactgctgcaggcaaatccaacaatagaaagtcagcatgtgaaagtttaaggaaaacggggctgccagcatcattcaaaacatctcccttcaaataattatgaatttcaaaggaaaaattaataacattacatggaaaaactcagcagacatcaccttaaccaagtgatcaaggttaacattaccagggatggacagatcaacattatgttctacctgagataatatactaagaaagataccacatcattttataatgttcttgccaaaaaatgcttacactcagctaatgatgagaaaatactggacaatcaaggtctcaagatcagaaagaaggaaataagtaagcaactatcaaagactgaatgctcaagccaggtgcagtggctcatgtctgtaatcccagcactttgggaagccgaggtaagcgatttcttgagcccaggagctcaaaaccagcctgtgcaacatgatgaaaccctgccttgtaaaacaaatgcaaaaattagccaggcatggtggtgcatgcgtatagtcccaggtactcggagactgaggtgggaggatcgcttgagcctaggaggtggaggttgcagtaacccatgatgtaccactgtgctccagcctgggtgacagagtgagaccgtgtctcaaaaaaaaaagtataaaggcaccaaggagatacaacaattaaatataatgtggcatcctggactagatcctgaataaaaagatgacactgctttagtggtgaaatttgagtaacaagtatagttaaatattctatttctgcaacttttttttttttttttttttttttgagacagagtctcactctgtcgccagactggagtgcagtggcactccgcttggctcactgcagcctccagctcccagcttcagtgattctcatgtctcagcctcccaagtatctgggattacaggtgtgcgctgccatgcaggctaatttttgtatttttagtagagacaggatttcactatttgaccaggctggtcttaactcctggcctcaagggatcagcccgcttcggcctcccaaagtgctgggattacaggctgagccactggtgcccagcctacttctccaacttctatgtgagtctaaaattagttcaaataaaaattgacagaacaccagtgaaatggctgtcccttagagcaggtggatgtcctcaaatatctggtgtcaaaacgcccttgcttttagaaagtaatattgattgttgatgggggacagtgttagtttttgttgatttttgtcgttgtttttaatgtgtttttcttttgggggaaatctttttgacaagcttaaattggtatcctcctttttgttttgtttttaaaaagtttgttcctgaaatccaaaattctgagaactgctaagctcatttaaaattattttctaatgattaatagtgaaggcaaatttgcaagatgagtgttgttccctccacagaaaactaacaatctccaagtcacaaaattcattcctcatgtttttgctgtgtcaaagcaaaattaagtccatatcacctctcccaggaagtcttccctgttcatcccagatgggaatggcatcatgccttgttgtttctcacaccgaattatgagcttctcaacatcagggcttctcatgcacatcacgtttctcgtaaaaggttgtgtttttgtggcagttgatttccacaatgaaaatttatttttttaatgttacggtatctctgtagcttttgaaatatttagtatgttaaatgtattttttaaacttgctttaactcataagctataagatgctgaaaaactcatattctaactcattttaagctttttatctttcagctctaagatagattaaaaaagaaaaggtgtttcaacgatttcttagtaccaactatcgatcctttatatgttttctaaatgtgctccttacagcaatttggggctctcatgattagtgtgttaataagaattaagcacagcagaaaaaaacttaatttgtattgctacattactaattagcctgagagctttagaggtttttatgtaaaatgctaaaacttttgttcaaaacttatttaaaactgaaaagaatattggaacaaattgccaagcaaacccagccttctttgtgttatcaaaggagataccagctcacctagcaagtaatacaactcactaaaaatgacaaatacatgatatggtgaaggtataggaaggtacagacactcagacactgcgcagaaagagtatatacagggaagaagctttctcaagaattatctatttgcatttaaactcttatttagccccaggtaaaccagcaacgttgctcatgactgaaaaaatggaaaacagatctgtgcccagcaataagggattaatttactaagttatgaagctataatgtcaagtcatacaactgtactgccaaacagtatgtattgacatagaaacatggccactatatgtttggtaaaaaaaaaaaaaaaaaaaaaaagaccacagtgtgatttcaactttatgaaatatattgaattttaaaaagtcaggaaaagctacacaaaattcacagtaattgttcctgacacaagaacaatttttccctcatttgtatatattcaactcatttgtatattttccctcatttgtaataattcatgtacatacacacacacacacatatattatttattttttgacacggagtctgctctgttgctcaggctggagtgcagtagaactatctcggctcactgcatactccacttccaggttcaagcgattctcagtcctcagcttcctgagtagctgggattacaggcatgtgcaccacacccagataatttttgtatttttagtagagacagggtttcaccatgttggccagctggtctcaaactcctgacctcaagtgatctgcccacctcagcctcccaaagtgccggattacaggtgtaagccactgcacttggctataattattatatttacaacattgactttatactgtgcaatcaaggaaagtaattcattagcagagttctaatttaatcaaatagatacttttgtatgtaagtgtataacatacatgaatgaatttactgatgacagcactttttcttttttttttgtaaatacaagaggttatccttcgatatgagaattgttgattaatgtgtgtgagaagatacttgacaattagatttctctgtgttattaaacattttacctggtgcatgagcttttacaataacaaagaactagttccaagtgtatgcagaaagatgaaaaagttctcggcatatggttcattatgtgtgttctacccagccctaatgcacagctccacatctccggcacaggtccccagttgtatcagtgacaaagaggaataactggccttctcctactcaatgctccaccgcttaggcaagaaaacaggcacagaagtcagcctaactgagtttgaatcccagtctgctaccggttagctatttggatgctgggtgattaattcaccaaactcccagggatcggtgaaatgggaataattacacatacccagcaagagtgcagcaagctataaattaggtataaatatgtagcacccagcactgtgcctggcatgtggaagtgatcaataatcacagctatattgataataaccatcctaacaatgataatcctatctccaacaccacaaagctgtgttaacattaatgatatggaaatgtttagcatagaatagcccacaaatgtgtcccagaccacttttctctgattatgcccaattctatccctcaaaaatcaaggttatgataacatcacaagacagtgttgcaggaaggttacagattgaagggaccaagtggttgattcaatcaatcatcattgattgaatgaaccaaaatacaaacaccactggaaagagaagtggctatgcagggaaagcaagatggcacagtgcaggttcctttgcattctggagtgtgtttgtgtggtgctgaaaagataagtacctatgctattcccaaagtcaggtctcaacagaacctagcatgttcttgtgctagtggctcccatgttggcatgacaccaccatccagagaacccagctagcaactctatgactcccttcataaggagtactgtcaaacatcaggaactttactgcagtgactcaagattcaaactaggggccacgaaggctctgagaaaggaaggtctatgcctggtgtctcctgccagcacccctgcctgggccttctagaaatccatccctgtatcttgataaatggatgtagcaaatgccagtagtactgaggcaaaggtatacatggccataaaaaggtaggcatcattaggaattggccatttaatccttgattgggtgaagatctcatataacatattgtgtattgaacttttttttgtttgttttttgagatggagtctcactctgtctgccaggctggagtgaatggtgccatctcagctcacttcaacctccacctcccaggttccagaaattctcctgctcagcctcccgagtcgctgggattacaggctcatgccactatgcccggctaattttttcatttttagtagagacggggtttcaccatgctggccaggctggtcttcaactgctgacctgtgatccactcgccttggcctcccaaagtgcttggattacaggcgtgagccaccgtgccagccggaacttttgtttccatgtgatagtctttcaaagtgcacctctctatcccactgcctgcacctacctctccacattcagagcactggagatgaggtctagggtaggcgacttacacaaactagagatgtgtcatatctccttccttcctgcctggggactgagattttcccacggtccacaaatccacaggaaagttaagcattttagaagaaggctttgaatctttactactaaataggttgtgctcttattttaaacaagttgagttattttgaatatgtgagacataatcaaggtacacacacactagaaaaagaaatgtgatatatatgtatatgatacatatatttatatatgtgtatatgattcacacaaatatacatatatgcatttttatttatttattttagacagagtctcgctctgttgcccaagctggagtgcagtggcatgaccttggctcactgtccacctcccgggttcaagcgattcttcttttttttttttttttttttttaggaaaaaaaatcttggtggtcatatttattggaagagcttgagaaaaacgaaaataccatttagcttagaagttgtgaattatctgcaaatcaactcatttcaggagtggaagaatccccagaatttttcttaatatccaaatgtatgcgggtttctcttttgaatatcttgcacctttagagagccactgtacaaagtctcctgttttccatacaggacaaattctttgtttcagccaactctagtggaggggcaaccaggaaaatgccatctccccggagaaagaacactggaatattctgtttgttgattcatatgtctcttcatatgtttcctcatcaatttctatagtagtcacagttcttccacgtctcccaagatcatatttaaatgttgatcataagtatgtaatctgcctcgagctctcggtcgtttctcattttcacacaaattcgctcctctgggctgagcctaagatcagggggtcctccacagtgttggtagtttgctgctggtctatgtcgtctgccatgtttcacaagtaattcttcggtctcagcctcccgagtagctgggactacaggtgcccgccaccacccaggctaattttttgtacttttagtagagacacggtttcaccgtgttagccaggatggctcgatctcctgacctcgtgattcgcccgcctcagcctcccaaagtgctgggattacagcgtgagccactgcgcccagcaccatacatgcatttttatctatacacatacatatacgttatgtatacatacttttttttatatacagacacacacacacaggagcaatgacttcagaaaaaaaaggggtttcctaatagttactatagagtgactggcagacaggaacctcattatctatcctctctacttttcttttcttttgagacagagtctccctctgtgacccaggctgggtgcagtggctccatctcagctcactgcaacctccacctcccaggttcaagcagttcgctgcctcagcctcccaagtagctgtgactacagacatgcaccaccactcccggctaattttgcatttttaggatagacagagcttcaccatgttgcccagtagtcttgaattcctgacccaggtggtctcctcaccttggcctccaaaagtgttgggattataggcatgcaccaccaccctggctgtcatctctatttttgatgatatatgaaaatttaatcaaaaatatcaagaaggttaaagacaggccatctagaaaaacccaaaaacatgaaaaatagaaaacaaaatttaaagaatgagagaacataatgacaaacaattaaaacagtttacctagtttaagaatattctacattgaaccaaaaaacaaaatccaactatttatcaggcaaaatataataaggaattcaaaagcttaagaataaaatgtgataaaaagcctttaaaagtggcttgctggatattcctagcatatgaaaaataagggtctcttctaaactagaaatgttttccagttgtaattgccagttatacaagttttcaatacatcatcaaaaaccagcatcaaaattaaactgcagtaatgacggattaacgggcttcattggcattaattaaataaagtgcctgagtccctctggaaagtatttgacaatatgtgcaaagtctatgggtttcagtcacatacctacacacctgaccaaaaaaaaaaaaagttaagcacatcagcagacactgtcttctccctatgccaagcaaaaagaattaatccctttatttctggcaggggtgggggggtgctggggtgggcaccagcaaacgttccaaacagatgtttacaaacagaaggtaactgataaaaaccaaaacacaaagctgcatgtctttcctgattcacagatgaacccactggaactactgcaaacagcctttctggaaaaatccagcaattaaaaggtgcaaacaagctgcctaatacccttgcgtagactgaattctttgaagaaaataaagtttattgtctggaaagagagaaagcatgaggaaagcactaaagcgtggaggtgaacaattagacagatgttcagttaaggaaataaagagaacagaagaagccacacccaggaattttacgagaatcctgacaactcggcaccacatcaagggcaagggtaaacgaacgccacccaagcccaggctgtgcaacttgacgctaactgctgaccttgcagatccgcctgcaggtgatgtggctctgagcaaaggcaggtgagcctgctcacttcaataagttctaagttcttctccaaggtgagccacagactgcagttcttcaggacagagttacatctctatcttcataatattactgcaggtaatggcaaagataatactaattatccccaagtctttcatattggtaaattccttggtgaataccaagaatatagctaaggattatttcagaaagttttggcttgctaatcctgtcccaactggctagaggagaagggacagaaaggtgctacgtttgaacatcttacagtggcactgctgctggatgatttctattaatcgatagatttggtgactgtctttctcttggcttacacccctggaaggctcacaggtaactcttcagcccagcttggcaactgttcatagcttctggccaatatttctgcacagtgctttacctctcgatttattgattttcccttaatcccaatagcctcatctgtgtctttttctcttgaggtattataccgggcccctacataaacaatctcaaatcctctttgcaaagcagcaatgaagagttgctagataggtgttatgatgaaaaggcagaaaaaggaatgcatagttagctggctggctggacacaaatagaaagatcaaaggaaaacagacagtattttatttattcctcatacaaaaatcgagttacaaactgccattattttacaaaagaagaaagacaaataaattacccattccagtaatttctaagactgcttttcaagtaagtgagagaaatatttttaaaaaatcattaaagataaaataaactataagctagtgctatgattgatcttttctctatactcctaaccagttctttgtacagccaatattcaatcaaccgccaatccagaaagatctatctaactctgctaacactccaaggacataaaataaagactcatgcattctttaagaagcatatacattatagtactgctgtatgtggaatgccctctaccccaagatgttcatgaactaatccctgatatcataaatatgttacatagcaaatggtaattaaggttgtagatggcattaagattgctaatggctgaccttcaaataggcagattatcccagattatcagggtagactccctgaagttacaggttccttaaaagcagaagcagaagagagagaaccaggaacagggcagtttgagaaggcttgagcagccatccctggctttgaagatagaggaaggggccatgagccaaaggatttggcagtccctggaagctggaaacagcaaggaagtgggttctcttctagaacctacagaaaaaatggtgtcctgctgacacatcgattttagcccactgagacctattttggaccactgactccaaaactgtaaagtgtaacttttgtgtggttctaagtcactaacattgagaaaattattacagcagagataggaaacaaaatacagttatgtaacatgtttaatttgtgagatttacattgcacatccaaacttctggctcctgtgaaaaatgaagacagagaagccaaggtctgcctgcatatgctcacattttcacaatcgcgtaggccgaggtgcagctgttccttgagaggggcactgaccctcttgtgcgccaccatctccaccactctctactgtctcgctgactcaaagctctggatcatcaactgctcccaccaaacatttgagtgtttgactcttgatctagtttgaagaaaaacaaacatactgctgggcgtggtggctcatgcctataatcccagcacttgggaggctgaggggcgcatatcacctaaggtcacgagtttgagaccagcctggccaactggtgaaactacgtctcgagtaaaaatataaaaattagctgggcctggtgatgcacgtcgtaatcccagagactcgggaggctgggagaggagaatcgcttgaacctgggaggcagggttgcagtgagccaacatcgtgccactgcattccagcctgggcaagagaccgagactctgctcaaaaactaacaaaaaacacatgcatagccaagcagggctgatattcaggagctatggcaatatagagccagcatctgctccgcttagtcaggatccatgccatccgtgaatgttaatatttagagtagaaacagaggcagcctgcttcctgaacattcctgcctgcacaggggcgaccacccctctgccccacctaaagcatatatgatatcccccctcaccccatccctggggccaggcaaggtttcatggccacagttctggctaaaccaatgcagtcgggcatcccagtttctacctgacacaactgctggacaatcagtacttttttctgcagaattattattctgaactcttgtagcacaaaaaagtaaagggatttaaaggaaaagtgatatggactataatttgcctctctatattgtaatcggggagcagtgtttgttggggatgtgaatctttcctctgaccagaaggatctctgtaagctcttggtatgtgcctaaaagcacacactgcactgtaagaaatgaggtgggcatgattacaggtgtgacctgataaccgctgaaaaaaatcatccatccataatcatatgaagagatgttcaatatcctaagccatcaagaaaatccaaatcaaaatccaatgcaataccgcttcatacccaataaaatgacaagactaaaaagaaaaatgacagcggtgctggtgaagatatggagaaatcggaaccttcctacactgctggttagaatgtagatggtgtggctgctgtggagaacaatctggtggctcctcaaaaggttaaacaaggagttcccgtgatccagaaattgcactcttaggagcataccccaaaaaaggaaaacctatatccaccaaaaatgtgtagacaagtgtacctggaagcattatgcacaatagccaaaatgtggaaaaacccacatgtccgtgaactgaatgcatagatgaaatgtggcatatccgtaaatggaatttactcagccctaaaaaaagaagtactgatacatgctacaacatgaatgacccttgaaacatgatgctaagtgtaaggatcgagacacaaagggccacacagtatctgatttatttattgaaaagtctagaataggcaaatctatatagagacagaaagtagatgagtggttacctgagctgggagagaggttgggagtggagagaaaaggaagtggggaaaaggatgccagtcaaggtttctttttgggaaaatgaaaatattctaaacttgactgtggtgacagctgcaaaacctctgaatatactgaaagcactgaattgtacattttgaatgggcaaagtttatgtatcttgttatatatcaataaagtagcttgagaaaatttacaaacttcagctcgctaagaattttagtaataaatcatttgaaacatacctcacaactgatggagacatatcaggcaactattggactctgatgagattgtggattgagaaaagtatggtaaacccatatgacagaatattgctagctgttggagatcacggtaagaaacttaagtgacatggtcaaatgtttgccatttacattaagttcaataaaaagcaggctactagagaataatacacagtacgatgttatttggttaagagtgtacaaatgcaggcatatgtatggtatgggcattagctaattcatagaagaaaaacacttccataacacaaaccgaaatgttaacagggattatttctggggaatgagacgagtcaaaagctgagcccagaaatacaaaatcaatatagcttaaagttgagtcattgtttccaatcactgggcttgctaaaattatttctacactgaatttgtcaccgcaaggcattgtgtttcatccatgacacctgcactccaagcataatttcaatcactgaaacaattgcaaattcacttggctgatgaaacgtctgggaaggatgaaggattgtcggaagggtgcaccattgggctcataccaatccatggataaatgggaaaaggtatggcaaggctgtgaaggtggccgcagcaccaggcaagacagtcagggccatgtaatctcacatcagctgactag

SEQ ID NO: 5110 - DNA, 12561 bp, Homo sapiens
ttctctacaaaaaaaaaatgcaaaaattagctgggtgtggtggtgagaccctgtctcttaaaaaaaaaaaaaaaaaaagagggactggcgcggtggctcacgcctgtaatcccagcacttagggggccgagacaggcggatcacgaggtcaggagatgagaccatcctggctaacacatgaaaccacgatgaaaccccgtctctactaaaaatacaaaacaattagccgggtgtggggcgggcacctgtagtcccagctactcaggaggcggaggcaggagaatagcatgaacccggaggcggagcttacagtgagctgagatctcgccactgcactccagcctgggcgacagacaagactccgtctcaaaaaaaaaaaaaaaaaaaaaaagaattttaataatatattttattaacccaatatatctacatatttcaacatgtaatcagtattttaaaattattaatgataattttacactcatactctttcaaacctagtgtgtaatttgcacttccatcacatctccactggatgctacattttcatgagaaatactcgatctgcatttacatcttgtaaaacttacgttgaaaaagtagactcacacccaaattgtcccaaatatgcttaaaagcttccaattattgttatattgacaagtacagttaagcaaaaggctgagtttaatcaggggtcgcacttgattaatctcagcttaaaaacagattcctcctcgggcgggggttgccccacccttggtctggttagaccacgttaaacagtgcacgcgcctctccccgcccatcgggtgatctggctttcactaacagaaacgtctggagcagtcgcaagagaatcctgtctcggaccagcctgcatcttacctaatctagtggttgcgtgattagccacccagattccctccaggactgcaggccgactccccacgcgctgctgtggacagcagacagtccgcagctgccgtcctctttgggagttcctcagctgaagagcatcatcttgacctcgggtcctgcctcctttctgggcagctgcatcagtgattggtcagtagggttttttaaaggtccagtcttttcacccaaacttgggacgagttgaggctctatcttcctctgcccaacattgctctttccctacccctacgagtcttcgttccaaaggtattgctcctggggtaccagtaaacttctgtgtggtcatctttatctcaggtctacttcctgtggggagctccagctatgatcgtgtgtgccgggagtgagctgcaaaagcggatgctgaggtgggattctggagctggactgctgactaccaggctggcagtgaggactcttcatggttggtagaggaagcgcagataggtcgggcacacggtagcaatgaggttggaaagcttccactgctgatgaaatgcaatggtattctggggaacactatccactagtggtgccctgtgtcaggagtttgaggtatgaggggagagaatacctatagaacgtagggccagagcagcggctcgcgcctgcaatcccagcactttgggaggctgaggtaagagaattgctgagcctaagagttcaagaccagcttgggcaacatagcaagacccacgtccccataaaaataaaaattagccaggtgtggtggtgtagtccctgctacttgggaggctgaggcagaaggtctcttgagcctgggaggtcgaggttgcagtgagctgtgatgatgccgctgcacttcagctgggtgacagagcaagaccctgtctcacaaacccaaaaaccacagttaaactaggtggtgctgctaaacacaaagactttgggaaatgacaaaagctgagaatgattaacaggcaataacagctaagggtgaaagccaccttaggaacacataaagaggtttttatctcttgcagcgcaaggtagagaaagctgaggactagacccaggatttagttgtaagatcagccaagctccaagaaggttaaatgctccacctagacaggctgctgtgccagatgcagggctctgatgctgagatgcagacatctgggttgatgtactcccaaaacctcaaatccccagagcccgtaacccggagtgcacagaagtggccccactcttcccaccggggcgagagtaccttcctcacagagacggaggcttccctcctgcaggacattaaccccagcatctctctcctttccagtccggccatgatggcaccaggcctggtaagagaggaaaaggaccttgtaccaagggagctgcgaatggagccaaaaagcgcttgcagggacggggcacacgtgatgagaactgggtgctgaagagctggaccaaggggaaagcccatgaagctggagaaaggtgggggtatcagttcgggggactctcctaggatacaggacttaatgccttgctcaggaccctaggggatgggccacctgctgccggatggctcctagaagcaggcagaaggcagagcacactaagcaaaggagagggctggcgctgctataagatggtggaaagaggcgttaaaaggctcagaggtgggcagttggtggacaagccctgtgaggcagaacgcccatgggaaggcccggaagattcattcgtctagaaagcaggaatgtgaccatgctggtgagagggcaggcacagctaagctcatggggtgccccctctagaagtcagggagaaggtgggagatgctgctatggaacaggctgctgggcaggagggtgctgggagcctgagatcataagaccaggcaatgccgacagctgggggcctgcctgtggccctatggagatgcctaagagttggtcacacaggcaaaaccaatggcattgctcaactgtgcaagcagagtcatgatgggtgacgggggctgggtggcctccatgaaaccatcggctttctgtggcaccggaagtttgtctcgggctgcttttcccttgacctgaggctggtctgcccctgtgtgctcccacagggcacctgagcttcctctgttggaaactaattactccagttggactcacctgttcacccgacagtcttcaagctcgatggtgggcttcgaggcagggctgtttctcagtgtctcgtgaagcaataagcttaatcgcccacagggcttctccgagtcgagcacctggggaaccttgttagcaatgcagattcccaggctccacgccagcgtacagttcagaaatggcatggacagggcccggcctttagtgtattataccttccaggtgattctatgcatgctcaagtgtaagaatctgatacacaggagttcagcagctgctgggagaatgatccccggggtagagggatgggaaggatatattaaaaaagagaggaggttaagagaaacgcacctcatttttgaccagtagtggggaagtattagctcagggaaggcagcacagctgtgagctgtgtcacatctgaagactgctccctggtaggagtcggaatgctgccatggaacatccagaaggtaggaaatacagtatccgttaaagaccttaggttttaggatctgcaactctggtccaaatcctttctctgccatggacctgtccccattctatccattcctgcttcgcagcccaccgaggtctgggctgtctttaccttgggcaaatctttcatttttttttccagagaagcgtcttgctctgttacccaggctggagtacagtggtgctatcatagctcactgcagctcaaactcctgggctcaagcaatcctcccatctcagcctcctgagtagttggaactccggcacacaccaccatgcctagctagtttttctgttaaactttttctgaagagatggggtcggcgatgttgcccaggctggactagaactcctggccccaagtaatcctggtgccccagctccaaaattgctgggattataggtatgacccactgtgcccagtccacctgtgtctttattttaaaatgactcttgtactacatataatttggctttgcctttgaatctttatccctttacaatttctgcgttttattatggttgttttaggtctaccattttactcttcactttgtttcccactccctcccctattttggctcctcttctttcttgccctcttttgtgttaaaaatcttttttttgagagaagtcttgctctgtcacccaggctggagtgtagtggcatgatcttgctcactgcaacctccgcctcctaggttcaagcaattctcctgcctcagccttctgagtgctgaaatgacaggcacccaccaccactcccagctaatttttgtatttttagtagagatgggtttcatgttggccaggctggtcttgaactcctgacctcaagtgatctgcctgcctgctcggcctcccgaagtgctgggattgcaggtgtgagccactgcactgggcctaaaaatgttgatttcagttttaatttatctactagtgttttggatatactgttgctttttttcttcgtggttgctctaatacagccttaacttctcgtattcttagtattgtagcacatcacgcacttgaaaattctttaacctctctgaacttcagttacttcatttataagacgagaatggtactttctctcatgggttatctgactgccgaatgagagaactcaagccgcgtacacggccagggcagaaaagcaatgcctgttgactgtcatggctgatcctagtcccgtcactactgtagaatgtggttccagtcatcagcactgggcctcctgagaccacacggagccaccactgacatccccagcggctgacccactgcagggggtcatttgtctacctgctgtgatcacccatctgctaaatggctgcccctcagagacactggtgtctcaccagggcacccctcagctgcctttccttgcccaggcctggccatcctgtgccccttctgcaggctgctcctgggccggtaacccaaaccacctgacgcagccaggccccacacgccatggcctgctcccagtcacagaaaagtctggcttgatttttaccactgcagtcctccctgtgcccttcagatgcctggactcgcctgtccaaacctccatctgctgcccattcttctcactcgcagtgatggctttagcaactgcagggacacaggcctccagggacactgtcttctcacactcagcatcagccccacaggtggaagtgccagccctcccgggggcggcctgtgcaaccactccaagtgggttttggggatgtgattctgggcctttcttttctttgtgtgtgtgtgtggtgttggttttttttttttttaaagacagagtctcacgttgtctcccaggctggtgtggagtggtaggaacatggttccgacctcctgggctcaagcaatcctcccaccgcagattcctgaatagctggaggccaagaggtgagtcccaacttcagacttagaaataaagacataacccaatacgcagttcagttagaaaaatatccatggaaatggaaaaagatctctaaaatatcaggataaaaatgggctgttggccaaatacagtgagcatggactcagagttgaacaggaagaagtctcaactggaaatcacctcatgagctgggttttgttcttggcattgctgctttcggctggctgcctcaccagaggataaaaaccactgcctcctaggcttgtgtgaggattaaatgaagtacagttacatctgagatacgcccagactgcaagaatttgtctttaagaggagcttcacttaaaagcactgggtttatgaggattacaaggcacttcaaaagagcgctgatcttccgtcgcagggtttcacatggcctggggccctaaggagcacttgaagcgtgctgcagtgccgaagcattggatgccgacaaactaaagggtatatttgcacctcgtccatcgacaggtccccacaagctgagggatgtcttccgctgatcgtcttcctcaggaatagactcaagtatgcattgaccggagatgcgtaaaggagatatgtatgcaatgcttcattaaaattgatggcaaggttcgagtggctacacataccctgctggattcacggatgtcatcggcatcaagacaggtgagcatttctgccggtctgtgacccaagggctgtgttgctgttgatcgcgttacagtcgaagaggcaaagtaaacctgtgcaaagtgaggaaggtgactatggggatgaagggaatccaacgcctggtgaccatgatactggaactatccactacccagatcctgtcatcaaggtgaacaatactgtgcaattgatttagggactggcaagataatcaactttatcaaattccacacaggcaatgcgtgatggtgattggcggagccagcctccgtcatgttggtgtgaccaacagggaaggacatccggttctttaaatgtggggcatgtgagggatgccaatggcaacagctttgccctgaggcttccaacatttttgtcactggcaatggcagtaaaccttggatttccctgcccagggaaaaggcacccgacttactattgctgaaaagagagagaagaggctggccaccaaacagcagtgctaaattgcagtagcagcgtatctctctctttttttttttttcctctcaaatagtgaatcttgtttctaaaaaaaaaaaaaaagttctgatttgaggctaggcgtggcggctcactccgtaaacccagcactttgggacacagaggtgggtggatcacttgagggtcaggaattagaaccagtctggccaacatggtgaaacctcgtctctactaaaaatagccaggtgcagtggtcgctcttgcaatcccagctactttgggggctgaggcaggagaatcttttgaacctgggaggggaggttgcagtgagctgagatcacgccactgcactccagcctgggcgacagagcgaactccatctccaaaaaaaaaaaagatgtgatctggatttttagagccttgggaacatgcgctaatgagagtaacccctgtggtcaccttcctagttgtagagtggggtgtgcgaactttcagcatttgtaacttgctaccttgtagggacaaccctggcactccttccattgtttccttgacttttctgcctctactactttacctttttgtataaaggcttctcttatgtgaaggtggatgtcaaatatgctttctttgatagtatagtctcaagggtacaatgcagctctgaagagctggagaagtgtagtgatatagttcgatgttcgtctctgtccaagtctcatgctgaatgccatccccaatgtcggagttgggggctggtgggaggtgtttgggtcatgagggaggcacctcatggcatggtgctgtcctcaagatacttcttgggagagctggttatttgaaaggtgtggcaccccctccccctgctcctaattttgtcatgtgatgtgcctgctcccccttcccttccgccataattgctagtttcccgaggcctcccgagaagctgagcaggtgtctgcaaaccatgagccgattaaatctcttttctcggccaggtgtggtggctctagcctgtattccagcagtttgggaggtcgaggcaggtggaccacctgacgtcaggaattcgagaccagccggccaacatggtgaaaccccttctctactaaaaatacaaaaattagctgggcatggtgggggtgcctgtaatcccagctactgaggaggctgaggcaggagaatcgctggaacccgggggtggagtttgcagtgagccaaaatcatgccactgcactccagcctgggtgacagagcagactccatcttaaaaaaaaaaacaaccaaaaaaaaaaaaaaactattttctttataaatacccaacctcaggtatttataacaatgcacaaacagcttaatgtatgcagacagccatttatagggtaattaagagaccttgcttgtgttgtgctgtgttagctgaggtcaattatcttgcccattttaatgggtttatggtgttttaggataaatgagtgtatttagggactaagggtgcatacagatttttccaccggaattaatggcaattatattctccacttaggagaattatcctaggaggggtttttaggtacaaattacccctttaaagcaggagaatgtaggtgaaaatacatcagaccgcacaacacaaagttttcttaaatgtttttatgttttgcttgttttgagacggggttctcactctgttacccaggctggagtgcagtggcgcagtctctgcctccgggctcaagtgatcgtcccacctcagcctcttgagtagctgtgactacaggcatgtgccccacatctggttaatttttatatattttgtaaagacgggggagtctcactatgttgctcggctggtcttgagctcctgggctccagcaatccacctgccttggtctcccaaagagccggattaccggtgtcagccaccatgccatcattaaatatttaataactggagatatatctaaaataatgtaaatgtatacaaatatacatactgtcttgggtgtgactggctggggccggatcacaagcaataaaggaattcaagatagttgcaggaatagaaaggcagatttattagaggagagtatgggctgggcacggtggctcataactgtaatcccagcacttcagaaggctgggcaggcagatcgcttgagctcaggagttcgagactagcctgggcaacatggcaaaaatctcctctaccaaaaattaaaaaattagccaggagtggtgcctcgtgcctgcagtcccagtacttgggaagctaaggtggggatcatttgaacctgggaggcagaggttgcagtgaggcaggtcgtgccactgcactccagcctggatgacagaaccagaccctttctcaaaagtaggagatacgttgcaagagtacaatgggcagcacagcagagatggggctgcttgcaaagaggaggggcttgagggacgtcttacaggctcatgccggagggggctgtgtgcggagcaaatggatgttgtgtccacaggttgtatgattagccttctcttggaacagttgctctccctcactgggaccccttccctgttgctgctggcacagcttatcaggactccacattccccctctactgaacaatgcccaagctctggcactggggtggcagtttcattttgcagctatttcctgtggcctggggcatagagttgaccctacctatgcctgttggtctgtcaggagaccctgtggtcactgtcccgggttgtgaggcctgggatgttggctcttggtggacaagggacttgttgaggaggggagcctatcaaggtgaaactgatgtccagctgcattcaggggagactagtaaggtagccagcatcctcggggataccgatattccatcctcagcatcatttgaaggtgaactgttgaattcgtcccagtgctgtttgggatcacctggcttaagatgtccagagcagggggctggctgtcttcacaggagaatttagcgtgagaaagagggggtccaggttccccaaatgtgtgtaggtttgccctggttgagcttctgctgccaatggcactacacgtagggtttgaacttttggccagaaaggataggaggggccttcctcccttcccagcaaggtagccaaactgtttactccttggcctccaggctacacaaaggagtggccctagccagtggcatgaatttcagagggatactagagtgtttccccgggaagacagaaaaggaaagctgtaaactgaaaggtgctgtaaacttttactgaatcaggcagcggtggtcggtggtcgggtggtcaggcattctccaccgggaccttctggtccactagggagtagacctggctggggaccttcagttgttccaggcttgggcgctgtccactgagaggctggagttggagaagaaagggagagaggagggaggactccctaagcagtccgcgagcacttcccatatgggccatcaaaatgtcacgggacaactggctacggctggtgtggcaggcggtaaaggaatttactaagacagtccatggggataaaaggcagacttattagagggaaagcacgaagatatgttgcaaaggtacaatgtgagcacagcagaggggctgtctgcaaacagacaggggctagagggaagtcttgggttgtgaggaacgacatgctgctgggctacgtggggagtgaggtattggggaacatgccagcaggtatctgtgatgagccatgtcttggaataattgttctcccccaaaggagaccccttcctcttgcttactttccatatacatgtgtggagtctttatctgaaaactgggctaatacggtaaatattttatactgatttatcttctaaatatttattagaaaatatatcaatgtagaagcaccattatagctctactctatttaaaaccataccagcttggtagtaaaggtccttatccagaggtaaacgctgttacagcttgctctaagtccttctaaagctaccttgcaaaaattagagtgagaaaatcgtgacaatgaaagggatctaacctaacgaactccatcttgctcctacctccaagctgcccttggtcattcctggacatgggctgaactagctttgggaggagttttttattttttatttttatttatttattttgagatggagtcttgctctgtcacccaggctgagtgcagtgacgtgatctcagctcactgctagctccgcctcctgggttcacgccattccctgcctcagcctcccaagtagctgggactacaggtgctcgccaccacacccggctaattttttgtatttttagtagagatggggtttcaccgtgttagccaggatggtctcaatctctgacctcatgatctgccccctttggcctcccaaagtactgggattacaggtgtgagccacgtacccggcctggaatttatagtttaactttggaacaaagacaacagcccttttgcaaacaaacccccttcttgcctggggactagacagcctttgtaagattaacaaattagccataggttagaaattgtggtttaggagtcttgtagccagaggccacaagattgcaaatctcccataacatcactattgtaaaatctaagattggtgctcacatatctttcagaccctgcatctgatgtaccagctagtgccacccagaatggtaatctggtcatgtcattcaataagttcgtgatcccaccaaggaacagaagatggcaagaacccactttgacctcttctttatttatttttgagatggagtttcacttttattgcccgggctggagtttcactcttattgcccaggtggagttcagtggcatgatcctggctcactgttccctccacctcctgggttcaggcgatctcgtgcctcagcctcctgagtagctgggattaaggtgcaagccaccacacccgggtaattttgtgtttttgtagagatagggttttaccatgttgaccaggctggtgtcaaactcctacctcaggtgatccacccgccttggcctcccaaagtgctgggattacaggcgtgagccacgcccccggctgaccccttatttcatctctagacccaaccaatcagcacaccccactcctgaccccctacccaccaaattatccttaaaaaacccgagtctccgaattttcagggagatgatttgagtaataaaactccggtcttggtcagccagttctgcatgaattaaactcttttctattacaattgccctgtcttgataaattggctctatctgggcagtgggcaaggagaaatgtcaggcagttatacttcctggtttttgtctaagtttataacatacttccatatgtaatacatattctataaaaaatgctatacataatatcttgtaacattctttcattcaaaatagaaaattagaattttgtatagaacagactgtataatgaacacccatacactcttcatcagattagccaattgtatgttgtcacatcttccttcctccatctcatttctccccctccggtgtatgtgtatttatgtgtatgtgtcccttgataatccatgaggaactggttccaggactcctgcagataccaaaatccaaaagctaaagtccctgatataaaatggtatagtattttgatctatgcacaccctctagtataccttaaatcatccctactgcttacaatacctaatcaatttaaatgctctatagtcattatatttagggaataatgacaaaaggtctatgtgtgtcaatacacatgcaaccatccatttttttctttgttccctgaatattcaacccaaggttgctgaatcctcagatgcagaatccatggatacagaaagccaactgtctgtgtg

SEQ ID NO: 5111 - DNA, 12514 bp, Homo sapiens
actgttgcagatacctaggtggtgagttagtggatccaggcaaaagtgacaagagcaaccaggtagttatcaccaaaagtgaggaaagaggaagggtatttgagaaaattacgacgagtcaccaatatgcgaacctgccaaggatgttttcctcccctgtgtctcctaagagactgtctctagcttggcttgacatgcagtgctacagatagatgctcagcaaaagcttctggaggcatagttataatcattattttcactagtatttactgagtacttattgaataccagggatatgctttgtgctttacataaattatttcttcttctcaatggaaatagtattatgatcacctttcacagatgaaaaaactcaagaaaagaaagactgagtgacccacctaaggacttgccccaatcatcatgcagcctgcctcctggtgtgcaggtcactgatgctggctttgtgcaccgggcatgggcaccggggtctcccacgtagggtaccagtgtatactcaaagccacaggaaaactcactgcatctccctagagcacccattttattcactgctaagcatcttaagacatatttttacatttacatgaacacagatattttgagtgaaatgtaaacttccataggagctttaggatacatcttggaggctggtcaggggctacttcaggggatatcaatcctccaggacctaaagatattctttgctgaaagcactagctaagacacagcttataaagggggaaatggggctggagggaaaacatgacctcgaaagtcacagagatggtgctcagacagccagggtttcagcccccaaattctgagtggttctcagctctgcaagcccctccaccagccaggctggatagctgcaagctctggagggctaggaacgcagtcccttcttctcttacagaattcaccccaaaacatcacattctgccctccccttccactagcactgtgattactgctgcatcatagtgccctttaaaagaacatggtttccaaatcctcctaaacatgtttgcaatgattgcttggcccttttgataaataaatgaagaagacgcacctgacctgatggctatagagggtaagatggggctgtaggagaaagaaaaggacactctgcaaacgacagaaatagtcatttacatggcaaggagggagggaacgctctgactcccagggggccctgagctgctcagatgttcctccaatacaagctgatgccgtcctgcttggccaaatcgacctgaacagcccagaaagctcacggccgtacctgtcagccccaatcggtgctgcagaaattttgttaggaaaatagaggactgagattcaatttttcgattgtctgaaggcttaatttagtgaccttggaaaatatctctagaggtgaaagaagatgctgggaatctgctgggaggaaggaggcttccctggtaatggtaatttgtttactctaattttgaggcctcttcaggcagccaagaaaatagtcagatagtactaccacttcttagaaaaagtgggggaggggagagccatagaaaccagtgagagaaaccccagccatacggcactactttctcaagagcaggtaggcattatgataatatgtacattatgttttatgtgtatatatatataaatatgcttattatgaaaattttaaacatacacaagggaggacaataaccccatataaatatcattcagatgcaaatattactagaatgttaaactgcttctttccttcatcctgtccctccttttctttcttctttcattgcggcagctctgctgctgctgttgcagaagtattttgtttattttttttcatgtaaattttttatagagagagggtctccctatgttactatgttacccaggctggtcttgaactcctgacctctagtgtcctaccacttcagactcccaaagcactgggcttacaggtgtgagccactgtgtctggcccaaagtattttaaagcaagccccagacctcacatcatttttcctctgctgaatgtatagtcagatggtatttagaagaggcggggttgctctggtgctcaacagcttttctcattaaaaaactactcaaagaaaaatgctagcaggagggaggagctctggaattaggagttccaatttggctacaatctgcaattcctgtaggatcttgggatactctgaacctctgggtctcatttccttaggttggggaggataatgactcctagacctgttaggggaactgaatgagacagactttctaaaatccttggcacagaacctagtacaggctaagggaaaggtgtgatgattactatatgtgccttggacacaggatgacaacaccaaaaataaaaagaaggcaaaaaaaaattgtaggtgtcaacttgactgggccacacagtgcccagatatctgactaaccattattctgagtgtgtgtctgtgagggtgattctacatgagactaacctttgaatcagtagactggtaaaactgattgccctgccctgtaggggtggatctcatctaatctgttgaaggcccgataaaacaaaagtctgagtaagaaataattttctctctttgcctgactgtcttcaacctggatgcttgtcttctgcctttggatgaggtttctaccatgggcccttctggatctccagatgctggctacacttcttgggacttctgggcttccataattgtgtgagccaattcgccagtcctaaaaatctctatctgtccatctgtctagctatctgtctgcctatctgtctctctcctctccatccatccatccatccatccatccatccatccatcttccagatggaccctgactatgatggttctgcttatgatgtttagaatttatgatggggtggaatggcaaggagaagagtccaagggtttaaatcctagctttgccattcatggctgtgtcgctttggcaagtcccttaacctctataagttttgattaccttatctctaaaagggggaaaactacatctacatttaggattacatacaagaatgcaatgcagaaaatgctgctcaaaagacagtggcctgagatctccattacatagtttccaatccagctgaggctaaatggcaattgcaatagagaaatataattgtgcccactttatagggttggaggactagagacgatattgctaactacgattaaacagttccctgcacataattggcacacacataattaataaaggtcagagtgtgaagtttgtaaataatgatagattatatcacgtttattattaggacatgtgtccaatagaatttggatatagtaggaccttaataaatgatatagttataaattaaattattattatatataatttatactaatgataatttaaaaatgcccagtgcagtgctgaactttagatggtagacacccataggcagatggcagggaacagtaacactgatggtgacgatggtggtagaatcctgtaacggtcatattgcctaaatgttggtcctaaccgtatccgttcttctcactcacctccagccaacctcctattctgcatcccccagtttttgcctggcccctggtttaacacccaggtcatcgaaggctcttctctctggaggctgtgcttttattgtcattgtctttgccactgtgaagggagcagaagccaggtcttgaagtcctcagcccccaactcctgtggggcgtacagatagattagctggcctctctcattcctactgtcacttgctgcctcctgtaatgttggcagggtgtcattaaggcctcacagcctgaggagctaatagacacaccagggctcccagttgccatgcctgcagcaatgtgcacctcttgacacccagcagctaatttcccttcataacctgaaatttcaacagcaactctgtccccagtcatgtcaaccagcttagcccccttactctgaccctaatgaggaggtgcagtgcctggttcccatcctgaaataacaacactggctgctggcatatgttttgttgttgttgtttttctctgaaatggtgtcttgcttgccgcccaggctaggtgcagtggcgccatctcggctcactgcaaccgctgcctcccaggttcaagtgattctctgccttagcctcccaagtagctgggataacagacatgcaccaccatgcctggctaattttttttttttttatttttagtagagatgcggtttcaccatgttggccaggctggtctcgagtcctgacctcaggtgacccacccaccttggcctcccaaagtgctgggattacaggcatagctaccacacccagcccctttttctcttagacctcactcttccagctcctttcagtccggggtctccctgccagaaaatggggctggaaatgtgttaaggagaaacttgcagaacagaaacagccttcgagactacacacctgaccctggagccacagagactccagctccacttctctgtgagttgatgacaccgagccttaccttcctcatctgtaaaatggtcaagatcatctgcttcccccacacatggtgctttgatgtcatctgcgtgaagctcttatcacagagcccgcacttggacagtgagcaattaacatctgctctcactgtcttagaggatcagccattcagttttcatgcatttaccctttcacttgatgcctatgtactttgcagttgggggaacagcaaatttgatttagcccccacagaaaggcagcctggagttctggagaggagagcaggttttgaccagagaaaccagggatcaaagctctctggttcccttgcaccatctttaacatgtggggcaggaaagcgacacggggaggaaataatctaaacccggctggttagtcctcaagagcaaagaagaaacatattcaaaaaatgtaatagcttggtgtccggcatgtagtgtgtgataatgaataccacttccacttacagagaaagggagatggaggcagaggacagctaaggaatccagaattgtcacacagctggtgagaggggtggctgtgactgtgacctcataccaccctcaaacctcaccactgtgctcttattgtgggttgaatggtggcctccaaaaaggcagttcatatccaaatccctgcaacttgtgaaggcaagcttattgggaatcaggtctttgcagagtaattaagttacggatcttgacatgagatcagccaggaagaccctaaatccaaaaacagtgtcttcatagcagaaaggtagagggagatttgaggcagacaggaaaggaacacaggaaagaggagaaggccatgtggctgcagaggcagggattggagtgatatggtcacagcccaaatcacgagcagccaccagaaacgaaagatgcaaggaacagattcttagctagagcctcaaagtaagtatagccctgccttgattctgaatgtctggcctccagaactgtgagagaatcatttctgttgctgttgttttgagactgagttttactctttttgcccaggctggagtgcatggcacgatcttggctcactgcaacctccacctcccgggttcaagcgattcacctgcccagcctcccaagtagctgtgattacagggcacgccaggctaatctttgtatttttagtaagacagggtttcaccatgttggccagactggtcttgaactcttgacctcaagtgatcggctgtcttgactcccacagtgctgggattacaggcattcccggttgtctttgtacaatatttattaaatgtctttacaaagcaacatccagactccgaatacaactgccaaggacagccgttatgctatggggactggctggggcatagcaggtggctctggcttcccacccttctgtctgagatgggagtggtgggcactacctcatctttgggttccatgatgctcacgtggtcagcagaggcttcttagggccagtcttaccagcggggtcccagggcagcatgaccttcacctgatgcccagaaaaccctatctgagcagcacatggcacacaacagcatcaatgtactagtaacgtggtctccgctggggatcatcaggccatccacaaactcatggatttgaccctcttcctcagagtctcctagaaaccacagcttggcagcctatggcccccctattcatgatgaccacagcccaccatcgcaggccctccgcacagtaagccctcctaggagtttgtactgcaactcgacctgggcaatggcacacagacctctggggccaccttttcagcataaagctctaaatgccctgtgggaagccaaatctcttctgaactacagcagtcaattccagaatccctgctgttctcaccaggaacattttttgttctgttggctaagatatttgttactgtcgtgatggtgtaacttgaacctgagcttcagagaagcgtctttagccagctccggagtaagaaacgattccgttcggctttgaagatgccatcagcgaccaacatcctcttcttggaaattcgccggccatcatgctgctgcacaccatcaaaaggaaagcagattgtgcctctcttatatctactagagcaagtcaggacagtgcagtaagaagacgctgcccatggaacacacctgggtggagtcagccctgccacttggttgctctatgaccttatgaaactcacttgacctccccgatgccggcatcctcatttatgaagtggagttgttcatgagtattaccattttcccctagcttgtagggtttaggggatggtgagagagaaaccacagagcactttgtttatggctataagctgccattttctactgttactattactaccaggaatgaaaacaacaaataaaaacaaagcaacccaaaaattgctcccaaaggaaaggtgtgtcgcttcctctctgttctgttctcaacaaagttgcctaggaccctgatatgctttgggtgtgtctccacccaaatctcaacttgattatatctcccagaattcccacatgttgtgggagggacccagggcgaggtaactcaatatgtgggccggtctttcctgcgctatcctcgtgatagtgaataagtgtcacaagatctgtgggtttaccaggggttctcacgttcgcttcttcctcattttctcttgccgctgccgtgaagaagtgcctttcacctcctgccatgattctgaggcctccccagccgtgcagaactgtagtccaattaaacctctttttcttcccagtctcgggtgtgtctttatcagcagcgtgaaaacaaactaatacaggccctgaagtactttgcttgtttctccccagcacctaggaaagttctgacatgtaccaagtgagcaatacatattgattagaggaatgaatgaatgaggaaaaagagttgtagagtcaatgagctaacctttgggaggagcttggactgaatacagtaaatcaccaatcacacatttgagtcaataaaaatttcatcatcattggtcagtttattgttagaaaactttctacaggcaaaatgaagcatctaaatgtgtctacatgtaggagtggactgttataaaaagcaaaatgagagttatttttaaccttcatatatttctaaagatcgtttaaaacaaatagatttttaaaaactttatttcaaggtttcaatcaataaaaagtaaaataaaataagtactagaaaaataaaatttggattcagaggctagaaacctacaatgaacacgtctacaaggcaggaggattgctttgaggccagaagtttgagaccaggctgggcaacataggaaaccccatctcaataaaaaacaaaaattagcccagtatggtggctctcgcctgtagtcctgctacttgggaggctgaggtggcaggatcacttaaacccaggcattggaggttgtagtggctatgatcataccattgtactctagctcggagacagaacaagattctgtcttaaaaaaaaaaaaataacaagtctagaaagctcagggtagccaatccttccatccccttagagaaaagcaaagttaagacatgcatatcagctcaggctcggcgggccttaaatgcacacatttgacagatacgtgtatacttttatataaactccctgacaccagtgactgggtctgttttataaacaatgtccattaaacttcagatgaagcctttattaaacatttgctgaatgaatggacatctttagaatgctatatgcgattacacagacaggtgacctctctcgttttgcagcatctgagatgtgggtcaccatggtgaacattcaggtgatgataagcgatgatgacttccctacatttttctgctttaggaagcacctacctcttattgaacctggaatgatgggatgggggggagtctgtccttccttattcacacaggcggctgacacaataatgtgatcatcaactctctcttcctgcagcccccaacccgccagccgccccagctgcagaatgcaaacatctgccgcatcattaaggcatttctatacagcaccatccaaggcctgaccctgtgaccgtttccacattagatttgaatgacctcagcagcagggctgaaaggctggagtattaattcacagaacacaagctcaatttaagatttaatttgagataacgaagagctactgaaagtgtattcaacttcaaagcatgcaataaaaggcctttccctgttttccaagttgaatatgaatccaatattctttaacagatttattcacaaatttacaaacaacacgaagcctcttttctctgtttcaattcctttttttttttcttttagttttttggctttatcaagcccctttatgatgtttctgctaggaatcttttttagctcttcctccctaatttacaaatgactcttgtttaggaatacctttcaatttgatagcattcttgaagagaaagtagacttccttaagaatctcccctactttagttcccttgcattccaacctaaatatgctaagcgtctgtttattcaacaatgatatgttgcataaaaagctttcacccatcaatgtaactctcatcatggaaagattcaaaatatattccacccattaggaacacgtgaccactgggttctagtgaatatctaggctctgaaactttatttataaaatatttagaattctaggtggggatgggaatttttattggttcaagagatttttgtttgtttttgtttttgtttttctttgagacagagtctcgctctgtctctcggctggagtacactggcgcagtctcagctgactgcaacccctgcctcctgggttcaagcattctcctgcctcagcctcttgagtagctaagattacaggcacatgccaccacacctggtaatttttgtgtttttagtagagatggcgtttcgtcatgtcagccaggctgggcttgaatcctgacctcagatgacccacccaccttggcctcctaaagtgctgtgattacaggggtagccaccacacctggcctcacgtagattttttgacactaaagagtttatttaaggctgggatggtggctcacacctgtaatcccagcactttgggaggccaaggcaagaggatcacttgagccaggagtttaggtcagtctggccaatgcactgagaccccatctctacaggaaatttaaaaatagctgggcatggtggtgcatgcctatagtcctacctactcaggagactgaggcgaaggatcgcttgagcctggtaggtcgaggctgctgtgagctaagatgccacagcactcagcctgagcaacacagtgagattctgtctcttaaaaaaaaagtttattttaatatttgagatgggaattggagatgagaattgttagctttggactcagaagcctgaatctacgatggatttgctgactattttgtgtctgacactatgctaggttactttgcattttctcaaagaccagtccagcctcagaaatagacttgggtttaaagctcagcaaccaactgagttccctgacctctgtctttgtcacctgtgaatgaccacatgcctcagtgcttcctgaaaacaactttaaagttataaacattgacacatatatgggtataaaaataccacaggtcatctgagcttgccctgggacactgttgggaatgggtgaacttcctaggaactgcaaacactctggtcacttgaagattacacaatggacaaaggccaggatcacaatattttgcaatcctgaaactcattactttattagccaccgggttttcaaaatgagaagccatgtggtgagcagggggaaagaggataaaccagaggccacatacacctgttgtggggtgggggctggggggcgcttggcttcgacccaccctccatcataactagctgtgtaacctggggcaagcctgtgcctcagtttctcacttttatcatccttctgctcttcaggtaacagacgatgctcaacatgcagggataatagatgggtgtgaagccacaattcccaacacagagaaggcaaataggagaaaggccaaggaaagcacacccatacgtttgatgcagtgcagtgggttcaatagtgtccccctagaaactgttcactcagaaccaacgaatgtgactttatttggaaacagggtctttgcaaatgtaataagataaggaatgagatgagatcatactcaattaggtgggtcctaagtccaatgactgtgtccttgtaagagacagaaaggacacaaagccagaggagaaggtgatgtaagggaggagtagagattagaatgtggtgtttccaagccaagggacatcaagaattgccagcagtcacagaaaccaggagacaggcatggcatggtttctccctcatagcttccagaaggaacgaacccacaaacgccttgattttggacttccggccaccaaaaccatgaaacaatgaatgattccaatctacccagtttgcgataatttgttatggcaggcccaggaaacacatacacgtggctggttggtattaaaatgcaaggcacttccctgaagataggccctgtggtcttgctttcacaaggttgtcattatatctcaaggaagggccacactaatcctaagttcatccactaatccaataaaaaccacctaaattttcttagtgggcaatggccaactctactcatggaaatgggcttacaagaagttctcagatcatcagtaagaaagatttttatttaaggatgggaaaataattaggaatactgagatgtctccaaacaatactcccagatcttcgttgactccacgatatttctggcgtattcagggcaccacttccactgttggagggcatgcaacgtcttcagtaccaaaactttgggtcacacatggaaaggacattctggtactgcaaatttggctctttggatcaaaacttagcagtgtccatgactgttcttgctttcttacaacacccagatgtcagtgctgggggcttctcttatgtctccagcaagcagggacagggtcattgtgcatcctgagacctactagagtgccaggcccatgacaggtgctcacggttatcaaaggaatgataacgatacagtacagaggtaaatagtaagaacaatgccagagttattttattttcctccatatcacacattaccatccccattttacagatgttgatatcaaactaagagtataaattaatgaaagatgagtgaatacataaataagtaaataatgagtccatctaggaaggaggagactcagatcgagttcaagtctcactcaaagaagactgagtgcaagtctcactggcgcaaacacgtagctcttaaccatcagagatattgccaagctttgtttacggatgaaaatgctgtgagctgtggccttccactgtgctggtgatgcagggcaggcgaaccccagaactgcggcttaggcaacagggttcttggctttgcccaggaaagaattcaagggcaaggtggtggtgttagcaattttattgaagggacagtgtacaacaggagcagaggtgctgctccttgcaaaacagggcaccccacatgcagagtacccacagtggcaattccgaggcagttctgccatcacatttaccccatttttaattatatgcaaattaagtggtggattatgcagaaatttctagaaaaaggtggtaacttccaggttgttgggtcattgtcatggaaaggggcagtaacttctaggtgttccatggaaattgtaaactgacatgacacactggcggacacagctcatggaaaggtgcaccaccctatccctgttttagctagtcctcaatttggtccggtgtgtaagccctgtctatgagttga

SEQ ID NO: 5112 - DNA, 12063 bp, Homo sapiens
  misc_feature (3642)..(3660): n is a, c, g, or t
ggcggcagcatttgcctagttaagaaggcctgggcttacaaatcaccgtaaaggactaaactgtttaaagggaaaccaaatgccaaatttagtccaagtgcttgattgaggtgtatatgaaggtgatttggataatactgaagtattttaattttctggactgcaaaacagtggcagaggaagtgactcaagtggctacaccacggttataaataggtgggaataacctttactgggcttacgaggaaagaaaaaagtcaatctgaagggaggggcgcgacgcgaacggcaagctgcagagaaccatccgagccggcgtccgccatggtgggcgggggacggctgcggccggaagcagacatgcgcttccggggtggggcctgccgcccgcaagcacgctcacctccgttgcgctgcgccgtggcctctccggattctgttaacggtagtggtggcttgttgggatccgttggtgatgggagagtgtgctctttaacttcggagagagatgcgctctcgtgtagccgtcaggcctgccataaggtctgcaggtgcctgttgtctgggtttgggggtcgagtagatgcgggcagccggagctgttgacggaaaggagtagccccaaaggagggcatgtgaagtcgcacgcgagctcgaggggaacggcgagcacccagaagcccccgggtctggagagggaagcgaggcctgttagagatctgtcagagaaggcatttcctaagtggaagcaagcagcagcttagccggattctcttctgagtgggtgccaccccggcttcggacccttgggcgtagagttgcggaaaacctggccgcagaatggtggacctcggtggtggtgttcagggagcaggtattcccggtgacgccctccaccacaaaccaggccctttgctacccggggacagtgccttcaggttagttctgcagaaactctacgcgaaatcttgcaagacaaagagctgagtaaggaacagctagtgcatttcttgagaacgtattaaaaacttctgggaaactacgggagaaccttcttcacggatgcttcacgatttcatgcttcaaaacaggtgtcgggtggaaaggcgaggcagtcttgcggatcttggggattgcaactggccctgtattcccatgcaaggaagttagttagttctcactttttgaagtagtcggatatattaacagtgctctaccctggagaaaactggtccatggatcattgctgttccttaaacaatctgtccgaaggacctgggaacgctctcaatttcacgggcaacttctgaacacagtgctgtcatttagtgcaatgtagtctaagtgcataaggaacacacagacattttgaacttttcttagatttattctaagtaaaaatgttgaaattataatctgaaactatttcatgtatatcataggataaatcaaggccaggcgcagtggctcacgccgtaatcccagcattttgcaaggcagaggcgggtggatcacctgaggtcaggagttcgagctagcctggccaacatggtgaaaccccgtctctactaaaaagacaaaaattagccggcctgacggcgagcgcctgtaatcccagctacttgggaggctgaggcaggagaatcgcttgacccaggaggcagaggttgcagtgagccgagatcacgccactgcactccagcttgggtgaaagagcaaaactccgtcttaaaaaaaaaaaattcaaatagttgggttagttgttattagaaccaagatattcattgtaaaagaagagataatatgtaaaagaaggtacgtataaactatgttaaatatggattggtaaattaaatatgaattggtaaattaaaattgaatatgggtccactctgtcacccagactcgagtgcagtggtgtgatcatggctcactgcagcctcgacccgggctcaagtgaacctcccacctcagcctcccaagtagctggactacaggcacatgccccacacccagctaatttttgtgttttttgtagagatgaggttttgccatgttgtccaggtggtcttgaactcctgagcttaagcaatccgcccatcttggccccccaaagtgctgggatacaggtgtgagccacagtgcccagcctcatgatttttaaaaatatatttcctaactttttcgtttaaagttcctagaagcaatgaccctcagtagcaatgagcacacctagtgcccaatcctggttcctttttttttttttttttgagacagagtctcgctctgccgcccaggctgagtgcagtggcacaatctcggctcactgcaagctccatctcccaggttcacgccattctctgcctcagcctcccgagtagctgggactagactacaggcacttgccaccacgcctggcaattttttgtatttttagtagagacggggtttcaccttgttagccaggatggtctctattcctgaccttgtgatccgcccgcctcggcctcccaaagtgctgggattacaggcgtgagcactgcgcccggcctccagatcttggtttctaagatgaaccagtactgggagaaatggcgattccgggtctggggttagggaaagtacaaggtgagtttgaaacactttatggtgctaaaagcaaagaattgcttgaagactaatgggtcatataaaaaggtcacagatgctggcttaggagggttgtcactggccacatctaggacaaattgaacattaagatacatattaatggaatggatcataacacattgactaaaatctaagagtcaatagtattaatcaaaaacaaatattgaccctagaggtcgggggcggggggaagaggtagagaaagcttatgtttttacagagctatggaataaatgtagaaggaaagatacattagaaaattcaccatttcatgatattgaaaccccgatatcattgattcaagcaacagtcatcaatggattctaaaatactgggtgaatactgttggggagcaggatattattggggagtggatatttactaccttaaccaagtaacaaatttggtgtcttcagtagtggaataatttgataacatgttcctcatgttatgatgcataagatacacacatctactatgtagtattttgctaaaaatgattagccgaaattaaatataaggaaacaatcagacaaatcccaaatgtgagacaatctatgactaacctggactcaatcaaaagtcagtgtcattaatagcaaaattaagggggaaaggaggcaagggaaatgtttagattcaaatggatgaaagaaacctactcagaatgcagtacatgaatcttaactggaagagaacagtaaaagatatttggggtgaaaattggaacaactaaaatatcaccatatgttgattatattgtggtattatggttaactttttatggtgttataatggtatataggaaatattttatttttagaagatgtatgcggcagtatttgggagtgaacaagaaaaaaatgtggcaaatgttgataattgatgaatctaggtaaagggtatacaagtgttcattgtatatggattttattattttttcaactttcttatagatttgaaaatctttgnnnnnnnnnnnnnnnnnnngcaaatgataccactctcttcttcagataacatgttattctccataagtttcttcctttgaccttttgatgcaaaccaggcttcccatagctgtcttaggcagcaactagttggctatttaatacttcctgacagttcatgtaaacaacaggtccagttgtctcagacaaattaacaaataagattcaacagtaatatttttaattaagttatggtgttgaggcaatcagaccctacaatctttaaagtgtctttttttgttcaattttaaaactatgaggccgggtgcagtgctcactcctgtaatcccagcactttgggaggccgagttgggcggatcacgaggtcaggaatcgcgaccaacctggctaacacggtgaaaccccgtctctactaaaaatacagaaaaaatagccgggcgtggtggcgggcgcctgtagtcccagctactcgggagggtgaggcaggagatggcatgaacccgggaggcggaggttgcaatgagccgagaccctgccactgcactccacctgggcgacagagcgagactccatctcaaaaaaaaaagaaaatcttcaaactaaaaaccagggtgaaactacctagaattaagtggtgatctgtctttttttgtttttttttaagacgggtttcactctgttgcccaggctggagcacagtggcaccatcccagctcactgcaacctggcctcccagactaaagtgatccacctcccagctttccaagtagctgggactacaaggacacaccaccatgcctggcttatttttgtatatttttagagatggggttttgctgtgttcccagtctggtctcagaactcctgagctcaagcaatctgcccacctcgacctcccaaaggctgggattataggcgtgagccaccaagcttagccaacatctgtctttatgctgtgttacgttattactactattaatgtgtctattgacaaaaatgatttgggtttgtggactagattatacaatgattgatttatcttttgacaggtgccttggaacactatgttaattgcctggtctggtaaacaagaggctaccttatggccttgctcagattggagtgtgttttcatcctgttttgacactaagcagatacgaaatggtgttaaaaggtataaaaagtggcaaataacttgccttgtatttaaatagtcaaaaaccagtcatttccacttgggataaattatataatttcagataagctaacttcctgatacgttttatatctaaagtattggtgagaagactgaagctcgttagtatggtttactcctccgagaacttcaaaccagtggcttgatttctggttacgcatcgactccagtggtggagaaaggtactgcaataattacctttaatttaatagttaatcataaattgtcttaatgtgtcagtggtaattcttctgacatacaagaaattatatttgagtatgtagctattaatatattatacaaatacaaaaactctttgtaacaattttcattgtctagattacaaagttactttggtaaaaacatttgttgggctcagatgtgtttgttaattgcctttctgtgtaaggtaaaattcaaagccctcacctagcattcctggctgatgtagagttgacccttgaccattgtcacagcttcagcttttgctacctacctccatgaactttccaattagtcaaaatggctctgtaattgatgatcaagttttagtactcactgaaaaaaaaaggttgaagtaagcatttttgtcttgccatgtgttatgttaccatttcccgactcaaacatcccaaatacccatttaaactgtatgaaataatcacgagtcatcaagaacttcgcagaaggtaagaatgaggactatgtgatactttcttctttatcccactttagtcatggttaacttccctcttcattggccataaaagtctggataacatcaacagttttttctctgtagttcttcctactaaaaaacaatatgttaagcaatatactcagtattttcactttttattttatttatttttgttgtctgtttttggttttttttttgttttttttttttcacaagtaccagtcacttttatttggaggttaattcccattaggatatgaaaggattcagcaacaatcgagatttgttgcttatggaggggttgcagccaagaaggttgctgggggagtgcagagcatgtcttttcagtggtacttgcatagccgctcgtgcttgagctccttgtaggaaaggcagtagatgagagcatgtaccctgccagcaccatggtaaaccccgagatgctccccttcttcacgttgtgtacttgttgtagtaccagtagtaacctctttgaaacgctccatcaaggccactagggtgaagtcccacatcaagatccagcttggcagctcccctagtttgacctccagaagtttctgtccttcactggtacaactgactccatcttggtttttttagagacatagtctcactctttgcccgggctggactgccgttgcacaatcacagctcactgcaacttcttttattattttagagatgaagtcttgctctgttacccaggctggtctcgaagtcctaagctcaagtgatcccctgcctcagcctcccaaagagctggcataacaggcgtgagccactgtgcctggccatattttcactttttaaaaattaaatttcagcaacctgtggtcccagctactctgaatccgaggcaggaggattgcttgaggccagcagtaggaggcagcagtgagctatgattgtaccgtgactagccactgcactctaacctgggcaacagaatgagacacatctcaaaaaaaaattaaattagaataaactttaaaatttgtattcgggacttgactagtttcgcacatttgctaataaaaagtatcggacaatttaaattcttacagataattatgggagttaaattagtgttatttaaatatgttaagacaaacttaaattttcttttccagtttgccatgagtccatctacttcagcagcagtgactgtcaggatgaagaaggccggaaaggaaacaaactttactacattttccctggggaaaggagttaatagaaaccctgtggaacctaggagatcacgaactttacacatgtatcctggcaatgtgtctaaattacatgtatgttttacctggagctcctattattttttacccagattctctataatcatttccgaaccatttgagaataaggtgcaaactggtgtcttaacacttcattgtgtatttttcagatgcagagacactcacctacataactcaatccagtcatcaaaatcaggaaattaacagtaatccactattgccacagagccctacaattgaactgattatctcaataatggcatttataggtccaagatcttgtctttcatgtattgtcatatgcctttacactccttcaaatgaacaattcctcttgtcttgcgtgaccttgcatttttgaagagtacagtctagttaatctgtagaatatgccttggctgggatctgtctctgtttccacgtgatttatgtatttttgtcgggagtactacagaagtggtagtactgagagctctcttctcagtgtgtcatatgaggagtgttactggtgatgttaacttttatcattagttaagatggtttctactagatttctccagtgtaaagctaataaatagtttgtatttataattaacggccaggcgcagtggctcacgcctgtaatcccagcactttgtgaggccgaatgggaggatcatgaggtcaagagattgagaccatcctggccaatgtggtgaaaccccattctactaaaaatacaaaaattagctggatgtggtggcttgcccttatagtctcagctactgggaggctgaggcaggagaatcgcttgaacccgggaggtggaggttgcgatgagccaaatcgtgccactgcactgcagcctggcgacagaacgagactctgtctcaaaaaaaaaaaaaaaaaaattaactagtaattaataagtgttgtgggcagatactttaagatgatgcagacatttctttgtcaccaaattttgccttactggttgcagcatccattgatgattcttgcccgatcagttactaatgtgaggtttgccaaatggtgatttttttttttctttatttgagacggatctcactctatcactcaggctgaaacacagtggtatggtgatagctcactgcaacccaaactcttgagctcaagcaatcctgcctcagcctcccaagtagctaggactacaagcagtatcaccatgcccgactgatggtttaatatttgtagagacggggtctagctttgttgccgggctggtctcgaactcctgggatgaaacaatccccctgcctcagcctcccaaaatgctggattataagaatgagtcaccatgtttggccatgtcaccaaattttgccttactggttcagcatcccttgatgattcttgctcaaatcagttactacgatgaggtttgccaatggtgttttttccccttcccttttttttttttttaaaaaaaaacaaattccatcattccttctaatttactggtcagcaatatactgtagagcttttccttctcctccattttttttttaaatggtatttcacagattactttctcagggggttacagtgtgttactgtcattatttattttatggtcaaattgtcctagacttggccagtgtccttttgacatatttccatcattgtcttacgagcacttccttaccttttgtagcaatatattgttccaggatcatcagtgagccaagctgtgctgctgcactccagcctgtgcaacaggatgagaccatgtctcaaaaaaaaaaaaaagaaaaagaaaaaatatatagcaaaaacataggagtttatatataatgagtagaaagtgattaatttttatttttttattttttgagacagcatctcactctgttgcccaggctggatgcagtgtcgcgattcccaggttcaagcagttcttctgcctcagcctcctgagtagctagactataggtgtgcgccaccacgcccggttaatttttgtatttttagtagagacagggttcaccatattgaccaggctggaatttttaaatatgaataactaatgaaaaactagaaggttattaactggtgaacattttcctttaactccaccaccatcacacttcattttggggtatcagctctcaaatgaaacttattggttattatcatagttaacgaacagctcaaccttgtactagggatttaaagatgatttttgtattgtggctattagtgtcttattttgttctttttttcttttgtatgaagaatggggtctcgctatgttgcccagtctggtcttgaattcctggctcaagctgttctcctgcctctgcctttctgagtgctaagattacaggtgtgaactacatgcccagattattttgttcttttattggtatcattttcactaatgaagagttttcctatgcagaaatttttctcttccatgacattgttccttttctgtttccagagttcacaaaatatttatcattagttgaacatgttataaaatattaagtagaatttctgtcatttagtatgtttcttgaaatgtttctgaggccatttctttctttttttaaaattatttaatagagatgggtctcgctgtgttgctcaggctggtcttgaactcctgggctcaagcaatcctcctgcctagcctcccaaagtgctgggattataggcgtaaaccactgcacccagcctcttaggccatttgtatctgtttttagttgattttatggttaatgtccaaatatattttttagagaacatgaagcagaccaataaaggctgaagaacagttaggatagaaaagaatttattctggatatgtgagaaatcagatattgttggaagagttgccaccagatatcctgacattgttggataccaattttcaaaaaattagaaaacaataaacaatcttttttgtttgttttaaatagggagggatcttgccatgttgcccaggctagtctcaaactcctgggctcaagtgatcctcctgcctggcctcccaaagtgctaggattacaggagtgagtcactgtgcccagcctaaagcatcttcataaagattcagatttagattttgtttgattcaaagcgcaccacagaatctttcatacttgagtttgtctttttttttttttttttttttttgagatggtgtctcactctgtcaccaggctggagtatagtggcacaatgtctgctcactgcagcctccacctcctgggttcagtgattctcatgcctcagcctgctgagtagctgggattacaagcatgcaccaccatgccagctaatttttgtctttttagtagaggtggggttttaccatgttggccaggctggtctcaactcctgaactcaagtgattcgtccaccatggcctcccgatgtgctgggattacaggctgagccactgctcccagcccagtttatcttattaactatcagttcgacgataactgtgtaaatacaactggtagaatagagtcccaggtatcagaaagtttactgcctttgagggcaattcttgtgaatctttaaagtatcatatgcaattcaaataggtttaaaatgtcagtacattatgtattaatgaagactgtggttgatcatgaataattaacagaagctgaggatttaaattgtggggttttctctcttttttttttgttctgtgactctagctaaaggtggttatttagtatttttaaaaattacatgaatatccaggtgaacaatgatttacaaaaaaagaaagataaagtggaactgtttttatccaaaacttaagaaatttctaggattgaaatttttaagaatttgaaatgattcctcttcagtttagagaagaagtaagtctgtttatcaatacttaattatatcatgtactatgtgtagtttgttttcataattatggctttaatgcaaaaagtaagttttgaaagatttcttttttatgaaaataactttacgtttcagaaaattatactccaaaccctttccctaaagcacaccatttttttccctaaggcctcttttgaataatcagcaaacatttttacttaaaagtgttacctttcgaggtagggcgcagtggctcacgcctgtaatcccgcactttgggaggctgaggtgggctgatcacctgaggtgaggagtttgagaacaacctgccaacatggtgaaaccccgtccctactaaaaatagaaaaaaattagccagacatggtgggtgtgcctgtagtcctagctactcaggagactgaggcaagagaatcacttgaacccgggggcagaggttggcaatgaggtgagatcatgccattgcactccagcctgggtgacagagcagactctgtctgtattaaaaaaaaaaaaagtgttacctttctgaatactaactctgagccggaagcattaaagaaatagtctgtagggctattgaaaaaattgatgcctaagtccctcccagttgagttcgttcagaatctctgggatagagcccaaccaagcaccatagttttaaattcacatttgggcctcgctgatgaaacactgagctcagtgagagcagagaatgcatcttatcgtcttcgtgggcccagtgcctaccacaggcctggtacagagtgggtgctttgtaaatgaaactttacttttgtattctgattgtgtaagtctaaaatatgtactcaggaggctgagcaggagaatcacttgaacctgggaggcagaggttgcagggagctgagatcatgccactcactccagcctggccaggtgacagagtgagactccgtctcaaaaacaaacaaacaaaaaagttctgtgaaatgattatttttcttctgtttttctgtgaagggccgagatggacgaaaaatgtggttccttgtgttctctctgtaaatggggacctagaccgaggcatgctggcctactctatgattctttccagctgacagagaactcctttacaagaaagaaaaatcttcatagaaggtgctgttgatatttcagagatagacttgggaaactaaaaatatgggtttgtttgtcttaatgttagtgtgctcggtttctaacataaactctaaataataaatttagtgcatgtgtctaagtatttttcagtttttttagaatctggccacaggaataagaatcaggttctcaagaatagaacaaggcatccctaataag

SEQ ID NO: 5113 - DNA, 13554 bp, Homo sapiens
tgacaagaaactgagactggcctccagtcaacagccagcaagaaaatgaggcctttaattggctgtctgcaaggaaatgaattttgctaataacctgagctaagaattgaatccttcccagtcgagtctcagataagactgcagcttcagctgacactttgatttcaggctttcagaagcccagctaagctgtatccaggctcctggcccgcagaaactgtgacatagtaagtaaggtgtgctgtgttaaaacatggagtttgtgataatattgttacacagcagcaacagaagaaggtcaagtcagtgagcaagaatgaatgttcaacaaatgatccgaacaactgggtagccctgaaaaaaaaaaataaagctggatccctcactctcacatgatataaccataaattccagtagaggaaagatttaaatagaaaaatacatcaaaagagaaaacatgcttttaatgtgtattttggagtgaggaaggccttcctaagtgaaagtccaaaaactatgaaagaaaagactataaatctgattaagagagaaaatatatctgcaacttgtatcacagagggctaatttcttaatatgtaagtagttcctacaaatcaataagaaaaagattaattactcaatagggaaaaaaagcaaaggctataaacagtttatagaaatgaaactacacatggttcttacacttatgaaagatgtttcctcattataagagtgagaaacacaatgagacactgactaggatcaaatgtgtgataacacacttgattgaaaagcaatgggaaaaatggcaccctcatttagtgctgtggggagtatactggtgcagcctctctagaggacatcaaggcagtaactatcaaaactcaaatgtgattgggcacggtgactcacgcctgtaatcccagcattctgggaagctgagggggcatatcacctaaggtcaggagttggagaccagcctgggcaacatggcgaaacctcattctactaaaaaaaaaaatacaaaaattagccaggcgtggtggcgtgcacctgtagtccagctattcgggaggctaaggcagaagaatagcttgaacccaggaggctgaggttgcagtagcagagatcacgccacacaccactgcactcccgcctgggagacagagtaagactacactcaaaaaaaacaaaacaaacaaacaaaacacctacaaacacccttgactcttcaactcacaattccatttctacaggtatttagaatgacatatgcataaggctatccaatgtaacatgtttgtcacagcaaagatgtgaatcaacctgtctaccaataggagcttagagtgaaatatttatagtgcatatataacagaataccatgaaccatacacacagaataaggaatctttcattctgaaagagagatctctgaaatatatttagtaagtaaacaacgacaacaataatcaaaaaaacaaaacaaaacaaaacaaaacaaaactgaggtgcctccagggaggagaccaggcagctggggtcaggtcaaaaggacagctttcattatgtgctcccttttttttttttttttttttgagatggagtctcgctctgttgcccaggctggagtgcaatggtgcaatctaggccactgcaacctctgcctcccgggttcaagtgattctcctgtctcagcctcccaagtagcgggattaaaggcacacaccaccatgcctggctaatttttttgtattttcagtagagacgggtttcactgtgttccccaggctggtcccaaactcctgagctcaggaagtccatccaccgggtctcccaaagtggtaggattacaggcgtgagccaccgcgcctgacctcttttatacttttaaatgttgaaccatacgattgcatttctttttcaaacaataaaattcatatcaataatacatataatttgtagaataggatgcatggtatgctacagtttctgcaaagaaattaattcagactatctatctgctcagacatacctacctacatacattcttgcacgtaaacagtacctctgaagtagcacacaagaatctgagggctggtttcctctgggctggagaatgggaaccagtaaactgtgcagtgaagcagcagggatgagaaattctctttccaattttatacattatatctattaccaatttgaaaacaaacgattaaaaaaaaaaaagtttaagctgttgggtttctctggtcctctgctcttccccctttaagattctcactgatgaatcgccctaactctccatgctgataactcctaaatcctggcccgtgtcttgaactgtcatcctgaaacagctttccctcagtttctcagcacagtggtctggtgattccccttcttattctcctacggtgtgccttcccttaagatctggtttctgtgaaactctggggtttcacagagttttgtgctaacaagttttcgtctcctcctcctcattggtacccacagctgagtggtcatctagatgcagtactttccaaatccccatccctgcccagatctcttgtctgagctccagatacaaaaacagttgccagagaacatcttactgacaactgggactcctcccccacaccggcagctcctcagtgttcccataaaccagtgaatggagccaccatccattcagatagaatactgggatctcctggattctttccccactccttccccatcccaataatcagttttaaggctcctacacgttctgtaatctgtcctcttcctcccacctctgtagatctccctggtccacaccaccttctctttcctgtgagttcccggctgttctgaatacccacaatattgctcccctatccatttccgccctgaggctcaattcatctttttggttctatattcgtaccctgggactgccatccaaaatgccactgaccgaggggcttgaatgacagacatagttctggaggctggaagtccagttcaaggagtcagcaggtttggcttctcaagaattctccttggcttgcagatgaccacttctcactgtgtctgcacatggtccttcctctgtgtatgtgcatgcctggtgtttctcgtgtatctaaaactcctcctcttacaaggacataggtcaaactgggctacagcctatccaacagcctaacaggtaacttaattatctctttaaaggccctatctccaaatacagtcacttctgaggtactgagggttagggctcaacatatgagttttggggatgcaaatcagcccacacagtgtccaacaggtcatgtcactcccctcaataaaatctttcactggggtcccaaccccttgaaataatatcctttccaaaacatgacccctgcctactattctctctcccagatgaagggtagtgtaggcaggggtgggagttcagatgggggtaagggtacaggcagaattaagagatcaggaagaaatggcaccctttcattatctcccttccagtcatgcttcttccaatacagatagactttgggcaagctgtctaaactctctgcagaatgggctgggtccttgatacccacaggcctggctgagcaccagggagagatggcatactccaccccatgcttagatccctggacagaaaataccaggcctgtatcctctctataaaggtaaaggttcccccagagtaatcaaggaatcttctggccaaatccaggattagaagcagatctaaactgcaactgggcatctccctttgagactaaactgctcattaagatgtcctagatacccagcattagaaagtaccaccttgctggctccatcatgaaaatgaatgcatggacttggcagcggcattatgcagacctgatttgtctgtctccacttatgaactgagtgacctggggcaagatgcttaacactctcagccttgatgtactcatctataaaatggggttaatattcttctaagtagttctaatatactaattccaagggctgctgtaattaattgccacgaactgagtggcttaaaacaacaaaatatgttctttcacaattctagaggctagaagttcaaggtgtcggcagggccatgctcctctgaaaactccagggcagaatccttccttgcctggcttctggaggttgctggcaaccttggcattccttgccctgcacctacatgctccagtgtctgcctctgtcttcacaaggcatcttccctctgtgagtgtctgtgtaccccctcttattacaaagacaccagtcatgggattagggcccactccagtccaacagaactgtgtcttaacgaattacatatgtcaagacccatttgcaaattggtttgcattcacaagtaccaggttttagggcttcagtgtatcttttaggggacacaatttaacctgtgacacctacttgaatgattgtgagaggattaaataatgcctaaaagcactaaggacagtacccggagcacacagtaagcactccacacagaacagtttcctcttccagtgtgtggctaacatacagcaggctactttcccagaagatcaggcctagttctttgctcctcataaaaacaaaaaccacaagcaagaaaccaaaagcaaataagccggatcctcatggctaatgctgtattaagacttttaaaataaacaaagcaggacttggtacctgtcactgaagtaaatattttatcagtgggtctctgaaaaaaactccacgcatgcacgtggccccacatgcctcctccctggaggagctggttctgccaataaggggcctcaagggctcttgaaagcagagaggagtttactcaaggtgtgcacctctggttccaacatctggctgcttccagctcagcaaagccttccagaaacaaggcaacacggggcctatggacacctaaagccatgctgaggctgaaccctgagcaacctcaacactggtgcttcccaggagagccaggcagaaagctcagccaaggaagtgattaataaatcatgggcaaagctttttcccattctctctcggtggaaaccaaaacgcctatcacaatgatcaaagctgctgcctgcaacttcagatgactttgactgagctcattaagtcataagcttctgcagagtggattttctccatggatatgcttgaaaattaggaagttaagtggcttgggagaacctgggacccattaaccaactagcagtcagagcttccattaaaagaggaaaatggctgaaaatctgaaatctgttcttgggcgctgttcaaagattctattatgagttttcaggggaagccccttggggttcacaccagcggagcagagaagcctccatggacatgaagtgagaaggacctcgaccgagaagacagaggctgggttgaaatcctggctgcatctggaatattagggatttctttcctctctctgagcttggtgtcctgagggggaagtgccccccagtctgaggcatgtggattccacggctggaaccgtgtataaaatcgtgactctgagccggggacttggtacgcacaccatatgcacttaggaagggctgttcgtaaacagatctgtagacgacagagtcccatctgccagttaccaaatgagaggccacacgtgaggaatttaaccatctgaaacagctagatgttagctggtagagggaaggcaggctagagttgtgaaacctgccaggttaaataattttctcctctttctgcagaacacggtgttctcttgcaatagatcttgcctatgttgtaaagctctttggctgagatggagacagaaatattaacaaaaaactgaggcattaaacataaattaaattaaaacattaaaatgagaaattaagcttttcctgtttggaagaagagactcagaatgtagggcaaaagaaagacagggaagcagggaggcccagagccagatcccagagaagagtgaagtgcagaattcagggcaatgcttacattgcccaggactcctctcagtaacgtgcatgaactcaacacacctcggaaaaagaaaaagaagatccagatcagattttgaggactccagtgtcacaccttctcaatatcctgagacaccaggccaaccaggcaacaggaacaagcagccacatggtgccagccctctactcccaaaagcccgctgagccagacgttatttctccaacagcaaagcctccttcagaggctctaagcatttgatgctcacatccactcctcccaaggatgagatgacctcactgctctggtcaatactaatcccttcaccccaaagtcctatagaaaattattccttcaatcagtgtcaagaggaaaattcgagatgatcttgaggaagctggtccagaggaaggcaaggagaacaagggctgcctgctgagacatgtgttctatgagaaaccaacatggcttcctactaaaaaaagaatgctcggaggtagaaaaaattggggttggtgaatttggtacagtctacaatgcattaaaagcctggatagaagtgtttatgcaataaagcactatatgaaaactttttcggatttcacctgagaatttggctttgcgtgaagtttatgctcatacagtgtttggacataccccacctggtacattactaccccttacaggcagaagataaccatatgatcattcagatggatactgcaatggcaggagcttgcaggctgctatatctgaaaacactaagtctactatcacttccaagagccaaaactcaaggacatccttctacagatttcccttgaacttaaatcagccacaactctggcatggtgcacccggacatgaaaccttgtaaaaccttcctttgtccaagatgcaaagtgactcctctggagtcacagaagttgaaaatgaagctgattagtttcctctgcccatgtgatatataaaattggtgacctaggccatgtgacatcaataagcaaaccaaagtggaaaaagcagatagttgctgcctagcaaatgagattttgcaagaggattattgtaccttcccaaagcagacctatttgccttgggattaatcactgcaatggctgaaggagaaggacattacccatcaacagtgctgcaaggcaccataaccatgagagtaacttcccagcattcctcaggagctctcagaagacttttacagtctgctcaagcacatgatccaccctgtccaggagagagaccttctgcagcagctctggtcagaaattggccctggccctccctgggaaagcagaagagctctagcagcagctgaatttggaaaagtccaagacagctgcactggaagggaactaagggaagcccagcaggcccagtccctgcagggagacttccatcatggtgccctcgggtctttgggaccacacgggatcagaaaacaccaaatgcctggtaggaggaaaagtgcaaggtcttcaagctttacctcaggacagcatgagcctctgaactaaaggaagaaacaggaaacagcccttgcttggccttatggattaggaggttgccctaccaaggatcccaggattcgctgtacatagaaaggaatagaatttggttttgaattcaagtaacagtttacagaaaatgtgcctggatttccacagtacttcccaggttatatgatgctatttctgaaaaaagttcccaacccctttgtggaagtgggtctcctaatatatataccctttctgatattgttttactaaataaatggcttcaccattacatgaggtgggtaaaagtaagactgtatataattggacatctctgagctggttgtttaattgcagaacaaaaacgctggatggagaaggttaaggaaaacttgacatggctgttctccatctacttgccctgtccctcttgtggccacgtctgactggtttgatgttccaagcctcaccaatttccctttattttatcagaatttggcctgtttcctattatttcatcatactttatccaaatcctttttatgtacacatttttaaagaaaagaatactgcatttttgctttttgttttttgggacggagtctcactctgtcacccagctggagtgcagtggtgcgatctcagctcactgcaacctccgcctcccgggttcaagagttcttctgcctcagtctcccgaggagctgggactacaggtgcataccaccacgtctggcaacttttatatttttagtagagatggggtttcaccatattggccaggctggtctcaaaccctgacctctgatccacccacctcggcctcccaaagtgctgggactacaggtgtcagccctgcgcccagcctgcatttttaaataaagcattttatcttgtcgaaagacaaattacagtagagtactcttctttgtcataccgtcactaacaaagaatgaaaaatttacgttagagacattttacgtgataaaagggtaagagaattcagtaggtcagtagtaacatgccttggcatagggcccagattcacagatccaaaagttaataacagtcaggatctgctataaaataatttggtcataaaggtatttgataaattgtttgtgtcatcttaatgaatgcaacctgttaagattaatggctttttttactgttggattttcttcttttcctgattttaaaaagcgaatttttaaattgaataaaccctcacactattctttaaaaaaaatagtgtgtctctgaccccaagactatttaagagcattaaatgagacagacctctctcctaacatacgcctggcagatgtaaataaatcttattcccccatctctctttggtttcctccctcctctctccagaatttttacccattcctatcttcacaaaggcctccccagtttctcggcacatagtgaggacttccgctttagaaaactcttcctgaaaccctaaatacccacatacctgaaaacaaattacctaaccctcccatggcccccagccacagccttggagcctcctctcttccagtcaagcctctgacagaatagtctctaccagcagttcccaaatgtgtgttacaagaacaccctggtccgtgaaaagggttcacaggttagcaacaaaagtagaaaatgaaggcacaattgcagcaagctctcttagaattaaacttattccacttacaggaccatccttcattctgatgagccattacacatttttgtattaaaacataatttattttagaaaataatgattggataattagagagtgtttggttttcattattctcatctgatcaaataaaagcgggtgactcaacatcaagagccaagcttttgtttttttcttttttttcattactttactggtccataatatccaagcctggaattgtgtttattatactaatcagtttcagttggctgcctccacttccgccccagctcactcttctcaacactattttttttttttttggagacagtcttgctctgttgcccaggctgagtgtggtggcataatcacagctcactgcagcctcaaacttcctgggttcaagttatctcctacctcaagcttctgagtagcaggcactacaggtgtgcaccagcatgtccaacctaattttgtattttttgtatagacagggtttcaccatgttgcccaagctggtcttgaacgccgggctcaagtgatcctcccacctcagcctccccaagtgctaggattacaggcatgagccccacacccaggctcaaccctaatttacaaacccagcttctactctcaccattcaagtgaaccattccctcaatggtgtccaaatctgggccttcttccctctagcctgcatctgacagctagaccaggccctggttacactcagacagacgacagcctccaaagtagaggctaactcaggctttccaaacagagccctgagcaagggaaagccttcccagtgcctatgtcccaaagccaaaccccaagttctaagctgggtctctgtggcctcatcactaccccatctaccaaagaagactgtggggctggaaaagcccaggactcacacaacctcgctctcacccaagtcccacaagttgttcaatttctctgaaactcagtctcctactgggtcaaatcacgatcatgacatcttgacctcatagggatcttgaggggattcaaaaaaatccagtgggtaaagcactttcccagagcctgggacacagtaagcaccaaataattgggaacatggttagtagtaggagtgtcctagtagacaatgccctctttctagttttatcttccattgctcaagactccagcaaattgtaatacttatggcttcccaaatacactgcatagtttctctcctctgggacccagccacgccatcctggaattccatcacatcaaggactgccttcccaatccttgtttattcatctggccggaagaaatggggacctcctctaactccagcaacattaggtctatatcactctttgccactcaccacattactatacaacaccttactcagagacccacgtgcacgttttccccttttcataaattcttcattacttaaggtcaggggaaagttctgcatatccaaccatactactatattgatttacaagtaagcgaacaataagcaattgttttaaaaagccagtgacataataccaaacaggtcatttaaaaatagatggtaagcacatacagagtggagacttctttggccaatgttgaatttcttcccaggacgaagaacagtagtgtttacatgtgggtatattgttacagaaataccacaagttgggtctacatcctgctgttttccgcaaagaaagccaaggctgagatgatgattattgccaaggaagaaggctttaatcgggtggcaaagccgaggaactcagtcttaaatcagtctccctgaataactaaaactagaggttttagggaagaaatgaacaacgtgttaaaaaaaaaaaaacacacacacacacagaactgggagaggcaaggaaaaattgtaatgaatgaggggttctgacatctaactgtcagaatgtggtgatctggtgagttcagttctttgatattttttttaagaggcctgaagatcatttcctaaggaaggaacacaattaaaaaaatgtaagtttcaagctttaagaccagaagggtcaatttctatgtttacccaaaaaactatctatgggaccgttggttggtttcatacatgcacagacacaaatatgttctcccaaaatctcaggcaatgcaagtggacagtaattaaaattttaataaaatggcatttaatccatcgtccttgtggcctggccttcctccctccacagttgtgactgactgtcaccaataactctactttgttctcccattaacatctacatctctgtagttctgatctctgtgttttttgattatgtcttcttctggtatatctacttctggtttagtctttaccacattatttcatatcttcactcagatcaccacttccaagtgacactgttatttattttgcaaagccagctttttaccctctgtttcgttccccacccacgttgagttctgaatccactaaatgtcctttcatggtgtcctatgtatgcaaatagctcaagtctacagagattttaatttcttttcatctactttcctcttccatctcgcaaacaaatataacatatttaaacaggaaagggaacatcagtgtgtcctcccctaaatatgcttagagaaagggcatttctatttcataatctttgggctctttagtccactgtatgaactcattaaactggaggtggtccagagagcccaggaacttaatgagcctcccagacgcaagctgttcatacccttttgaagtcagtgtggaaccaaatatggaaaatgatcatcagccacttagtcctgatgacggccccagagggtgggtatacctcttccacccaaaattcaggaagaaaaaggtactttctgtagaggcaaaacgagactggatgagccgtttgaaccagcagcaaaactaaaatatacctggaattctgaagactctgctccagaatctcacttagcactgaccctgcactatgtcctaggtcatgaaagagaataccctagaacttggagacaagctcaagttcaaactccaaaaacgtgaggattttagaatcaaaaaaaaggaaaaaggctatttaaatgtatttcaaaaagaccaagaagacagagggaagacatttcaaggagggggaaaaaatgcaaataataaattttttaagtgaaaatgtgaaaataggagtcaccaaagtctaatttctagttcatgattagtgaccagaaatttcaggactgaattttcaggaggatcaagagtcctcatctcggttttaagaccacaaacaggatcacagtatccctggcttaaaatatcctcattgtacattttaaaataactaaaagagtataattggtcgtttgtaacacaaaggataaatgcttgagggaatggataccccattctccatgatgtattatgaaacactgcatgcctgtatcaaaacatctcatgtaccccgtaaatatgcacctctctgtacacacaaaaattttaaattttaaaaaaattttaatattctcattgttgttaggtaaaatgcaaaagctttacatagcctgctgtacaaaccaaagcacaactgagaagtcataagtagaaactcattcatttattcaacaagctaggcactgggggtttgagataaatgaactcccagccctcaaccctagtctcggcatggattggtaagcatgtggtgagtgctcctaaatgccagcatgggctaagcaacctgcattcatgatcttgtctactctccccaagaatctgtgaggctgctattaaccttatcctccttttacaggtaaagaacacactgaggcagacagctctgtaactggcctaagtaaggtcacgcagccaggatctgacctcagactgtttgttcaagagcctgccttctgaaccatcactctcccacacctccagtggaagcggagcctaaaaagggctcaccactgctttgcttatcttcttgcagcagtgcaccctggatgaatggtccagcatcacagaatgagacaccctccagggaggaggagcacatggctgacgctcactgcttctatacgctgagccacgggggcaccagaatccacacaattgggaaacattctgatcccagcagaatgagaccttatcacccagtcctacggtccagagctggggcctggacgttctgccatgccaacagtagaacaaccgcctcttaactgcctgtcatgaatggccttggggtccccatccattatccacctcagcgggagatgagggaacaggcctggccacagcccaccatcccctgaccagtcatcaggggcaggcaaattaaaaccaaagc

SEQ ID NO: 5114 - DNA, 33639 bp, Homo sapiens
agtgcaataaacataaaaatattatcaagaacatctctcaaaactgcataaatacatggaattaaacaacttactcctgaataactcctgggtgaatatcaaatttaaggcataaatcaaaaattctttgaaattattgaaaatagggatgcaacttaccaaaatctctgggatgcactaaagcagtgttaagaggaaagtttagagcatgaaatgccttcatcaagaagttagaagatctcaaattaacaatgtaagtttgcacctaaaggaactagaaaaagagaacaaaccaccccaaagctagcaaaagaaaactaaaattagagaagaatttgacactgagttgcaaaatccatacaaatgatcaataaaactacaagttggttattagtaaaaataaaccagatcaaaggcccctaactagattaacaaaatcaaagaagatccaaataagcacaatcagaaatgaaaaaatgatgttacacctgatcccacagaaatataaaagatcctcagataatattatgataactctatgtgcacaaattagaaaatctggagaaaataaataaattcctggaaataattcctaagattgaatcaggaagagattgaaatcctgaagagactaatatggaactctgaattgaatcagttacaacaacaacaaaaaaaccctaccaatcaaaaaaagtcctggatcagttaattcacagccaaattctaccacatgtacaaagaagaactgagaccaattctactgaactattccaagaaaatccaagaggagggactcctctctaactcattctatgaagccagctcagcctaatgccaaaatctggaagagtcacaatgaaaaaaaaaaacttctggctaataccctgatgaacatagacacaaaaatcctcaacaaaataccaggaaaccaaatgcagcggacatcaaaatgttaataaacgatgatcaagtaggcttcatccctgagatgcaataattgttcaacaagtacaaatcaataaatgtgattcaccacataaacagaatttaaagcaaaaaaatatgttcatctcaatagacaaagaaagaatttcttataaaatctgacatcctttcatttaaaaaccctcaacagactcagcattaaaggagcacatctcaaaacaataaaagccattatgacaaacccacagccaacatcatactgaatgggcaaatctggaagcattccccttggatatggaacaagacataaatgccaactctcaccactcctattaaacatagccctggaatcctaactagagcaatcaggcaagaaaaagaaataaaaggcatctaaacaggaaaagaaaagtcaaactatcttcactgacaatataattctatacttagagaaccctaaagaatccacaaaaggctactagaactgacaaattattttagtaaggtttcaggatacaaagtcaatgacaaaaattactagcatttctatacatcaataacactcaggctgagagtcaaatcaagacacaatcccatttgcaacaaccacaaataaatgaaatacctaggaatacagctgaccaagaagtgaaagatctctgcaaggagaactacaaaactgctcaaacaaatcagagatgacaaaataaatggaaaaacattcaatgctcatggataggaaaaatcaatttcattaaaatggcatgcttcctaaagcaatttacagattcaatgctatttccatcaaactacctgcaccaatcttcacagagttagaaaaaacaattctaaaattcatatccaaccaaaagagccagaatatcatagcaatcctaagcaaaaagaacaaagctggaggcatcacattacccaacttcagctatactataaggctatagtaaccaaaatagcatggtactggtacaaaaatggactcatgaccaatggaacagaagagaaaactcagaaataaagccacaaacctaaaaccatctgatttcgacaaggtcaacaaaaacaagcaatggggaaaggactccctattcagtaaatggtgtgggataactggccagccatatgcagaagaatgaaacaattgaaacacagccatgcccattggataggtatcgtccatggctgtctttactatcacagcagttgccaaagagaacatgcctgcaaagtccaaaatatttactatctggcactttatagaaaaagtttgctgatactcaatttggatcactgagtgaccacatggaagacaaccacattgttgacctgaacaacaacctctacttctttacataaatgaaaaataagccattgaaattctgggcctaattgctacctagtttatcctggtctcactaataattcttcctcagcagtcacagggtgattgactgataatgtacatggcccaatcatcagttgtttgagccattgaggtggactagttatgcccatggagtacagctctctcctctacgacccaccacgagcccaaaatttcctccagatactctaccagtcagtcctaggacctgattgaccccagggagtctgaccccctaagtataacacacatcatgggcagcatcatgggcctgggaaggtgtaaacataatccaatttctgcccattaactgaatgttaacaggaagacgttccctgaagcagaaggaaatgaccttgatgacgatacccttgccaaaggtaggtacccttgccttgtcacctacctggtggtcatgacggtgataaggctggccctgctttcatgtaactaactggccttcaatggttcacttttcccattgatgacttttttcagttatacacttttgtaaactagaagtgtttttactggcatttctttagtacttttttatttttaccatcattttaatttaaaaaatgcagtcacacattttccatgatacctctaatttatggcaggttatagaggtcttgcatttatggcaatggtataaagtccctttttgagtgagcatgttgaagtaaaaagagtgacttcatttaaagaaaactgctcaggaagtacagatgatatgctgataaggcaaaaaaccatgatattagtatgagactaactaggttccagaaacactgcgtatgcccaggctgcagtggagaatgtcatagaatcctggatcatagagtgtggagccatggtgaagggtgcgtgagagggtccctcccccagagccacacctgtctttccacaaggaattcccaaatgtcacccagtggattcagacttctgtctcccgttcagtgttctccaccacaaaatctacacctgatcaatcccatagttcagagacaaagtgagtgaggggcccagaaagacatgtgtttgctgtgcccaatgcctgctctaacatgtgtttccacatatctgctgagcaaactgatggaggtggagaagcttgggagagttcatttgaggccccagatatgcccactctcccaagtcctacccaacctcctatgtaagccaggggtgctttggcatgtgtccatggggatgttcgcctcaaagtgatgcaggaaggagtcaaggcgtcccctgatgggctgatcctttgctctggaatccttaagatcattgtagatccttaagacattccagaactctcacagcattctggagtccattatttaacacatgtttattgagcactactgtgggccaggcatgttcttgggtccttggggtccattagtgaacaaagcaaaggccctagattcacggagcgtgcattctagcagggggagacagataagaagaacatgcaaatactccatggatcatgtgatatgttagaacgggataagtgccttggaaacaaagaagcattaagcagatgagggagatcagaaggaaggatcccatgaattccgctgtcttgaattttacatagtaggggagaggagtgggccaggaggtgtgtgagtggcaagtgtactgaggtgtcagtcggcaagtgctcaactctcaggtgtgcccagctccctaatgctgaggagaaaaatgcaggtgtgtccattcaccctggccaagctgggaagaaaagcccaaaggttctaattggctcaccacctctccccagggtacaaaggaccctacaggcatcagagaagaccccattcactcagcagccaggcatttggagggtttccagcagcccacctctagctgccttcttttcttccttttttaaaaaataatatttactgtttttattttctgactgcaaatgtaatgcatattattacaaaaaaggtaaagtattatgatttaaattttgtttgtattccagtttttctgctgttgctatactttcttcctttaaaatggaatgttaagttcagataatttggatgcttctttgctcattaagtatatcatgagcatcattctatgccattaaatagcatagcctgatttagcagctgcatcacatttggtattgcaccacaattaatttccccaagcttttatctgggtcattaggttacatatgaagtttttgataatatagagagcactgtggtgaatatttttagtgaaacctttatgcccattcataattattttaggataagttcccagaaatgacattctgagtcgaaaagtgtatatcttttgttaaaattccttgccaaaatattccaactacactctcccattgaaggatgaaaatctccattcatcagattttttgctgtgcttggggttataaaattgtttttggttatcggataggcaaaatgataataataatagcaatattattttctatttagtttgcatttatctgaagaccagtgaagttgagttctttttccctttcttcacttggaatgttgtttttattattattattataataattattattattgttatgccacttgacttggtgatctgcaggaaaacctcccaagatggaaagcatgaaattgtctttgctggcctgattcttgacagctgtgtcatcccagagcctgagtgcctcagtttcctcatgtacctgtgggggccatgaggcctgccttctggtactttgaggtctgggactgttgcttataataacttgtgtataagcaccacatggcatggatctacctggctatgtaaacttgggcaggtttctaacctctctgggcttcagttttctcatttgtaaaatggaaataatggaacctatgtatcagagtaatctgaggcttaaatgagttaatacataaagggtacttgaaacagtgcctgaacactgggaggacgcaataactattaccaatgttcatctatgttgtatccttgagattttcatcagggcaaccaacagcacttgcctgggataggcagatggtagaatcttggcattcagggctgcaagactcatgcagaaatcaatcctctcacatagacctggcagattgggaccagaatgtgaaaggaattcacccaaggtcaccctgtaaatgtgtgggagagacaaaacagagcacagttctgacgttgtcccacaaagattttacccctaagatattgttggaaatgcacctccaagggaggatcagtgtattggtggtctcccctcctcaatgctgggagttccaagtttccgggaagaaaagagctgtgaagcccttctcactctgcttggtcttaggagacctagtgagtcccagcgtccccacctgaagcccctgatagcctcctacccactacaatgtctgagtctgtaaatatcaagtccattttcaggcttaaacctcccagtccaaggcgctgcctagaagacacctcgcttagatctggctgaacttcaggggttcttctttccccctccgcagtgcacccaagatcccaaggtagggcagtttctctcagaactattgaccaaccgaaagggaacattcctttcaagctttctgaagactgtctttacctcaatatttacactcctgctgcttgaccaagaaaaacaggctgctggtaagttgtgggatcccctggtcaagacgtgtcatgccagtaccccagatattctagtgtagatcggaaggggatgaaggcagcttggggaggagctgcacaggccaggattgtttcaggaccccagggcctctacaggaaacacaggttttcacacgtcagtttcccctcgtgacatagggactctgggggagtttgctgtgcctctttatgaacatcttaattgttccaagttccctcatgataatagaaggatgagaatgattaccttagttactagattaaaaatctgatacccagattggtatcagagtgggtaagacatgatttcaataatgttagcggtcgaaggaacttagagaaaagccaacacctcaactcttcctttcagatagagaaaccgaggcccagacagggaaggggaggtcacccagtaggatagttttgctcaagtcttctgatcttcaaactagtgcttttgacacagagtagggcattgagattgttgtggcctttctccagcacaccaacatccatctggggtaactttcactgtccgggtatggtgttgggggcagagcctgggacaatcccagaagctcttccttttgcctttggccaaattctgggatttttttgtacctaatttccctccctaattgtgttggcaaagggtgatgaccaatgtgtcagcatttgccaaataaacaaacggcaggagatggggctggctgccagctgcgggttgggagtgtctgctggcaaagaaggccaccccaaggtgaaagaggaaggggtgtcggtccagtcagtctcccaggggcaccgtagcatggtgcctaggagtggcggagcaggtcgcgaacatgggactagaagttggccctacatgtgcttcgtgagacacaggaagtgggagaaggtttactcattaattcattcattcttctattgtgtactcagggccccatatacacattagacctggggcttcacggaaaggaggaacatgaacgcactccacactgcccctgcctcaaggatcttgccttttgtggggtagaggcatatcctcctttcagcatgttattgcaggcagcactcgggctcagtcttcacacaaagatgaatgcacactcaatccctccacaggagcaggcagggattagaggtgtgggagaaacaggagctctgggaacctgaaggcaggaaaactccaggaatggccacaggttctagaactacacgtgcttagaacagcacttcgtacatatttatgttatgagttcttttatatttcatgaataatattattacaatactattattttaccactctcacttcttccccactatgtggacttttaaaatgcaagaaccttgagttaggattgtacctactctcatcctcgggtattagcagagtccctggcacatagtaagttctcagcagtgttagtccattgattgaaggcatcctgaagagggtgggttttaggctgggctctgagggtggataggatttggggatgcagaggcataaaggaggcatttgaggaagagacacctcacaggcatgtgtgcttctcgagacaatcattcatgcacagagaagtttacttcaccagaaagagttaactgagatgaagctgagatacaagggctgccccatgggtacgcggagtgttgaacagtccaggcttgagggtgatgggagtgaggtggagaacatgaatccttagcgttgctatgcccatgatgatgttctcagcgtgaagagccttgcgaggaggaggcactggagctgggtagaaaggaaggggcagccagggtatgtgcagtggggtggtggcttgggccccattgggagaattatggaggagagagactgccttttgcaaccttgctgggcacttgtgaaattgggtaacaacctccctcagttgtgaccaacaggcaggtcaccaaacaagatgccctcgagtgctccctggccttgtgtcctgtaacgagtatgttgcttcccccctgcccaggtgaggtgtggatccacagaggggggctgatggtgggcaccgcatcaacctctgatgggcgggactcgcagcccatgaaaacgtggtggtggtgaccattcagcactgcctgggcatctgggattcttcaggtaagaaattagactctcctcactgcacctttggcccccaacatgaggctctaggaccagctctggtcatgtcagccctcaggagaccttaactgggttcctcattgtacagacaagcaccttcataattggacactacctaccctctcactccccagccacactagtcactagcctctgagcttttgtatgtggtgttccctctgcctggaatgcttagtctacctaagaattcctcttcatcctgcaagacccagcccccagttagctccactgaaagactcattccttttcatctgtgctgctcccacacattgcatttctctgtcatggcagctagcatgcgcccagctgttgaaggttgacacatctgacttctcatggaaaggagggaaggggcagagcatacagggagttcagggcatattgtgggtgaaggaatgggcgctgcagaaggtggggttgggagcatctgaccccttcctggaggagtgttgggacccactcaccccattttctgctgaaatctggcaagtgtgggaagcaaagatggagtcctcctcatcaggtctccatggggaagaagtccccatggcgtggaggaatttggtagctttgagagcttgtttggggaaagcatcaaacttaaagggctggtacattggaggagagaaaatggggatgccaagaatttttagatttttgagaatgtttttagaattcattggttataagcaacagtttcccagtgaccagattaagtcaagacggacgattggctaggtgtggtggctcatgcctgtaatttctgagagtgtgtggccctcactcctgctctggtggagaagggtgacgtcaagcccctggctgaggtagtctcccgctggatgcccccaaccccttggctctgtgcttctgaattctcagaggttattttgccatgggttctagctgatgttctcctagaatcactgaagcgattgggaggtagaggggaagccttgcttgagcccaggagttagagaccagccagggcaacaaagtgagatcctgctctacaaaaagcaaaaaattaagctgggcatggtggtgcaagactgtgggcccatctaatgggaggctgaagtgggaggatcacctgagcccaggaggtctatgctgcagtgagctggtttgcaccactgcactccagcttgggaacaaagcaagaccttgtcccaaaatcttctctgaaaaggagaatttatttttcaaggaaatagagatctgggaggatgggctttgtgcaaaacaggaagcagaaattacaaaatgatgggaatcctagactctgttactcttgttctcttctgtctctttctctctgtctgtctgtctttctctctctctctcaccctctacttctcctgtccctgtttatttatttgagaaacactctgggcattgattctgtccgagatcctgcaggggctctgggggcatgtgcgcttgccctgactccccgactgtggagcctgcctgctctcctctgtgcccttctttctggctgcactttgcttccaatctgcatgagcaccctatctgccctgagcttaaggactctccttggttccagaaagtagtcaggctgtctttcctgttgtaaaaatgagtgttttttacattagcagctctccaccccaattccaggtcacttaagagaaggctcactgtcccgtctttgcttcgatgtccctgaactcttagaaaagtaggaaaccaagtatgctgggcaaactgaccccaatgcctaggtcaggcagaagggaccctgtccctcggagggctttttaaatttttatattttttacatttttttaaagatgaaaagaggttcttgtgtattaattattgttactttgtggcttgactcaggacaaaggtgcagagaccatcgccatggccaaatctggatctatgcctgcatggcccttgagctaaggatgactttttttaatatatgaaattcaaatttcattgtccataaaggaagttttcctcgaacacagtgacacccttcatttaccttgtgtctctggctgtgtttcatgccaacagcagtcttgaagttgcagcgagaccacatggcccacaaagcctcaaatatttactatttggtctttgatgggcacattctgacctgtggcctaaagagtcatgtttgattactgcttgggactctagtacacaaatggcaggtggaaactcctggctgtgccacagatgcctcactcagctgagaaaccccatctagtcttgcaagggacgagaccctgtttttctttagaactcaccattaaagcacatttgctctttctgaagtggtcctgtgtgaatcatcttatctaggcctcctgcaattctgcacatcttattgtgtggaagacatggcactctcccacatgtattaactcatgaggtaggtgcagtattattaccatccatgagtggagaaaccaaggcccaaacaaatcaggtggactgcctgtgcctaatggctggtaagtggagcagccaggatttggaagcagacaagtaaattcaagatccatcatctcaaccccagctccacctcacctttcttgacacattcagcttgagatgatttgtccattttaatagagataaggtagcagagataagagactgggtaattggctcatactcaattgtgattagtaacagaggcaatgctctgcggaatccagaacccacacatgtgggttagagtttcttctgctgccccctgccacttgtacaagtcaggcttagttaggatagaactctttttccatattgatggagggaagggacttcgctcttgaactctgttgttgcttgtgtctttgcagcaaattgctaacactgttgggtgtgaaaccaccaactcagctgtcatggccactgtctgcggcagaagatggaagaggagctcttggagacgacattgaaaatggtaggtgcctgttcccgtagcccaaaccctgtaaacttggtcccagacttcttcatttcagctgcctcttgccctgggacagttacctggggcaatttctcaagtctcaggagtctcagtatcgaatggggaatctaatttgtccttttttttattgaaaaatgacacaaatgtaaaaacaagtccaaaaataacatgataaaaaaactgaccaaatttactatttgaccaaattttaatatttgccattcttgttttcagatgtatttttgagaaactaaacattacatattcccagggacaccatcattctgaattttggggatggagttattaagctcaaagattttcagaaagattcacaagttatcttggttgacttagaaactgtctgtattagacctggtagtggtccagtttctagattttctgagactctgactcagttgtcattctaggatagtcgttcgtccactcatcattaatccatctactatgatcttcttatgcatctatgtgttcactaattcatcccatcattgatatatttttatcaatctaatatcaacctgttcataactttttatttttctatttcaatctatccactgttcatgcatcatccagccaccatatatcttaactctatcacccattcctccaaaaccaacaatccagttatcacctatctgttagttttcacccactattcagtatccatccaattcaactgtactccagctattggtgaagccatccatccctccatttaccacccatccatccatgctaagtatgtaggggtgggtgttagaggtagtgaaacagacagaagtggacatagtccctgctcacatatacttttcaggttgagtatggtggcagcacagggggaagcattcattgtagtcatcaggggtgcttcacagagaaggtggacgagccgaattgagaccagacagcggaattcgggaattcatgcccttaaccctgactccaccttatcttcttgagaaattcagcattgagatcattgtgcccattttaatagaggtaacagagacagaaaattttgtaattggctcatgtcacagttccagttagtcagaggcaacacagttccagtaggacccagaacccacacctgtgggtctagaatatcttctgccattcctgctgtcctcaatattaggacttggggacctttatgattgacggacagctgtggcagtctctcaacacaggaagcccagcaggacaaacacccagatgacacagcacccagggccattgggaactattcctttgagggagaagggtgtgaattccaagctcatgagtagcctgatctctggaatccctcttggacctgaggctactcctgggtcccaggtccggctgctaccactggactctgcttggtttacatgggttgagtccaatgtggtcttggagcttaggtcttggttcaagctctaaagaccaaagtgttcaaggaattaaaacacaactgctttctaatgcctggaaggaggcaaaattccagcaattctgcatgtggcatcagaggacccagcttaaaaggaaaaacttggtaatttgggaaaatccagccctaagatcctgggacatccttctgagattttctgagatcttggggagcgcctccatgattacccactgcctccagtacacacacatgcagacacacagagaacacacacacatagacacacacacacagagaaacacacacacagacacacagagacacaacaaacacacacacagacacacacacagagaaacacacagacacagacagagacacacaaaacacacacacagacaaacacacacacaaacacacacacacacacacagacactcctgctagtgggactacaatccttaatggagagacctgcactggttacttcctgcgaacaggcagacacgtgagctacagtgcagcgatacaatcactgcaatcttcatgaacacacaccaagagaagcatggggtagggtaagtttcagtgagttgtatgagtcagagctgtgtaatggggatgagaaaactcccccaaggtgccttgaatggaaaaaggaatgtgttggaataacatcttgtgttaactgaaaaactcaggagttgacagtttcaggcatggctggatccagatgccattgaatgttattgagaatctaccattctctatccttcagctttggacaactctgtgttacttcactcttcagcagatacatcttctgggaaggttaaagacaacagcactctagagtatatcctatctgcttcgaaaccctctgtccaaacaattcctacaaaagttctggggtaactctattggattgacatggatgtatacctatccctgaactaatacccgcaatcagggaatggagcgccccaggtcacatatagatgcctgaattcatggagtgatagggaaagaaagaatccctgaaaaagaatgggggtattcttccctggggaacaggaaggggagagggatggggacagggaaggctccaaaagcaggtgtcctatccagagctgtagcaatgctggctcagattcctggcccatccttcccgtgccagtgcccactctttcgttctatgccttcaccctgtctcaggcccagcagagccagagtccggcccacttcctctgggcccagccagctcggcacaggagggagaacctgacacctctgctgccccactcacccagctcagtgttctcctgggagcctcttacccacatcctctgcttttgtcttcacagaatttctgaactctagacttacaggagaccccagagaggtaaggacattttgtttctcgattgcgggttttgagtcttagcactttaagctccaattaactataagtgaaagaatcctctctcgggtaattataggaactctgtgtgcttgatgctgaggcccagagaggggcagtcactcacctgggtaacacagccagaagactagtggctggcctggaacccattttcctgactcccagtccagtgctcccaggcacacctctgtatgccctgggctctgcccactcccctgcttttttacattttctgctccccaaatggcactatgggaggaggttgaaccagaacattccattatcgggaggcagagataaagggatgattagccacggagaggggaagcctgaatctcagtccaaggacactcaactcccccagcacacaggagtctccaacaatatcctcctgatctcctcaccacccccacctcccatgggttgacagtttctggtgacatcacctctgacgaatcttacaatcctgtcctctctctgccttcctggaggtcacagcactctcctaaatggtcatgggcggagtacacgagattatccagcaaagacttaataaacacttcctatatgccaggacttgtttaggagctggtgaataggagtaaaacaagaaagactccctgccctcttgggaccttccattacagtgtaggggagtgcaataaaaaagcaaatctagtatgtattctgttggatggtgtgcagcattagggtagagtttgcaggtggtttcaatttaagtagcaggatcagggaatggctcaataagaagtggcatttgagccaagctctggaggaggcaggaagccagctgtcaggaaacctggggaacctattccaggcagagggaacagccactgcaaagaccccgatggaagtggcaggtccagtggagaggatggagtgtggggacagactggcttgaggctgaagaggtaatgggaagtggagagggatcatttaaagtagttgcatttggattctgagcaagatgggaagcctttggagttttgaacagaggagtcacatgatcttagatttcacaaaggtctctgcccctggtgatcaatagactgtaggaaacgggcagagtggatgcagctgaccagctggcgggccactgcatgccataatccaggcaatggctcctggctgcttaaggctgtagtagtggggatgggaggatggttggagtctggatatctttgaaggaatagctgagaggattcgctgatggacaggatctaggggtaagaaagggagaggagtggaggatgtcctgagttttcgggcagaagcaaagcatacccacacagggcagccacttgaaaactctaagtggacaacaatcacttgtcattgtgctgatggcagtcttcccacttggctgccacccaaccagggcaatcctgtctctctcccaacttttatccttttctacttcatatcctctacccaattccgtgtctcatggtgcagcagattggccttccttaacagagttagagtgcgtcacccccacttcttaaaagcctgacctccttatgagacaaattcccttccctccatggagttagtccttcaaaacacacctgcgtcgcactatgtgccagactatacagaaggtaggctctgcacctgtccctccctctaaaactgccccacgataattttccaagcccagaactcctgagtgtttctggaatttaccctgcaagtgatatctatgtccctttgctcacgtggttcccgttttttagaaattctcactccttcctcacttgtcaataccagtcactgcccagagcccactgcaggcaggcggcacctcctcacgtagcctgccctgcatcttccttgcagagaagctgctcctcttgctggcctcccacgcagccctgcctgaactgcacagcctctcaaggaggccggacttgcaccccaatcctgttcgtattgtcagccatattggattaggatctgcaccttgtccagctggttctggtccactcacagaacatttcccccaggcagcccgaactagctcgtcattcattggcttttgtagagagaacaaaggtcctggaagccatagggtctcaaaaaagctaggaattgtccagttgcattgatatctgggagggaaatacagcccatagggcatggagctgggaagatggcacagaggctggggtctatgagagggacccacagcaaccctgctaacaagtaatacctaacagttatcagcccttccagacaccaggtgctgcgctaagtattttgcatgtgttcagccatttaatcctcacaataactcacctcttagatgagaaaactgaggcccaaacaggtgaaactcccaccagtaagtagcagagccaggcttcagatccagttaatctggtttcaaagtccatactcgttttaactgtacccagaaccagctgccctgatggcaatgcgtgaatcaggctctcgctatctgtgaccatacaaaaattattcatcaaaggtaaaacctaaaattaggacatggatcatatactgtgagttcatcactgattcttttattcatgattttctctctaatagggaatccgtcctagtctaggctccttgagtgatgagggttccgtacctcctcaaagccacccatgatcaataacagctctcatttaaatagagatagatagcacaatctctcctcattaatcatgattctgcgtttataaattcacctgcttcctaaaatgtccttataacccccaaatcgatctggtggcactttcatggtcacacacaggcaggtacagagtaggggaatctggatttgctgatgggcacgttccatctgagatccggcaaggcaacctctgtcttcttgtttcatctccaagctaacaagtgtcctcttcgtggtcaatttagtgccatgtgttctgcatttttgtgtttttctggtgatgtcactgttcagagttgcccgcaagagtagcgctgctgtctagtgtcctgagctaagcaggctgtgctgtgccttaccgggaaggcgcctgtgtgagataagcttggcagtgctgctggccatgcgttcgttgttgaaaaatccacaaaactgcacatacaggaaaggaggaggaaattggccagttcatacatgaggctgtgatgggaagtgctaaagtaaccctactgtgtgtgatgcagctgtggaaagatggaaaagaaactgcattgggagattcatagatgatgaaggaatttttaaaaagcaggatggacagcactgttgtgaggttgaaaacagaaatttacactcatcttacccagggtcaaaaaatgggaagggcttttcagctggtgtttattaaaagtaatcctacttataattaactctttgtaagacttatgtattatataaagttctttcaacagaaacccacacataaaagaaggttgatgaaaatgttgtggccagaggttgcaagaacctaacccagtatttcccctttgagtgaagaccctgtattctctaattcagcctcgtgggagctttgtcggaagcaactgctgggactaccgaaaacaactgtggacacaggagggaaatgcatgtacttcaaattgaagtatatagacatgtaattttatatagataatcatgtatttcagtctgagtgaagatttcttcctctcctcgtcacctgaccagtgtcagctctgcctgaagttctgcccctgagtcacacatctatcctccttagttaggaccctgtgttgcatacccatggcccaaagtcacgccggtctagggtgctggtctcaccctcagacaggagagttggggacacggttgtgacctagggtgggaatcacaggcgctgtgttgctctctccccagagttacccccacacacccacggtgattgatggagtggtgctgccaaaaacacccaggagcttcaagctgaaaggaagttccacactgtcccctacattgtcggatttaacaggaggaatttggctggtttcttccaacagtgagaaggcgcaggcctcttggagggactcaccacccccatcagccctcccacctctgatcccaggagtgcttccctctccaagcactgcttgagtcctgggcagctgttcccttcagcaggagttaacatttccatggaaaccttctccggagggcacagttgtcaccgggatatcagggccctgggatcccctctccccagactctcgattgtcttcctattgaagaatcctgaagtgtctgtgctgggaggaccagtagataaaaaactgtgcagatgggaaaactgagggggcctaggaggggaaaggagttgaggagtccgggaggcagtcgggggcttcctggcttcccactttgggctgggtatgcatagttcccccataatcactcatgctcttcatcacctcattgaaaagatccaaaaaagtggcttcttttgattcccattgacttctagggaacagtagacaccagggtctacttgagggatgacggtcagagagggtgaggatggacaagttacctaatcgggtgctgtgctcaatacctggtgacaaaaaatccatacagcaaactccagagacacaatttacccatgtaacaaacctgcacctgtaccccaaccctaaaataaaaattgggaataaaaagtggaagaaagaaagattgacttctaaattgaaaaagcgttctccttccagtcgaggacacacaaagctgaccatgattaaagcagaggacagaatttattcagtaacacaactgcacagaggaaagaagagtccagtatggattgactcaaatccccaaaactaactcctggcactgttttaaaggctgagtgtgcaaaaggaaggcactgtgtgctgtggagagggacttggtccatgtgactagaccgcctggatgtcttatcctggctcacctggggcagaaacaaactcctcttatcgtcaggacaggaagccatgcttagactgcaggaagaacccactgaagtcaggctctactctttccacagggactgggaaatcaggagtcagctccctgaatgtttgcattgcaaagagaaggctctaaggccctcaagaaatggggttgggtggtaaattccatcccaaagggcagagaaagtgtttatcattgcagcttctaaactaactgctctagttgggttcaggggcctgtctgcttctctccaggttttgctggagcagagtaaattgttctggcagagttgagccttcccaggcaagcatgttaaggaactggagtcattctagggacacagccttaagctgctagaagcgatgctagagtttggtcagtctctgagtgcagaggtttgggcagagttgttttgtgtgaagagatatgaagttcgccctcagaaggatttcagaggttataccaaagaccaaagccatgaaggcaggctctaaggtttcagtgtcatctgtgacaggtgggggtactagggaggtctgcatcctcttccccagaccctctattccacactggcttggcagacaccttccctcaccatgtcactggccactgtagtatcccagcctgacacacacacaaaacacacacacacacacacacacactgcaaaacatgccacagcttctccacatttttttttttttttgtaatctttgcaatgcttgagtttctgatataagcccatttgattcattgattttgcccatttcagtaaaaacccatgcctttaaagcccaaaatattggaggactttcagtctgcattgatttggttggttcgtcagtttgttcttctcgttaattcccaatgattcataaatgcttaactttttttttttttttaacagttatgagctatctactctccgaagggaaactggaccagaagacagccatgtcactcttctgaagtcctatccctttgttgtaagagtctaggaatcacgggaattggctaggacccacaggcgacaaggattgcccaaattatagagcaattaaatggccgaatgaagactggggcctcgggtttctcccatctttccacctttcccacttcactttccaccctagcggggagttgcaagggcttgtgggattcaccattgaggcagcccttcctggtgggctggagaagctacatcctcaccagggggtggttgtcactttattgatctattttagcgcattcctaaggaattgatccagaagccattgagaagtacttaggaggaacagatgaccctgtcaagaagaaagaccgttcctggacttaatgggggacgtactgttcggtgtcccatctgtgactgtggcccggaccacagaggtgagtcctagaggtcgaacaggggagggatatggaccccaccagcttctgatctgactcacctacctcccagcatagacagatgtggaaacagccgagggtcaggcctcaaggctgattccatatggcatgggatgaggtgctgtcttattttggtttatgccagtagagcctgtgaaaaaaaaaaccagaggcaagcggtttttttaaggtggtgatcccagatatagcagtagggcggtggggaagtgagagaggaaagagatggaatccaatccaaggtgcctgacaagggagtatcctctgtggacaactggagctgggaaactcaaggaaacactgagaaacagcactcaggggcatcccatctgagcaccaagggagctggggtatttatccaccagccccacttgtcattgtttgaaggctcttgcaaggagttgtttattccctgtgactttgactgctgcacacaagggcagagtagtctcttgtgaccagacaaaggcctcaggccgggagcgcagatgctggaggtagaagtcaggctggcatgcccaggaagaggggatatgggtgagaactgacagcatctgctgcaagggctccatgcctggagttatcgtgggacatagggctgcgtaggacaaatattgaaagatgagtcttggaaggtttttaaggtccaagttggctgcaacaagcttgttaagcattggagctggaagaacaatgggagtcctgcacaggatccagaggttgtccaggaccaagaaggccaaaagtaagagctatggtgggtgtgggggaggtggtcgaagaatggcaatgtctgaggctggcttttgtctatctcggtgtgtgcaggaacatgcaacacagtgccaggacagggtctatgcaggaccttctaccactgacccaaggctgtgtgggggggcatgaggttagggatgcgtgggctcacctctagagaagtgtcttctcctgggtgcaactagaggaggctcacaggactcctctttttcttccagctctcattcgcctagtctgcagccaggaaatgtcctctctctaaccatgctggaagggtttttaaatttggaacttcatagctaaagctaaagctatagctaaagctgatgtcgcaggtgcccagacacacctttgcaaggaaggggcaggtgctcataactctcacttcttcacaaagtcctgataaaaccctataccaggaccactggagttgaatcatttctgtcttaaacttggctttgccccatgttctgctctgatctatatatagtgttcccatctccatcttccaatggtttgagcaatactgaaccctgtttttcatctgatttcccataactttgagttcagagttttttgttgttgttgttgtgttgtttgccaggactacacagatcttatcaactttcacttattgttgtgtctcactcttttgataaaaacaacatttctgaacataaagttaatatgttaaagttaatatgaagaaatttcaaaaatatggaaacacgtaaagaagaaactacatatcactcctaattcccccaccggaggcaagtggtataaatttttttgtactttcttctaaagatttttcatgtcctatatctttaaaaatcaattttatatttcgcttttgttcatagaacactatgttgtgaggatttctcaatattcatataaactcatcaaaacattccttattccatgaaatggctgtgttaaaagactttaatattcctatcctattagatgtttagcctggctgctcacattctgatactaaataacactgagttcagcctaatgtttataagtctctaaccacatgtctaataattttctgggattctttttagaagtgaataactaggctggaccaaagaaatatttttgaactcttgcaaataatgcaaatttgcattccagtgcataagaacgtggatttcttaatttactttccatttgggataccaaggttaaaagttaatgctgccaatttgccccaccaaaaagaagcaatcaccctgtattcttttgcatgtctttcatgacatgtctttcattgtctctgcttctctcttgtgcctatttgtcattgcccaaaactgtgccctactttcctctgaagacttgtgtgtgactgtaggaattctatgaatatcaatcactttagccaaaaaggtttgacaaagtacttttgggcagcatgctgcctataataatttctatcattcacaaaagctctttcctctatgttggctctgagttcctttggaaaatgtttgaatggcaaaggcaaggtcaaaccctcctttagcaagttttgcttgaccttgaagcagccatttaacaggtggattacagagccacagaggatggcatcttcccaagtgcgcttcctgctgagccaagggtgcagtgcaggaggctgcaaagatgagtgaatagattattcttcattcttacattgaaatgacatgtgcgggtgggcgtgaggttagggatgcgtgagctcctgttgttaaatccttttgtggctgaatatttaaaatgttaagaaatgatggctggaggtggtggctcatacctatactctcagccctttggggactgaagtgggaggattgtgagagcctaggatttcaagatcagcctgggcaacatagtagatcctgtctctacaacaaaattgttttcaaaaagtgatgatactatattacaaaatacatatataatatcatcccaagtttatatacataaaagagagatatgttaaaataaaaaaaagcattctctgtggtagagttaccagtgatgttttaaatttgatttttaaaatggttttcaaaatgatttttaaattatataggaggtggaaaattcaaagtgctgaggcacaggacaggtggcccatgatgtagcccagaaggggcagtgatttgtggctccaatgagccaatcatgggaaactggcatcttcttcgggctggaacaggagagctttgttggtgggagaggaggcagagcagaaggagagagggcggggagaggcaaggtcacccttgctcagccccttctttctctgccatgactttactgccttaacaccctaacactcccaggccaggcaggcagcaagcacatggagacagtgagatataaagcagtgagtgccgcagattcctgagacacaagaggagattgttccctctctgcatatgtttgtatttaagtagcctcatgttcagacaagcaactggatttgcttcagtcttctcaggatgggtgagaaaaacactggaagtgctcaaaatgaggagaacagaagacacctgtcagagtggagatggcgtccaagtgaacgaagtctgttataatgaattacatccagtgtaaccagatgtagagagattgtcttgtgtgagaatgtaccacaggcaaaggggtttacgaggcagagtcagtgtccctgcactggcagttattttgaatgattgacccagggtttccacattcattcattaaacatttgttcattgaacaaatatctggtctaattccagttccacctcaaccagctatgcagcccggagcatgtcgctgagctttccgtgactctgtttctctactgtgctgacagccagaggtttcctgcagagttggagaccttgtagcctccaggtgtgtgtctggcaacatgaactgtgcatgaatccttgtcttctcagagctggagcacccacctacatgtatgagtttcagtaccgtccaagcttctcatcagacataaacccaagacggtgataggagaccacggggatgagctcttctccgtccttggggcccctctttaaaaggtaatggctccttgctctccgtgagcttggagttaggagatctgggttctgtcttggtgtggtggctttcagcaagtttcttctctcctggtcttagtttactgattcctataacagggttgaatgtcactgggttgtcccccagcttcctcccactctaacatatggaggcgggatgtgtattcatgtgccctttgcacagccactcagaatcctgctctgtgactcaacaagacgggtgtgtgtgggggagtcttctgaaggattcactatacagggttgaattcattaggttgtcccccagcttcctcctgctctaatacacatgacgggggatgtgtatcatgtaccctctgcacagaaactcagaatcctggcctgtgacatcaacaagacaggcggggggtgtctcctgcaggattcagtatgacagagttgaatgtcatcgggttgtccccccactcctcccgctctaacatacctgagggaggatgtgtattcatgtgccctctgcacaggcgtcagaatcctgttctgtgacatcaacaagacaagtgtttggggggtctcctgcaggattactatgacagggttgaatgtcattgggttgtcccccagcttcctcctgctctaatacacttagggaggatgtgcatccatgtaccctctgccacagacactcagaatcctgggctatgcatcaacaagacaggtggtgggacacatgcaggggtgctctaggttgagaagccaccaacaatttccctctcccaggagcgctgagaatgtgagtgagggtgagattagagttggtgtaaccctgagtcaggtctaatgtgtgtcggtttgtctttctgtctgtctctaacaaaaaccataaacctttacatttattacatttaataattgttagtttagaaatcacaggattatgattacggtttatagtcagcaggattcactgtgacaggattgaatgtcattggcttgtccccagtttcctcctgctctaacacacatgagggaggatgtatatcatgtgccctctgccacgacactcagaatcctgggccgtgtcatcaacaagataggcggagggacacatgcagggcctgctctaggttgagaaaccaccaatcaatttccctctcccagaagtgctgagaatatagtgagggtgagattagaattggtgttaaccctgagtcaggtctaatgtgtgtcggttttgtttctgcctttatgtctctaacaaaacctcataaacctttaaatttaatataattaaaattgttaatttagaaatcacaggatgtatgaatttggaatgggagaggagactttattttgatgtggtttatagtcagcaaagttgctatccctcaagctgggaaggtgcctctggcaagcccagaaacaggctcatcgaacgaggaggggttgggtagaagctttatatgaacagttggctaaacatacatgttcaacacgttacagggggagcaatggatattcatgaagacatcctgacacatgtgtattaaacaaacatgcatgtaacattgcccatgttcacctggtgtggagacctaatatttaaatgtattacaattagggcttataaatccaagggtcttctcagacacaaagcccagcaagtgagcagcctctgtacaccggccaggtccagtccatggctgggatgttcttatctggagaaaataactgaaatcagtctcttatgcaatcaaagccgtagtaaggctggtgggcagggttctgttcttccgagtatccaagctgcagccattttaattgtttcattttgcttaactccaggccagtactggtttagctgtagacaaaaagaagcaccttcagcagggagaacagagtggattctttaagggtagagatgcaggcctgaacccttgcccgcatggccttcgatctttttttaatttggtgtcttattgccacaaggagtgtgttctgtagaatgatcacctttattttattgctgatactcgtccggtggtgtctaaaccacaaaaagggggagtatgatgaggcgtgtctgacctcctatctgtttccaggcaggaactcagtttgggtttttctggggtccccttagcccagagagggtctgttcagtgagttaggggtgttagattttatttttagtttacattatacaatatttttaaaaatcctttcatgatgtcttctagccttaactctcagctgttacagatcacatgggactcaccccatggctgctcaggatgaccatcgccactgggcatgtcccaattatgcacccttaggaggcttgagttctgttatattcagaatgtgaattgtgggtgtgtgcaagagagagcaaccctgggaggtggggcaagccatggaatgatgcatgcccattgctgagccctaggtcagccatgcttaaaggtaaagtaacacaaatccaccaggatcttctaaatgtgcagacctcagctcagtgggtgtggagcatcgccaagactatgtttctagcaggtttgcacgtgaagttgacaatgcaggtccgcggacacactttgagtaacaaaggctttttttcttcttccccacagagggtgcctcagaagagggatcagacttagcaagatggtgatgaaattctgggccaactttgctcgcaatgggtgagctcttggcaaagacacagcacagctggtgagggtggggggcggggcatgcctattgggaggggcagcttctaaggttctagcgatcaaacttctgaccctgtgaccatagcactctgaaatgagagctctctacaaatggagaggccgcccccggagatagtgaactccccgtctctgagatatacaagcctcttgacggagataacttgggcgtcctcacacatctctgaagattttggggacacacagcagctttggggcaattctatttgattttgtttccagaaaccccaaggagaagggctgccgcactggccagagtacaaccaggaggaagggtacctgcagattgggctaacacccaggcagcccagaagctgaaggacaaggaagtagctttctggaccaaactttcgccaagaaggcagtggagaagccaccccagatagaacacattgcgctgtgaacggaggtccatccagcctcgggaacctggaggagcaaagactggggtcttttgccaaagggatgcaggttcagaaggcatcttaccatggctggggaattgtctggtggtggggggtaggggcagaggtcatgaaggagcaagttttttatttgtgacctcagctttggcaataaaagatctttgaaagccaaatcactgcttgtgtcttgtattagagattaatccatcctcctcagagcagaacgatgatgaaagaggcaatgtgagaaggaagctggctttgctggggatggcctgcctcaggacgagtacagtccagagggctgggtcatggacagtgctcaggggagctctggcctactgcatgtttctgagcccccaagaatttccaacaataggatttaggattgccagatgcagcatccctatcctccatttggatctgcctatggaaatggaaatggcccaggctgaaatttgcctggatcagggaagagagagaggtgccgaggtgatcccgtggcactgttggaggcctttattgactcttgcacaggtctgccacaccttcctcagtatgtacactagcctctagacccctccctgaggctgtctctttcaacagctggtctaaactccctctgtaacctgaccacttctgttgcgggcactgaccaccttagagcaagtctccagagggtcatcctaatctgtgtctttcagaatctcaggggtgatttctggattctgctagaatgtggaaaactctaagagtgtcactcctgccttatcagcaagagaaaaagctggattgtcctcaaaatcatacttttcctattgcccaggagaaagattggggtagatagtcagactagagagggccaggctggtggctcaagcctgtaatccagcactttgggaggccgaggcaggcagatgataaggtagaagatcgagaccatcatggctaacacaatgaaaccccgtctctactaaaaatacaaaaattagctgggtgtggtggtgggcgcctgtagtcccagctactcgggaggctgaggcaaagaattgcatgaacccgggaggcagtgcttgcagtgagccgagatcatgccactgcactcagcctaggtgacagagcaagactccacctaaaaaaaaaaaaaaaattcgccctgggcaagctgcaggggagggtgggaagccgactcaggccctgcacctgggtagctgccccacctgtgctgccccaggtaacgcatgtacaggatgagcctcccttcccccagcagggacagatccactcagtcctgccccgcatgctctcctaaaagtttgtatcaagactgtgcctcattatccctgcgatgggaagggctggggagaaaaaaacctaccttaccacttgattgtgtcaaatacaagggaattcattgcaaagagcttgctgtgctccatgaacggggtggagctcaagctgaaattaaaggatgggtaggaagggggatggccagccacaacgtggtggaagtgtgacctgagcagtgggggcaagggggccagcccacgggcagcagggctggtgttggcaaggtgctggagcacaccgtgggtgcctggaggacagcttttctaccttgacatgtaggaaacaacttctctctttataggaagataatgccataaaatgtctgtctacctatctgtctatctttatctatctaccatctatcaattatctatctatcatctattacctatctaatctattttttcattaattacatttatttatgtaattgtatttcaagctctatttacctcctgaactttcatgtgagagactacattttattcaatatatgctttaggtaagtttcagttggattttcttagtacatatgacagagtcctgattaaaatcattgctgcatttgatcatttatatttatcctgtaactataatttatgtgatcaccagtaattttatctgtatcaatcttgtctctgtattagataacaggttcttaaggtctggtacaaacatttcagttttttattgaacatacatacatataagaaatatatatatatacacatacacacaaacacacacatgctatgtaatattatgacttgataacttcactaactgatcacactgtgtaattaggacccagatcaaacacaatattaccagcatcccagaagccacatggagctcaattccaggccctgctcactccccctccttgcctatctacccaaaatggtcaccacagtcctgatgtctagcagcaatattctttttccaggttttgtgctttatatgaacagaatcacatactcttgcatctggttttttccctcaatattatgtttatgagattcacgtgtattgttgtatatggctgtagtttgcatcattgctgtatagtcattcattgtatggatatgtcataatttactggtgtagggcattggagaatgtattagtctgctcgggcttctgtaacaaaataccacagactgggtggctaattaactgaaattcgcatttgcatagttctcaaggctagaagttccagaacaggacacatgagaaggcagcagtctgcaaacaaggaggagagccctcaccaggaaatcagtcagctaatcaactaaaatttgcatttgcatagttctctaggctataagttccagaacaggacacgtgagaaggcagcagtctgcaaacaaggaagagaggcctcaccaggaaatgagtcagctaatcaactgaaatttgcatttgcaaaaaaggaagagagccctcaccaggaaatgagtcacttaatcaactaaaatttgcgtttgcatagttctctagactagaagttccagaccaggaacagtgaggaggcagcagtctgcaaacaaggaagagaggcctcaccaggaaatgagtcacttaatcaactaaaatttgcgtttgcatagttctctaggctataagttccagaccaggaacagtgaggaggcagcagtctgcaaacaaggaagagaggcctcaccaggaaatgagtcacttaatcaactgaaatttgcatttgcatagttctctaggttagaagttccagaccaggaacagtgaggaggcagcagtctgcaaacaaggaagagagccctcaccaggaaatgagtcacttaatcaactgaaattcgcatttgcatagttctcgaggctagaagttccagaccaggaacagtgaggaggcagcagtctgcaaccaaggaagagagcccccaccaggaaatgagtcatttaatcaactaaaatttgcatttgcatagttctctaggctataagttccagaacaggaacagtgagaaggcagcagcctacaaacaaggaagagaaccctcaccaggaaatgagtcacttaatcaactgaaattcgcatttgcatagttctcgaggctagaagttccagaccaggaacagtgaggaggcagcagtctgcaaacaaggaagagagccctcaccaggaaatcagtcactgttctcatttaatgttctcactttagaagatcatgcaagggacaaaatctccagaattttcctgggcggggtcacagctggggtgggaaagttgtagcccctctgaaacttcccgctagctgtccttctatggaggccaggagcgcatcggggaaggtacagtccacagtcccccccatcccaccagtcaggctccaaggggtcttcacatccacaaaacaccattttcatagacaatagcacacacaccaagatgcgcaaattcaaaccagatacccaaatggcactcacttttgaatttgcaaggatttttaccactactcttttggtggtagtgcctagtggcaagaattagaaaaccaggaagtattcagcactgatgtgacagatcagtagctcctgggatttgggagaattttgtgcagtccagctttttggagaagcttatgtcatttacgcttgctgagtccgtgtaagccccaaagccaagctttcacaagctaggacttaggcagctttgaaaaggagagtttatcttctaccctctcaaagagggtgtaggaggttccccttgagagtaaccactggccctccagatggcttggctgcttctgccaggctctactttcagaaatgcccttcattgtcaattatcagaattaaagcctttcagtgtctcctcattgtccagggatgaagtctgttcccttggcttggcattgaagctctctgtcctccattcccccttccattgcaactggcctcccaagaagcccctgaatctgccttgttccaatgctaatttcttctctgcctctccaaatttgcccatctctcaatacctggtaccatcaagagtcatcacagctttgggcattaacattatgaatattgatagttctcagggcaagaaaacacacagaacatgcatctctatggaggcactctattcacctggatgcttataatgtaatctgtagtttgagtttccagggctctttcagattataattcaatcttcacttttctgtgtctaaatttttacattgctttctgaatctcttttttcccattttattcttaacaggctaaaggaaggcttaatagagtagccctaataataggatctgggtttataatcgggcttttgtgatttgaatcaaagaaatgcaaaaactagtgtttatcagagtgtgctgcacttattcctggagttatgcaagatcattttagatggacacaaactaaaaaccacttatagaatggctgtttatttattttgctgtgtattagggaaaaacccttactatcaagtccatggtttaatggatattacctgtgacaacgattgctggagtctgttaaaatctgtcccaccttccttggtacacagccagattacattttccagcctcattgcaattagattgaacacgtgaataagttctcaccaatgtcctctgagtgggagtgagagtgccacagccaggcctggcccatacaaatgctccatggtcacacttctgctcctgctcttccaggtgacaggcaattgacacctatggcaactttagaaaccatgagtgaaggaggcaaagccaccatagcctagatcaggactgagtaaactacagcctgagggccaaatctgcctactgtctttttaaaaataaagttttattgaagcacagtcatgcccattggcgtagtattgtttatgggccgccttactaccacagcagtcgccacagacagcccatggcctgcaagtccaaagtccttactctctggccctttatagagaaagtttgctgatatcctaattttatctctgaatgaccatatggacaacagccaccttgttgacctgaacaacgttctagtccttacctatgcgaaaaataagccgttgaaattctgggcctatttgctaccatagtttacctactctcactaataattcttgctcagcagtcacagggtgattgactgatgaatgtacatgcccgatttccggttgtttgcgccattgagggtgactagttatgcccatgggagtacagtctctcctctaagacccaccaccaggccaaaatttcttccagatgctctgaccagttagcctaggacctgattgaccccaggtagtctgaccccctaaatataacatagcatcatgggctgggaaggtgtaaacataatacaatttctgcccattgaactgaatgttaacaggaagaattccctgaagcagaagaaaatgaccttggtgatgatgacccttgccaaaggtaggtgaccttgccaaaggtagttaacccttgccttgtcacctacctggtggtcctgatggtgatcgttctttcatgtaactaactggccttcaatggttcacttttcccattgagtgactttttcaattatatgcttttgtaaattagaagtgtttttactggcatttctttatgcacgttttatttttaccatcattttaatttaaaaaatgcagttacacattttccatgcatacctctatttatggca

SEQ ID NO: 5115 - DNA, 11941 bp, Homo sapiens
tacttccctaactcctctctttacttctttggcccgttctttctgccacaacctaccacaaagatcctgcttagaatgaaccaaggtcccaggggattgttgcataggcataagggttttcttggaagcctctgggtttgttgatacagaggatccctatggctccttgatgataatcagttgtgaaggtatagtattgagaaactggtctaaagtttttatggtatatatattttaattttatttaataaatatataaaaagcactgttctatgtgttttaaaaatactaacacttgaatcttcttaagtactttgtggagtaggtaacgttattattccaatattacagatgggaaactaagaagttaagtaacttgcccagagggtataaagaggaagggacaaggtgatgttccatactttaaaggaaccagattatcatatttgtagaaagaaagactacattttgatctatcccaaagagtgttatttgaagtaattagactgtgtagctctgaaagaattggaaccgcaattcaaaacaatttaaactgttctggagacaaagctaactctctggtggggttttttcttctgatgataaatttgggggtcacttaatccaggacagttcctgcatttatggaaatgagcatatcgaggtaggattaaagaagtgaattcattcattaggctctatgccatctggttcatttttttctaaagctgagccaagaacatctgtaccccaattttttattttctggccaaaaggggacaaataacatctcacactaagaacattaaaatatttaccaaaggtctcttttagcaaagaatatttcttcattgcaatgcctctgaacatcttcctgaatcaattatattcatctaaacttttattttctatgactaagtaacagtaatattcataatagcaacgacattcagtgagctcttattctgtggtcactgtttcaggtgttttacctatattctatgtatgaaatagcacaacttactctgattaactcaattttattggatataacagttattttcaatttctattatgacaaaaaatgttttattaatcatatctatagctaaactatgtaaaatgtttgtaattatatccttagaatcaattttcagaagcagaattgccagtgtaagagatactttaagaaaaaaattcagcacattttaccagttttcctgccaagaatgttataccatctatattcccaccaacaatgtagcaagacttttgtgaaaagtttttttgtttttttgtttgagatggagtcttgctctgtcacccaggctggagtgcagtggtgtgatcttgcctcctgcaacctccacctcttgggttcaaacgattctcctgcctcagcctcccgagtagctggactataggcacgtgccaccacacctggctaattttttgtgtttttagtagagatggggttcaccatgttagccaggatggtctggatctcctgacctcgtgatctacctgactctgctcccaaagtgctgggattataggcgtgagccactgcgcccggtgtgaaaagtttttaaataatgaattgctagttagcaacctctgagttttttaaggtgttgtctagcagtctttataaaaaaaaaaaacagaggtccaatcacctatttccttagaagagggaatcaagggtatattcagtctgtctataatgcactgctatgtaattactagggaaacttctccaaaagtcacatgggtaaagtgttataaattctgagtcataagtaaagtttctactatgtgagagactccattccctgttgtcactgagatcattaaggtctcagttcacatgttacctttgagagaatttttcctattatcttatctaaaatagtcttcccaaggtctattccattactctgtcttttttcatagcacttactaattatctttgtttattactttattgcttgtctccccattatacgtatgcttctgggagtcaggagctctttcttataccagcgattttatcacaagacctaaagagtgcttggcacatgaaagatgtctatatatgatgaatcagtgaatgagtgatgatgaataaatattggtcctcttaaatcccaaagtcctctgtttactatttatgcacagctttagtctgtagtacaacactgttaagagacaaaatatgcatatggggcaaagcaatattgtaactctaaggtactcaaccttgtagatgaagataagtgaggaagaaccagttattaggtatcaatggcattggtcatttggttataagcgtaagtgaatttccccttgaatttacctgtgagttgctatttaatggtgttggacagttacagataagtttggtagaacttttctcttgtttccttaagggttttgcctttgggtaaccaccttaatttcttcagtccctgtcttcatggataaagtcttagcagagctattaaagatcctaatgtcaacttctcttaagattaattgtccattaatgggtgttctgagagatgttattttgagatcaagtgctaaagatttaaatacacactttaactgggagaatatgcttgtttcactaggacagatatgtttctctatgtatccccagcacttacagtaactggcacgtaggaagcattaagaaaatgttgaataaagaacaagataatcaaattctgtcttgtgaagaaacccatttgggatctattatatgttcgggtaattcctctgagcatcagcgaggatctgtgcaactaacactctggtttatatctatttgaactgctgattgtgggcagtagaaattatttcagtagaaacttagctggcttgaattatgagatattattagtctcattaagaaaaatgtctaccgacttctttaggaagctcagtcttcagaaagtttctttgagatttcatatagaattccttggttttaataaacgttccgacttctgcatatttgctattgatgcaacaatgatgcttggatcaaagttactttgtcatttctaattcatttattttagattactcagctagtagaaaacaatagagtcactttgttctgtaaagtctcttcgtagtatttggtgggattgtgctattcttcagtgggctggtaatcctataaagcttagagaaacacagggctctttaaacgatcctttttctcttttctgtttaaatttcatcacttggttatttttgccacctgcttggattgcctccttacccaaatctaaattcctacagtaaaataaatagaaaatgtggtcgctactctccttcaaaataatatttcatttctttggacaagtatgttaatttcttcatatgcagttgtcaatggtccaggtttcgaaccaaatagcctaaatttgtgtctggaccccactacctgctattattgactttgggcaactagttaacctttctgtgcctcagttttctcatctttaaaatggggctattaagagtcttctctgtattgtcattgtgaattatgaatcaatacataaaatgagtttagaagaatgctggcacttcacaagtgctcaatgttaaattgtttttattgggaagaaatgaaaatactccttgcttaatgttggagaaaagaatcactaacccatcgcatctctaagatgatgatgaaattgcagttgccatttattacatccctactgtgtactaggcactgaattcaatgcttttccaccttatgtaagtgaaatctcacagcacagtgaagtattattattattccatgttacaatgaggaaacaggagaccctaaaaactgagttctttctctaaggttaaacagctcatagggatggagttcagatgtgaatccagttctatctgattttaaatcctgttctcttaatgttatgtcatgtcatctctacagtcttcaataattgagacttaatgttctttgattactacatccagtggctattccaagggaattcaaaacccttgtcttcatgactttcaaaagcacccaagtcctgaaaacaacatttttgtgaagtatattagtgtaatccaaaacatgataacactttttaaagatatttgcagataagactcccctaccctcactgttacagtaacagtgaattttccctggtattgctctgaacattaaggaattaaaacacttgaggctggacttgtaagagacctatttttgttttgttatgttgtaatagctgttgtttctgatatttttcttttccttcattctgctttttctttctccaatcttggcttaaagggcaacttcctgtgcatgtcaggaatctgtggcaaagggaacaagtatgataatttgtctgctaccatttggatgttctattgtctcagcagccaggaaaacagacagagcccctgtgagcatcattgtgtttgggtgcggctttagttgccaaagtgcagtttttactgttggcatttccaccacctgctatggcaataaccatcgaaaggacaaatccccttgtctgtgatttttctttctaggcttctttgagaaagactgtgaaatgatttattcctctgtacatatgaagctatagtgtattctccacgcatagttttggcctctgatactctctgttcttaggttaatccattaacttgcctggggaaaagggacaggaaagatggatgaaggtgttatgaaaacagagatgagaaggatcttaaaaatcccaaccactgccttttcttccctgttcccatctgctcctgagaagtccttcagagatgccaggcctgttaatacctatactttatacctgttgttttaaatgaggcagttcttctcactatatggatataataaacagttaagctgtcttcctctatgcccctcaaaaggagcaaacacacaagccctacacaaatggtatcgtgcccaaatgagtgttggaaatgctggaaaaacaaaggtaagtaggtcttttcattgcaggccttctcagagccttaaaaaaaaatctcactcatattttgaatctctaggagagacatatagtatacaacattctccaaatttgttgaccttggaatgcttttttttttttagaagcaacttgagggacaaaagttctgtagaaacgctttggagagtattgggatagattactttcattgcatttttgcaatttggtttataacttaccttggagattgggcaaattggctggttagtttagatacaatatatttttttcggttgcaattgtatttttacagtagctagcagaagctgtggttctgaaaagatactataaaacattatcttgtgttctagaaaatagaaaatactctattttcttccccacctccattttcccctgtctttagaaaaattaaagtatacttaagaagaggaaacaaagtgagtggtaaggtgtatgcctctatagatggacaggtgtgttagttacattatatccaagtaatgtgtagtgggccttattaatgagatcctaagaaactataaaaaatgaacataccccagatttcttttgtgtacactttgaaagtgtttttccatttctattaaaaagtttaatttgtcatgctatgaaatcaacataaatttatggaggcagaacataatacagtaaaaagacaatgtgatcttttcatgtggcatttttaatacattgtatcacaaattacttcaaagaaacaattaaaaaacaaggaagaacttaggaggttcttaaaatagtatgtagcacattttagaactcaagtacagagctttcctgatgggcccaagtcctgtctcctctcaccctttttttttggggggggtggcgggaacaaaacaataaacacctttattacatgggtgaagacaaaacgaggattttttgcctttccgggccttgatcttcctaagatagaactccaactctttgccctctagcaatagccatctgctcggccacatccacacagttctctcactctttcaaaatgtcagcaccgtttcagaaggagggactggcccttgtgatggccataatgtaaagtgttcacacgaccagtagcatttccattcttagaaagctacgcttcttagaaagctacgctacttgattctaaaaatcagtcatacagacgtgtttttattcctttcagaggcaattcatttcatgaaaaaagctgaaatgaaaacactttatagttaagcttggtgtagtcataaccacacatagctgtgtctgtcataatttgtaaattgagctctgtcataatatctatttttcaggaggctctcagtaaattttcttaaaaagtctttctgattatgaaagtaatgcatgcattgccctgtggcaattacatattactctctcatagaatatatagagagaaggtggcagtgaggacaattctgggtcacctggaaggttttcctctggcacaggaaagacagctgtcctatttctagttgataagtgcctagactgtgcattagaggccaaacattgaaggaagtcaaattgcctttttgtgattctaaagtggtctttgtatcagaaagtagaatctgaagaaatatgctgcaagccagatgattatagttaacagtaatgtattatgtagtttcaaatagctagaaggaggatgttgatgttcccaacacaaagaaatgataaatatttgagatgatagataggccaattactctgtctggtcactctatattatatgtatcagaacatcactatgtgcctgatagattatgtatatcatttgtcaattaaaacaaattagaaaacaacttacttgtctttttgctaaatctggtgtggatccagctgaatataatttcttcctagttctatgaataggatataggtcttggttccatggtgttgtgtgacttatacttttgcttatctttgtcagtacttttgtgggaagagataggggctctatcagaggttgttagcttggtgatgttttcacccacaaattcttcattgttcttagaagttttctcatttctttgaactttccattaacattcaatctttcacttaatgaaaaatattttccttcctcctctttttcctcttccgtactttctccaaattcaggagcagataatggtaattgaaagttctagggacacactgtgagctcaaggtccagaaaggtagggaaagtctttattttgaactgtaggtatgttttaattccttctggagactagcactctcagggatgctgagactggcactggtgctaccagatattaaacagaatggatttaaagattctcctgtattaagaagattattttcaaaagaaagctctattttgtagttattgtcatttcctaaagatataactttcctggagctgtggatcgccacaatattgatggcccatccagcactatttaaaggcagggctttgtcatattttttataatatttgcagcttggtcaaaaatatttattaaatgattaaataaattcaacagcacttagaaacaatagaggcagaaaagaagttgtggagttggggtgtgtgtgtgtatatatatatagaattagtacattttcacatgctgatacaactgagactgggcaatttgcaaaagaaagaagtttaatgtactcacaattcatgtggctggggaagcctcacaatcatgatggagggtgaaaagcacgtctcacatggagcagacaagagaatgagagccaagcaaaagtggtctcctcttataaaaccatcagatccatgagacttattcactaccatgagaacagtatgggggaaactgcccccattattcagtatctcccactgagtccctcccgcaacatgagggaattatgggaactacaattcgagatggatttgggtggggacatagacaaaccatatcatacatatacataggtcagattggtaaagttatagaagcaaatgttagaaaactattttgtaaagttggaaagtagaaacaataaaaaacacaattcaaagagataagcattttcactggtgtttttttctggtgtgattcttccaagattattctggttatccattgctgtgtcacagaccactccaaatttagtggattaaaatgataaatattttatgatgtcatagattctgtgggccagaaatttggacagggcacagtaagatggtgagaacagtttgtctctgttccctgatgtctttgatctcaactgggaagaatgaggagctagaagtgactggcatggctgagacctagaattacctggaggcttctttatcacgtgtctgtgtctgagcctggaatgggatgatttgaaggctgaagttagctgagatgtgtggcttttccatgtggctcaggcttttcatgcatggtggctgcgcttctgagagagagtcctgagaggaagtatctggaaagggagccttccaagagaaccaggtggaagctgcatgccttttctgacctatcctctggaggcacacagttacatttccaccacatttcattggtacatgtgaatcagaccaaacagattcaaggggagaaagaatgagcctcacttctttgcgaggagagtcaaggtcacattgcaaaagagcgtgttggatggaagatgttacatctgatttgaaaaatatacttctctacaatattgtttggtcatcttataaaagtaaaaaatagtgtcctttataatatttcattgagaagtgtattaggcactttatcttgctaatgtaagatggtcactttaaagtgctctgtgtttgaaacattgtctttcttcacctttctaaagaacgcttaagatgatatatggcaaccaatcaatattacttttttcatttgtgtagcttatttaacacaactatttaataaatattatagggacattgtgttattccattttgtgaccctataaagaacacctgaggctcgataatttataaagaaaagaggtttaggccaggcacagtggctccgcctgtaatcccagcactttgggaggctgaggtgggtggatcacaaggtcagcagatcaggccagcctggctaacatggtgaaaccctgtctctactaaaagtacaaaaaaattagcaggcgtggtggcacatgcctgtagtcccagctacccgggaggctgaggctggaggatcgttgaaaccaggaggcagaggttgcagtgagctgagatcacaccactgcattccagtctggtgacagagcaagactctgtctcaaaaaaaagaaagaaagaaagaaagaaagaaaagagtttaatagccaaagttctataggctgtataggaagcatagtgttagcatctgcttagctctggtgaggtctcagggaggttttactcatggtggaaggcgaagcaggaacagcacatccatgacgagagcaggagcaagaggagtagtggggtgccacactctcaaacaaccagatccatgaatttgcagagagaactcactcattactaagagcagggcaccaagccattcatgaggatccatccccatgacccggacacctcccaccaggccccatctccaacataatggattcatttcaacatgagatttgaagggaacaaaacatccaaaccatatcaaatatcatagaaaaaaaataaacatatgggaacatataagtgagaaaataagtttgtgaattatcaaaaagggaaatagtaatatctaggaaggttagcatacataagtgatgttctagtggttctcaattttgtggcagaatataatcatctacagaattcaaatcaaaacaaaacaaaaaaaactctgtaccctgctccctcccccagaaacactgatttaactggtctaaggtatagaccaggcacaatatttaaaagttccctaggtgattgtaatgtgcagccaatcttgagaaccattgcttaaacagtttgtaaaatgtacgaaacagggaaagatgtttaattacaatgtttagttactgactgaaattttatcaataagatctaaattctaatctaaacagaaattcatttgcctctcattcttcaacagattagttcccagaggacactgttggattcatatctgacacgtaaaaaagcccacacaccaatatccaaagcagaaagctgaaagggacctgtttccttgataattcattgaaccattgaaatattgaccccataattgttccaattttgacttctaagaatgtgaatatttgtattttgtttcaactagatgttggaaaattctatagtttgcacccgaaaggtttgaaacattcctttgtataaacacattttcttgattgtgtggtcaatctgctggacgatccgctatgaattcagacagatctgggtttgaatcctggctctgctaccgtttaatgctttaacaatcttatttcatcatgcctccaaaaactgggagaaaatagaatacctgtttagaaaatgattataggaattaaaagcatccattcttttattcaggaaacctttgagcactgagtattccaagattgtattctgtacttggagtatataggaatgaacaagacagccaccttagcagaatgggagagggaggcaataagaaagttaaagaagagatgacaatgtcggttctgatagaagctgggataaaaaaaggaggtagcaaaaaagtgtgaataggacaagtctagactcaaatgataaaaggtagctctgcaaggaccagacaagcacatctaagtcagagattgttaatacaaaagagtcttatggcaaaaataagattggtttatttgagaacaacaacaaaaaggtcagagagcctggatctaatcagtaatgcagtggagagtgagaaaagtaagatggacgggtaaacagacgactgattaggtaagccaggaagaggagttgggatttattataatctcatgatcagcatttataaaactttaagcaaggtgctaaattatctaattttataataaaggggtaagagtgaagggggaaacctggttagcaaggtcttgtaatagtcccagtagatatgatggtgccttgttttagggtggtgctggtggaagtgaaaaaatatatgtttattttgctgtgaacccaaaactgctctaaaaaataaggtctattttttaaaagtatataatgttagtaaaacacatagatttacatggtgggcactcagtttattagagatagggtctcctctgtgccccacgctggaatgcagttggcatgatcatagctcactgtaatctcgaactctgcactcaaacaatcctcctgcctcagcctcctgaggagctaagactataggcatcaatgcccagctaattttatttattatttatttatttttttgtagagacagggtcttgctatttgcccaggctggtctcaactcctggcctcaagcagcccttcttccttggcctcccaaatgttgggattacaggtgtcaaccaccatgcctggccagtaaatgctattttattcataagttatcattaccattagtacaatgtggaagcaagatctggctctgtcattagcattgcttggtggaaagatttactaaataaagcagagagacttttccaaattgtatttattatcttaaaggctttcccctgaaggtacactgggatactaagaagacctgaatagcttaagatcttacaaaaggattccacataccggtttgggacttctaagggaaaatgcaaagattcacaattttaatagacagtgatttttgtttctatatctgacggtcatataattatattttagcacccaacacagttttgccataatg

SEQ ID NO: 5116 - DNA, 12632 bp, Homo sapiens
gtctactgctcattcctatgcggagcctctaggccaagacacactggagttctttaccgcctgttcataagtctgttcattgttgccacagatgtgactatgaacccctaagcctggtaagatattggatccaacaccaactttttagactatactcagaagccaagctgcaaagaaattagtttcagaaactcctccctacggcccactcctctctcctccctccttctttattccccagcctgagggatttagaactttggaacaggagtcgctaaggtttcttcctgcatctggttagggaattagccacatctccagaaataagatttattttaagcatcacataggggtgaaaagaaaatgtaggcaggatggcctttttgcagcagatttatttatttcttttattatatactttaagttttagggtacatgtgcacaacgtgcaggtttgttacatatgtatacagtgccatgttggtgtgctgcacccattaactcgtcacttagcattaggtatatctcctatgctatcccttccccccacccccaccccactacaggccctggtgtgtgatgttccccttctgtgtccatgtgttctcattgttcaattcccacctatgagtgagaacatgcagtgtttgtttttgtccttgtgatagtttgctgagaatgatggtttccagcttcatccatgtccctcaaaggacatgaactcttcattttttatggctgcatagtattccatggtgtatatgtgcacattttcttaatccagtctatcattgttggacatttgggttggctccaagtctttgctttgtgaatagtgccacaataaacatacatgtgcatgtgtctttatagcagcatgatttaaatcctttgagtatgtacccagtaatgggatggctgggtcaaatggtatttctagttctgatccctgaggaatcgctacactgacttcaacaatggttgaactagtttacagtctcacaacagtgtaaaagtgttcctacttctccacatcctctccagcacctgttgtttcctgacttttaatgattgccattctaactggtgtgagatggtatctcactgtggttttgatttgctttctctgatggccagtgatgatgagcattttttcatatgtctgttgactgcataaatgcttcttttgtgaagtgtctgttcatatcctttgcccactttttgatggggttgttttttcttgtaaatttgtttgagttcatcgtagcttctggatattagccctttgtcagatgagtgattgcaaaaattttctcccattctgtatgttgcctgtactctgatggtagtttcttttctgtgcagaagctctttagtttaattagatcccatttgtcaattttggcttttgttgccttgcttttggtgttttagacatgaagtccttgcccatgcctatgtcctgaatggtattgctaggttttcttccagagtttttatggttttaagtctaacatttaagtctgtaatccatttgaattaatttttgtataaggtgtaagaaagggatccagtttcagctttctgcatatgttagccagttttcccagcaccatttattaaatagggaatcctttccccatttgtttttttgtcaggttggtcaaagatcagatggttgtagacatgtggcattatttctgaggcctctttctgttccattgatctatatatctgttttggtaccagtaccatgctgttttggttacttaggcttgtagtatagtttgaagtcaggtagtgtgatgcctccagctttgttcttttggttaggattggcttgtcaatgtgggctcttttttggttccatatgaactttaaagtagtttttccaattctgtgaagaaagtctttggtagcttgatggggatggcattgaatctataattaccttgggcagtatggccattttcatgatattgattcttcctacccatgagcatggatgttcttccatttgtttgtatcttcttttatttcattgagcagtggtttgtagttctcctgaagaggtccttcacatcccttgtaagttggattcctaggtattttattctctttgaacaattgtgaatgggagttccctcatgatttggctctctgtttgtctgttattggtgtatagaatgcttgtgatttttgcacattgattttgtatcctgagactttgctgaagttgccttcagtttaaggagattttgggctgagacaatggggttttctagatatacaatcatgtctctgcaaacagggacaatttgacttcctcttttcctaattgaatacctttttttccttctctgcctaattgccctggccagaaattccaacactatgttgaataggagtagtgagagaggcatccctgtcttgtgccagttttcaaagggaatgcttccagtttttgtccattcagtagatattggctgtgggtttgtcatagatggctcttattattttgagatacgtcccatcaaacctaatttattgagagtttttagcatgaagggttgttgaattttgtcaaaggcctttttgcatctattgagataatcatgtggtttttgtctttggttctgtttatatgctggattaatttattgatttgcatatgttgaaccagccttgcatcccagggatgaagcccacttgatatggtggataagcttttggatgtgctgctggatttgctttgccagtattttattgaggtttttgcatcgatgtccatcagggatattggtctaaaattctctttttttgttgtgtctcgcccggctttggtatcaggatgatgctggcctcataaaatgagttagggaggattccctttttactattgattcgaatagtttcagagggaatggtaccagctcctccttgtacctctgtagaatttggctgtgactccatctggtcctggactgtttttggttggtaagctattaatattgcctcaatttcagatcctgttattggtctattcagagattcaacttcttcctggttagtcttgggagggtgtatgtgtcaaggaatttatccatttcttctagattttctagttatttgtgtagaggtgtttatagtattctctgatggtggtttgtatttctgtgggatcggggtgatataccctttatcattttttattgcgtctatttgattcttctctcttttcttcttattagtcttgctagcagtctatcaattttgttgatctttttgaaaaaccagcttctggttcattgattttttgaagggtttttttgtgtctctatttccttcagttctgctctgatttagttatttcttgccttctgctagcatttgaatgtgtttgctcttgcttctctagttctttaattgtgatgttagggtgtcaattttagatctttcctgctttctctactgggtgtttgtggtataaatttccctctacacactgctttgaatgtgtcccagagattctggtatgtttgtctttgttctctttggtttcaaagaacatttttatttctgccttcattttgttatgacccagtagtcattcaggagcagtttgttcagtttccatgtagttgagcggttttgattggtttcttaatcctgagttctagtttgattgcactgtggtctgagagacagtttgttatatttctgttcttttacatttgctgaggagtgctttacttccaactatgtggtcaattttgaataggtgtggtgtggtgctgaaaagaatgtatattctgttgatttggggtggagagtttgtagatgtctattaggtccgcttggtgcagagctgagttcaattcctggatatccttgtaactttctgtctcgttgatctgtctaatgttgatctgtctaatgttgacagtggggtgtaaagtctcccattgttattgtgtgagagtctaagtctctttgtaggtctctaaggactgctttatgaacctgggtgttcctgtattgggtgcatatatgtttaggatagttagctctcttgttgaattgatccctttaccattatgtaatggccttctttgtctcttttgatctttttggtttaaagcctgttttatcagagatgaggattgcaacccctgcctttttttgttttcattttcttggtagatcttcctccatccctttattttgagcctatgtgtgtgtgtgcactgagatgggtttcctgaatacagcacactgatgggtcttgactctttatctaatttgccgtctgtgtctttttactggagcatttagcccatttacattaaggttaatattgttatgttgaatttgatcctgtcattatgatgttagctggttattttgctcattagttgatgcagtttttcctagcctcaatggtctttacaatttggcatgtttttgcagtggctggtaccggtgtgcctttccatatttagtgcttccttcaggagctcttttaggtcaggcctggtgatgaaaaatctctcagcatttgcttgtctgtaaagtattttatttctccttcacttatgaagctagtttggctggatatgaaattctgggttgaaaattctttcctttaaggatgttgaatatggcccccactctcttctggcttgtagagtttctgctgagagatctgctgttattctgagggcttccctttgtgggtaacccgacctttctctctggctgcccttaacatttttccctcatttcaactttggtgaatctgacaattatgtgccttgtagttgctcttctcaaggagttctttgtggcgttctctgtatttcctgaatttgaatgttgacctgccttgctagattgggaagttctcctggataatatcctgcagagtgttttccaacttggttccattctgcccgtactttcaggtacaccaatcagatatagatttggtcttttcacatagtcccatatttcttgaggctttgttcatttctttttattcttttttctctaaacttctcttcttgcttcatttattcatttgatcttccatcactgataccctttcttccagttgatcgaatcagctactgatcttgtgcattcgtcatgtagttctcatgccttggttttcagctccatcaggtcctttaggacttctctgtattggttattctagttagccattagtctaatttattttcaaggttttaacttttttgccatgggttcgagcttcctcctttagctcggagtagtttgatcgtctgagccttcttctctcaaattgtcaaagtcattctctgtccagctttgtaccgttgctggtgggagctgcattcctttggaggaggagaggcactctgatttttagagtttccagtttttcgctctgtttttccccatctttgtggttttatctacctttggtctttgatgatggtgacgacagatgggtttttggtgtggatgtcctttctgtttgttagttttccttctaacaggacctcagcttgcagcagatttttaaaagaacttccaggaccttgtctgtatattgacgccttgtcactacaggaatcagagcagggcattacattgatcctttaagaaaattttgctacctataccccttgaccctactctttttttttttttaatttttaaaggtaattgttagaaattcccaaggtttatttgaaatgacacaccactgaaaacataacttttacagatgatttgtgatacagtacacatcacctatcttactttaggacagtctgtgaagatgatatttttcctctgcagttcctttgtcaagtgactttagacagatacaggactgcaagagtgactcaggtatgctggcataggagaagcaggtgctagtgtttcacttgaactagttgttgggctggggggaatgaaagctccctaggccatgaggacatctttgcaatgtggagaggacccaaatcatgggtgttgctctttgaatgttgaaggccttgtcagcatactggtcacccagtttcatctcacttcatactgtttgtaccaaagcaccacagtttccttatgaaacttagcttcaaggtggagatgtttttgaaagtattaatataaaatccaattcgtcttgactataataatggtacttttcttgtaagtcaccattaaactcttcaaactttctctatgctttctgaaattctcttctgccttagacagaggctcctatccttcctcctgaagctctgttgagcccgatggagtgggcaggcactgtcatagtccgtcagcttcctgctgcacttggtgatgtgattcttcagtcaggaaattggtccaggtagttttccggtgttagcaaggatgcatccatgagtttttgtggatatcctcccagagcacatcacctttctcaccaaccattttcacaccttcctgccagaccaatccagcgcacagacttcacacagtgactcagcttcgtcaaggtctcttgaagcctttgattgcttctaaacatcctcagagttctctcaggtctggtaccctctgcttctgtggcttgaagttctggacatattcttcaaactgtttgtcttttgtctcagcagctttcctggcttctggaggacgttttcctgtgagtggctgagtctcttccaggcattcttggcaagatgccctcttgatgttggccagggctgcaggtccaggacctgggaggagctgagcgccagtgtggctggtggcgtggaggggcgggaggaagtggggaggatcatgaggaggggtgggtcttcgaccctactgttgatatgttgttcagggaccatcgggagcccagagctctgcctgtttcacgggactccacaaagagaactgcaagtcccagtctttcacctctcttggacttttatcttgtctcttcatcacatctcttcagtataaggaagaacagaaagggaggagaaaactcagggttgtcagtcaaatgtgtccatttacagaatttataaaatgtattgttatctagttatctttatactagcctgctatggcaggtttcaggatcactggacctagagggtagtcaagaaagattttctttgatgtggcttagatccccctgaattcattcccaaaagccaagggaagaaagaacaggattaagtatacattgcccatatcttggaagacaatacagaggcagtaacagacagaagaactagcagacacacagaaagacatgggtcactttaaatttttttattcattttaatgaaaaattatattttgttaaaaatggtctatgtgagaagttctgaatacagtagggaataagaactatgttatatttaccatcctcgagcacacagtcaagaactacaaaagagaaaggcaaatttcacacacagccaagttgagtaaaacaaacaaaatctttggtctaatcagataaagatcatttactagcctggaaactattgtgaaggtattatttatttttgttttctctgtgttatttatacatcccaagaatcctaaaaaatccccaccttttgtgatgaagagtaggtgggcagccatagatcactgagtgtcagtatgacagaggccaggatgaggggcatccagctgactggtcactgggtggccccttgtgtagtccaagcacatctaccctgtattttggtcaaaagaatatctttcttttaaaattaatttaaaacttatcattgagtcatggatactggctcttcacctggccataggaccacaaaccccctcttctcatgctagactctgaaaagaatcaaaagtatttggagccagaaaaggccattttatcttctagtatgagcattgcctccatcctctcccttcctccccactctccacatatgaccaactgttgtttttcaactctgctattttgcacatgccagacacccctatctagtcttatctctgatttcccctaaaccagacctctcataccactttatgaaaatgcatctctctgttcagtagtactggaattaactatcaagacaatggtcatctgaattagaaattatatctctgttttcaattattatcaatattatttgataaatgttaaccaaagttttaactgaacacatttctcaagagatactttccctagactcatcattttgaattgagggaaatggtttaccctcattgagaaagtaattgagggaaatggcttactctcattgaagaaagtctcatttcttcacgtgcattttctagaaacagcagccagctccatatatgcaagagaactggatgtatgtctgaagcaaaaatgccttattcctatgtataacaggactaatatatgcaggccatatggagagcatgggcattgactgaaatgccggtgacccaaatcatagacccaagaattatatatataatggttcatatatatatattatttatataatatatataaacacacacagatacatacacacctattatatattaagtatatataatagtgtgtattatatatattaaatatatataataggtatgggtatgtatctgtgtgtgtatatgtatgtgtgtaagtatgtatgtatgtgtatgtgccagccataagctaatcaaacaatgtgagttaaattacctgagaaaacaatatcagtgagcactgagatatgtacttagtgttgtacatatatcttatacaaatcagcaatagacagcagggtaaaataatgttctaagtagcagagggattgactgatttccactgaaatgctcgggattgattagttctcattgaaatgactttccctagttacttatgctggcaacattgtatcctgtccaggtcccctgaattattcctcagagaccagtgaaacaatgtcatgctctaagtgaggcagagagaataaacgaagtatgccactctgaatctgcttagttttaatgctaagataaatgggttcataaaaggtgggaaaaggaagtggatgtagctcattgtgatgtgacgacatgaggaacatgctttccaaacctatgaataaatgtcagacaaactacagtgacaagaagaccaggatgcagcagatatgagagacacatgtgttgagggccttggccctttctctccagaaccaatgcccatgacagtcttgagaatcaaaatgtaggagaaaaagatgatggaaagtccaacaagaccattgcaaataaaactacaactggatagagacggttgaaggtgtgtcagcacaggctagcttgatgacatcttggtgtagacagaaagcatgggagagtacagggatcgacagtagggaaaccagtgtaggcgaacaactattggcataatggacagaccacccttgtcaatacccgcacaccaatcttcattacctgggtgttggtcaggatagaggtaatcttaaggggttgtggatggtaatgaaacagtcataagccatggcaagcaagacacctactccatgacagaaagagtatggataaaataggcctgagagaagcaggctccatggccatctccctgtgatctaaccacagaacacctagcactgtgggcattgtggtcaatgtcactcgaggtctgtagctgccaacatagctaagaaatagtacatgggctcatggaggttatgacattcctgatgagaaagagaagagtgccactgccaagaagtatggagatgtaggctgccataatgggatgaatatccagtgatgtgccttctccatgcctgggaagccagtaagctggaggtggaagcagacttattgagccccattgccagctttgcaaagaggcaaatatttactcaggtaaagcaatagtaatcagttgtataaaagttgctccttgagaactctacctgttctaagatgttcaccagtcctgactttcagtgacagcaaggatgataatttagtcattcctggagatcctaggtatgggaaaatagaatgtataaagaagatattatttagggtttactcatgtaagattattggatactacgttggggatacagctattcatgcagaataaacattgtgaattcattgtaaatcatataacccagaaaataaaaacaaaatgaaagaagaaatcacttatttgaatagtgctgtaatggcctgaaacttataggtcacttttcatggtgctcttcacctgactggtggtattatagggtggatgtaaaggtttcccaggctatgtgagacctaaagatcagtagaaaaatggttctaagcactattggaaaagcagatataaagattatatggaaaacaaatacacaagtaagaaatatatgagcaaatacaataaaatagtaaatttcagagttgacttttcttcaatattcctggagggaaaattcaattgatgaagctccagagactttgggtagttagaaaatgacgtaagagtgacttacctgtgtgtgtttccaaagcacatagactctatgttgcccagctttataaccctagttattgatacactgcttcaaagaattcaaatttcataatataaattgaagaataaacagtaaaatgtggatttgatgataagcttttgaggcactaattgataatagcaccaaactactgttgcatatcacctacttggtgatgcaaaataaaaattggtaatttaggcaagatcaaggagaattttttttttaaaactatggaatcgatgggatttgacaaaagtgagaaggctctgtgactcattagaattctaagatttcagcggtgcaggcagccaacctctgagaatacataaattgtgtgttggtggcatgagccagagaaataggcccaccttctcttatggttggtttggactatacatctcatatactattgaaaagcatattgatgtaaatttatgcacgatttacaagacctctttctgtccatgaaaagaagcatccaagattactggactttcattttcagaagaatttgttgaagtttcagctctgcttttctaacaataatgatcttgggaaagtaatttaatcttgagatttggttacataaccttaaagactactagtgatttctgtcttctcagtcattctcttgacacaaagtaaggggaatgttttgtaaagagtggataatttttttatttttgtgtttttgttattgtttcagagaatacctcctttctctttctctagtgagtacatgtcaggattattcacccagaggtgtgtcaatgatttcctttttttctgtggaagccttgggaacagatataagatgatgatggggttttaggagcctgtgtttgactttaaataaagatattaaactatagtttctctaatcagcaataaaatgtgatatgtctgggtgggaaagggaaaggagaaaagattgatgagccaatgtggaacttctgacatagctaaaagtaacgttgagcctggggcattgggactgagggaagtgaggggaaagcaactctgtcctcaaaaagtgagaaaaggaggtattattgctcaatctgctgccagtgagaggttcagacaatactcagcttatgcaggattaaagaagcagtatggcaataaaaattgtacataggtatataacttattgttttattataggtattcattgttaaagattaccataatcaaactaattaatatatctatcacctcacataataactttaattttttggtagtaaaaatatgtgaggtctgctttcttagcaaattttaaatatacctaaataaactgggagggaaaagataatacagaacattaatctagttaattgtgttatattactactaataaacatataattgataaattaaaaaaaaaacaggagtaggaataccagatagggaaataaagctgagaaacaaatgtatggaacaaataattgttgaatttctaccgtgtgtcaagattggactggggcattatatacacctcattttttgggaagaatccttaaaatagctgttgtcttgtctgttttcatattgaaaactgagtgctttcacttgattcactcagttgctttgtggtatatgagatgatctgtgagtttcagaggggataaaaatctaaaacctttgcctctccctgcagccattcaccctcttccagggtctctgtcatagaatagacttgagtttttataatgagaaactaattctcaaagtctcaaactctgccgcataaactgatggctctatgcgacacctcagcaggagcccattcagatgttaactttcatatattctctcaccttcccttggcttttttccttcacttttcctgacactcttttctgtctcaagcacttagtatctccacctttttttacccccttacctttggctattatcctttctgtgatggttaatattgagtgaaacttgattggattgaaggatgcaaagtattgttcctgggtgtgctgtaagggtgttgcaaaggagattaacatttgagtcagtagactgggagaggcagacccacccaccctccgttgggtg

SEQ ID NO: 5117 - DNA, 201 bp, Homo sapiens
  misc_feature (1)..(201): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5118 - DNA, 201 bp, Homo sapiens; identical to SEQ ID NO: 5117
  misc_feature (1)..(201): n is a, c, g, or t

SEQ ID NO: 5119 - DNA, 201 bp, Homo sapiens; identical to SEQ ID NO: 5117
  misc_feature (1)..(201): n is a, c, g, or t

SEQ ID NO: 5120 - DNA, 201 bp, Homo sapiens; identical to SEQ ID NO: 5117
  misc_feature (1)..(201): n is a, c, g, or t

SEQ ID NO: 5121 - DNA, 201 bp, Homo sapiens; identical to SEQ ID NO: 5117
  misc_feature (1)..(201): n is a, c, g, or t

SEQ ID NO: 5122 - DNA, 201 bp, Homo sapiens; identical to SEQ ID NO: 5117
  misc_feature (1)..(201): n is a, c, g, or t

SEQ ID NO: 5123 - DNA, 201 bp, Homo sapiens; identical to SEQ ID NO: 5117
  misc_feature (1)..(201): n is a, c, g, or t

SEQ ID NO: 5124 - DNA, 201 bp, Homo sapiens; identical to SEQ ID NO: 5117
  misc_feature (1)..(201): n is a, c, g, or t

SEQ ID NO: 5125 - DNA, 201 bp, Homo sapiens; identical to SEQ ID NO: 5117
  misc_feature (1)..(201): n is a, c, g, or t

SEQ ID NO: 5126 - DNA, 201 bp, Homo sapiens; identical to SEQ ID NO: 5117
  misc_feature (1)..(201): n is a, c, g, or t

SEQ ID NO: 5127 - DNA, 201 bp, Homo sapiens; identical to SEQ ID NO: 5117
  misc_feature (1)..(201): n is a, c, g, or t

SEQ ID NO: 5128 - DNA, 201 bp, Homo sapiens; identical to SEQ ID NO: 5117
  misc_feature (1)..(201): n is a, c, g, or t

SEQ ID NO: 5129 - DNA, 201 bp, Homo sapiens; identical to SEQ ID NO: 5117
  misc_feature (1)..(201): n is a, c, g, or t

SEQ ID NO: 5130 - DNA, 201 bp, Homo sapiens; identical to SEQ ID NO: 5117
  misc_feature (1)..(201): n is a, c, g, or t

SEQ ID NO: 5131 - DNA, 201 bp, Homo sapiens; identical to SEQ ID NO: 5117
  misc_feature (1)..(201): n is a, c, g, or t

SEQ ID NO: 5132 - DNA, 201 bp, Homo sapiens; identical to SEQ ID NO: 5117
  misc_feature (1)..(201): n is a, c, g, or t

SEQ ID NO: 5133 - DNA, 201 bp, Homo sapiens; identical to SEQ ID NO: 5117
  misc_feature (1)..(201): n is a, c, g, or t

SEQ ID NO: 5134 - DNA, 201 bp, Homo sapiens; identical to SEQ ID NO: 5117
  misc_feature (1)..(201): n is a, c, g, or t

SEQ ID NO: 5135 - DNA, 201 bp, Homo sapiens; identical to SEQ ID NO: 5117
  misc_feature (1)..(201): n is a, c, g, or t

SEQ ID NO: 5136 - DNA, 201 bp, Homo sapiens; identical to SEQ ID NO: 5117
  misc_feature (1)..(201): n is a, c, g, or t

SEQ ID NO: 5137 - DNA, 201 bp, Homo sapiens; identical to SEQ ID NO: 5117
  misc_feature (1)..(201): n is a, c, g, or t

SEQ ID NO: 5138 - DNA, 201 bp, Homo sapiens; identical to SEQ ID NO: 5117
  misc_feature (1)..(201): n is a, c, g, or t

SEQ ID NO: 5139 - DNA, 201 bp, Homo sapiens; identical to SEQ ID NO: 5117
  misc_feature (1)..(201): n is a, c, g, or t

SEQ ID NO: 5140 - DNA, 201 bp, Homo sapiens; identical to SEQ ID NO: 5117
  misc_feature (1)..(201): n is a, c, g, or t

SEQ ID NO: 5141 - DNA, 201 bp, Homo sapiens; identical to SEQ ID NO: 5117
  misc_feature (1)..(201): n is a, c, g, or t

SEQ ID NO: 5142 - DNA, 201 bp, Homo sapiens; identical to SEQ ID NO: 5117
  misc_feature (1)..(201): n is a, c, g, or t

SEQ ID NO: 5143 - DNA, 201 bp, Homo sapiens; identical to SEQ ID NO: 5117
  misc_feature (1)..(201): n is a, c, g, or t

SEQ ID NO: 5144 - DNA, 201 bp, Homo sapiens; identical to SEQ ID NO: 5117
  misc_feature (1)..(201): n is a, c, g, or t

SEQ ID NO: 5145 - DNA, 201 bp, Homo sapiens; identical to SEQ ID NO: 5117
  misc_feature (1)..(201): n is a, c, g, or t

SEQ ID NO: 5146 - DNA, 201 bp, Homo sapiens; identical to SEQ ID NO: 5117
  misc_feature (1)..(201): n is a, c, g, or t

SEQ ID NO: 5147 - DNA, 201 bp, Homo sapiens; identical to SEQ ID NO: 5117
  misc_feature (1)..(201): n is a, c, g, or t

SEQ ID NO: 5148 - DNA, 201 bp, Homo sapiens; identical to SEQ ID NO: 5117
  misc_feature (1)..(201): n is a, c, g, or t

SEQ ID NO: 5149 - DNA, 201 bp, Homo sapiens; identical to SEQ ID NO: 5117
  misc_feature (1)..(201): n is a, c, g, or t

SEQ ID NO: 5150 - DNA, 201 bp, Homo sapiens; identical to SEQ ID NO: 5117
  misc_feature (1)..(201): n is a, c, g, or t

SEQ ID NO: 5151 - DNA, 201 bp, Homo sapiens; identical to SEQ ID NO: 5117
  misc_feature (1)..(201): n is a, c, g, or t

SEQ ID NO: 5152 - DNA, 201 bp, Homo sapiens; identical to SEQ ID NO: 5117
  misc_feature (1)..(201): n is a, c, g, or t

SEQ ID NO: 5153 - DNA, 201 bp, Homo sapiens; identical to SEQ ID NO: 5117
  misc_feature (1)..(201): n is a, c, g, or t

SEQ ID NO: 5154 - DNA, 201 bp, Homo sapiens; identical to SEQ ID NO: 5117
  misc_feature (1)..(201): n is a, c, g, or t

SEQ ID NO: 5155 - DNA, 201 bp, Homo sapiens; identical to SEQ ID NO: 5117
  misc_feature (1)..(201): n is a, c, g, or t

SEQ ID NO: 5156 - DNA, 201 bp, Homo sapiens; identical to SEQ ID NO: 5117
  misc_feature (1)..(201): n is a, c, g, or t

SEQ ID NO: 5157 - DNA, 201 bp, Homo sapiens; identical to SEQ ID NO: 5117
  misc_feature (1)..(201): n is a, c, g, or t

SEQ ID NO: 5158 - DNA, 201 bp, Homo sapiens; identical to SEQ ID NO: 5117
  misc_feature (1)..(201): n is a, c, g, or t

SEQ ID NO: 5159 - DNA, 201 bp, Homo sapiens; identical to SEQ ID NO: 5117
  misc_feature (1)..(201): n is a, c, g, or t

SEQ ID NO: 5160 - DNA, 201 bp, Homo sapiens; identical to SEQ ID NO: 5117
  misc_feature (1)..(201): n is a, c, g, or t

SEQ ID NO: 5161 - DNA, 201 bp, Homo sapiens; identical to SEQ ID NO: 5117
  misc_feature (1)..(201): n is a, c, g, or t

SEQ ID NO: 5162 - DNA, 201 bp, Homo sapiens; identical to SEQ ID NO: 5117
  misc_feature (1)..(201): n is a, c, g, or t

SEQ ID NO: 5163 - DNA, 201 bp, Homo sapiens; identical to SEQ ID NO: 5117
  misc_feature (1)..(201): n is a, c, g, or t

SEQ ID NO: 5164 - DNA, 201 bp, Homo sapiens; identical to SEQ ID NO: 5117
  misc_feature (1)..(201): n is a, c, g, or t

SEQ ID NO: 5165 - DNA, 201 bp, Homo sapiens; identical to SEQ ID NO: 5117
  misc_feature (1)..(201): n is a, c, g, or t

SEQ ID NO: 5166 - DNA, 201 bp, Homo sapiens; identical to SEQ ID NO: 5117
  misc_feature (1)..(201): n is a, c, g, or t

SEQ ID NO: 5167 - DNA, 201 bp, Homo sapiens; identical to SEQ ID NO: 5117
  misc_feature (1)..(201): n is a, c, g, or t

SEQ ID NO: 5168 - DNA, 201 bp, Homo sapiens; identical to SEQ ID NO: 5117
  misc_feature (1)..(201): n is a, c, g, or t

SEQ ID NO: 5169 - DNA, 201 bp, Homo sapiens; identical to SEQ ID NO: 5117
  misc_feature (1)..(201): n is a, c, g, or t

SEQ ID NO: 5170 - DNA, 201 bp, Homo sapiens; identical to SEQ ID NO: 5117
  misc_feature (1)..(201): n is a, c, g, or t

SEQ ID NO: 5171 - DNA, 201 bp, Homo sapiens; identical to SEQ ID NO: 5117
  misc_feature (1)..(201): n is a, c, g, or t

SEQ ID NO: 5172 - DNA, 201 bp, Homo sapiens; identical to SEQ ID NO: 5117
  misc_feature (1)..(201): n is a, c, g, or t

SEQ ID NO: 5173 - DNA, 201 bp, Homo sapiens; identical to SEQ ID NO: 5117
  misc_feature (1)..(201): n is a, c, g, or t

SEQ ID NO: 5174 - DNA, 201 bp, Homo sapiens; identical to SEQ ID NO: 5117
  misc_feature (1)..(201): n is a, c, g, or t

SEQ ID NO: 5175 - DNA, 201 bp, Homo sapiens; identical to SEQ ID NO: 5117
  misc_feature (1)..(201): n is a, c, g, or t

SEQ ID NO: 5176 - DNA, 201 bp, Homo sapiens; identical to SEQ ID NO: 5117
  misc_feature (1)..(201): n is a, c, g, or t

SEQ ID NO: 5177 - DNA, 201 bp, Homo sapiens; identical to SEQ ID NO: 5117
  misc_feature (1)..(201): n is a, c, g, or t

SEQ ID NO: 5178 - DNA, 201 bp, Homo sapiens; identical to SEQ ID NO: 5117
  misc_feature (1)..(201): n is a, c, g, or t

SEQ ID NO: 5179 - DNA, 201 bp, Homo sapiens; identical to SEQ ID NO: 5117
  misc_feature (1)..(201): n is a, c, g, or t

SEQ ID NO: 5180 - DNA, 201 bp, Homo sapiens; identical to SEQ ID NO: 5117
  misc_feature (1)..(201): n is a, c, g, or t

SEQ ID NO: 5181 - DNA, 201 bp, Homo sapiens; identical to SEQ ID NO: 5117
  misc_feature (1)..(201): n is a, c, g, or t

SEQ ID NO: 5182 - DNA, 201 bp, Homo sapiens; identical to SEQ ID NO: 5117
  misc_feature (1)..(201): n is a, c, g, or t

SEQ ID NO: 5183 - DNA, 201 bp, Homo sapiens; identical to SEQ ID NO: 5117
  misc_feature (1)..(201): n is a, c, g, or t

SEQ ID NO: 5184 - DNA, 201 bp, Homo sapiens; identical to SEQ ID NO: 5117
  misc_feature (1)..(201): n is a, c, g, or t

SEQ ID NO: 5185 - DNA, 201 bp, Homo sapiens; identical to SEQ ID NO: 5117
  misc_feature (1)..(201): n is a, c, g, or t

SEQ ID NO: 5186 - DNA, 201 bp, Homo sapiens; identical to SEQ ID NO: 5117
  misc_feature (1)..(201): n is a, c, g, or t

SEQ ID NO: 5187 - DNA, 201 bp, Homo sapiens; identical to SEQ ID NO: 5117
  misc_feature (1)..(201): n is a, c, g, or t

SEQ ID NO: 5188 - DNA, 201 bp, Homo sapiens; identical to SEQ ID NO: 5117
  misc_feature (1)..(201): n is a, c, g, or t

SEQ ID NO: 5189 - DNA, 201 bp, Homo sapiens; identical to SEQ ID NO: 5117
  misc_feature (1)..(201): n is a, c, g, or t

SEQ ID NO: 5190 - DNA, 201 bp, Homo sapiens; identical to SEQ ID NO: 5117
  misc_feature (1)..(201): n is a, c, g, or t

SEQ ID NO: 5191 - DNA, 201 bp, Homo sapiens; identical to SEQ ID NO: 5117
  misc_feature (1)..(201): n is a, c, g, or t

SEQ ID NO: 5192 - DNA, 201 bp, Homo sapiens; identical to SEQ ID NO: 5117
  misc_feature (1)..(201): n is a, c, g, or t

SEQ ID NO: 5193 - DNA, 201 bp, Homo sapiens; identical to SEQ ID NO: 5117
  misc_feature (1)..(201): n is a, c, g, or t

SEQ ID NO: 5194 - DNA, 201 bp, Homo sapiens; identical to SEQ ID NO: 5117
  misc_feature (1)..(201): n is a, c, g, or t

SEQ ID NO: 5195 - DNA, 201 bp, Homo sapiens; identical to SEQ ID NO: 5117
  misc_feature (1)..(201): n is a, c, g, or t

SEQ ID NO: 5196 - DNA, 201 bp, Homo sapiens; identical to SEQ ID NO: 5117
  misc_feature (1)..(201): n is a, c, g, or t

SEQ ID NO: 5197 - DNA, 201 bp, Homo sapiens; identical to SEQ ID NO: 5117
  misc_feature (1)..(201): n is a, c, g, or t

SEQ ID NO: 5198 - DNA, 201 bp, Homo sapiens; identical to SEQ ID NO: 5117
  misc_feature (1)..(201): n is a, c, g, or t

SEQ ID NO: 5199 - DNA, 201 bp, Homo sapiens; identical to SEQ ID NO: 5117
  misc_feature (1)..(201): n is a, c, g, or t

SEQ ID NO: 5200 - DNA, 201 bp, Homo sapiens; identical to SEQ ID NO: 5117
  misc_feature (1)..(201): n is a, c, g, or t

SEQ ID NO: 5201 - DNA, 201 bp, Homo sapiens; identical to SEQ ID NO: 5117
  misc_feature (1)..(201): n is a, c, g, or t

SEQ ID NO: 5202 - DNA, 201 bp, Homo sapiens; identical to SEQ ID NO: 5117
  misc_feature (1)..(201): n is a, c, g, or t

SEQ ID NO: 5203 - DNA, 201 bp, Homo sapiens; identical to SEQ ID NO: 5117
  misc_feature (1)..(201): n is a, c, g, or t

SEQ ID NO: 5204 - DNA, 201 bp, Homo sapiens; identical to SEQ ID NO: 5117
  misc_feature (1)..(201): n is a, c, g, or t

SEQ ID NO: 5205 - DNA, 201 bp, Homo sapiens; identical to SEQ ID NO: 5117
  misc_feature (1)..(201): n is a, c, g, or t

SEQ ID NO: 5206 - DNA, 201 bp, Homo sapiens; identical to SEQ ID NO: 5117
  misc_feature (1)..(201): n is a, c, g, or t

SEQ ID NO: 5207 - DNA, 201 bp, Homo sapiens; identical to SEQ ID NO: 5117
  misc_feature (1)..(201): n is a, c, g, or t

SEQ ID NO: 5208 - DNA, 201 bp, Homo sapiens; identical to SEQ ID NO: 5117
  misc_feature (1)..(201): n is a, c, g, or t

SEQ ID NO: 5209 - DNA, 201 bp, Homo sapiens; identical to SEQ ID NO: 5117
  misc_feature (1)..(201): n is a, c, g, or t

SEQ ID NO: 5210 - DNA, 201 bp, Homo sapiens; identical to SEQ ID NO: 5117
  misc_feature (1)..(201): n is a, c, g, or t

SEQ ID NO: 5211 - DNA, 201 bp, Homo sapiens; identical to SEQ ID NO: 5117
  misc_feature (1)..(201): n is a, c, g, or t

SEQ ID NO: 5212 - DNA, 201 bp, Homo sapiens; identical to SEQ ID NO: 5117
  misc_feature (1)..(201): n is a, c, g, or t

SEQ ID NO: 5213 - DNA, 201 bp, Homo sapiens; identical to SEQ ID NO: 5117
  misc_feature (1)..(201): n is a, c, g, or t

SEQ ID NO: 5214 - DNA, 201 bp, Homo sapiens; identical to SEQ ID NO: 5117
  misc_feature (1)..(201): n is a, c, g, or t

SEQ ID NO: 5215 - DNA, 201 bp, Homo sapiens; identical to SEQ ID NO: 5117
  misc_feature (1)..(201): n is a, c, g, or t

SEQ ID NO: 5216 - DNA, 201 bp, Homo sapiens; identical to SEQ ID NO: 5117
  misc_feature (1)..(201): n is a, c, g, or t

SEQ ID NO: 5217 - DNA, 201 bp, Homo sapiens; identical to SEQ ID NO: 5117
  misc_feature (1)..(201): n is a, c, g, or t

SEQ ID NO: 5218 - DNA, 201 bp, Homo sapiens; identical to SEQ ID NO: 5117
  misc_feature (1)..(201): n is a, c, g, or t

SEQ ID NO: 5219 - DNA, 201 bp, Homo sapiens; identical to SEQ ID NO: 5117
  misc_feature (1)..(201): n is a, c, g, or t

SEQ ID NO: 5220 - DNA, 201 bp, Homo sapiens; identical to SEQ ID NO: 5117
  misc_feature (1)..(201): n is a, c, g, or t

SEQ ID NO: 5221 - DNA, 201 bp, Homo sapiens; identical to SEQ ID NO: 5117
  misc_feature (1)..(201): n is a, c, g, or t

SEQ ID NO: 5222 - DNA, 201 bp, Homo sapiens; identical to SEQ ID NO: 5117
  misc_feature (1)..(201): n is a, c, g, or t

SEQ ID NO: 5223 - DNA, 201 bp, Homo sapiens; identical to SEQ ID NO: 5117
  misc_feature (1)..(201): n is a, c, g, or t

SEQ ID NO: 5224 - DNA, 201 bp, Homo sapiens; identical to SEQ ID NO: 5117
  misc_feature (1)..(201): n is a, c, g, or t

SEQ ID NO: 5225 - DNA, 201 bp, Homo sapiens; identical to SEQ ID NO: 5117
  misc_feature (1)..(201): n is a, c, g, or t

SEQ ID NO: 5226 - DNA, 201 bp, Homo sapiens; identical to SEQ ID NO: 5117
  misc_feature (1)..(201): n is a, c, g, or t

SEQ ID NO: 5227 - DNA, 201 bp, Homo sapiens; identical to SEQ ID NO: 5117
  misc_feature (1)..(201): n is a, c, g, or t

SEQ ID NO: 5228 - DNA, 201 bp, Homo sapiens; identical to SEQ ID NO: 5117
  misc_feature (1)..(201): n is a, c, g, or t

SEQ ID NO: 5229 - DNA, 201 bp, Homo sapiens; identical to SEQ ID NO: 5117
  misc_feature (1)..(201): n is a, c, g, or t

SEQ ID NO: 5230 - DNA, 201 bp, Homo sapiens; identical to SEQ ID NO: 5117
  misc_feature (1)..(201): n is a, c, g, or t

SEQ ID NO: 5231 - DNA, 201 bp, Homo sapiens; identical to SEQ ID NO: 5117
  misc_feature (1)..(201): n is a, c, g, or t

SEQ ID NO: 5232 - DNA, 201 bp, Homo sapiens; identical to SEQ ID NO: 5117
  misc_feature (1)..(201): n is a, c, g, or t

SEQ ID NO: 5233 - DNA, 201 bp, Homo sapiens; identical to SEQ ID NO: 5117
  misc_feature (1)..(201): n is a, c, g, or t

SEQ ID NO: 5234 - DNA, 201 bp, Homo sapiens; identical to SEQ ID NO: 5117
  misc_feature (1)..(201): n is a, c, g, or t

SEQ ID NO: 5235 - DNA, 201 bp, Homo sapiens; identical to SEQ ID NO: 5117
  misc_feature (1)..(201): n is a, c, g, or t

SEQ ID NO: 5236 - DNA, 201 bp, Homo sapiens; identical to SEQ ID NO: 5117
  misc_feature (1)..(201): n is a, c, g, or t

SEQ ID NO: 5237 - DNA, 201 bp, Homo sapiens; identical to SEQ ID NO: 5117
  misc_feature (1)..(201): n is a, c, g, or t

SEQ ID NO: 5238 - DNA, 201 bp, Homo sapiens; identical to SEQ ID NO: 5117
  misc_feature (1)..(201): n is a, c, g, or t

SEQ ID NO: 5239 - DNA, 201 bp, Homo sapiens; identical to SEQ ID NO: 5117
  misc_feature (1)..(201): n is a, c, g, or t

SEQ ID NO: 5240 - DNA, 201 bp, Homo sapiens; identical to SEQ ID NO: 5117
  misc_feature (1)..(201): n is a, c, g, or t

SEQ ID NO: 5241 - DNA, 201 bp, Homo sapiens; identical to SEQ ID NO: 5117
  misc_feature (1)..(201): n is a, c, g, or t

SEQ ID NO: 5242 - DNA, 201 bp, Homo sapiens; identical to SEQ ID NO: 5117
  misc_feature (1)..(201): n is a, c, g, or t

SEQ ID NO: 5243 - DNA, 201 bp, Homo sapiens; identical to SEQ ID NO: 5117
  misc_feature (1)..(201): n is a, c, g, or t

SEQ ID NO: 5244 - DNA, 201 bp, Homo sapiens; identical to SEQ ID NO: 5117
  misc_feature (1)..(201): n is a, c, g, or t

SEQ ID NO: 5245 - DNA, 201 bp, Homo sapiens; identical to SEQ ID NO: 5117
  misc_feature (1)..(201): n is a, c, g, or t

SEQ ID NO: 5246 - DNA, 201 bp, Homo sapiens; identical to SEQ ID NO: 5117
  misc_feature (1)..(201): n is a, c, g, or t

SEQ ID NO: 5247 - DNA, 201 bp, Homo sapiens; identical to SEQ ID NO: 5117
  misc_feature (1)..(201): n is a, c, g, or t

SEQ ID NO: 5248 - DNA, 201 bp, Homo sapiens; identical to SEQ ID NO: 5117
  misc_feature (1)..(201): n is a, c, g, or t

SEQ ID NO: 5249 - DNA, 201 bp, Homo sapiens; identical to SEQ ID NO: 5117
  misc_feature (1)..(201): n is a, c, g, or t

SEQ ID NO: 5250 - DNA, 201 bp, Homo sapiens; identical to SEQ ID NO: 5117
  misc_feature (1)..(201): n is a, c, g, or t

SEQ ID NO: 5251 - DNA, 201 bp, Homo sapiens; identical to SEQ ID NO: 5117
  misc_feature (1)..(201): n is a, c, g, or t

SEQ ID NO: 5252 - DNA, 201 bp, Homo sapiens; identical to SEQ ID NO: 5117
  misc_feature (1)..(201): n is a, c, g, or t

SEQ ID NO: 5253 - DNA, 201 bp, Homo sapiens; identical to SEQ ID NO: 5117
  misc_feature (1)..(201): n is a, c, g, or t

SEQ ID NO: 5254 - DNA, 201 bp, Homo sapiens; identical to SEQ ID NO: 5117
  misc_feature (1)..(201): n is a, c, g, or t

SEQ ID NO: 5255 - DNA, 201 bp, Homo sapiens; identical to SEQ ID NO: 5117
  misc_feature (1)..(201): n is a, c, g, or t

SEQ ID NO: 5256 - DNA, 201 bp, Homo sapiens; identical to SEQ ID NO: 5117
  misc_feature (1)..(201): n is a, c, g, or t

SEQ ID NO: 5257 - DNA, 201 bp, Homo sapiens; identical to SEQ ID NO: 5117
  misc_feature (1)..(201): n is a, c, g, or t

SEQ ID NO: 5258 - DNA, 201 bp, Homo sapiens; identical to SEQ ID NO: 5117
  misc_feature (1)..(201): n is a, c, g, or t

SEQ ID NO: 5259 - DNA, 201 bp, Homo sapiens; identical to SEQ ID NO: 5117
  misc_feature (1)..(201): n is a, c, g, or t

SEQ ID NO: 5260 - DNA, 201 bp, Homo sapiens; identical to SEQ ID NO: 5117
  misc_feature (1)..(201): n is a, c, g, or t

SEQ ID NO: 5261 - DNA, 201 bp, Homo sapiens; identical to SEQ ID NO: 5117
  misc_feature (1)..(201): n is a, c, g, or t

SEQ ID NO: 5262 - DNA, 201 bp, Homo sapiens; identical to SEQ ID NO: 5117
  misc_feature (1)..(201): n is a, c, g, or t

SEQ ID NO: 5263 - DNA, 201 bp, Homo sapiens; identical to SEQ ID NO: 5117
  misc_feature (1)..(201): n is a, c, g, or t

SEQ ID NO: 5264 - DNA, 201 bp, Homo sapiens; identical to SEQ ID NO: 5117
  misc_feature (1)..(201): n is a, c, g, or t

SEQ ID NO: 5265 - DNA, 201 bp, Homo sapiens; identical to SEQ ID NO: 5117
  misc_feature (1)..(201): n is a, c, g, or t

SEQ ID NO: 5266 - DNA, 201 bp, Homo sapiens; identical to SEQ ID NO: 5117
  misc_feature (1)..(201): n is a, c, g, or t

SEQ ID NO: 5267 - DNA, 201 bp, Homo sapiens; identical to SEQ ID NO: 5117
  misc_feature (1)..(201): n is a, c, g, or t

SEQ ID NO: 5268 - DNA, 201 bp, Homo sapiens; identical to SEQ ID NO: 5117
  misc_feature (1)..(201): n is a, c, g, or t

SEQ ID NO: 5269 - DNA, 201 bp, Homo sapiens; identical to SEQ ID NO: 5117
  misc_feature (1)..(201): n is a, c, g, or t

SEQ ID NO: 5270 - DNA, 201 bp, Homo sapiens; identical to SEQ ID NO: 5117
  misc_feature (1)..(201): n is a, c, g, or t

SEQ ID NO: 5271 - DNA, 201 bp, Homo sapiens; identical to SEQ ID NO: 5117
  misc_feature (1)..(201): n is a, c, g, or t

SEQ ID NO: 5272 - DNA, 201 bp, Homo sapiens; identical to SEQ ID NO: 5117
  misc_feature (1)..(201): n is a, c, g, or t

SEQ ID NO: 5273 - DNA, 201 bp, Homo sapiens; identical to SEQ ID NO: 5117
  misc_feature (1)..(201): n is a, c, g, or t

SEQ ID NO: 5274 - DNA, 201 bp, Homo sapiens; identical to SEQ ID NO: 5117
  misc_feature (1)..(201): n is a, c, g, or t

SEQ ID NO: 5275 - DNA, 201 bp, Homo sapiens; identical to SEQ ID NO: 5117
  misc_feature (1)..(201): n is a, c, g, or t

SEQ ID NO: 5276 - DNA, 201 bp, Homo sapiens; identical to SEQ ID NO: 5117
  misc_feature (1)..(201): n is a, c, g, or t

SEQ ID NO: 5277 - DNA, 201 bp, Homo sapiens; identical to SEQ ID NO: 5117
  misc_feature (1)..(201): n is a, c, g, or t

SEQ ID NO: 5278 - DNA, 201 bp, Homo sapiens; identical to SEQ ID NO: 5117
  misc_feature (1)..(201): n is a, c, g, or t

SEQ ID NO: 5279 - DNA, 201 bp, Homo sapiens; identical to SEQ ID NO: 5117
  misc_feature (1)..(201): n is a, c, g, or t

SEQ ID NO: 5280 - DNA, 201 bp, Homo sapiens; identical to SEQ ID NO: 5117
  misc_feature (1)..(201): n is a, c, g, or t

SEQ ID NO: 5281 - DNA, 201 bp, Homo sapiens; identical to SEQ ID NO: 5117
  misc_feature (1)..(201): n is a, c, g, or t

SEQ ID NO: 5282 - DNA, 201 bp, Homo sapiens; identical to SEQ ID NO: 5117
  misc_feature (1)..(201): n is a, c, g, or t

SEQ ID NO: 5283 - DNA, 201 bp, Homo sapiens; identical to SEQ ID NO: 5117
  misc_feature (1)..(201): n is a, c, g, or t

SEQ ID NO: 5284 - DNA, 201 bp, Homo sapiens; identical to SEQ ID NO: 5117
  misc_feature (1)..(201): n is a, c, g, or t

SEQ ID NO: 5285 - DNA, 201 bp, Homo sapiens; identical to SEQ ID NO: 5117
  misc_feature (1)..(201): n is a, c, g, or t

SEQ ID NO: 5286 - DNA, 201 bp, Homo sapiens; identical to SEQ ID NO: 5117
  misc_feature (1)..(201): n is a, c, g, or t

SEQ ID NO: 5287 - DNA, 201 bp, Homo sapiens; identical to SEQ ID NO: 5117
  misc_feature (1)..(201): n is a, c, g, or t

SEQ ID NO: 5288 - DNA, 201 bp, Homo sapiens; identical to SEQ ID NO: 5117
  misc_feature (1)..(201): n is a, c, g, or t

SEQ ID NO: 5289 - DNA, 201 bp, Homo sapiens; identical to SEQ ID NO: 5117
  misc_feature (1)..(201): n is a, c, g, or t

SEQ ID NO: 5290 - DNA, 201 bp, Homo sapiens; identical to SEQ ID NO: 5117
  misc_feature (1)..(201): n is a, c, g, or t

SEQ ID NO: 5291 - DNA, 201 bp, Homo sapiens; identical to SEQ ID NO: 5117
  misc_feature (1)..(201): n is a, c, g, or t

SEQ ID NO: 5292 - DNA, 201 bp, Homo sapiens; identical to SEQ ID NO: 5117
  misc_feature (1)..(201): n is a, c, g, or t

SEQ ID NO: 5293 - DNA, 201 bp, Homo sapiens; identical to SEQ ID NO: 5117
  misc_feature (1)..(201): n is a, c, g, or t

SEQ ID NO: 5294 - DNA, 201 bp, Homo sapiens; identical to SEQ ID NO: 5117
  misc_feature (1)..(201): n is a, c, g, or t

SEQ ID NO: 5295 - DNA, 201 bp, Homo sapiens; identical to SEQ ID NO: 5117
  misc_feature (1)..(201): n is a, c, g, or t

SEQ ID NO: 5296 - DNA, 201 bp, Homo sapiens; identical to SEQ ID NO: 5117
  misc_feature (1)..(201): n is a, c, g, or t

SEQ ID NO: 5297 - DNA, 201 bp, Homo sapiens; identical to SEQ ID NO: 5117
  misc_feature (1)..(201): n is a, c, g, or t

SEQ ID NO: 5298 - DNA, 201 bp, Homo sapiens; identical to SEQ ID NO: 5117
  misc_feature (1)..(201): n is a, c, g, or t

SEQ ID NO: 5299 - DNA, 201 bp, Homo sapiens; identical to SEQ ID NO: 5117
  misc_feature (1)..(201): n is a, c, g, or t

SEQ ID NO: 5300 - DNA, 201 bp, Homo sapiens; identical to SEQ ID NO: 5117
  misc_feature (1)..(201): n is a, c, g, or t

SEQ ID NO: 5301 - DNA, 201 bp, Homo sapiens; identical to SEQ ID NO: 5117
  misc_feature (1)..(201): n is a, c, g, or t

SEQ ID NO: 5302 - DNA, 201 bp, Homo sapiens; identical to SEQ ID NO: 5117
  misc_feature (1)..(201): n is a, c, g, or t

SEQ ID NO: 5303 - DNA, 201 bp, Homo sapiens; identical to SEQ ID NO: 5117
  misc_feature (1)..(201): n is a, c, g, or t

SEQ ID NO: 5304 - DNA, 201 bp, Homo sapiens; identical to SEQ ID NO: 5117
  misc_feature (1)..(201): n is a, c, g, or t

SEQ ID NO: 5305 - DNA, 201 bp, Homo sapiens; identical to SEQ ID NO: 5117
  misc_feature (1)..(201): n is a, c, g, or t

SEQ ID NO: 5306 - DNA, 201 bp, Homo sapiens; identical to SEQ ID NO: 5117
  misc_feature (1)..(201): n is a, c, g, or t

SEQ ID NO: 5307 - DNA, 201 bp, Homo sapiens; identical to SEQ ID NO: 5117
  misc_feature (1)..(201): n is a, c, g, or t

SEQ ID NO: 5308 - DNA, 201 bp, Homo sapiens; identical to SEQ ID NO: 5117
  misc_feature (1)..(201): n is a, c, g, or t

SEQ ID NO: 5309 - DNA, 201 bp, Homo sapiens; identical to SEQ ID NO: 5117
  misc_feature (1)..(201): n is a, c, g, or t

SEQ ID NO: 5310 - DNA, 201 bp, Homo sapiens; identical to SEQ ID NO: 5117
  misc_feature (1)..(201): n is a, c, g, or t

SEQ ID NO: 5311 - DNA, 201 bp, Homo sapiens; identical to SEQ ID NO: 5117
  misc_feature (1)..(201): n is a, c, g, or t

SEQ ID NO: 5312 - DNA, 201 bp, Homo sapiens; identical to SEQ ID NO: 5117
  misc_feature (1)..(201): n is a, c, g, or t

SEQ ID NO: 5313 - DNA, 201 bp, Homo sapiens; identical to SEQ ID NO: 5117
  misc_feature (1)..(201): n is a, c, g, or t

SEQ ID NO: 5314 - DNA, 201 bp, Homo sapiens; identical to SEQ ID NO: 5117
  misc_feature (1)..(201): n is a, c, g, or t

SEQ ID NO: 5315 - DNA, 201 bp, Homo sapiens; identical to SEQ ID NO: 5117
  misc_feature (1)..(201): n is a, c, g, or t

SEQ ID NO: 5316 - DNA, 201 bp, Homo sapiens; identical to SEQ ID NO: 5117
  misc_feature (1)..(201): n is a, c, g, or t

SEQ ID NO: 5317 - DNA, 201 bp, Homo sapiens; identical to SEQ ID NO: 5117
  misc_feature (1)..(201): n is a, c, g, or t

SEQ ID NO: 5318 - DNA, 201 bp, Homo sapiens; identical to SEQ ID NO: 5117
  misc_feature (1)..(201): n is a, c, g, or t

SEQ ID NO: 5319 - DNA, 201 bp, Homo sapiens; identical to SEQ ID NO: 5117
  misc_feature (1)..(201): n is a, c, g, or t

SEQ ID NO: 5320 - DNA, 201 bp, Homo sapiens; identical to SEQ ID NO: 5117
  misc_feature (1)..(201): n is a, c, g, or t

SEQ ID NO: 5321 - DNA, 201 bp, Homo sapiens; identical to SEQ ID NO: 5117
  misc_feature (1)..(201): n is a, c, g, or t

SEQ ID NO: 5322 - DNA, 201 bp, Homo sapiens
gataaagacatacctgaactgggaagaaaaagaggtttaatggacttataattccatgtggctggggaggcctcacaatcatggtggaaggcaaggaggascaagtcatgtcttacatggaagggagcaggcaaaaagagtttgtgcagggaaactccacctttttaaaaccatcagatctcatgagacttattcactatc

SEQ ID NO: 5323 - DNA, 201 bp, Homo sapiens
cagaggcacgagctcatcatctattttcacaacactaatgcaagagacctccaacacaagcaaagcaaaggtaccgactgggtgcagccacatatcgtgastttccaggccattctgcctgagttgagatcattatgctgcttctttcattgcacaggaacgtgggggttttctctaaactatgactcatagcaaagcata

SEQ ID NO: 5324 - DNA, 201 bp, Homo sapiens
gtttggggaagtgtttttttttttctttttatctttcattcctgttcaaattcttttttaatttacacataagaaaaagtggtctggcacagtggctcacwtctgtaatcctagcactttgggagactgagagggaggactgcttgagaccaggaattcgagaccaacctgggcaatatattgagaccctgtctctattta

SEQ ID NO: 5325 - DNA, 201 bp, Homo sapiens
gcctgccagctatgttaaaagaagttttttgcaaagccaccttttgtgtatggaactgtgtgtgaaaaaagacttatagaactgtgagaaacttggataaratgaggcatgcgtacttccccatctgaaatagccaagatgatgaccattcttataagtgaaagagttttttttttttgtttggggaagtgtttttttttt

SEQ ID NO: 5326 - DNA, 201 bp, Homo sapiens
gtgtatagatatatgtacagtatagcctgccagctatgttaaaagaagttttttgcaaagccaccttttgtgtatggaactgtgtgtgaaaaaagacttayagaactgtgagaaacttggataaaatgaggcatgcgtacttccccatctgaaatagccaagatgatgaccattcttataagtgaaagagttttttttttt

SEQ ID NO: 5327 - DNA, 201 bp, Homo sapiens
tgcataaacatatatatgcaaaggtatatgtatatgcacatacatgcatacatgtgtatagatatatgtacagtatagcctgccagctatgttaaaagaarttttttgcaaagccaccttttgtgtatggaactgtgtgtgaaaaaagacttatagaactgtgagaaacttggataaaatgaggcatgcgtacttccccat

SEQ ID NO: 5328 - DNA, 201 bp, Homo sapiens
gccagcctcggtgacaaggcaagactctatctccaaaaataataattctaaataaagcaaaataaaatgtatgcataaacatatatatgcaaaggtatatrtatatgcacatacatgcatacatgtgtatagatatatgtacagtatagcctgccagctatgttaaaagaagttttttgcaaagccaccttttgtgtatgg

SEQ ID NO: 5329 - DNA, 201 bp, Homo sapiens
gctaggattacaggtgtgagccaccacgcctggccttagcaaattctaagcactcagaaaagttactttattattgctattatcagtatcatcatcatggrttctcacccttttggagacatcccataccttgttgaaagcttttgttgttgtttactcatgaaacctttggaccctctcccttgagaaacgcacatttgg

SEQ ID NO: 5330 - DNA, 201 bp, Homo sapiens
caggcatagtctctgccctttttcccactcagcactttaagcatggggctgagctcacagcctcatacagagcaaaccccttttcatgtcagtcttgcatrtaagtgagtcttctctccgaaaaactgctgctgggataaaagacttcctggaacctggggtccaacaccaaggccactaagaccaaaagacaaccccagt

SEQ ID NO: 5331 - DNA, 201 bp, Homo sapiens
cgtaagtgagtagtaataaaacattgggaagaaaaactccatgggtgcagggcattgccttttcacaggagtatccccagagccaagatcaatggctgacycatagtaggcacttaataaatatttgttgagtgaatgaatgagtagtaactcaaagtagtttttaaagtgctccaagtatacaaagctggaaggaattaa

SEQ ID NO: 5332 - DNA, 201 bp, Homo sapiens
acttgcttcatattccattaacatccagagatgctaaaaagtgaaaaaaaaaaaaaaaaaaagaagaagaagaagagaactaggctacaagaaattttaaraagagacactggcctaatgggtcacatgtacatccctggaccagcatggtgcagaagcgactgatgggggtgttgtgtgggggagaatctggtttccaag

SEQ ID NO: 5333 - DNA, 201 bp, Homo sapiens
ttcacactgcacgcctgtgtcaaaacatctcatgtaccccataaatatatatacctactatgtacccacaaaatttttttaaataaaagaaaattaactcstaaattcctaccattatgcagactggataactaaatcatgataccatgatatcatagtgaagaatgtgatgagggctatgaggttagacttatctgggtt

SEQ ID NO: 5334 - DNA, 201 bp, Homo sapiens
ctcatgtaccccataaatatatatacctactatgtacccacaaaatttttttaaataaaagaaaattaactcctaaattcctaccattatgcagactggayaactaaatcatgataccatgatatcatagtgaagaatgtgatgagggctatgaggttagacttatctgggttcaaatctttatgagttacaaaaaatata

SEQ ID NO: 5335 - DNA, 201 bp, Homo sapiens
agaatggaaggtcctaagcaggaaggacagtcttatttgtatctttaaaaaagcttactctgacaagtcattctacctctttgagcctctggtacatcctmtataagatacaagtagtattctttttttcacagggctcttaagaaagttaaattcgatcttggacagaaagtacatggcatacagtaggcactctatgaa

SEQ ID NO: 5336 - DNA, 201 bp, Homo sapiens
tatcccagcagctggtaagtgttggagccagaattctcacctcagcagtctaccgcagactccaagctcttcgccactcagtgaactgtgatacattcccmcagttaccaatggtagactttgaaaaaggaaataaaaaaggaagctgaaatccacattgacagcaaagataggcaggaggggattgacaggagcggaagc

SEQ ID NO: 5337 - DNA, 201 bp, Homo sapiens
accctttcttctctccttcctgtttcctggattttctggctgcttgcagaaaatcctaagttattagaagatggcagagccacaagatagtggagactgasttcttaaatccccacatgaagagaagctgcctgctgaccccaggaatacccaccatcggaccatcaggttagcaaaaagtaagctttattgttaagccag

SEQ ID NO: 5338 - DNA, 201 bp, Homo sapiens
aagttattagaagatggcagagccacaagatagtggagactgagttcttaaatccccacatgaagagaagctgcctgctgaccccaggaatacccaccatyggaccatcaggttagcaaaaagtaagctttattgttaagccagaggtcagcaaacttttctgtaaagagctagagagtaaatattttgagctttgcaggc

SEQ ID NO: 5339 - DNA, 201 bp, Homo sapiens
gtctctctcacaatggctcaactctgttatcatagcataaaagcttccttagatgatctgtaaacaaatgggtgtggctgtgttccaataaaactttattyacaaaaacaaacaagggcccaaattgggctggagaaccacagcttgtcaaatcttgtgctaaggcattaaaattttgcaggaattatttgttattatagc

SEQ ID NO: 5340 - DNA, 201 bp, Homo sapiens
accacaatgagataccatctcacaccagttagaatggcaatcattaaaaagtcaggaaacaacaggtgctgcagaggatgtggagaaataggaacacttayactgttggtgggactgtaaactagttcaaccattgtggaagtcagtgtggcgattcctcagggatctagaactagaaataccatttgagccagccatccc

SEQ ID NO: 5341 - DNA, 201 bp, Homo sapiens
gctcagcccctcccacaaaatgaaactgatcccttgtccctcctgaagatggatgacatcattaaagtatgggcttgatttagtggaatggaagatcacascttgggatcagaaattcagctacctagctacatcagccactatgtggtcttggcaaattcccttaactcccctatggctcagtcacttcatctgaaagtt

SEQ ID NO: 5342 - DNA, 201 bp, Homo sapiens
tggccaagccaagataagattagaacttcatctacatcgagcattattttcacctcttatttattgattttaattttccttctttttttttttttttttttgagacaaagtctcactctgtcacccaggctagagcgcagtggcatgatgttggcttgctgcaacctccacctcccaggttcatgcaattctccctgcctc

SEQ ID NO: 5343 - DNA, 201 bp, Homo sapiens
catggaaaagactaaagataggtctccccactctcccaggaactacctgatgcctctttagcaggagctgagtgggctccaccaacattccgatctgtgcrtctgcccttttcgagagctctcagtgtttaatgggaaggcccatcactcgcatccaaactctggagctgccaggttacaagagcaccaacttccacctcc

SEQ ID NO: 5344 - DNA, 201 bp, Homo sapiens
cccaggaggttgaggctgcagtgaactatgatcatgccactgcactccagcctgggcaacagagtgaaacactgttttctttaaaaaaaaaaaaaaaaaaattgtgttgtacacctttaatatatacaatttttctttgtcagttaacctcattaaagctgagtgcggtatggggggaacctccagtgcagtctttagagt

SEQ ID NO: 5345 - DNA, 201 bp, Homo sapiens
ctgtttgtgcagcagggcctcatccatcctagctgatccagctttcctgaaaccctatcttaaagggcatctcctgtcactttcagtctctttaccctgcyttgcctgtggcacttaatgcaatctaacattatatatttaccgtgtttatattttgtccccatcccctggaatataagtttgataagggcagggacattg

SEQ ID NO: 5346 - DNA, 201 bp, Homo sapiens
atccatcacttgccaggcagtatctaggtgctggggggactctatgaaggggatatgctcctgcccaggtggagtttagcagggaatctggacagtgatgragtcatttcaaatatgataaacccatcaggtatacacaaggagaaaagctaattttcatttttataggtattttataaacatttttctaaacactctact

SEQ ID NO: 5347 - DNA, 201 bp, Homo sapiens
ttactgaaactttaaattaaaatgatataagttctgagatttgcattaaaataatcagggggttggtaaggtattagggaggagggagtattaagaaaacmagattgggcagggtgcgatggctcatgcctttaatctcagcattttgggagaccaaggcaagtggatctcttgagcccaggagtttgagaccagcctggg

SEQ ID NO: 5348 - DNA, 201 bp, Homo sapiens
agatttcatggttggtatgcatgtcgctggtgtttgctccaggcactgactaactctgtctgggttgtgaaaacaaggacactgtaagacctttcataccwttcaaagaagaaagtggacaacgccttccgctaagggcctccttaacgtggtgtattccagtgtgtggtatactgatggtgtacaagatcattttagatg

SEQ ID NO: 5349 - DNA, 201 bp, Homo sapiens
atcagagaggtttaggaaacactgatttggtctgtatcaggtgcagcaaattcaaatatgtgcagaacccagagagatgagataaataattttttttttttgaagggagtctcactctatcccccaggctggagcacagtggcgcaatcttggctccctgcaacctccgcctcccaggttaaagtgatcctcatgcctcag

SEQ ID NO: 5350 - DNA, 201 bp, Homo sapiens
ctcccagaaagcccatcatcttctgctttggaaagccaatattgtaaatattggaagcataacttccagcacacacaaacacacacacacgcaatatcatsccacctcttcaacagatgaaggcgaaaacaactaaaatccaagagtaaatctccagctaaaaacaagctcaaatagcaacaagaacttcaaggaggagat

SEQ ID NO: 5351 - DNA, 201 bp, Homo sapiens
catagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctgga

SEQ ID NO: 5352 - DNA, 201 bp, Homo sapiens
tgcttactgaattttcattttgcttttcttaattataagaataatgcaaagtcccatcaacaacatttttgtgtgagttgatggatttctttatatatatwtattttttttttttgagataggatctcgctctgtcgcccaggctggaatgcagtggcacaatcagagctcactgcagcctcaaattcctaggctcaagtg

SEQ ID NO: 5353 - DNA, 201 bp, Homo sapiens
tttgcttactgaattttcattttgcttttcttaattataagaataatgcaaagtcccatcaacaacatttttgtgtgagttgatggatttctttatatatwtatattttttttttttgagataggatctcgctctgtcgcccaggctggaatgcagtggcacaatcagagctcactgcagcctcaaattcctaggctcaag

SEQ ID NO: 5354 - DNA, 201 bp, Homo sapiens
gttttgcttactgaattttcattttgcttttcttaattataagaataatgcaaagtcccatcaacaacatttttgtgtgagttgatggatttctttatatwtatatattttttttttttgagataggatctcgctctgtcgcccaggctggaatgcagtggcacaatcagagctcactgcagcctcaaattcctaggctca

SEQ ID NO: 5355 - DNA, 201 bp, Homo sapiens
acatcagcaggaagcaaacttctactatgttataccactgatatttgagggcttatttgttatagcatctaccattatcctttgaattacgaagctaaggraaaaaaagcccattggctttaaaacccagcagagttcagtaggaggaggaagatggagaaagttataaagtaatcaagttgggtgggaacctcaggttag

SEQ ID NO: 5356 - DNA, 201 bp, Homo sapiens
tacatcagcaggaagcaaacttctactatgttataccactgatatttgagggcttatttgttatagcatctaccattatcctttgaattacgaagctaagrgaaaaaaagcccattggctttaaaacccagcagagttcagtaggaggaggaagatggagaaagttataaagtaatcaagttgggtgggaacctcaggtta

SEQ ID NO: 5357 - DNA, 201 bp, Homo sapiens
accaccctcctcagtgaggtgatgacgccaaggatcaagctgatggtggctccagcaggcatgacattgaaacaggcaaatgagatccttcagcctagcargggaagctgcctatggtcaatgatcgccatgagctagtggccatcgtctcccacaccaacctgaagaagaatcgagactacattctggcctccaaggatt

SEQ ID NO: 5358 - DNA, 201 bp, Homo sapiens
acactcaactcacagttgcagatttcataagcaacaaaaagaagaatccatttcacaggcatttttcagtgcctgtctgaccacactgatcaaggcagtgrgggtacagaggtgcacaaaacgtgcaaagtgcctgctacagtgatgcttaccctctggtggggagagctgaagttctgggaaagtacagtttgagggaat

SEQ ID NO: 5359 - DNA, 201 bp, Homo sapiens
atgcacatacatgcatacatgtgtatagatatatgtacagtatagcctgccagctatgttaaaagaagttttttgcaaagccaccttttgtgtatggaactgtgtgtgaaaaaagacttatagaactgtgagaaacttggataaaatgaggcatgcgtacttccccatctgaaatagccaagatgatgaccattcttataa

SEQ ID NO: 5360 - DNA, 201 bp, Homo sapiens
ggtgctaaatgttacgagagtgcagcagaggcataaaataaaagaagcctgaagcaaacttttaattcgttacacaaaaaagtctttagtcttctttgccragattaaagcagtgccactctgggtctggagccgaactggtagctggggtctagaagaattcagagttcatcccgagtcttctctagagatggaagccgg

SEQ ID NO: 5361 - DNA, 201 bp, Homo sapiens
aaataagacacctgaaactccacgatatgataaatgatatgacaacagggggaggtgctaaatgttacgagagtgcagcagaggcataaaataaaagaagmctgaagcaaacttttaattcgttacacaaaaaagtctttagtcttctttgccgagattaaagcagtgccactctgggtctggagccgaactggtagctgg

SEQ ID NO: 5362 - DNA, 201 bp, Homo sapiens
tactgagtcctgattccctaggcaaaaagtgcaaagcataccgaaaaataaatatccagccttaaaaaatcagtacaacaatcccttggctcccatcaacwtcgtagaccccactgtgtgcaggggccgcagtcgacggcagggtatgaggagaaacaggacaggtttccatgtcccttgtgagcgcagagtgtaggagga

SEQ ID NO: 5363 - DNA, 201 bp, Homo sapiens
tctgtactgagtcctgattccctaggcaaaaagtgcaaagcataccgaaaaataaatatccagccttaaaaaatcagtacaacaatcccttggctcccatsaacatcgtagaccccactgtgtgcaggggccgcagtcgacggcagggtatgaggagaaacaggacaggtttccatgtcccttgtgagcgcagagtgtagg

SEQ ID NO: 5364 - DNA, 201 bp, Homo sapiens
gtatttttattttttccaatgattggattctccagggtgcgcacatgacagagacaagtttctgtactgagtcctgattccctaggcaaaaagtgcaaagsataccgaaaaataaatatccagccttaaaaaatcagtacaacaatcccttggctcccatcaacatcgtagaccccactgtgtgcaggggccgcagtcgac

SEQ ID NO: 5365 - DNA, 201 bp, Homo sapiens
gcacgagcacaattttacgtggttatgggaaggaatggtgttctctatgtgtatttttattttttccaatgattggattctccagggtgcgcacatgacaragacaagtttctgtactgagtcctgattccctaggcaaaaagtgcaaagcataccgaaaaataaatatccagccttaaaaaatcagtacaacaatccctt

SEQ ID NO: 5366 - DNA, 201 bp, Homo sapiens
gtgacatgccctgtttcaaacatataaaatatattaactaatttaatgctcataacaactctatgaggtcagttctattttatcccttttaacaaataagyaaactagagcacagatgggttaagtgacttgtccaagatcacacagcaagctagtagagacgggattcaaactaaacggtaactcaagtcccttctctta

SEQ ID NO: 5367 - DNA, 201 bp, Homo sapiens
cttatagactccttactatgtgacatgccctgtttcaaacatataaaatatattaactaatttaatgctcataacaactctatgaggtcagttctattttrtcccttttaacaaataagtaaactagagcacagatgggttaagtgacttgtccaagatcacacagcaagctagtagagacgggattcaaactaaacggta

SEQ ID NO: 5368 - DNA, 201 bp, Homo sapiens
caagccctcataaatgatattcatgccctgataaaagaggctccagagagatcaacggccccttccattaccaatgaagaacaaaacaaaatgatgacagycatctatgaaaaaggaagcaggccctcaccagacatgaatcttctggtgccttgaccctggacttaagcagcctacagaactataagaaatagatgtttg

SEQ ID NO: 5369 - DNA, 201 bp, Homo sapiens
tttcattatggtggagaagcagaaggaaaaatgtgctcagaggcagaggcaagatgaggaaactcagtgacaagaccccctttttttttttttttttttttgagacagagtctcttttcgttgcccaggcccaggctggagtacagtggcccaagctcggcttactgcaacctcctcctccctagttcaagagattcccct

SEQ ID NO: 5370 - DNA, 201 bp, Homo sapiens
attgggaagaaaaactccatgggtgcagggcattgccttttcacaggagtatccccagagccaagatcaatggctgacccatagtaggcacttaataaatatttgttgagtgaatgaatgagtagtaactcaaagtagtttttaaagtgctccaagtatacaaagctggaaggaattaattctgccttgcatgtgtgtgtc

SEQ ID NO: 5371 - DNA, 201 bp, Homo sapiens
tttctggttgctggcatatctagatcacatcttatcaccaccctgaggatgcagccaataaaaaaggatgaaatacatttttaaattgtttttttttttttcttaaagccatggctcctcagttaacctaagcaactttagggtcaccataccttaagactcttcactacataataaatgaaattcatttcattactgacg

SEQ ID NO: 5372 - DNA, 201 bp, Homo sapiens
aatatgttcttccttcttatgtttaccaagggtctctggctggtttacatccttttgtacagcaggctctctctcaggcctcttgcaaattttttttttttgcactggctcccgaatgttctgctcctaagactccgaatctgcactgctctggctacgtgagagagaggttcaaagtgggacacagcttcaccatcagtt

SEQ ID NO: 5373 - DNA, 201 bp, Homo sapiens
ccgtttcacgtcatctgtgctatttttctcatgtcccgcctgctgcacccactcccgtttcctttctgccttccttagtcatctaagtttgcaacacctgkcttatgaatgcacaaaatctggatgctcttgtgacatgcccaagaaaggctggtaaggggaggaagtgcagaccccactgagacatcaagaacccaagcg

SEQ ID NO: 5374 - DNA, 201 bp, Homo sapiens
accagaaaaaaaagcatacatgttaatgagtttttttttaaaaaaataggaaatccatccctttccagttcctcacccacaaaaatgggtgctgatcaatyggttgtgtaggtaaagggatgagaagagggtatcttgattcaattccttttcttccaacagcctcccatgctttcgcacagtcacaaagtcatgggagac

SEQ ID NO: 5375 - DNA, 201 bp, Homo sapiens
aacactatctcaaactcatccagatttctctgcccaccatgtacctcagacctgcacggctgcttcctcttctcacaaaaacaccaatgccatccctttgraaatacaatgtgctgttgacgtcccccctccctttggaggtattttgttttgttttgttgagatggggtctcactacagtcgcccaggctggagtgcagt

SEQ ID NO: 5376 - DNA, 201 bp, Homo sapiens
cctcccacctcagcctccgaagtagttgggacgacaggcacatgccaccatgctgtgctaattttttgtatttttagtagagacgaggtttcaccatcttgcccaggctgatgatctcaaactcctgggctcaagcaacccacctggctcagcctcccaaagtgctaggattacaggcgtgagccaccgtgctcagaccct

SEQ ID NO: 5377 - DNA, 201 bp, Homo sapiens
ggttggtcaggctggtcttgaactcctggcctcaagtgatccacccacctcggcttcccaaagtgctgggattacaggtgctaattatgattagatccctrtcagtagtcctggatattgtttccaaatgttaaagttatttaacgaggctgaaatgatcactgtggaatgcagggatgaatgtctcaactctaaaatggg

SEQ ID NO: 5378 - DNA, 201 bp, Homo sapiens
cccaggtaccagggttgtgtttctcccactgggcaggaggacgttcagaggtcaggtctgagaactgtgggatgttgcctgtgatgaggacagagacaccrtctgacacactggggtccatgccacctttctgcctccactccctatagaagatgttggagaggagcgatccctcttctccaatgtctgcgacagaccaaa

SEQ ID NO: 5379 - DNA, 201 bp, Homo sapiens
atgtcttgcatagcgtagttaaattgtttccaacttttttggaaacatttttactggggtcaattcttttgtgtttaaattttataaatatttgcttcatygatcaggatttggaccacaacaaattttactaatttataacttctgccattttgagttttcttttgtggttattatttccaccaagtcaagtccatttct

SEQ ID NO: 5380 - DNA, 201 bp, Homo sapiens
aatcgcacaggggactggggatcctgagagctgaaaactgaggcttctaaggaaattgggacttttccataaatgtatacacccagacttgtacatgaaartcaattaaaagaaaaacacaaactatcccactgtgtcttgaaatattaggctcttcggagttctagggacgttgtttaatttaaatctggcatatgtgcg

SEQ ID NO: 5381 - DNA, 201 bp, Homo sapiens
ctccttacagtttggagaacagaggattattttctaattttttttccatccaatatggaggcatgtctgaaggtcatccaagtgactaaaacatggcaagyatttgatgatggaggaggtagagatgcaacacttggagataaaatttccagaaaaatgcagcaattaaccaagatattttttctttttttgtgaaccaaa

SEQ ID NO: 5382 - DNA, 201 bp, Homo sapiens
accacttcagaacgttcctcattgatggtgagcgagccaactgccatgactgcccgttgatagaccacctggatgcaaggcaaaaaaaaaaaaaaaaaaargagagagagaacaacagtactttacttttcctgctaacattcctgaggactgcaggccctttgtctgagtaagagcctaggggatgaaaagataacttac

SEQ ID NO: 5383 - DNA, 201 bp, Homo sapiens
ttctgggaagcagcctctaatcccataaaactgggcaggtagcctctcctttccctacctcactagctagtgtgagacctgcacactcatctgtctgcccyagtggactcattgagggtgggactgtgttctgtttgcctttatggccctcgtacccagcccagggctgcttacataatagatgcacaaatacctatgaaa

SEQ ID NO: 5384 - DNA, 201 bp, Homo sapiens
gtgggactgtgttctgtttgcctttatggccctcgtacccagcccagggctgcttacataatagatgcacaaatacctatgaaatgaacaagttagccagragcggtggctcacatctgcaatctcagcactttgaaggcaaggcaggaggatcacttgaggccaggagtttgagaccagcccgggcaacatggcaaaact

SEQ ID NO: 5385 - DNA, 201 bp, Homo sapiens
cctagaggcccctgcattccttatcatggagccccctcgatcctcaaatgtagaagtcagactaagcattctcacactccaaatttctttctgcaactatyaggcttgtgtgaaactaattgcagttttcgctgttttttttaaatggcaaaacccacgattacttttgccccaacctaatagctgcacaaaactttctac

SEQ ID NO: 5386 - DNA, 201 bp, Homo sapiens
tcagtacaaaatatctttctgcattcttttctaacctgtattgtttccgacgagaagtcggctgacatcttttttcactctgacagctttcaactgtggtrtatctttttagctgatatatctttaaaactgattttgagaaatttgattatgctatgtcttcatatttctcattctcaggatttaagttttttgaactga

SEQ ID NO: 5387 - DNA, 201 bp, Homo sapiens
aacttattttcctgctgtctgccaagaaaaggaaataatggaggtaactcagcaacgatccagagagactcctggggaatttgcattctcctgttgaggaytgcccttgtgagccctggtaagccctgatgtgctttctgttactctcatagtgtatcaactgagcatttcaacatattttatttcaatttccaggggtga

SEQ ID NO: 5388 - DNA, 201 bp, Homo sapiens
tttatttcaatttccaggggtgagaggaaaagtaaaaacatcaaataagcctggtaagcctgaggattcagatggatagcattctcacgtgcacataagcwgaattggtcacactggaaaacaactactccaccaccacccacctccctcccccttcctctgtcatcatcatcctccatcatcatcacatccatcctcctc

SEQ ID NO: 5389 - DNA, 201 bp, Homo sapiens
gaagcataaatatctggataagcataaaagactcttcttttaattaaaaaaatacatatgcatgtgactatttaaagcacaaatccttacattgcctcttrgggtattaatgtacagatgcaatgcatataacactaaagcatacaggatggtgagggtggaagaagagagacaggccctctcacattgttttatacggtt

SEQ ID NO: 5390 - DNA, 201 bp, Homo sapiens
ttttaattaaaaaaatacatatgcatgtgactatttaaagcacaaatccttacattgcctcttggggtattaatgtacagatgcaatgcatataacactawagcatacaggatggtgagggtggaagaagagagacaggccctctcacattgttttatacggttttatactcagaaaaagaaagagaagcgaaactaaagg

SEQ ID NO: 5391 - DNA, 201 bp, Homo sapiens
cgatatgacactccttcagctacaaacacacacataccagtatgttctccttctctcacagacacactcacatgtggacacacactcatgcatgcatgcgygcacacacacacacaccgagtaacttgattctccatgagactctgccagaaactaaactattgacaaaagtttcctgatgtgcccaactctctaggtgtg

SEQ ID NO: 5392 - DNA, 201 bp, Homo sapiens
tgacactccttcagctacaaacacacacataccagtatgttctccttctctcacagacacactcacatgtggacacacactcatgcatgcatgcgcgcacrcacacacacaccgagtaacttgattctccatgagactctgccagaaactaaactattgacaaaagtttcctgatgtgcccaactctctaggtgtgcttct

SEQ ID NO: 5393 - DNA, 201 bp, Homo sapiens
gtaacacatgttctcactaataagtaggaactaaaattgggtgctcatggacataaagatgggaacaatagacattggggatcccaaaagggaggagggarggagggggtcaagggttgaaaaactacctatcaggtagtgcattcactacactacttgggcaacaggaacattagaggctcaaacttcagcattacataa

SEQ ID NO: 5394 - DNA, 201 bp, Homo sapiens
atcagcacacagctcaaacaagatggggtcagatctccacttcatacacactggatttccacacatgcatgggaaagaaaagaaggactattgccccacarattcactgcatctagtattgctaaggggctgcagcctcttgccaaccacagacccatctcagtggacaatgcaaagggtagcattaaatcatgagctttg

SEQ ID NO: 5395 - DNA, 201 bp, Homo sapiens
ttgtcctcagagccagaattcgaatccaaagacatgttcttaagaaccatggcattcacctctccctaggacacacaagggctcaaatcgagcccatgagscttctatcagctatctaccagttcatttggatttttggctcattgcagactaatgatgcacaagtggtctcattaatggtatgcatgtttgtttgtttgt

SEQ ID NO: 5396 - DNA, 201 bp, Homo sapiens
agaggaatgagtaaagaagaaaattgaaagaggtggcagagagatgggaggggctaagaagactggagattactaatggtgcagctgaatcataaaactaycatgcttataggaaactcgtggctctggggtttaacgaaaggttttatatttttaatttgccagatcagggaagcagcagggtctttttttttttttttt

SEQ ID NO: 5397 - DNA, 201 bp, Homo sapiens
taatggtgcagctgaatcataaaactatcatgcttataggaaactcgtggctctggggtttaacgaaaggttttatatttttaatttgccagatcagggamgcagcagggtctttttttttttttttttttttttgagatggggtcttgttttgtcatccaggctggagtgcagtggtgtaattacaactcacagcagcct

SEQ ID NO: 5398 - DNA, 201 bp, Homo sapiens
tagtacttactttttttttttctttttttttttttttttttttttttttgagatggattctcactctgtcacccaggctggagtgcagtggcgcaatctcrgctcattgcaaacgccattctcctgcctcatcctctggagtagctgggactacaggcacccgccacaacgcccggctaattttttttttttgtattttta

SEQ ID NO: 5399 - DNA, 201 bp, Homo sapiens
aaactgggttgaggccagattcaatattcacgacccattttcataagacaagccaattgatatttttttctctctgattgaattggaaaaagagttctctytagctcactaaagagatacaagacttttttgtgtgaaaagaaacaatttctttccattttgatccatgaactcacttcctctaaccctttcttaacctcc

SEQ ID NO: 5400 - DNA, 201 bp, Homo sapiens
tctggttacaatttattttacttttaaaaatgcagcaggaaaagtgtggggaaagagaggttttgctaaatttagcaaaatacttgacatttttatggaartgttttacaaatgcaagcaagataaaaatctagagaaactgggttgaggccagattcaatattcacgacccattttcataagacaagccaattgatattt

SEQ ID NO: 5401 - DNA, 201 bp, Homo sapiens
cttccgttttgcttgtgaatagccacatcttccaggaaccccaagtgccccctgccactcagcccctcccttgggaaccccctacctccccataaccagcyactaaaggattaacacctcacataacaggtgctccagaattctacaaagtgagtgtctattctgattcagctgtgataatgctgtagtggttaaatattt

SEQ ID NO: 5402 - DNA, 201 bp, Homo sapiens
atgaagcaacgcatgactatacatatgcatgtatattcagaaggagagaatagaaagaatgatggaaagaaagaatccaacagatagcggctgagattttytccagaattaaagaaaatcttgaatcctctaagaaagtccacagagggcaaagcacaataagaaaaaccatatatactataaaatcctgagcatgcaact

SEQ ID NO: 5403 - DNA, 201 bp, Homo sapiens
ttcatgcaattctccctgcctcagcctcctgagtagctgggattacaggggcctgccaccacatccagctgatttttgtatttttgtagagatggggtttmagcatgttggccaggctggtcttgaactcctgacctcaggtgatccacccgccttggcctcccaaagtgctaggattacaggtgtgaaccacctcgctca

SEQ ID NO: 5404 - DNA, 201 bp, Homo sapiens
gttgccttctctcttttggatcactcactctgaggaagttggctgccatgacatgagggacttcaagcagccccacggagaggttctcaaaatcaataaaygaggccccctgccagcagcctcggaaacaagccatccatgccagccagtcctccagcctcagtccagcctttagatcactgcacctctggccaatgtact

SEQ ID NO: 5405 - DNA, 201 bp, Homo sapiens
agggacttcaagcagccccacggagaggttctcaaaatcaataaatgaggccccctgccagcagcctcggaaacaagccatccatgccagccagtcctccmgcctcagtccagcctttagatcactgcacctctggccaatgtactgaccacagcctcacaagagaccctaggcaagaatcccccaactaagttgctcccg

SEQ ID NO: 5406 - DNA, 201 bp, Homo sapiens
actcaacactaaggatggtagaacagacggaagggaagaaggtggattcttgttgataccactgggccactgaatccatcagtccccaactttgatctacktcagagtttctggtcatgtgaaataataagtttatacatcgtataatctactttgagtcaaggttctcataattacttgcagctaaacataccccaactc

SEQ ID NO: 5407 - DNA, 201 bp, Homo sapiens
tcttgttgataccactgggccactgaatccatcagtccccaactttgatctacgtcagagtttctggtcatgtgaaataataagtttatacatcgtataakctactttgagtcaaggttctcataattacttgcagctaaacataccccaactcattcaaggagctacttgtaatgggctctctgcattttacatttggta

SEQ ID NO: 5408 - DNA, 201 bp, Homo sapiens
atctactttgagtcaaggttctcataattacttgcagctaaacataccccaactcattcaaggagctacttgtaatgggctctctgcattttacatttggyagtatcttagacactttttacagattctttctaatctctctagtatcctacaatttagatattatcacccctactttacagatgaggaaactgaggcttg

SEQ ID NO: 5409 - DNA, 201 bp, Homo sapiens
acactttttacagattctttctaatctctctagtatcctacaatttagatattatcacccctactttacagatgaggaaactgaggcttgatgccgttaartaacttttcctaggtcacatagctagtgagaggcaccgctaggattcagtacaggcctttgaactcaaagttgacattcgttccaacccaccaggctgat

SEQ ID NO: 5410 - DNA, 201 bp, Homo sapiens
ctcattttgttcaagtgcttacttgcctacaggaggctcaggattaaatctcttttgccctatgccagggtttctcaacctctgcactactgaccagatcrtgtttctttgctgggtgggctgtcctgtacattgtaagatattttacagcatccctggtccctacatgctgatattagtagcatctcccgacaaacacct

SEQ ID NO: 5411 - DNA, 201 bp, Homo sapiens
gcatgggtctcagagtctgatggaaagggcagtcgtaagtgagtagtaataaaacattgggaagaaaaactccatgggtgcagggcattgccttttcacargagtatccccagagccaagatcaatggctgacccatagtaggcacttaataaatatttgttgagtgaatgaatgagtagtaactcaaagtagtttttaaa

SEQ ID NO: 5412 - DNA, 201 bp, Homo sapiens
ctgaggcatatttttctgccatcaggtttaaaatgttaaataaataataattgaaatatgaaatagtggtgtctatacatgtacatttttgtcactccctwaacagcaggaattatacccaacatttaagttctttctcagggtttcactaagcatactccaggctagagacagctccaggctggatattgcaccaaatga

SEQ ID NO: 5413 - DNA, 201 bp, Homo sapiens
ttttgtcactccctaaacagcaggaattatacccaacatttaagttctttctcagggtttcactaagcatactccaggctagagacagctccaggctggayattgcaccaaatgaattcacacatacactccctcacccactagaagttcatatccctggacagctggtagcagtcattccagttaacagcatttctgaat

SEQ ID NO: 5414 - DNA, 201 bp, Homo sapiens
tcagggtttcactaagcatactccaggctagagacagctccaggctggatattgcaccaaatgaattcacacatacactccctcacccactagaagttcayatccctggacagctggtagcagtcattccagttaacagcatttctgaatgcagagaaaaccaggcaacaaatacttaatgagcatttcctaaatgcagtg

SEQ ID NO: 5415 - DNA, 201 bp, Homo sapiens
ttaataatataattgattcacccatacatatatccaagcaaccaaccattcatccctccacccatttaccctttcactcatccacctttccacccttgatscattcaaccctacatctttccactcatccattcaaataatcattcacccttctctttatacaacaactcctttaccaatccatcctcttccccttccagc

SEQ ID NO: 5416 - DNA, 201 bp, Homo sapiens
gtgtgtctcactttgattgatggggtgccatcaaaagcaaaattttctcccttgttgcttctgaaaaagactcccaaacccacagtgaagtcagtctgggrcagagagaggtggtgtgatattatatatgtcattataaactctaagtgcctcttttccgaactcttagaaggttagtagtggcaaaggcaacaaaaaagt

SEQ ID NO: 5417 - DNA, 201 bp, Homo sapiens
aacccacagtgaagtcagtctggggcagagagaggtggtgtgatattatatatgtcattataaactctaagtgcctcttttccgaactcttagaaggttartagtggcaaaggcaacaaaaaagtcacagtgatgaatagaacatgttggaaagtggctcagagagtaggaattaaagaatgccagctccagtaaatgtca

SEQ ID NO: 5418 - DNA, 201 bp, Homo sapiens
tcacagaatatacccatgaaacaacccagcacatgtatccactggatctaaaataaaagttgaaattataatttaaaaatgggttagaatcatagcaaatmactgtgcatgagccccgcctagccatttctagtacataacctggtatttggcttctagtagatgcttatgacagcaaccataagcctcccacccaaaaat

SEQ ID NO: 5419 - DNA, 201 bp, Homo sapiens
acttttatcagtagataaaatcctcctaaaaacagtgtccataggagtcaaaataataaaaaagaacactaggtggtgaaaatattggaaacttctagacrtacagtagccttcatttcttgcaccgccaaaagccgggctgataatggagcaaataccctcttcccaggctcccctgaggaagctgccactttattcatg

SEQ ID NO: 5420 - DNA, 201 bp, Homo sapiens
tttcttgcaccgccaaaagccgggctgataatggagcaaataccctcttcccaggctcccctgaggaagctgccactttattcatgaccccacagtcaccktctcctggaagcctttcctaattagagcccttctagaattctgggattttatgtctcagcagtatggtgagaacaataggattgttctgttctgctttat

SEQ ID NO: 5421 - DNA, 201 bp, Homo sapiens
ctgttcatgcctctacattgatgtttctcaagcttttatgatccaggtctccttgataaacatttttaacctcacattttcctctaatgctatttgaaatkgcaagagaaattaatatggtgactaaaacatatcaagagatgtcatagttcaatagaccctgctactaacaaccccaggtgcaaatctttgcttcacatg

SEQ ID NO: 5422 - DNA, 201 bp, Homo sapiens
atctagcatagttcttgacttgtagcgtgtgctcagtagtgttaataattatggaagagctcattggccaccaagtgaatgctaagctggaagaggattgratacattatttactccaaccccatctcaagccaagactataaccctctcaatttcatgggaggttgaccctctgtcatgacattggacaaacattgggag

SEQ ID NO: 5423 - DNA, 201 bp, Homo sapiens
cagcccatcatagcagcattattcacaatagccaaaggtgggaacaacccaaatgtccattgacagaagaacaggtaaacaaaatgtaaatacatacaatkaaatattagccagcgttcaaaaagaaaggacattcggatacatgctacaccagcacactccctagctcacgatattttaagtggatgaataaatgaatga

SEQ ID NO: 5424 - DNA, 201 bp, Homo sapiens
acaatagccaaaggtgggaacaacccaaatgtccattgacagaagaacaggtaaacaaaatgtaaatacatacaatgaaatattagccagcgttcaaaaasaaaggacattcggatacatgctacaccagcacactccctagctcacgatattttaagtggatgaataaatgaatgagcaaaaaaagagcaccctacctct

SEQ ID NO: 5425 - DNA, 201 bp, Homo sapiens
tcatgctgaacaattagatgtgctatttaggcaaaataaaaaatatattgcacattttctagacagcctgttagcatccatgccaatgacacgaacatcakgacatggggctgatattaaagtaaccagaaacacaaatgtgtattgcaacactcggaacattgccatctgtgtgttgcatgcccggagggacacccaggg

SEQ ID NO: 5426 - DNA, 201 bp, Homo sapiens
aatgacacgaacatcaggacatggggctgatattaaagtaaccagaaacacaaatgtgtattgcaacactcggaacattgccatctgtgtgttgcatgccyggagggacacccagggaggactgcgtgaagacagggtgagaaagagtccaggagaaaaacagcagctgagaggagtggggtgggcagggattggagtaga

SEQ ID NO: 5427 - DNA, 201 bp, Homo sapiens
ttactaattcactcagttctttaaccaacatgtattgagtgtctactctgagcctggagctgggtgctggatattcaacaacagataagaaaggcagagaycctgtactagtctgttcttgcattgctataaagaaatacctcagactgggtaatttataaagaaaagacgtttaattggctcacagttctgcaggcttta

SEQ ID NO: 5428 - DNA, 201 bp, Homo sapiens
tgaaaacacgacacacagaaaatatttgcaaattatatatctcataaaagtctagtatccagggtacatagagaacactcacaactcaacaatagaaaggygactccgtttttaaaaaaggcaaagggtctcaatagacatttcttacaagatggcatacaaacagccactaagcacataaaaatatgctcaatacaaaca

SEQ ID NO: 5429 - DNA, 201 bp, Homo sapiens
aaaatcacaatcagatagcacttcacactcaccaggatggctaaattcagaagaatggaaataacaaatgttgaccaggatgtggagaaataagaaacccygtacactgattgtgagaatgtaaaatggtacagctgctatggaaaacagtacgacagttcttcaaaaagctacacatagaactcctatatgatccagcaa

SEQ ID NO: 5430 - DNA, 201 bp, Homo sapiens
tatacacccataaaaaggaatgaagtactgataccttctacaacatggatgggcattgaagacattatgctaagtgaaggaaaccagacgcaaaaggccaygtattatacaattccatttacatgaaatttccagaataggcaaatccatagagacaaaaagtagatccatggtttctagggctggggacaaagggagaca

SEQ ID NO: 5431 - DNA, 201 bp, Homo sapiens
aaatggattctcccctgcagcctccagaaagaacacagcactgcaccttgattttagcccagtgagatgtgggtgaccagtaggattataaattgatgtgytttaagccactgtgtgtaatttgttatagcagcaaagggaaaaaatactaataggatgtgtaacaggcatctcaagtctatcatccatctcagccacatt

SEQ ID NO: 5432 - DNA, 201 bp, Homo sapiens
gctggggagctgatgtcaccactaccccctccgaagcccatccatggggcacagtgcactccactggcagatcccggaaagggagcacgctgactgactgrctgactgactgcctgccacatcaccgtctctgcattgcaattgcaaacattgttgtgcattctgaatccccagtgtctttctgtttttcaccagccatga

SEQ ID NO: 5433 - DNA, 201 bp, Homo sapiens
acagtgcactccactggcagatcccggaaagggagcacgctgactgactggctgactgactgcctgccacatcaccgtctctgcattgcaattgcaaacaytgttgtgcattctgaatccccagtgtctttctgtttttcaccagccatgatcatgacagtgacaacaataacaatacagccttatgctcatagctccatt

SEQ ID NO: 5434 - DNA, 201 bp, Homo sapiens
ataccacactcactgaggactcactaggtgtcaggcaccatcttagcacaaataagatacacaaggcctgtgcctttgggagcttaatttctagtagggamtggaggagaggggcatatggacaataacaaccaaaaaaaatggtaatgtcacagtatgataaaggctgtgaaagaaataaagtgcaagctagagaataat

SEQ ID NO: 5435 - DNA, 201 bp, Homo sapiens
ggtcaaatgtcgttaatataaatatctaccatggggcaatttccgaggctcttacatgcttcgtcctgaggttagcatgaggcaactgcactcactgctaygccttcccacacttattctaagggacagccagctaggatggagtgggagctgatgccctggattaaggtgcctggttaattccacttgcctggtttcctt

SEQ ID NO: 5436 - DNA, 201 bp, Homo sapiens
taaaaacaaatagaacttctctctgcctagaggtttcctttcatgaagataaagtttctagctggaactggctgtttttgcagggaagcacacatgagacragctttttggagtctctccaatacctgcctgtttcataaatggcacagtctccaaatctgatgctcactggaccagggtcaggctatggaactgattaaa

SEQ ID NO: 5437 - DNA, 201 bp, Homo sapiens
ctgactccagaaacaagatggcactctgtctccagtggttccactttacctagatttggagcctccaaaacattgtatggccacactccatctctgcctamgatggaattatgagagagctttggaaaatggctgttccaaaagtgatagtcttaacacaaagatcaggaagaatatttgatttggattaccacccacagc

SEQ ID NO: 5438 - DNA, 201 bp, Homo sapiens
gagatggcctgtttctgtttaacccttaggaaagaaagccaaatgatggttagcaagggagaggatataatgtggtaagtctgagctcctgtctggttatrgctaggaactcagttttcaaggtttctctgggatccccctggccaagaaggggttccatttaattagttggggtggtttaggattttatttttatttcta

SEQ ID NO: 5439 - DNA, 201 bp, Homo sapiens
ccctcctctctacaggactcctccctactggacaattggaatcctcgccaatgttgggctgggagccagcggaatgtaagtgggagtgacagtgccacttscaggagaatctttaagatccatctcttcatctacatccttctcttttccctcttccatgagattagcaatgacctagaaaggagccctccgtcagtctga

SEQ ID NO: 5440 - DNA, 201 bp, Homo sapiens
cttttttatttatttttgggcagggttggggaacagggtcttactctgcgacccaggctggagtgcagtagcatgatctcagctcattgcagcctccatckgggctcaagtgatcctcccacctcagctttccaagtagctgggactataggcatgcaccaccatgcccagctaattttttttttttttttttttttgaga

SEQ ID NO: 5441 - DNA, 201 bp, Homo sapiens
ggctcaagtgatcctcccacctcagctttccaagtagctgggactataggcatgcaccaccatgcccagctaattttttttttttttttttttttgagacwgggtttcaccacgttgcccaggctggtctcgaactcctgggctcaagcaatctgcccacctcggcctcccaaagtgctaggattacaggtgtgagccacc

SEQ ID NO: 5442 - DNA, 201 bp, Homo sapiens
gatcagcgtctgatcctggggccgcgggctgtctggggaacatgcagttctttagtgtctggatatcattagctaatttgtgtgtccaatttcaaagaaawgtttcctccctagaggagtttctactcaaaggactggctatttttggctcccacccactcggctgtgttgtgcgaagccagcatttcctagactatccca

SEQ ID NO: 5443 - DNA, 201 bp, Homo sapiens
agccaaaaaaaaaatagacccaggcaaaataattttgaaatagaaaaacaatggtgaaggacttacattaccctcatttcaaacatattacaaagctacaraaatcaagagagtgtggtattaagggaaagagacaaatcactggaacaaaactgaacgtttagaaataagctctgacactgtcaattgatttttgacaaa

SEQ ID NO: 5444 - DNA, 201 bp, Homo sapiens
aattaactcaaaatagatcttagacctaaatataacaactaaaactataaggctccttgaaaaaaaaattagagaaaaccatcatgtccttgggttaagcrgaaagctcttagacacaaaaccattcattattcttttactagacataaatgaaaaaataggcaaattcatctccattaaaatttaaaacttttgcactcc

SEQ ID NO: 5445 - DNA, 201 bp, Homo sapiens
ctagtcctttcaacaaagaatagaagagtttagtcaaatgaggagtctttgggattggaatggttctagcctcattctctaaataattctacccaaacaayatttaggaataatttttttagagtggcataaacaccataattacatgcacatacttttcatcttttctgttctagaaaaggagtcttcttacagtccaag

SEQ ID NO: 5446 - DNA, 201 bp, Homo sapiens
ctcctacatttgctgcgtagcattggcaccttcactcaagtgacagtattatagtcaggtggcatcgatcagctttaatcagccttatatttaagagctasagtctctgggtgttttagggaatacccgggcaacaaagtgaaaaaaaaaaacaaaaaaccttttgcagtagattgcatgattgcacaactggcccaattc

SEQ ID NO: 5447 - DNA, 201 bp, Homo sapiens
agttactctctgctcagcactaagccacgtgtacagaggagataccaataaggaaaatgactgggtccctggttataatgtcctaaatctgtaatggagtkaatcaacaagacacttgcaaacaaaatggtgagggctcaggaggctgtaatttttaaaaagtgctggactgaggaaaggtgagagttacaggctcagttc

SEQ ID NO: 5448 - DNA, 201 bp, Homo sapiens
tacaggcacccaccacaatgcctggctgatttttgtatttttagtagagacagggtttcaccacgttggccaggctggtctcaaactccttacctccagtkatctgcccgcctcaacctcccaaagtgctgggattataggcatgagccactgtgcctggcccagaaagcattttttaaaagaggaacccagacccttgga

SEQ ID NO: 5449 - DNA, 201 bp, Homo sapiens
cgggtcagaagagatctgcacctgctctgttaaggtagtcttgccatctctaagggtttgatttgctggcttgtttactggagtcagaaacagaataaagktaactcacttcaaaggctagattcaaatgctacttcctagaagataccttcaggaccctccttcactcccaaatagaaggaactctgctttttcaacatg

SEQ ID NO: 5450 - DNA, 201 bp, Homo sapiens
cttggatccgatctgccttcaaaaaagaatgtgtcattcagccactgggggtgcaggttactgacatcctctggcttcagagccctcaggattcacttccrcttttgagctgaggtcacattctgccagagcagtcctcagccagtgacagggcatgagggggacatggggcctggcaacttctgcccaacatggggctcc

SEQ ID NO: 5451 - DNA, 201 bp, Homo sapiens
cgatctgccttcaaaaaagaatgtgtcattcagccactgggggtgcaggttactgacatcctctggcttcagagccctcaggattcacttccacttttgarctgaggtcacattctgccagagcagtcctcagccagtgacagggcatgagggggacatggggcctggcaacttctgcccaacatggggctcctttcatgg

SEQ ID NO: 5452 - DNA, 201 bp, Homo sapiens
gcttcagagccctcaggattcacttccacttttgagctgaggtcacattctgccagagcagtcctcagccagtgacagggcatgagggggacatggggccyggcaacttctgcccaacatggggctcctttcatgggcaacctcttctccaaagctttctgttaggttggcagagactgtctggtctgcatggtggtctga

SEQ ID NO: 5453 - DNA, 201 bp, Homo sapiens
tgtttgttccctccaaactcatgttgaaatgtcacctccagtgttggaggtagggcctggcgggaggccattagatcatgggggcagatccctcatgaacrgcctagcaccataaccctggtaatgagtgagctctcgctcttagttcacatgagatttggttgtttaaaagagtgtggcactgatcccctttctctcttg

SEQ ID NO: 5454 - DNA, 201 bp, Homo sapiens
ggcagatccctcatgaacagcctagcaccataaccctggtaatgagtgagctctcgctcttagttcacatgagatttggttgtttaaaagagtgtggcacygatcccctttctctcttgctctgtctttcaccatgcgatatgctacccccctttcaccttccaccatgattggaagcctcctgaggcctcaccagaagcc

SEQ ID NO: 5455 - DNA, 201 bp, Homo sapiens
cccactcgcaactatgaggaatagatactatcagcagcaacagcaactttttttttaaggacaaagaaagtaaatatgggaaaatgtaaacttgtccaaaracatacatctagtcatgagaaagctgaaacccaaaacagctaagccgatgtatcacagcctctgaatcaccatcactgaaagaaacaacacacttgggga

SEQ ID NO: 5456 - DNA, 201 bp, Homo sapiens
gggcagtgatcaatcatttcagccatcttaaatgagaccagaatagatacaagaagaatctcagccacatataactctaaccatcaagggtattactaacycccaaaatatttcatcttcttgaagttttatggctatggctcttgagtgttttgggggtacagggagatatgggtttaggcagctgaagcaatacctatc

SEQ ID NO: 5457 - DNA, 201 bp, Homo sapiens
tctctccactctcagaaatgcaaacatttatccttttgttgatgttattcaggaaccacttccagcagcctgtacctcccttagtcatgttccttttaacragctcagtttatcaatgtccttcttaaaatacagaactcacacatgagcataaccgaagatacaatatttgtgaagggactgtgaaaacgagagtaggca

SEQ ID NO: 5458 - DNA, 201 bp, Homo sapiens
ctctcagaaatgcaaacatttatccttttgttgatgttattcaggaaccacttccagcagcctgtacctcccttagtcatgttccttttaacaagctcagkttatcaatgtccttcttaaaatacagaactcacacatgagcataaccgaagatacaatatttgtgaagggactgtgaaaacgagagtaggcagaggcaaa

SEQ ID NO: 5459 - DNA, 201 bp, Homo sapiens
cattctgtcatctgttcattcatctgttattgaacctttcaaggtaaaagattagaggattctggccagcagagaaaagagaaaagtggatggatatgaayactatgtagaaggtgtagtcacagggtgaggggtgtgagggaaatggtggcagcaagaagttgagcctgggcatctgggaggatggtggtgccatgccct

SEQ ID NO: 5460 - DNA, 201 bp, Homo sapiens
tattgaacctttcaaggtaaaagattagaggattctggccagcagagaaaagagaaaagtggatggatatgaacactatgtagaaggtgtagtcacagggygaggggtgtgagggaaatggtggcagcaagaagttgagcctgggcatctgggaggatggtggtgccatgccctggaggaggaccagtttgaagaaggaat

SEQ ID NO: 5461 - DNA, 201 bp, Homo sapiens
gattctggccagcagagaaaagagaaaagtggatggatatgaacactatgtagaaggtgtagtcacagggtgaggggtgtgagggaaatggtggcagcaasaagttgagcctgggcatctgggaggatggtggtgccatgccctggaggaggaccagtttgaagaaggaatatcataggagtccaataaatactactagaa

SEQ ID NO: 5462 - DNA, 201 bp, Homo sapiens
gaattcgagaccaacctgggcaatatattgagaccctgtctctatttaaaattgttttaatttaaaaaaatttacaataaataaataaaaataagaaaaamctcccaaatcccaccactctagtacaaccaaagtggccacaccatcacacgtgaggttgttcacagcatccttctctggggatgattctaagtcccttga

SEQ ID NO: 5463 - DNA, 201 bp, Homo sapiens
atagatactgctgtgctagcatacttggaaaccaccatatatgttcttggaaattcaccaagcacattaccatgttaggcagacttattactattctgcartatctgcaagtaacatagaagcaaaaaaagcacataacacataaaataattacacatagacctgaggtagaaaacaaataatcagaggagaaggcaagag

SEQ ID NO: 5464 - DNA, 201 bp, Homo sapiens
gtctgaagtaattaggttaagaaaagttagtttaacacatacatccctgaatagcagaaactgaatccaccacagatgtacttcttactcgtctgaagtcraatgtggatgtttgtattcagagggcggccctctgacaagtgacgattcaggggctcagctcctttcatcttttggttctgccaccttcaacatatggct

SEQ ID NO: 5465 - DNA, 201 bp, Homo sapiens
gcttacagttcccaggcccacagcgtcagcagcagcggcagcagcggcaggcggccgcgcgggtgtttgtcgcttcgcggggccttgcggcagcatggcgraccatctgatcagtggcggcaccggctacgtgccccaggactggctcaccgtgcagcagctcttcctcggcgccaactgccgcacccacaacaacttcct

SEQ ID NO: 5466 - DNA, 201 bp, Homo sapiens
aggtagacctaacttcagccctgacccggaagatcatgctgaagacaccactgatctcttcccctatggacactgagacagaggccgacatggccatcgcratggctctgatgggaggtattggtttcattcaccacaactgcaccccagagttccaggccaacgaggtgcataaggtcaagaagtttgaacagggcttca

SEQ ID NO: 5467 - DNA, 201 bp, Homo sapiens
ccgtggtgctgagcccctcacacactgtgggtgatgtgctggaggccaagatccggcatggcttctcttgcatcctcatcactgagatgggcaccatgggsagcaagttggtgggcatcatctcctcccgagacatcaactttcttgctgagaaggaccacaccaccctcctcagtgaggtgatgacgccaaggatcaagc

SEQ ID NO: 5468 - DNA, 201 bp, Homo sapiens
catcaactttcttgctgagaaggaccacaccaccctcctcagtgaggtgatgacgccaaggatcaagctgatggtggctccagcaggcatgacattgaaasaggcaaatgagatccttcagcctagcaagggaagctgcctatggtcaatgatcgccatgagctagtggccatcgtctcccacaccaacctgaagaagaat

SEQ ID NO: 5469 - DNA, 201 bp, Homo sapiens
gcctagcaagggaagctgcctatggtcaatgatcgccatgagctagtggccatcgtctcccacaccaacctgaagaagaatcgagactacattctggcctycaaggattcccacaagcagctgctgtgcagggcagctgtgggcacccatgaggatgacaaatactgcctggacctgctcacctgggtaggcatcaacgtc

SEQ ID NO: 5470 - DNA, 201 bp, Homo sapiens
cccacaccaacctgaagaagaatcgagactacattctggcctccaaggattcccacaagcagctgctgtgcagggcagctgtgggcacccatgaggatgamaaatactgcctggacctgctcacctgggtaggcatcaacgtcatagtcttggactcctcccaagggaactcggtgtatcaaatcaccatggtgcattaca

SEQ ID NO: 5471 - DNA, 201 bp, Homo sapiens
cacagcagtgccctggggctgaccgcaggccatcacttcctgggtgatgcagatagagctgcagcccataactacatgcagtccatccacaccagtgtcartcaggttcttagcctgggctgctgtcaccacattcctcccaatcacctggaggtggaggtacttctgtttgatgtaatgcaccatggtgatttgatacac

SEQ ID NO: 5472 - DNA, 201 bp, Homo sapiens
tacctccacctccaggtgattgggaggaatgtggtgacagcagcccaggctaagaacctgattgacactggtgtggatggactgcatgtagttatgggctrcagctctatctgcatcacccaggaagtgatggcctgcggtcagccccagggcactgctgtgtacaaggtggccaagtacgctcagcactttggtgtgtcc

SEQ ID NO: 5473 - DNA, 201 bp, Homo sapiens
aagtatcgtttctggctgctgctgctcttctccatggcatctagcgagcccatgccccagtacttcttgagctgcaccctgtctgagaagaagtactcgcygctgggcctccgtggtggtggccagcagggagcccatcatcactgtggaggctccaagggccagggccttgaccacgtgccccacggtctggatgccaca

SEQ ID NO: 5474 - DNA, 201 bp, Homo sapiens
ccactgctatcctcagtacagctgcttctggtaagcgtgcaggccatggacgccaccctcgatctgggctgacatggtccacttctcaaatttgagctctyctgagtacatcatggagccatgctggttactcgctatgaggtagggcacaaacttctgaatggaccctttgtcctggatggaggccgagacaccctgcac

SEQ ID NO: 5475 - DNA, 201 bp, Homo sapiens
ggaagcttaagcaaaatgaagcaaaggggaattacttcagttaagttttactttagagcagatgctaaagcaagaaactggggggacatggtttagttggraggtgatcacaggaagtgtggtgaggaagtagaaaaataagacaggaaaggaaaagaagccagcagcagggaaattcatgggaaggttacttctggggat

SEQ ID NO: 5476 - DNA, 201 bp, Homo sapiens
agaagccagcagcagggaaattcatgggaaggttacttctggggataacagggatttaaccccacaagggccctccaataacagtgtaggacacacctcaktactgtctccctgagcagcaaagaagccagggtatgccaacttctatccctcatcattaaagacagttctggggggcatttatttatcccctgccacttc

SEQ ID NO: 5477 - DNA, 201 bp, Homo sapiens
gagcagcaaagaagccagggtatgccaacttctatccctcatcattaaagacagttctggggggcatttatttatcccctgccacttcaggtctgccataygcaggagccaaacacaatcgtatggccagagaacattcttaggcagagagatgcctgtgcttgaggtgagaagccatcactgtgttgggaactgtccatc

SEQ ID NO: 5478 - DNA, 201 bp, Homo sapiens
actcaagtttgaggtaaagtctcatttcacctcactgggtcttcctggaccagataaccatccccgaactgttcacagggaccaggagcatataatgaccrcattgttccagcactgaaccatatgctccatctctgcaccaggaggaatctctacaaaaagctcaggggctacagctggggagagggcttaacagagatt

SEQ ID NO: 5479 - DNA, 201 bp, Homo sapiens
aactgttcacagggaccaggagcatataatgaccacattgttccagcactgaaccatatgctccatctctgcaccaggaggaatctctacaaaaagctcasgggctacagctggggagagggcttaacagagattgattacatacaattaccagaagaatggaaatgagtgttaagataaaaaatacacaggttcattcca

SEQ ID NO: 5480 - DNA, 201 bp, Homo sapiens
ggttctcatttagactcctgtcacttatatctctggctaataaagggaactatggtcacccccaccccaccccacgcagcaattgtagtttttcccgcccsgatacttgcgacatcaatgtactgctgtgggtacagctctacaagcacctgttttgcaattttcaggttaacaagtaaaatcttccttgagtgtatacct

SEQ ID NO: 5481 - DNA, 201 bp, Homo sapiens
catgcccaatcctctggtaggtaattaggatatagaaattgggcacaatctatgtcttccagtcctggtatggcggagaagaaaagattcaagtagcagayagactgctgtatctaaaaacttgggttcttttcccagctccatcttaaactgtgcagaaagagaattctgctaaactctccccactgctgaataaagtgt

SEQ ID NO: 5482 - DNA, 201 bp, Homo sapiens
atattgatttattctacttgatcggaaatcatcagtagtccaattgtcctttctaatggaagatcagcataaacaaagtcacattcaggccaggactcttragaaaggggcgtgttttctcctcacttatttttctgctgattggaaagaaaagacagtgagatttaggggactggaagagccacaatatggcagaaatct

SEQ ID NO: 5483 - DNA, 201 bp, Homo sapiens
ctttctccgttctcctatttaacctactgggctttaaagccagtggccctttttcttagcttcctcattcatgaaacagttttctggggaggccctagaaytttacctctgtattaaaatgatctctattttcttttcattaagggaaaaatatacaaggggggtggatgcagggggcaaggagtgggtaagcagaccaga

SEQ ID NO: 5484 - DNA, 201 bp, Homo sapiens
tcattatgctgcttctttcattgcacaggaacgtgggggttttctctaaactatgactcatagcaaagcatacaggcaatcgtgtagagaaacctgttctycccaggaaaggagggtgagcaaatgctaaaagttttgatactttaatatagcactggccgtggctaattttacttaatatgaaagatttcaaataatgga

SEQ ID NO: 5485 - DNA, 201 bp, Homo sapiens
acttaatatgaaagatttcaaataatggaaacactgacaggcaaaaacattaaaagtttgcataaaatctcaaaaaaccctgcaaacaagagagaagcatkgtctaattaaaataaaggaaaagattgctactgggttcctgaatactcttttcacaaaggcttcacgtcagatgaacttcaagcaccaagcagcagggat

SEQ ID NO: 5486 - DNA, 201 bp, Homo sapiens
ctgagattctacattcaggctcccagaggatgtcaaagctgctggtgcatggaccacactttgaatgatgagatctgtttagctggttggtaggtacctgrtggctgagctttcaaactctgtaatcagactacctgggtttgcatccagcctccactgtttaccctttcttactgtgtgcctcagcttccacatttgcag

SEQ ID NO: 5487 - DNA, 201 bp, Homo sapiens
tcaaaatccacttgccttgggagaaacgcttgaacctgggaggtagagattgcagtgagcagagatcgtgccactgcactccagcctggcaacagagattmagtcttgaaaaaaaaaaaaatccacctgccttggtacaagatgggaaagtctttgggtgtttattggctgtatgttcaagatgaatcacctgtgagctgt

SEQ ID NO: 5488 - DNA, 201 bp, Homo sapiens
tagcatcatggtatatttatatataagaataattgcctgtttatctgtctccccagcctttttatagcatgaactatgtccttcaccactgtatccctagsaactagcacagagcctggcacctagctcacaatcaataaatatttgtggaattgatggatgaattcaggcactggaagcaagaaaagggccagcaccacc

SEQ ID NO: 5489 - DNA, 201 bp, Homo sapiens
gtcacaccagagagtctaacagtgtgatttagagtgggggcttagaatcacatagcatgagctcaacctccagaggacctggaagccaaggtcacccatayaagaactcaacagcagaccccaaaaaagactctgcacgccaaggctcagtgagcttcccttgttggcaacgtcccatgcttattttcatccgttgttgct

SEQ ID NO: 5490 - DNA, 201 bp, Homo sapiens
cagaggacctggaagccaaggtcacccatataagaactcaacagcagaccccaaaaaagactctgcacgccaaggctcagtgagcttcccttgttggcaamgtcccatgcttattttcatccgttgttgctgagaaggtggcactgtccatgattccgtaggaagatcaccactggcagctcacggttggacctttcatga

SEQ ID NO: 5491 - DNA, 201 bp, Homo sapiens
aggacctggaagccaaggtcacccatataagaactcaacagcagaccccaaaaaagactctgcacgccaaggctcagtgagcttcccttgttggcaacgtyccatgcttattttcatccgttgttgctgagaaggtggcactgtccatgattccgtaggaagatcaccactggcagctcacggttggacctttcatgattc

SEQ ID NO: 5492 - DNA, 201 bp, Homo sapiens
agactctgcacgccaaggctcagtgagcttcccttgttggcaacgtcccatgcttattttcatccgttgttgctgagaaggtggcactgtccatgattccrtaggaagatcaccactggcagctcacggttggacctttcatgattctgcctatgtgtccctcttttggctgattttagtctgtatccttcagctataaca

SEQ ID NO: 5493 - DNA, 201 bp, Homo sapiens
gctgctccccctctctccaacagatgactgggcaaaaatagaagagaatccctcctttataaatatctttacatgctaaatgtctctataaagcaccatgmgccaagctaggctgctaagaaacagatgcaaaacagatgcaaagatccatgagatagctgagaagttaaagaattttaattcaacaaaaggcaagaaaag

SEQ ID NO: 5494 - DNA, 201 bp, Homo sapiens
ttccagaaagataaaggaccaagggaaaagagagcaggatttggtctgagatataagcaggagattatggtgctccttctaggccacagcaagcaattgaytttaattctaggtaaaatggaaagctggaggaagattttaataaagatgcatgtgattcaagatatgggttttgtcatcgttcttactcactcgaccagc

SEQ ID NO: 5495 - DNA, 201 bp, Homo sapiens
tgatcataggatgtcaaagctggaagaagataccagtttagaagatgctgctgtcactgaatgcagatttcataaggagttgcagtgaaggtagaagcatktttcatggatctgtgttaagggcagagctagaagcccttgctgatggtttctacatagcaggtaagagggagagagaaatcaaaggtgacttgtaggttt

SEQ ID NO: 5496 - DNA, 201 bp, Homo sapiens
tgcccctgacgctagcacagtgcccgcccggcagggagcagacatcccctcccaccccccaatgtccccactgatgtctgttgatcaactagatgatagasagtgagtggaaaagaaaggcagaggggggacccactcttgttccttggtgccagggtttaaagaggtttggctgcatctagcgtgttttctcagatgctc

SEQ ID NO: 5497 - DNA, 201 bp, Homo sapiens
gcagcaaattcactgcgtgtttactttagctctttcccacatcagactgaaaccaggtctgcttctattttgtgcccctgacgctagcacagtgcccgccyggcagggagcagacatcccctcccaccccccaatgtccccactgatgtctgttgatcaactagatgatagacagtgagtggaaaagaaaggcagaggggg

SEQ ID NO: 5498 - DNA, 201 bp, Homo sapiens
ggaagccccctggccccctcatcccccaaacagcagcaaattcactgcgtgtttactttagctctttcccacatcagactgaaaccaggtctgcttctatyttgtgcccctgacgctagcacagtgcccgcccggcagggagcagacatcccctcccaccccccaatgtccccactgatgtctgttgatcaactagatgat

SEQ ID NO: 5499 - DNA, 201 bp, Homo sapiens
aatgagactccttctcaaaaaaaaaacaaaaaacaaaacaaaacaaaaaaaacaaaaacccaccctagatattgccaaatgtcccctggcctagataattscaactagtccttcaaaaatcagggcagtgtcacctcctccaggaagccccctggccccctcatcccccaaacagcagcaaattcactgcgtgtttacttt

SEQ ID NO: 5500 - DNA, 201 bp, Homo sapiens
tcttaaccccagcactgcgaacatttggggctggataactctgcattggagggggctgtcctgcacacactgtaggttatttacaagcatccctgtcctcyacctactagatgccagtagcaactccaccttatccccagtttggacaacagaaaaacctagatattgccggccaggcgcggtggctcacgcctgtaatcc

SEQ ID NO: 5501 - DNA, 201 bp, Homo sapiens
accacagcacttttcctcctcttgtctagacctgtgtttcttaaccccagcactgcgaacatttggggctggataactctgcattggagggggctgtcctscacacactgtaggttatttacaagcatccctgtcctccacctactagatgccagtagcaactccaccttatccccagtttggacaacagaaaaacctaga

SEQ ID NO: 5502 - DNA, 201 bp, Homo sapiens
ctatcactttggagatcaagatttcaacatatgaattctagggggacgctaacattcaaaccacagcacttttcctcctcttgtctagacctgtgtttctyaaccccagcactgcgaacatttggggctggataactctgcattggagggggctgtcctgcacacactgtaggttatttacaagcatccctgtcctccacc

SEQ ID NO: 5503 - DNA, 201 bp, Homo sapiens
tctagagatttttgccttgcctggcttgccctaatcccattcatgacttaatcacctcccaaaggctccaccccacctcagcctatcactttggagatcargatttcaacatatgaattctagggggacgctaacattcaaaccacagcacttttcctcctcttgtctagacctgtgtttcttaaccccagcactgcgaac

SEQ ID NO: 5504 - DNA, 201 bp, Homo sapiens
ttcatctccatctgacagcttctctactcctatttcttttattattggtttttattttttagagacagggtcttgcactgtcacccaggctggtgtgcagyggagtgatcagagttcactgcagcctctacctcctggactcaggtgatcctcccacctcagcctcctgagtatctgagacaggcgcatgccaccacaccc

SEQ ID NO: 5505 - DNA, 201 bp, Homo sapiens
gaaacatggtgatcacttctccgcttgcatgcactaacagcccgcatttgaagcctctccccgccgtgtgcagccctgccaccctccaccgcacccgacaygcattatccagagtgatcattctaaaaagtatattggactaagttacttaaaacctgcttaaaacactttaatgtttccccttccctaagataaagtcta

SEQ ID NO: 5506 - DNA, 201 bp, Homo sapiens
aaacgaccctgttgtataactgcattccattgcactgcattaactaaaccaattctaagttcttttgtggaaacatggtgatcacttctccgcttgcatgyactaacagcccgcatttgaagcctctccccgccgtgtgcagccctgccaccctccaccgcacccgacacgcattatccagagtgatcattctaaaaagta

SEQ ID NO: 5507 - DNA, 201 bp, Homo sapiens
acaacgcccggctaattttttttttttgtatttttagtagagatggcgtttcactgtgttagccaggatggtctccatctcctgacctcgtgatccgcccrcctcggcctcccaaaatgctgggactacaggcgtgagccaccgtgcctggccagtattattttttttaagattgtatgcatcttcataccatctctcctc

SEQ ID NO: 5508 - DNA, 201 bp, Homo sapiens
gctgggactacaggcacccgccacaacgcccggctaattttttttttttgtatttttagtagagatggcgtttcactgtgttagccaggatggtctccatstcctgacctcgtgatccgcccacctcggcctcccaaaatgctgggactacaggcgtgagccaccgtgcctggccagtattattttttttaagattgtatg

SEQ ID NO: 5509 - DNA, 201 bp, Homo sapiens
agtgcagtggtatgatcttggctcactgcaaactctgcctcctgggttcaagcaattctcatacctcagccttcccagtagctaggactacaggtgcttgycaccatgcctggctaatttttgtatttttagcagagacggggtttcaccatgttggccaggctggtctcgaactcctgacctcaagtgatccgcctgcct

SEQ ID NO: 5510 - DNA, 201 bp, Homo sapiens
aactggctcagggccgggcatggtggctcatgcctgtaatcctagcacttcgggaggctgaggaaggctgatcacttgagaccagaagtgcgagaccatcytggccaatatggtgaaaccctatctctactaaaaatccaaaaaattagccggaatgttagcacatgcctatagtccctgctactcgggaggctgaggcag

SEQ ID NO: 5511 - DNA, 201 bp, Homo sapiens
tcctatcaaccgggccaaacaaccagcaaggaacacctgctgaaaggtgaagaggacagagccttggcagagattaatgccttcctgatgccaggcggccrtgagaactgagattggcagtgtgaaggtccaccttctctgcaaccaaatcataagtgtcccatagacaaaggctttgtgtttatctgccttcagactggt

SEQ ID NO: 5512 - DNA, 201 bp, Homo sapiens
gactcccagctgcaactcctaacataagtctctgctcatgtgaaagagttcagtgtcctcacccaatggagagtttccttatcattgtccttaaccaatgragagtttcttgtgtccatatatccagtgtccttacccagtggagagtttctcgaacccatgactacaccatgcttttaagcacaccaggctcctaggata

SEQ ID NO: 5513 - DNA, 201 bp, Homo sapiens
tctgcctgactcccagctgcaactcctaacataagtctctgctcatgtgaaagagttcagtgtcctcacccaatggagagtttccttatcattgtccttamccaatggagagtttcttgtgtccatatatccagtgtccttacccagtggagagtttctcgaacccatgactacaccatgcttttaagcacaccaggctcc

SEQ ID NO: 5514 - DNA, 201 bp, Homo sapiens
agacatttaccatgtgttccaagtgctttatataaattaactttcagcccttgcaacccaccttcaaaggtaaatactatcattatccccatttcacagaygaggaactgaggcaccaaggaaaatgaaaactttccagtaggcacacccctagaaagtggtggattcagggttgaacgaacacagtttaatgccggtctc

SEQ ID NO: 5515 - DNA, 201 bp, Homo sapiens
tgatctaaatgccacctctgctgagtttcttttagcgccttttgcattatgaaaagtcagtatctcattgaatcttctcatcaaaacagccagacatttascatgtgttccaagtgctttatataaattaactttcagcccttgcaacccaccttcaaaggtaaatactatcattatccccatttcacagacgaggaactg

SEQ ID NO: 5516 - DNA, 201 bp, Homo sapiens
tccacgtggccaccagaggatgcttctggaaggtaaatctcatgttcaccaccatccaccctggctttaaaatctttagtggtttctttctgctcttatarcaaagatgcaacacccaaatgtggcctgagggtctcagcacggttctgctctgacctccttcactcttaccctccaagcaccagggtcttctcaggcaat

SEQ ID NO: 5517 - DNA, 201 bp, Homo sapiens
ctttgtcgtggtcagtgctgcgttcctggcacccagcagagagcccgtagacagtggtgcacaataattacccatggaatggtgaatgtttcttagcaacygtaacttactgcctgcactcctctcccctgcagccagttctccacgtggccaccagaggatgcttctggaaggtaaatctcatgttcaccaccatccacc

SEQ ID NO: 5518 - DNA, 201 bp, Homo sapiens
aatgtcagcacaagaggtttttcctgcctaaatggcagccaatatgctctagtctctcgccctgcttttaagtatttcttcccagccacactgcttcctgmcacattcattcacttgcttgtccatttgccgtctctgtccttatacagaaacgtcatctctctaaggcaggggctttgtcgtggtcagtgctgcgttcct

SEQ ID NO: 5519 - DNA, 201 bp, Homo sapiens
tgttgccctgggggtgaagatgctacctgaaaacccacatatcctggaaaggtctcacacaaggatcaggcgttttcagacagaaaggttttcttgttgaygttttctactgcattctctcttaagctcaagactttttattttgtgttttttacattgatgagttataaaggggcctctctcatctttcccttcttttta

SEQ ID NO: 5520 - DNA, 201 bp, Homo sapiens
actcaggaggctgagacaggagaattgcttgaacccgggaggcagaggttgcagtgagctgagattgcgctactgcactctagcctgggccacagagtgasactctgtctccaaaaaaataaataaataaataaaagtatatatatacaaaaagaaactcaatggaggctgcagcatcttcaaagtttatcactgattgtg

SEQ ID NO: 5521 - DNA, 201 bp, Homo sapiens
atgccccaacatttattttggggatacggcatatgtctcacctagtctgggactaaaaagtttcctgccttattcatgcaggggcttcttcatggtttgcrtaaggcagccaattaaagtagaaactcagacctggcacaatgctcacgcctgtaatcccagcactttgggaggccgaagggggtgtagatcacctgaggt

SEQ ID NO: 5522 - DNA, 201 bp, Homo sapiens
aagtggaccctcccgtggagatggctctatttcaaatcaaaaccccatcgcaccaccacccaagggcttccttttgcctttccctaatccactttttgccyagtgcttattatcagctgacacattaaatatttgttatgtttctgttggcctctcctcacacaaagaagacaggtttgttgactgctgtatctccagcat

SEQ ID NO: 5523 - DNA, 201 bp, Homo sapiens
aaaaagtagcttcctcatggtattattgtgaaaaataaaataaaatgcttggtgcactgtccagcatgtacagggaatctattgctattatttattattgktactaacagcattagatgcatttcctttctctgcatcttgaaggtagtctatgcaaagtacccagcatagcctgtaggatatctccaggccattagagag

SEQ ID NO: 5524 - DNA, 201 bp, Homo sapiens
ttggacacatgactgcttggagattgagagccaaattcaaatcccaacttaggttctcactaattggatgagttggggcaagtcacgtcaccttcctaagsctcagtttgctcctctgtataacaagagtaataaaaagtagcttcctcatggtattattgtgaaaaataaaataaaatgcttggtgcactgtccagcatg

SEQ ID NO: 5525 - DNA, 201 bp, Homo sapiens
agaatctctgtatgctcactacagaaaaaaataaaaaaatatctagagcatgaggacacagaaaggacttccagaatcccccacccagtggcaaccacttkgacacatgactgcttggagattgagagccaaattcaaatcccaacttaggttctcactaattggatgagttggggcaagtcacgtcaccttcctaaggct

SEQ ID NO: 5526 - DNA, 201 bp, Homo sapiens
gctaggggatgcaaaatctcatgggtagagatgcagccttgcttcagagaaatcttactgcaaaccctggaggccagactttagacaggattgcaatgacmttatgtatccgaggcagtggaagtttcctctaaagaaaaaatgggaggcaagtggcttgaggaagtcaggcacagcgagcttcgtagccagggtcctgga

SEQ ID NO: 5527 - DNA, 201 bp, Homo sapiens
tgaaggaattaaaacaccaaaaagagccttggtatttcctctcatcttggttcaataacctcttgtgagaaaaaagttttcagtgcgtgtcgctataaatragcatgattggcttgccagttgaacctacaaacagaaataatgtgagaggtcacaagtccactcatttgcactggacttccaaagagttttgtcatgcag

SEQ ID NO: 5528 - DNA, 201 bp, Homo sapiens
tgatgaaagaaatagatgtgaaggaattaaaacaccaaaaagagccttggtatttcctctcatcttggttcaataacctcttgtgagaaaaaagttttcastgcgtgtcgctataaatgagcatgattggcttgccagttgaacctacaaacagaaataatgtgagaggtcacaagtccactcatttgcactggacttcca

SEQ ID NO: 5529 - DNA, 201 bp, Homo sapiens
caacaaacaaaaagagggccacagctgcccccagtgttcagctgcattcccaagctagagaacgagacacttccaaatctgaaataactcatccaactgargcagggctctataaacaacagacaagtaaaatacattgaataaatattacataatctattttctttagtggttgtgtctgtatatatgtgggtacattca

SEQ ID NO: 5530 - DNA, 201 bp, Homo sapiens
taaccacctggtattgagatggtagattccgactgagtccactcaggctgatcttagaccgagttggcaacaaacaaaaagagggccacagctgcccccartgttcagctgcattcccaagctagagaacgagacacttccaaatctgaaataactcatccaactgaagcagggctctataaacaacagacaagtaaaata

SEQ ID NO: 5531 - DNA, 201 bp, Homo sapiens
gtgggtgggagagggaagaccacagctgggtcccctaagcagcctgtaccttcccagctctaaggcagccatgagacctaggtagtgaatgaatggactgstcaatgacggctctattcaacacatatttattgaacatctatgttgtgtcagactctgccctcctggaatccctcctggatggccctgtgaggggaatct

SEQ ID NO: 5532 - DNA, 201 bp, Homo sapiens
atggtgccacctatgatgctgtaaggacaagataaaagtaagtacatataaagcaccaagcatagtgcttggcccatgttaagagctcaataaaaagcatkattttactataattatgatcatcattattatcattgctactcccctgccaggtttagcaggggtcctacctgtaccagctccaacataaagagccacagg

SEQ ID NO: 5533 - DNA, 201 bp, Homo sapiens
ctggattcaagagagtcatactagctatacgatacaaggttaattgttctgattctcagctgcaaaatgaggataaataatcatggtgccacctatgatgytgtaaggacaagataaaagtaagtacatataaagcaccaagcatagtgcttggcccatgttaagagctcaataaaaagcattattttactataattatga

SEQ ID NO: 5534 - DNA, 201 bp, Homo sapiens
ggtggtaatcatttcacagtctacacactcatcaaaacatcacattgtacaccttgaatacaaaccactttatttgtcagttaaacctcaataaagctggraggaaaaaaacagtataccaaagaaatgaaaagatgggccaggtgcagtggctcacgcctgtaatcccagcactttgggaggctgagatgggtggatgac

SEQ ID NO: 5535 - DNA, 201 bp, Homo sapiens
gtgaagcgattagatcttaattatactcacaccacatacacagacacccaaaatggtaaccaacagtcgtgaaagatgtgttaattaattcgatggtggtratcatttcacagtctacacactcatcaaaacatcacattgtacaccttgaatacaaaccactttatttgtcagttaaacctcaataaagctgggaggaaa

SEQ ID NO: 5536 - DNA, 201 bp, Homo sapiens
attattaagttgtaaaaattagaattagattatgcatggaaagcatctatcaccgtctggcatacagcagaggcacaataaatggaagatattgtcacaakgatagcaaggaggaaatgtttaatctgtaaggatttcaaagagggaagctaaaattgtatttctaagcagaaatttgtggacccattttaatgaaaagat

SEQ ID NO: 5537 - DNA, 201 bp, Homo sapiens
tttgatacatgaaagctactgtttatcattgttttataattatcactattattaagttgtaaaaattagaattagattatgcatggaaagcatctatcacmgtctggcatacagcagaggcacaataaatggaagatattgtcacaaggatagcaaggaggaaatgtttaatctgtaaggatttcaaagagggaagctaaa

SEQ ID NO: 5538 - DNA, 201 bp, Homo sapiens
aaaaaatattttttttggaaaacgtgtttttaacaatgatcatccatttcccaataagtccaaggaagtgttgatctccaaaaaaaaaaaaaactgaatcycaacgtaagtttgtgaccttgagcaaattgcaggatctgtctgtgcctcagttgccccattaataaaaagagggaagtcacctcactgctaacacttcat

SEQ ID NO: 5539 - DNA, 201 bp, Homo sapiens
gggcatgcctgcactgccagtcaccccccacacaccgtgcaccccagctccgctttcaccatgaagatgagcaggaaagaaaactcatctcccaacccgasgttgctctgattctctaggtcccagaatctctgagttgcagacaccttggaaatcctcattgtcataagcaagaatgccccagagttacagctccacctt

SEQ ID NO: 5540 - DNA, 201 bp, Homo sapiens
ccacctattgctgatgctgcacgagggaaactctatccagggaggtgattgtcctggtgccacggcactcacagctgggcatgcctgcactgccagtcacyccccacacaccgtgcaccccagctccgctttcaccatgaagatgagcaggaaagaaaactcatctcccaacccgacgttgctctgattctctaggtccca

SEQ ID NO: 5541 - DNA, 201 bp, Homo sapiens
tctcagtaaggtaagaggaggctggtgttttccagaaacagaagagaagaaggtggggtttctgtgctagcaccagaagacacaaactggaggcagcaatmccactgcagttgatgtgacagaagcccctggagaagagttcaccaaaacgtgaaaggggagtccagcagctgcgtgctaagggggtgtggctctcagctc

SEQ ID NO: 5542 - DNA, 201 bp, Homo sapiens
agactgtatgtgaaaaaggaccctaagatgaaacagtggtgggtgttataagaattctgatctcagtaaggtaagaggaggctggtgttttccagaaacakaagagaagaaggtggggtttctgtgctagcaccagaagacacaaactggaggcagcaatcccactgcagttgatgtgacagaagcccctggagaagagtt

SEQ ID NO: 5543 - DNA, 201 bp, Homo sapiens
acgtggctttccaattttctacgatgagagtagttacttttacatttagaagaatcaaatgatatgacttttttaaagagatgagttattaaaaggagacrtgatcagaagacatttagcttcgtttaggaggcaaagcagatgcacgtgggccatttcaaatagaaaaccataagactgtatgtgaaaaaggaccctaag

SEQ ID NO: 5544 - DNA, 201 bp, Homo sapiens
tctattctctaaaatattgcactgaaatggtatttaccttgataacttaattgtttggcacccttttaaattttgcatccaaggagggattcttaatctcytcttccttgtcctggccctgatacgtggctttccaattttctacgatgagagtagttacttttacatttagaagaatcaaatgatatgacttttttaaag

SEQ ID NO: 5545 - DNA, 201 bp, Homo sapiens
tcattacacattaagataatcattacacgattaatagataatcattacacgttgttaagtgctacaatggcagcatgatagggcacttgatgagtcttggkggggcggcagtcagagaagactacctgggggctggggatcatgaaagaaggcaggaggggaaatcatttctgcacaggttacagtagactgagtgcatgt

SEQ ID NO: 5546 - DNA, 201 bp, Homo sapiens
tggaaaatggccccaggccactgctgcttaatgggccatgatggatgaacacagatctagagaaatgattgtttaccaactaagggatcagagcctatggscctctttctgtcctctgaagagcatgctgctactggggcaaatgagtttgagtccagagccgacaatgagcaggtgatcaagccccaagtgaaatggcct

SEQ ID NO: 5547 - DNA, 201 bp, Homo sapiens
cactccagcctgggtgacaagagtgaaactccatctcaaaaaaaaaaaaaaaaaaaaaagtggtaggcatggcctgagcacgggaaacccagggtaatgtragaggcgcagagaagaggccccctaattcagcctgcaatggtgcagtggagtgggggacagtcaggaaagacactttggatacctgagcgttgtttggtt

SEQ ID NO: 5548 - DNA, 201 bp, Homo sapiens
ctactaacaccttgattttagctccatgagacccatttcagctttctgacctgcagaactgtaggataataaatttgtattattttaagccagtaagtttrcggtaatttatttcagcaataggcaactaatacaccatgtatcaactgcaaacaattgttgcagttctagaaagctggcccaatttaccagttcttgggt

SEQ ID NO: 5549 - DNA, 201 bp, Homo sapiens
caccttttatacctgatctccagcccctcaaagggttgtattaatgcatttaaccctcatatgctaaatttcatttctaattataggataaccacaggaaraatggttatccagaccagccctttaactcaagaatcacaaatgcaacatctagcatggagaagcaggtaaagaaaataatgtaaaccttgttcaatcgat

SEQ ID NO: 5550 - DNA, 201 bp, Homo sapiens
agaacagagcacagattcaatgttgaattgaactgattatgtgacatcctgcaaacaataaaagcatcacttttaaagaacttaaagttccttctcacacmttttatacctgatctccagcccctcaaagggttgtattaatgcatttaaccctcatatgctaaatttcatttctaattataggataaccacaggaagaat

SEQ ID NO: 5551 - DNA, 201 bp, Homo sapiens
ggagaccatagcatagataagaggtcctcaaaactaatggatcatgagcagctgtgaggtgtgatgcactaattagttaggatcccagtccaatcagtgawacttggaaatgattttggctttttttgtaagctacagcacattcaaggtcatttctataataacatcattcttactcatttacaatctgaaatgttttct

SEQ ID NO: 5552 - DNA, 201 bp, Homo sapiens
atgctaattaattatttttttttaatctaagttacccagtgttggtttcatctacctgctgccctactgcagaatcagaaagtgggaatctgctttgtggygggatgacgttcaccaagcatcgttcagggctggttcaccatgatgcctgtccaaacccctgagcacctagtgtctgtaccacacatgtaagtacttaat

SEQ ID NO: 5553 - DNA, 201 bp, Homo sapiens
cattctccaaacatttccaacacaggaggaaaaacacaaggtcagggccgattcactgactgctgtgtgctgaagtaactgcctgtcagatcctccttcayggatccctagagaggctctccttattcattgcagatgcacgctttttgcagagcacccttgaaacatgctaattaattatttttttttaatctaagttac

SEQ ID NO: 5554 - DNA, 201 bp, Homo sapiens
atatctagcttttactttgtacactaatacaagaagaatcctcacctaggtgagtttccacagccttatttttcttagtcctccagagttttcaagagaaycttattccacagacaggaaaaataactaatgggtactaggcttaatacctgggtgctgaaataatctgtactacaaacccttgggatatcagtttacctg

SEQ ID NO: 5555 - DNA, 201 bp, Homo sapiens
ataagtgcccttttatttgtgattcggctcaattcccaaggacggcacaacccctagactcagaccaggaaaggcagtggtaacaaacagggagacctggrcaggatgggggttgcaatagagtctgtgcctgagctcacctgggcacccaccccacatgttcctcaagggtcttgcttgcagggagctcagtgatataag

SEQ ID NO: 5556 - DNA, 201 bp, Homo sapiens
tcaatttgctggtaagtgaccactttgatccataaagaaggtgattttgaaaggcttagccaaatacatactcagacaaaatgatgtacaagaaacagcarttcctccaggaaggaagcttagaagaaaaaatacttgctagacacatacagatgctgatttaatttttgtaatcccatgtgggtattgcctattcaaaac

SEQ ID NO: 5557 - DNA, 201 bp, Homo sapiens
ggagatttagcagtaaacaaaacaagccctggctccatttagcttacactctgatggagagagacaggcaatacactaatacagatgaaaatacgttataygtcaagtgctgataaagtcccgtatttatgctggaatttgggtgaatcatgtcaatttgctggtaagtgaccactttgatccataaagaaggtgattttg

SEQ ID NO: 5558 - DNA, 201 bp, Homo sapiens
tatttacccagtaatggggttgctggatcatacagaagttctacttttagtatgaggaaactccataccgtttttcataatggctgttctaaattcccacsagcaatgtatactagttctctttctccacatccttgccagtatttactttttgtatttttgataatatcttttctgagctgagattatatctcactgtgg

SEQ ID NO: 5559 - DNA, 201 bp, Homo sapiens
agcagcagaatgtgtggcctcttggtttgccaagcctaaaatattgactatctgggcttttaaataaaacacttgccaattgctgctttacaatactttcyggtagcttatcaaaataatcttgggatcttttaaatatgcagcaccttaagcccagaatctgaattttaactagtttcccaaggttcgagaatccttgca

SEQ ID NO: 5560 - DNA, 201 bp, Homo sapiens
gccctttcctgtattgtctgtggctgcctttgtgctatagcagcagaatgtgtggcctcttggtttgccaagcctaaaatattgactatctgggcttttamataaaacacttgccaattgctgctttacaatactttctggtagcttatcaaaataatcttgggatcttttaaatatgcagcaccttaagcccagaatctg

SEQ ID NO: 5561 - DNA, 201 bp, Homo sapiens
ttaggtgtaaatcctgggaatactcaggtctcagggaactactccaaatgatgtacaaacctagagtttccatttaggcaaaagtttctaataaagtaagrcttcttcactaaatactatcagttgcatactcacacgctggcagaacaaagactgcagggtgtttcagcatctccataccaacagctagaacagattcct

SEQ ID NO: 5562 - DNA, 201 bp, Homo sapiens
gcaaatataaaccaagttaggtgtaaatcctgggaatactcaggtctcagggaactactccaaatgatgtacaaacctagagtttccatttaggcaaaagkttctaataaagtaaggcttcttcactaaatactatcagttgcatactcacacgctggcagaacaaagactgcagggtgtttcagcatctccataccaaca

SEQ ID NO: 5563 - DNA, 201 bp, Homo sapiens
catcttcacatctttctctgtccacatcctggaaaagctcttcacttttgaggattcacaggattaagttggtcccaccttgctaatccaggatcatccgmatctcaaggtactaaaccctgaatctcacaactgcaaagtcccctttacactataagcaacatattcacagcatggacatcttagggaagccattattct

SEQ ID NO: 5564 - DNA, 201 bp, Homo sapiens
aggctgcccacattcctcggcttatgactccttccttcatcttcaagccagcaccactgcatctctctgactcttccatcttcacatctttctctgtccayatcctggaaaagctcttcacttttgaggattcacaggattaagttggtcccaccttgctaatccaggatcatccgcatctcaaggtactaaaccctgaat

SEQ ID NO: 5565 - DNA, 201 bp, Homo sapiens
atttaatgggatcagccatggtgcgttcattttctattgctgctatgacaaattaccatcaacttggcgggggcttaaataatcctcacttattgtcttayacttctgtggttctgaaatgtgaaatgggtctcgctggactaaaatcaaggtgtcagcaggattgctttcctttccggaggccgtaggggagaatccact

SEQ ID NO: 5566 - DNA, 201 bp, Homo sapiens
tcaataattcatccattcaacagatatttactatatagctactctgtgccaggtactattctaggcactggagtatagcaatgatggacaaactccctgcytcatggggcttgcattttagagctatgtgccagacatagtgccatgtcctggtggaggagaggaagtgcttgtggtgcaggaatgaaagaactcacagtc

SEQ ID NO: 5567 - DNA, 201 bp, Homo sapiens
atactatatgtaagctatgcctccataaagtaccactgaaacataaacaaaaggcttttagataattactacaggtttattaaccttcagcctctgtatayttattgagaatctgctattcaataattcatccattcaacagatatttactatatagctactctgtgccaggtactattctaggcactggagtatagcaat

SEQ ID NO: 5568 - DNA, 201 bp, Homo sapiens
agcgagtttgttattgttgttgtcatttacgtgcaatttaatggatgtaaaatactcagcactatagtgcttggtatatagcaagcattcaatatatgtaygactttagcacccaaaagactattagaaaagtacagtacttattcacgtactcgtttacttaatggctctttattaagcctcaaccatgtaccaagaact

SEQ ID NO: 5569 - DNA, 201 bp, Homo sapiens
gagttatacacttgagctaataacatttaccattcaagcgagtttgttattgttgttgtcatttacgtgcaatttaatggatgtaaaatactcagcactayagtgcttggtatatagcaagcattcaatatatgtatgactttagcacccaaaagactattagaaaagtacagtacttattcacgtactcgtttacttaat

SEQ ID NO: 5570 - DNA, 201 bp, Homo sapiens
gagccaccgcacccagctgtaattttcttagtctcaatttcctgagttatacacttgagctaataacatttaccattcaagcgagtttgttattgttgttktcatttacgtgcaatttaatggatgtaaaatactcagcactatagtgcttggtatatagcaagcattcaatatatgtatgactttagcacccaaaagact

SEQ ID NO: 5571 - DNA, 201 bp, Homo sapiens
ggttttgccaatgtcgtccaggctagtctcaaactcctggactaaagtgatcctcctgcctcagtctcccaaagtgctgggattacaggcatgagccaccrcacccagctgtaattttcttagtctcaatttcctgagttatacacttgagctaataacatttaccattcaagcgagtttgttattgttgttgtcatttac

SEQ ID NO: 5572 - DNA, 201 bp, Homo sapiens
gtcgccgttctgacttagtacacaggctttccactgtgctaaagcaaggagcccaaagaactagagggcttgccaatggttttcttgtggttttattcgtstactaattaaaaacattggccaggcatggcggctcacgcctgtaatcctaacactttgggaggctgaggtgggtatatcacctgaggtcaggagttcgag

SEQ ID NO: 5573 - DNA, 201 bp, Homo sapiens
cagccctcttgaaaacatctccaatctcctaagagataaaaagcctcactcattttcccacccctgacccaccaaccagcttccatccctaaacctagagsgaaattatgatgttctgtctcctcctcctatttctattcctcatgccctgcatgtctccccataggagctcataataggcttgtaggttccacctgattc

SEQ ID NO: 5574 - DNA, 201 bp, Homo sapiens
acaaatgttcagcttatgccccaaatttttacaaccatctcccttttaagtcactgaacaactgctaggagcctctgagccatgctaccccagaatacccyagaatactcattcctattcaaatatttggttttcagtgttacaaggacaagtattcatttggaccagagaaataggctggatttgcactcatctgtcaca

SEQ ID NO: 5575 - DNA, 201 bp, Homo sapiens
tggggctctgttcccacggattttatctggcacagtatgtctgaggtgtgacccagaaatccgtatttttaagtagattctgaagcaaatagtctgcaaaytggtactaggacagaccccatgggatggaagcactttgccaaagtgaactatcaggaattacagagagctggggaaagaatgcttgctgtgtattaggtt

SEQ ID NO: 5576 - DNA, 201 bp, Homo sapiens
actactcctcatgcccatcaatgaccacacagacacatgcacacacacacacaggttcaaccccacttccatatctttagcaatggtctcctggggctctrttcccacggattttatctggcacagtatgtctgaggtgtgacccagaaatccgtatttttaagtagattctgaagcaaatagtctgcaaattggtactag

SEQ ID NO: 5577 - DNA, 201 bp, Homo sapiens
tgaaagaggattgccaagtgaatggtgatgtcacttacaaaagtggagaacaggttagggaccctgctttcttcctcacaattgtagctccagcacctagycttgtacctgacatacagtagccactctgtaaatgttttttgaatgaatgagtgagcaagggtggaagtgagtataggtagggggacagagaaatgcata

SEQ ID NO: 5578 - DNA, 201 bp, Homo sapiens
gtttttatcttcgggaaggaccacttgagcttgagtatgaggaagggcttggaggagggaatgaatgaaggcagaaaagcaggcccagagaaatctcactraagcaactccagaaaagagagaaagatctgaactaggattgctgcaatacagatacacaaaagagaggttcaagagatgtttaggaggtacattcaactg

SEQ ID NO: 5579 - DNA, 201 bp, Homo sapiens
ttgctcttcaccactgacaacgtgcacctccctccttatcggtgcttaacctgtgagctccctttcctttacctggtcattctcccatatattcagatacsatctgaagatcaacccttccccagcacagtgcttcctccatcaccagcttcttcctctggaagcaatgcatccacagcagaagaatgcaccctgaactaa

SEQ ID NO: 5580 - DNA, 201 bp, Homo sapiens
tggatggatggacagatgaacagatggacggatgggtggatgtgacatgagttgtgggtataagagattgaagaaataaacgaacatccagtgagaaaggsagtggctgagttagtagcacagtgatgggttagagagggcagggtataagtgagagctggatgaacagggggtgtgaaatgagggggctcagaggtagaa

SEQ ID NO: 5581 - DNA, 201 bp, Homo sapiens
agtcacatggcatgcccaatatcatgctgcaagcatctctcagagtgatggttctgacccaggggtcctggtgccaggtgacctctgtccatcccagggargactaggcaatgacataagacagtgtctgatgtctaacattctcaccaccgtgtgtttccttcaggtatatcacaggtatgtcatgcctgtcagtcccca

SEQ ID NO: 5582 - DNA, 201 bp, Homo sapiens
gcacataccgagagctccattaatgagagctgtgattatggtggctgttgtaatcaagaaagaatcaaccacaatgacagcaacaaaacccaaaacactamaacccacaaacacagcactaatgcaaatacaaacagctcccctgtggcttttttccacgtcttctaaatgacacaactttgcagcaccatggcaaaggag

SEQ ID NO: 5583 - DNA, 201 bp, Homo sapiens
agagcataatagcaacttacattccatttacccattcataaaggttacaaagcccatccacacccattatctctttgatcctaactactcaagagataacrcaagtggcataacactcatggatggcatttctcctaaagacacaggatgagaggttaaatgacttccctgagatctacatggccccatggtgatggcagc

SEQ ID NO: 5584 - DNA, 201 bp, Homo sapiens
tctgctctagactctgtgtttcagtaccatcataactgaggactcattcaatcaggtctagagcattcaatcctgttccagaatgttccagagcttgctgrgtccccagggtgacacctgactccatgggtaccaaagcctggtgtttcctagagcataatagcaacttacattccatttacccattcataaaggttacaa

SEQ ID NO: 5585 - DNA, 201 bp, Homo sapiens
gtctgctctagactctgtgtttcagtaccatcataactgaggactcattcaatcaggtctagagcattcaatcctgttccagaatgttccagagcttgctsggtccccagggtgacacctgactccatgggtaccaaagcctggtgtttcctagagcataatagcaacttacattccatttacccattcataaaggttaca

SEQ ID NO: 5586 - DNA, 201 bp, Homo sapiens
ggactgtggctaacctagccagccccgtggctttgaaaaagtgcttaatctttctgggcctgagtttctttacctataagataggaataatgacccttccrtcacatgggtctgctgtgagaatgggatgaaaaggtagaagtgggagactcatctgtccacgcctgactttgacagtttgggtgcttgtctccacatcct

SEQ ID NO: 5587 - DNA, 201 bp, Homo sapiens
ctctgagctagacatgaccagggtacccatgaaaaggtctgtgcacagagcaaagctgtaagcacacgcatcttatctggttctctacatgtagagaggarggcatggctgcactgtgaacttcctcaggagaaagataattggagggacagcagttaattggcccagagccagctcggcacaggccatctgtgaaagagt

SEQ ID NO: 5588 - DNA, 201 bp, Homo sapiens
ctggaaggatgtctgtaattattgcttgcttatcatctattcttctcattttcctctagttcgtcctgccccttcctcctttgagtctatatggttctaayagaacaaactctatctgacccccaccccagctcatgaccggaaaatcaagccacggaaataaaacagcatcagcaaagacagttttctaacgatatattt

SEQ ID NO: 5589 - DNA, 201 bp, Homo sapiens
acacacacacacacacacacacacacacacacacacactcctccagccccagttcagagataacctctgaactgtagcagattcaaagtcctaaagccttycagaaatatttcagagtgacatagtaccctgctggtaataaaccaacatggtttgttgactgtatttcccttttattattattatttttttgagatggaa

SEQ ID NO: 5590 - DNA, 201 bp, Homo sapiens
gtttcattaaacaccaagcagtggatggcgacttaccacgcttgatgcattgcttctctggggctgaaataccatttacaaaattactgtgtttaaaggcrtaactttgggaaattgcgcaacagcatttcacagcagcagaattttttaaaaaaagcatagaatccagggtggtcactggaaagggatctaaatgtcttg

SEQ ID NO: 5591 - DNA, 201 bp, Homo sapiens
tgccactgcctcccagggggccctggccactcctgaactggacagattcttgtgatggaaccggacacaacagccgggattccaccagccaaacaggtcawggtttaccttcacaattttgggagttaacagtgacatggtctgtgcttggtgaaggaacagatgtttaataactgtgcagtagcaaggaggttatataac

SEQ ID NO: 5592 - DNA, 201 bp, Homo sapiens
cctgatagttatttgtaaaatgccttctccatgcctggcaccatgctaaatgtatatactttaagatgttacaagaagaagagatgtctatcttacacacrcaccctctttaggaaaactcctgggttcacagttgttaataacttatacttggtaaatatgtggtaaattcatagtcaagtctgtcatactacctagacc

SEQ ID NO: 5593 - DNA, 201 bp, Homo sapiens
aaaacacataaatggtcatgccaggtgtcatcaatgaaggccaaataacttcccttcaatactaattcataactctcctgggataagactttttttgcccmctcatttgtgctatagatctacttgagctcttctacttgatttccagtgcagtaacttctccatgtcctacttccctaactaaaatgggaaccacacaga

SEQ ID NO: 5594 - DNA, 201 bp, Homo sapiens
gttcctctggattctctcacctcgtatctcttgctgatttactttgagactcagctgtttttcccacttctgagttcagagtcccaatcagatgtacagcraaggcccacaggacagcttggcctctgaggtgcctgatttcactgcgagaagtgtttgttgagcatatggtgatctcccagataaatatttgcaaagagt

SEQ ID NO: 5595 - DNA, 201 bp, Homo sapiens
tccatgtgggaagagcacctggaatttacagcgtaactctttctctccaacattctcctttcccttggaggattatttaccaattaatgttaaagttcctyatggtttaaacccaggccctcctgagtcatcattctcccctgcaagaccttgcccagtcgtagggctttgactgccatcaataagctcaaatcctgtgta

SEQ ID NO: 5596 - DNA, 201 bp, Homo sapiens
taaccaaatgaagcagatcctcaggaagctgactgtggggatttggacaatggtacaccagacaccagcagatctgccagttcatttacccaactttgagrcccatgtagaaatgtggctggcctcccatgcccacgcagaacacagctagcaccatcacgctggaccgtgactcctccatccctaagattcatgccagga

SEQ ID NO: 5597 - DNA, 201 bp, Homo sapiens
cctgcagctttaagtaagaatgtttgaccagtaatgctgtaagcatataggataagagagacctatgttgtacacacttccagttgtgctaactcaggtaygaagatctctggaggtgagctatcaaaactccctgttattgctcattctaatatctgccaatcttaataatcatcaagttcttgttttggaaataaatac

SEQ ID NO: 5598 - DNA, 201 bp, Homo sapiens
gttaaatgacacattggaaattttcaagacaatttcttaagcaagtaatacgggttccatccggctccatcatttgccattcacttgacaaatgtcataaygccactgcacaccccaccagagcaaatattttcttccaaccttaaaataacatctacaaattaattcagtctgtcaaggggaactctccttgggtaattc

SEQ ID NO: 5599 - DNA, 201 bp, Homo sapiens
atggcaatatttaatgccaaaaatcttcatgatctgaaatctacttagtgtcttattaatacagccagtccagttttttaaaattagtattagtgtgtacrtatttttccatatttcaactttcaacctatttatgcttttatatttaaagtgggtttcttatgggcaccttagagttggttcttgctttgtgatgtttat

SEQ ID NO: 5600 - DNA, 201 bp, Homo sapiens
acactcaagacagcttctcacgcattcctctatctcctcccctggggccaaggtccagataagcacatataagttaagtgagcaagtctaaaagcagatgygcttatcctttcaatcactctacttttcatcactctcccttttacactctgctccaccatccaaccccactggttctgaaggtttcctattgaaccaccc

SEQ ID NO: 5601 - DNA, 201 bp, Homo sapiens
gatcaactgtgtttaataaaccaataaataaatcaaatccaaggaagtctatgaaagggtttcagagggtctgtgatcccctgaaattgcacataattttractgcatgtttatgaacacgcactcctctggaagggtccgtagccttcattagattttaaagtggtccccaactccccccaaaatcaccccaaattatct

SEQ ID NO: 5602 - DNA, 201 bp, Homo sapiens
ccaattttctctgcatgtctttatcacccaactaacagaccagaaaggaagatttctcagctcatttccggttacctggtattcttagaagatcccaccayttgccagaagtgagaaacaaaaaggtttcacacaatcatgttgtctaacaggaattctttttgcaactgatcagccttcctcaaagacgttccctatagg

SEQ ID NO: 5603 - DNA, 201 bp, Homo sapiens
aagcccaggaggtagaggcctgcagtgagccactccagggagtgcagcggcatgaacatggctcgctgtggccttgacctatgggctcaagcaattatctkgcctcagtccccacaagtagctgggactacaggtggctcctcactgcagcctctcgtctcttaaaaaagggtgtgtgggggaatcaaagtggtgaatcta

SEQ ID NO: 5604 - DNA, 201 bp, Homo sapiens
acagagaggaatgctaactgtaacttgaatgatttgagttctcattgcttttctcccatcttttctttctctttcatcaatgttatacaattagttttttmataaagctcctactagcaagctactcctccccacactcagaaaacctcctacctaaaatctgataaaaatctttgttttcactactttaaactcttggcc

SEQ ID NO: 5605 - DNA, 201 bp, Homo sapiens
agagattttcctagttttctttttacagactaagtgactcattaaagttctcaaatgtattaaccagaaaaaaaagcatacatgttaatgagttttttttwaaaaaaataggaaatccatccctttccagttcctcacccacaaaaatgggtgctgatcaatcggttgtgtaggtaaagggatgagaagagggtatcttga

SEQ ID NO: 5606 - DNA, 201 bp, Homo sapiens
tccaccaacactatctcaaactcatccagatttctctgcccaccatgtacctcagacctgcacggctgcttcctcttctcacaaaaacaccaatgccatcyctttggaaatacaatgtgctgttgacgtcccccctccctttggaggtattttgttttgttttgttgagatggggtctcactacagtcgcccaggctggag

SEQ ID NO: 5607 - DNA, 201 bp, Homo sapiens
tagttctgcaccatcgtgaggaaagctgtaagttcagtagaaggagcaaggtgtcaaggtcactcttttcctaatgctgacaacattaaaagacagagtawtagagtttcaggagtcaaccgtcagagagatgcagaatctaaaagggaacaggcaaggataattgaggcagtgttgtgtgtgtgtgtctccaacttgctt

SEQ ID NO: 5608 - DNA, 201 bp, Homo sapiens
catcctggattttttttttttttttgtatagaatttgtcacagtggaacgtaattgtcactgggaggtgagtttattcagggcagggatcttgttttattstccttgtacccccagtctgtggcacaggtcttggtacatgtggttcatgacattgcaccaactgtggataacacaaggctcctgtctccttgattagttt

SEQ ID NO: 5609 - DNA, 201 bp, Homo sapiens
acaaaacaaaggcccaataaatctgacaaataagaaaaaaaaatgagctagagaaaaataagacccaagtaaccctgggttcagaaataatattctggagsctgtgacctctgttctcacgatctcagagggtcactgaactatttgccgaagtgaaaaaatacttttgatggtggtggtgataggaaatagtacaagatt

SEQ ID NO: 5610 - DNA, 201 bp, Homo sapiens
caaacatcaaacaatacacatggtcataattttccattactggatgaagttggagagatacaattctttgaagtaagacggcagaaaccttgtaggaatcyaggaaaccttattatataccaagcacttctggaatctgcttaaccaatctgcctcacacaaataaagacggtcaagctgacatggcttaaaaggcacatg

SEQ ID NO: 5611 - DNA, 201 bp, Homo sapiens
acacacacacaaacacataaataaattaaggaggacgcttttgagtgtttaaattcttaggactgcagcagcaagtttagcaaagaacacagtaggagctygatccagtttggcaaagggtctggctaagtcaaaactgtgcaattatcattcctggttgttggggttttagaattctctattcatgctaatgacattgca

SEQ ID NO: 5612 - DNA, 201 bp, Homo sapiens
tagagacatttcccaaacccaagtctgaccaggaaggcaatgagccagaacagaaaatatcgatgagaacctagatgttctgtaagtacatgaacaaaccyctggcccatctggatgcttttactgtttattttttatttggtgcaaagaagaccttttctgtttagcaccacaaaagttgtttctgtgttactaacttga

SEQ ID NO: 5613 - DNA, 201 bp, Homo sapiens
aatgatcaatgacgcattttcacccaacaagcacccactaagtgcctactgtgcacaagacatggaactgggccttggggacacaggatgaaaaaggcacscagcaaaggcaatagttgaatttatcacagtaattatggaattgcagaccagcttgtaattgggaacgtctgttggttcctattacagcccttgtgtggg

SEQ ID NO: 5614 - DNA, 201 bp, Homo sapiens
gaggcttacttataagataataacaacaaacatctcttaatgcacagttcctggcacacagaaaggtctccatacgtggaactattatcattaattcaacrtttgttaaacttatcttcaggaaaatgagcctctgtagcagaagaactaattgacaaatggagatctgagtttcttcaatggcattcccttgacttttga

SEQ ID NO: 5615 - DNA, 201 bp, Homo sapiens
ctgccctgaggattgacgtccccgagatgttaacctctgtgtgtcaatgaagcagggaaactggacagttggttcacttttctaaatgcaggagcaagatragggaaattattgatttctatcaaaacagacaagaagcaaatagaagagaagaccatgggcagggaagggtttgaatacaaatggaaaccaccaggcata

SEQ ID NO: 5616 - DNA, 201 bp, Homo sapiens
ctgtcacagtcagcaatgtttgagacgaaacttgaatggtgagaacaagacaaccacagaaaggtccaggggaagaaattcccaagcaaacggaacaacamgtgcaaaggtgagtgtgaggaatgttccagaaagataaaggaccaagggaaaagagagcaggatttggtctgagatataagcaggagattatggtgctcc

SEQ ID NO: 5617 - DNA, 201 bp, Homo sapiens
tcctccctagttcaagagattcccctccctcagcctcccaagtagctgggattacaggcacccaccgccacgtctggctagtttttgtattgttagtagasatggggtttcaccatgttggccaagctggtctcaaactcctgacctcaaatgattcacttgccttggcctaccaaaatgctgggattacaggtgtgagcc

SEQ ID NO: 5618 - DNA, 201 bp, Homo sapiens
cctgacctcgtgatccgcccgcctgggcctcccaaagtgctgggattataggcatgagccaccgtgcccggccaaaaaatttttacatggaattagttacyaatatttaaaaatggaaaggtttctaacaaaatcagatgacattttctctttttaaaaaactagaagacctgataatattgactctacattcccataaga

SEQ ID NO: 5619 - DNA, 201 bp, Homo sapiens
ttccatgcaggaatctgtgacaactgaaatgccccatatgagctaattttctggataatcaaaatcccctcattaaacaactctgtcatttaaaataaaaycatttttattggatttaatcctttctaaaatggatttcatgcattcctgggtctacatccaggacacactccgtgcttcctacgagaatgattcctagca

SEQ ID NO: 5620 - DNA, 201 bp, Homo sapiens
ggagcagcttagcctttgtattctcacacagattagtctttggttacaggtgaccacaaagattgagggaacttaaattgccaggcatttaccattccagygcccaaaggcaaaaatctgctgaggatccctgaagtgaggctttgtcagcaaagcacagaaaggtggggctgggcacacagcgctgcaaaagggatccca

SEQ ID NO: 5621 - DNA, 201 bp, Homo sapiens
cacctgcctctgcacacatgtctttcttctcccctctttcagtaataaaggaggcatctctcctctagcctaacacgcatcccagcccttgggctctagayacattctcttctgcactgtccttgcctctcaaactgacctaagacctccagtggttttcactaaatccaacaggtgcactgcacataagcccctcctctg

SEQ ID NO: 5622 - DNA, 201 bp, Homo sapiens
agcccctgatctgctgcctttcccccattcttctctactgcctccgagaaacctcaaactcagtaggcttagagaagaactcagcctcttatcttccaccrtaaaaaatagtttctctcccatctgccatataggagttcttgaaatcccaaccatggaaatatccattaattcatctctcttctgccacccccatatata

SEQ ID NO: 5623 - DNA, 201 bp, Homo sapiens
taaattcttccaattgttggaattgtttcaaaataacatgtcacttttattgtttaagccagaggtcactaatctttttttttttttttttatggtaaacrgccaattagtaaatattttcagcactacaggccatacggtctctatcacaactactcaactctgcctttgtagcacaaaaacagccatagacaatgcgta

SEQ ID NO: 5624 - DNA, 201 bp, Homo sapiens
tttgatggttctcttgacatttgactttctctggtttgagcaattcactgcttgtcaggcatgggcctggcatgctgaccttgtactaatcctggtgttgkattgataacagacactaagattctgaatctcaacaggcccattagggaattcactgcaaatttacgcagattaaatcccctggagttttaccactgagga

SEQ ID NO: 5625 - DNA, 201 bp, Homo sapiens
cttgacatttgactttctctggtttgagcaattcactgcttgtcaggcatgggcctggcatgctgaccttgtactaatcctggtgttggattgataacagmcactaagattctgaatctcaacaggcccattagggaattcactgcaaatttacgcagattaaatcccctggagttttaccactgaggaagactcagtggc

SEQ ID NO: 5626 - DNA, 201 bp, Homo sapiens
tcctcactgcagcctctcgtctcttaaaaaagggtgtgtgggggaatcaaagtggtgaatctatagcccctaggccataatcatcatcatattttttttayaacatatgggtaattatctcaaggtacaagttcttcagagtctagaaagcacattaaatcctccacagcttagagaccaatgctgagaatatgcaacctc

SEQ ID NO: 5627 - DNA, 201 bp, Homo sapiens
aaactatagaatgagatgatatggatcaattgacattcaattcaaggtgcgatttttatttcagaatttctggatattcacatactggaatatagaattcrtaaaagcagggattttgcctggtttttccttctgctgctttttctcccttgaagaacctagaatactacctggtataaagtagatgctcaatgcaaattt

SEQ ID NO: 5628 - DNA, 201 bp, Homo sapiens
gaggtgagaagctgctggggagctgatgtcaccactaccccctccgaagcccatccatggggcacagtgcactccactggcagatcccggaaagggagcaygctgactgactggctgactgactgcctgccacatcaccgtctctgcattgcaattgcaaacattgttgtgcattctgaatccccagtgtctttctgtttt

SEQ ID NO: 5629 - DNA, 201 bp, Homo sapiens
cagaaaaacaaatacttcatgttctcacttataagtgagagctaaacactgggtatacatggatataaaaatgggaatagacactggggatgatgataagygtgaggagagcaaggctgaaaaactacctgttgtgaactatgctcactacttggatgatgggaccattcatatcctcagcatcacagaatatacccatga

SEQ ID NO: 5630 - DNA, 201 bp, Homo sapiens
cattctgcctgagttgagatcattatgctgcttctttcattgcacaggaacgtgggggttttctctaaactatgactcatagcaaagcatacaggcaatcrtgtagagaaacctgttctccccaggaaaggagggtgagcaaatgctaaaagttttgatactttaatatagcactggccgtggctaattttacttaatatg

SEQ ID NO: 5631 - DNA, 201 bp, Homo sapiens
gtcacagaggcacgagctcatcatctattttcacaacactaatgcaagagacctccaacacaagcaaagcaaaggtaccgactgggtgcagccacatatcrtgactttccaggccattctgcctgagttgagatcattatgctgcttctttcattgcacaggaacgtgggggttttctctaaactatgactcatagcaaag

SEQ ID NO: 5632 - DNA, 201 bp, Homo sapiens
aatcaggcaggtctcaagaaacaaagtcacagaggcacgagctcatcatctattttcacaacactaatgcaagagacctccaacacaagcaaagcaaaggyaccgactgggtgcagccacatatcgtgactttccaggccattctgcctgagttgagatcattatgctgcttctttcattgcacaggaacgtgggggtttt

SEQ ID NO: 5633 - DNA, 201 bp, Homo sapiens
cgggagcccacacatctttctctgtgttcttgtgaccatggaaatcaggcaggtctcaagaaacaaagtcacagaggcacgagctcatcatctattttcayaacactaatgcaagagacctccaacacaagcaaagcaaaggtaccgactgggtgcagccacatatcgtgactttccaggccattctgcctgagttgagat

SEQ ID NO: 5634 - DNA, 201 bp, Homo sapiens
aacagtgtcaggcagagcccccgggagcccacacatctttctctgtgttcttgtgaccatggaaatcaggcaggtctcaagaaacaaagtcacagaggcaygagctcatcatctattttcacaacactaatgcaagagacctccaacacaagcaaagcaaaggtaccgactgggtgcagccacatatcgtgactttccagg

SEQ ID NO: 5635 - DNA, 201 bp, Homo sapiens
gctctcaacagtgtcaggcagagcccccgggagcccacacatctttctctgtgttcttgtgaccatggaaatcaggcaggtctcaagaaacaaagtcacaraggcacgagctcatcatctattttcacaacactaatgcaagagacctccaacacaagcaaagcaaaggtaccgactgggtgcagccacatatcgtgactt

SEQ ID NO: 5636 - DNA, 201 bp, Homo sapiens
acctaccttgtttggggacacctttttagaggataactcttggtcctcaagcttagaagctgttatgaggaagatgttggggcttttcagaataacatccraagattaccccacagataccttctcctctggaatcgctctcaacagtgtcaggcagagcccccgggagcccacacatctttctctgtgttcttgtgacca

SEQ ID NO: 5637 - DNA, 201 bp, Homo sapiens
acccctggaaatactgggggaaagtcacctaccttgtttggggacacctttttagaggataactcttggtcctcaagcttagaagctgttatgaggaagaygttggggcttttcagaataacatccaaagattaccccacagataccttctcctctggaatcgctctcaacagtgtcaggcagagcccccgggagcccaca

SEQ ID NO: 5638 - DNA, 201 bp, Homo sapiens
aagccttcatattctctccccactcccctgccccatggtcccctatttccactcccctccagtcatccccacactgtcctcctcccacagctgtcccctgwtccttcctaacttcagctcattgtggcatcttttcagcccctgtatccacgatgctaactgaaaaatcctattctatttctaattcaaaagcccacattc

SEQ ID NO: 5639 - DNA, 201 bp, Homo sapiens
caacagtgggctatagtttatgggaatcaaaagttatacatggattttaaactgcatgggggttaatgcaactagcgcctgcattattcaaggatcaactstgtttaataaaccaataaataaatcaaatccaaggaagtctatgaaagggtttcagagggtctgtgatcccctgaaattgcacataattttgactgcatg

SEQ ID NO: 5640 - DNA, 201 bp, Homo sapiens
agcattagatgcatttcctttctctgcatcttgaaggtagtctatgcaaagtacccagcatagcctgtaggatatctccaggccattagagagagaaaaaraaagtccttcctaaattcaaacttcatatcacttcgccctctgatttaagcagggcattaggttcatctctaactctccctttctgtcaactgaagaaca

SEQ ID NO: 5641 - DNA, 201 bp, Homo sapiens
tctaacgatatatttggagcccctagagtctgccaagtatgaagccatttctcctggacccctttgttatacaagccagtgagtttctatgttcatttaargagtttgagtagggtttctgtcacttgaacatacggctcccacataatacagagtatcataaataccatgtggacatctaccttttcaatcaacaaatat

SEQ ID NO: 5642 - DNA, 201 bp, Homo sapiens
tcctccacctaaacactacctccctacccccatactccaccctggttggccaacttctaatcatttttccaatcttagcctaactaccaccgccctgggargtcttcaccagcaactgtgccaggcacccttgtgcaccaagagcctttagtatcatttctagcatcatggtatatttatatataagaataattgcctgtt

SEQ ID NO: 5643 - DNA, 201 bp, Homo sapiens
tggctcaaactgccaggaagctttctgagcaacagcagatgttggggcttcgagaaagattgctctctgcttttggccagaatccctggggtcatttaggyggtgatgttgccagttcttctcccctctggccaacacctctcaatccattatttgggataccaattataaacttgggacaagagcctaatctcccagcaa

SEQ ID NO: 5644 - DNA, 201 bp, Homo sapiens
tccgagcgccgtggaagagaacagtctgattaagttggctcaaactgccaggaagctttctgagcaacagcagatgttggggcttcgagaaagattgctcyctgcttttggccagaatccctggggtcatttaggtggtgatgttgccagttcttctcccctctggccaacacctctcaatccattatttgggataccaat

SEQ ID NO: 5645 - DNA, 201 bp, Homo sapiens
ataccaaaaggacagctatagaaaggcttcaaatctacttcttagtaaacacatcacttcaataaacatccattgaacatctactttatgctagcaaagtrtaggaattaaagaggtaagtaaaaattgtgtggtcctttctctgcaatcatttagagtttaagggaaaggcagatcctatgcaaataattacaataaatg

SEQ ID NO: 5646 - DNA, 201 bp, Homo sapiens
taacagcattagatgcatttcctttctctgcatcttgaaggtagtctatgcaaagtacccagcatagcctgtaggatatctccaggccattagagagagaraaaaaaagtccttcctaaattcaaacttcatatcacttcgccctctgatttaagcagggcattaggttcatctctaactctccctttctgtcaactgaag

SEQ ID NO: 5647 - DNA, 201 bp, Homo sapiens
ccttgacacctctagaaatctcttccctctgtctagaatgtctttccctatccccttcacctgtggaggttttactgtgattatgaggcacacatcaaaayaccacagcatccaacatatagcaggtgcttgataaatatgtgttgaataagtgaatacaaactccctagcagaatagaatgcaagccttgatttccagct

SEQ ID NO: 5648 - DNA, 201 bp, Homo sapiens
ctgcctcggcctccctaagtgctggaattataggcgtgaatcaccatgcctgacacagcagaacctttgagatatatttaagcaaggaggctggaataccrcctcatttgactccagggaaaatataactttttcccagagatgaaaataaagacaccagagcggggtccactcaaggatactgatgtgagccatcccctg

SEQ ID NO: 5649 - DNA, 201 bp, Homo sapiens
tgaattcctgctttctactccctagtactgtgccctcaggcacatagatgaacatctcagttcctttctcctttctgataagggtagagaacagcaaggcstacctggttctttccttattttattattatcaagctgttcatttcagcacatatatctagcttttactttgtacactaatacaagaagaatcctcaccta

SEQ ID NO: 5650 - DNA, 201 bp, Homo sapiens
tccccgagatgttaacctctgtgtgtcaatgaagcagggaaactggacagttggttcacttttctaaatgcaggagcaagatgagggaaattattgatttstatcaaaacagacaagaagcaaatagaagagaagaccatgggcagggaagggtttgaatacaaatggaaaccaccaggcatagcattgggagcttctgaa

SEQ ID NO: 5651 - DNA, 201 bp, Homo sapiens
cagtaatcactagtgttggagatgctataattgaagtcagcttatgacaacagggaaaaggctgagtctaaaagctctcaccattcaacactccccactcmcaatgttcccactccaaatggtacagtaatggtgtgatgataggtccatccagattctatcccgggggatctcttcctgtgtgtagccttccccctacac

SEQ ID NO: 5652 - DNA, 201 bp, Homo sapiens
aagatagccagagttctgcttctggtatggtaggaaatctcttaacagattccctcccacacccaaacaggtaaaaaattaaagctagaaggaaaaaaaawatatacctgaaggctctgtagagtaaaaatagccagtagatttcacagggacattgaaacatggaagaagggctcatcatagagttctacatttttgcca

SEQ ID NO: 5653 - DNA, 201 bp, Homo sapiens
ctctcattttcccttcaagccaatattgaagacttgatatcttggtccattattctgtccaaataaggaaaggaaacaatgttgaatcttgatacgtgacstgataagactttggtgctctctgaacatccatcttctttgcctcaaaataaaaaatatagggttgatgaatgggcaaggcaatcctaagcaaaaagaata

SEQ ID NO: 5654 - DNA, 201 bp, Homo sapiens
gatggggtttcaccatgttagccaagctggtctcaaactcccaacctcatgatccacccgtcttggcctcccaaagtgctggaattacaggcgtgagccamcgtgcccagccaatgtcacgcacagttttaagcaaaactatgtttcagtctcagctaaactatgtcattaccacgtcttctctgtctcccattgccgctt

SEQ ID NO: 5655 - DNA, 201 bp, Homo sapiens
agcacctctgcatctgggtgtagccatgtgactcgttcatccaacaggatgtgggccagagttttggagagataggacaccctttcttctctccttcctgyttcctggattttctggctgcttgcagaaaatcctaagttattagaagatggcagagccacaagatagtggagactgagttcttaaatccccacatgaaga

SEQ ID NO: 5656 - DNA, 201 bp, Homo sapiens
atgctgtatctggaggactttgcagttgagttcagtgatgttttttaaaccaatacctgatctaaagagtatcccagaaaaccagtctgctgaaatcaagygtcactttggaactcaattttcccctgtgtggtatgcacaaacaagtttctatgcagaaattactaaagagcaggtgtgggtcaaacctgctctgtcttc

SEQ ID NO: 5657 - DNA, 201 bp, Homo sapiens
acgatggtacaccaacgcagtataatgtattctttgtgtgtgtgtgattgagtctcgctctgtccctcaggctggagtgcagtggcacaatctcgactcamtgcaacctctgcctcctggttttaagcgattctcctgcctctgcctcatgagtagctggtattacaggtgtgtgccaccatgcccagctaatttttgtat

SEQ ID NO: 5658 - DNA, 201 bp, Homo sapiens
aatcaccaccagcctggggtgcacctggtagccttcctcagtgaaggataagtctttgccatcccatgtaacattgaccataaatctagaaaggggaagasagaaagacaaatttttaggaaagaattagagcaatcgaacaaataagtggatgccaccattaatggaatactgaaaaattataaacttacaatgctatat

SEQ ID NO: 5659 - DNA, 201 bp, Homo sapiens
gaagaaatcatacccggtgaggccaagggagcgggcctcactcagaatgagaacagcctcgtctttggaacagtagagcaagatgacagaagagtggatcytcttcagctggacttgtgtctttgcatcctcaaaggaagtgtccagtgtgatcacattctgcatgtcccagcccacaaagctgttgtccactgtggtctt

SEQ ID NO: 5660 - DNA, 201 bp, Homo sapiens
acggccacctccaccgtgttagggttggactcattgagagtaagaggatgttgtccctggaatacatagttattgaggttatccttctgccggttggccasaaatgtttggagttcgttcatgttgtctccaaaaatgctctctttcccctgaaaggacctgttgtctgagtacatcaaattccccttatctgaaaccatg

SEQ ID NO: 5661 - DNA, 201 bp, Homo sapiens
acttcttgagtgaagataataatgattacatagcctacctaatattgttgcagtgaggacaaaatttatatataaaaatagagaatataatatatatatakagagagagtatagcaaacttattctctattaatatgtatatatattatatattatatacatatataatatatataacttagcacagttcctggttttgtt

SEQ ID NO: 5662 - DNA, 201 bp, Homo sapiens
ggttcatttttcagatttatgttaattgtaagaagtatattctgtctacttcatcacacacacacacacacacacacacacacacacacacacacacacactcctccagccccagttcagagataacctctgaactgtagcagattcaaagtcctaaagccttccagaaatatttcagagtgacatagtaccctgctggta

SEQ ID NO: 5663 - DNA, 201 bp, Homo sapiens
aggttcatttttcagatttatgttaattgtaagaagtatattctgtctacttcatcacacacacacacacacacacacacacacacacacacacacacacactcctccagccccagttcagagataacctctgaactgtagcagattcaaagtcctaaagccttccagaaatatttcagagtgacatagtaccctgctggt

SEQ ID NO: 5664 - DNA, 201 bp, Homo sapiens
caatatcctaactgcaccagctctttgcctgagattataaataaagtccatgaggaccaccaagtggcatgtctagctggccccatgactttgttctcaaycagtcaaatctggatcccagatcccctcagtaactcaccacgaagatatcaggtatgacctcatctgaacttcttctggagctatttgcaacctccctgc

SEQ ID NO: 5665 - DNA, 201 bp, Homo sapiens
ccagcccatgagcaacaatatcctaactgcaccagctctttgcctgagattataaataaagtccatgaggaccaccaagtggcatgtctagctggccccawgactttgttctcaatcagtcaaatctggatcccagatcccctcagtaactcaccacgaagatatcaggtatgacctcatctgaacttcttctggagctat

SEQ ID NO: 5666 - DNA, 201 bp, Homo sapiens
gctttcctagcttactcagagcttgcagtgtaacaagtataaagttataataatgatgatgatgaccacaataataagaaaaataaaattataataatgayctgatagttatttgtaaaatgccttctccatgcctggcaccatgctaaatgtatatactttaagatgttacaagaagaagagatgtctatcttacacaca

SEQ ID NO: 5667 - DNA, 201 bp, Homo sapiens
gattatgataaaaataataaaaatgagtacaagacaacctgggataaaatactttaaaaagccctggaggtaacatggataaataaaccaacccaggtggkgactaaggtgtactgcgcagagatgacagtcacttccagcttccagttgatcattagcaggtcaggatatgggattattatcactaactccatctttttc

SEQ ID NO: 5668 - DNA, 201 bp, Homo sapiens
actaacttaaacaaaattaaaccactacgggcgtttagtggttaatgtctgaaattggagcggcgcggtggctcatgcctgtaatcccagcgttttgggargccaaaacgggcagattacttgtggtcaggagtttgaaactatcctgaccaacatgatgaaacctggtctctactaaaaatacaaaagttagccaggcgt

SEQ ID NO: 5669 - DNA, 201 bp, Homo sapiens
ataaaggagttgcccatattacagatgaggaaactgaggctcagagagaacagacttttccaagctctcacagcaaagtttagcatctcagctatcaagamaacccaagtattaacgttagaatatagtgaatgtccccccctgccagtgctccaaggaacgttcatcctgccttgtttcagaagcaacatccacagccac

SEQ ID NO: 5670 - DNA, 201 bp, Homo sapiens
ttgatcagtaaaatgggcataatcatagcagccatgccataggtttgtcatgagtataaaatgagaattcatcgagagtcctgagcaccatcccaatcccygtatccagtggctctcattaatattagcccatgaatgttaacaatgccctccaacttaggaacaaggaagtgcatttggaaaaacatagctctacaaagg

SEQ ID NO: 5671 - DNA, 201 bp, Homo sapiens
actgagctaattcaaggatacaataagtagttgaaaagcagtcatagctgagatatgagatttaaactcatatttgagtctcatatgaagtctcagagttyttttttttttttttttttttgagacggagtcttgccgttgcccaggctggagtgcagtggtgcgatctcggctcactgcaacctctgcctcccaggttta

SEQ ID NO: 5672 - DNA, 201 bp, Homo sapiens
agaactgagctaattcaaggatacaataagtagttgaaaagcagtcatagctgagatatgagatttaaactcatatttgagtctcatatgaagtctcagasttcttttttttttttttttttttgagacggagtcttgccgttgcccaggctggagtgcagtggtgcgatctcggctcactgcaacctctgcctcccaggt

SEQ ID NO: 5673 - DNA, 201 bp, Homo sapiens
tttctctgcatcttgaaggtagtctatgcaaagtacccagcatagcctgtaggatatctccaggccattagagagagaaaaaaaaagtccttcctaaattyaaacttcatatcacttcgccctctgatttaagcagggcattaggttcatctctaactctccctttctgtcaactgaagaacatggatctgctccattcac

SEQ ID NO: 5674 - DNA, 201 bp, Homo sapiens
actaacagcattagatgcatttcctttctctgcatcttgaaggtagtctatgcaaagtacccagcatagcctgtaggatatctccaggccattagagagagaaaaaaaaagtccttcctaaattcaaacttcatatcacttcgccctctgatttaagcagggcattaggttcatctctaactctccctttctgtcaactga

SEQ ID NO: 5675 - DNA, 201 bp, Homo sapiens
atctcggctcattgcaacccccacctcctggattcaagcgattcacctgccttagcctctctagtagctgggactacaatcgcgtgccaccatgcccagcyaatttttttgtatttttagtagagacggggtttcactgtgttagccaggatggtctcaatctcctgacctcatgatctgccacctcggcctcccaaagtg

SEQ ID NO: 5676 - DNA, 201 bp, Homo sapiens
agtatttgtttttaacaaggctgatttcaagctgtttcttcattgtggggtttcctaataatctttccttctcttggttctgtttttttttttttttttttggcgggggggtgggggggtgggtgggggtgacggagtctcactctgttgcccaggctggagtgcagtggtacgatctcggctcattgcaacccccacctc

SEQ ID NO: 5677 - DNA, 201 bp, Homo sapiens
cagtatttgtttttaacaaggctgatttcaagctgtttcttcattgtggggtttcctaataatctttccttctcttggttctgtttttttttttttttttttggcgggggggtgggggggtgggtgggggtgacggagtctcactctgttgcccaggctggagtgcagtggtacgatctcggctcattgcaacccccacct

SEQ ID NO: 5678 - DNA, 201 bp, Homo sapiens
gtggaggttgtggtgagtggagatcgcaccattgcactctagcctgggcaacaagagcaaaactccgtctcaaaaaaaaaaaaaaaaaaaaaaaaaaaaaagtcaagacagaaaaataataactccaacacagagatactctaaaatgggctcagaaaccacaacataaagaaacagaaagaagaaaaggatttttataag

SEQ ID NO: 5679 - DNA, 201 bp, Homo sapiens
ggtggaggttgtggtgagtggagatcgcaccattgcactctagcctgggcaacaagagcaaaactccgtctcaaaaaaaaaaaaaaaaaaaaaaaaaaaaaagtcaagacagaaaaataataactccaacacagagatactctaaaatgggctcagaaaccacaacataaagaaacagaaagaagaaaaggatttttataa

SEQ ID NO: 5680 - DNA, 201 bp, Homo sapiens
aggtggaggttgtggtgagtggagatcgcaccattgcactctagcctgggcaacaagagcaaaactccgtctcaaaaaaaaaaaaaaaaaaaaaaaaaaaaaagtcaagacagaaaaataataactccaacacagagatactctaaaatgggctcagaaaccacaacataaagaaacagaaagaagaaaaggatttttata

SEQ ID NO: 5681 - DNA, 201 bp, Homo sapiens
gaggtggaggttgtggtgagtggagatcgcaccattgcactctagcctgggcaacaagagcaaaactccgtctcaaaaaaaaaaaaaaaaaaaaaaaaaaaaaagtcaagacagaaaaataataactccaacacagagatactctaaaatgggctcagaaaccacaacataaagaaacagaaagaagaaaaggatttttat

SEQ ID NO: 5682 - DNA, 201 bp, Homo sapiens
ggaggtggaggttgtggtgagtggagatcgcaccattgcactctagcctgggcaacaagagcaaaactccgtctcaaaaaaaaaaaaaaaaaaaaaaaaaaaaaagtcaagacagaaaaataataactccaacacagagatactctaaaatgggctcagaaaccacaacataaagaaacagaaagaagaaaaggattttta

SEQ ID NO: 5683 - DNA, 201 bp, Homo sapiens
gtaattacaactcacagcagcctcgacctcctgggctcaggcatcctcctgcctcagccttccaagtagctgggactataggcctatgccaccacatctgrctattttttcttttttttggagggacagggtctccctgtgttccccaggctggtcttgaactcctaggcttaagtgatcctcctgcctcggcctccctaa

SEQ ID NO: 5684 - DNA, 201 bp, Homo sapiens
gcatggtgcagaagcgactgatgggggtgttgtgtgggggagaatctggtttccaaggacaaagtgaagaaattggggaaaaggaaaagagcaaatattgygtatttattcaacagaccattcgggtcattgaaaatcatgtttttgaagacaaattaatgatgcagagaaaatgcttactatttaatgttaaagaagcag

SEQ ID NO: 5685 - DNA, 201 bp, Homo sapiens
ggagaattgcttgaacccgggaagcagaagtcacggtgagccgagatcgtgccattgcactccagcctgggcaacaagtgtgaaaccctgtctcagaaaaacaaacaaacaaaaaaaactatgggaagacatagaagcgagggtgacatcaaagaggtaatagatcatgtcaattgaaggctgtgtagagaatagattgga

SEQ ID NO: 5686 - DNA, 201 bp, Homo sapiens
aaatgaattttttaaaaaaagcatagttgaaatggagataagtcatggaagagtcagagaggagagaaaagaagagggaagggaggaagagggaagagagkatgatggagagaggaatcgagagatgagaggagatggagaggaaaagagaggaggaaagaagagaggaatgagtaaagaagaaaattgaaagaggtggca

SEQ ID NO: 5687 - DNA, 201 bp, Homo sapiens
attatgattagtaacatattgaaaaactttgtatagagtgctgttatttcttttaaatgtttgttatagatagacgaagccatctaggccaggagtttctyttttgtctttttaaaatgggaaagtttttaggtatattttcagtttttcagcaaatatgagctattcagatcgtcaatacctacatctcagttgtagaaa

SEQ ID NO: 5688 - DNA, 201 bp, Homo sapiens
agatgaaaagaaatcgcctccgagtcccagaataacagctccctcctcagcagtctttcccctctgctgacctgctgtaccagcgtgtagtgctgggggggcagctttaagggtaacacgactggtatttacctgctccactggctttctctttcttagagacagaagcacacggagttatttctgaagcactagatcccc

SEQ ID NO: 5689 - DNA, 201 bp, Homo sapiens
ctcattaatggtatgcatgtttgtttgtttgtttgtttgagacggaggctcgctctgtcacccaggctggagtgcagtggcaccatcttggctcactgcarcctccacctcctgggtcaagcaattcttctgcctcagcctcctgagtagctgggattacaggtgtgtgccaccacacccagctaattttatttttagtag

SEQ ID NO: 5690 - DNA, 201 bp, Homo sapiens
ttctttttggagttgggttgatgttacaactgcaacaacaacaacaacaacagcaacaacaaaagaaccagtgcaagacacacacacacacacacacacacgcacacacagttgcacacacacatgctttgggagatggcatcacttatttcagttgaatgtgttaatttgctagagatctactatattttcctcactgtg

SEQ ID NO: 5691 - DNA, 201 bp, Homo sapiens
gttctttttggagttgggttgatgttacaactgcaacaacaacaacaacaacagcaacaacaaaagaaccagtgcaagacacacacacacacacacacacacgcacacacagttgcacacacacatgctttgggagatggcatcacttatttcagttgaatgtgttaatttgctagagatctactatattttcctcactgt

SEQ ID NO: 5692 - DNA, 201 bp, Homo sapiens
gctcattcgtgactttccattttttccctattacagcccagatctctttatcacagcaacagatttcctgccacgcccacaattttcctgctcccatcttrtcctcctgtcacacccacctggcaccaccttccacccagctctgagtcaatccaccacttcctcacctgtcaaccaccaagcctcattcacaaattacag

SEQ ID NO: 5693 - DNA, 201 bp, Homo sapiens
cttgaccatcacagcagagtcacatagatgtgaaagagatattattacaatttttcagagcggtaaactgatgttccttcaagtaactttttttctttttyttttttttttctttttttgtagagatggagtctcgctctgttgcccaaggtggagtgcagtggcatgatcttggctcaccgcaacctccgcttcccaggt

SEQ ID NO: 5694 - DNA, 201 bp, Homo sapiens
atatatattcccacagttctcttcctatcagtcaatgaacaaccacttaataagaccccgtttcttttgagtattatgccagctctttgggagaaaaatgmcaacaatgacactgttctcaagaactgaaaatgtggtctaagaacggcaccactagaaagtactacacatgcataatcagtatgactaccacacctggta

SEQ ID NO: 5695 - DNA, 201 bp, Homo sapiens
aataagcttaacgacagctttgcccagttaaaaacgtgattattctaaggcactgggggaagaggagggttcccttgggatgggatggataagacttgctrtttttgaaaactaagcctaagtaacccaccaccgtcaatccaatttcacccaaaccaattatccccatctcagacagtaatcaacaatttgagagcccta

SEQ ID NO: 5696 - DNA, 201 bp, Homo sapiens
ataacatccaattgtaaaataaatgaaatgccatttgcagtctggcagagtaaacagctcttttggggagtatttacctgaatgatattaagaagtttttkttccctcagcaaacttgccaataagagttagaaagtggctaagagaggtagactgtgatcctgggctgacagctgaaaaagccttttatttattgtgata

SEQ ID NO: 5697 - DNA, 201 bp, Homo sapiens
agcataacatccaattgtaaaataaatgaaatgccatttgcagtctggcagagtaaacagctcttttggggagtatttacctgaatgatattaagaagttytttttccctcagcaaacttgccaataagagttagaaagtggctaagagaggtagactgtgatcctgggctgacagctgaaaaagccttttatttattgtg

SEQ ID NO: 5698 - DNA, 201 bp, Homo sapiens
tcagcataacatccaattgtaaaataaatgaaatgccatttgcagtctggcagagtaaacagctcttttggggagtatttacctgaatgatattaagaagytttttttccctcagcaaacttgccaataagagttagaaagtggctaagagaggtagactgtgatcctgggctgacagctgaaaaagccttttatttattg

SEQ ID NO: 5699 - DNA, 201 bp, Homo sapiens
cccaggaggcggaggttgcagtgagctgagattgcaccactgcactccagcctgggtgacagagcaagagtctctcaaaaaaaaaaaaaaaaaaaaaaaaagaaagaccaagggagttagtaggttgcctgttatggggttttatctttatcctatgggcaagtgacatatgtaagggatggggatgaggacttactgaag

SEQ ID NO: 5700 - DNA, 201 bp, Homo sapiens
gctgtgttaccttgggcaagtcgcttcacctctctgagcctcagttttctcattagtaaaatgagagtaatggtcataatacctatctcataatacctcayacagaacaccttgctgttcctccatgtcccaccttgacacctctagaaatctcttccctctgtctagaatgtctttccctatccccttcacctgtggagg

SEQ ID NO: 5701 - DNA, 201 bp, Homo sapiens
tttagccatgtgaccttgaacaagccacataatctttttgaacctcagttcactcaatcaccaaataaaaacaacacttccatttcatatgctgttatgasgcttacttataagataataacaacaaacatctcttaatgcacagttcctggcacacagaaaggtctccatacgtggaactattatcattaattcaacatt

SEQ ID NO: 5702 - DNA, 201 bp, Homo sapiens
aaaaggaaataaaaaaggaagctgaaatccacattgacagcaaagataggcaggaggggattgacaggagcggaagcaagccctttctcaggagatgatgsataatgatgagaaatagccagccaagggagggaatgaggggaagagcattccaggtggaaagaaaagcatatgcaaatgccccaaagcaggggagacctt

SEQ ID NO: 5703 - DNA, 201 bp, Homo sapiens
aatgagctgggcatggtggcatgcacctgtaatcccagctacacaggaggcataagaatagcttcaatctgggaggtagaggttgcagtgagccaagatcrcaccactgcactccagcctaggtgacagaatgtgactctgtcgagagaaagagagaaagaaagaaagagagagagagagagagaggaagaaagaaagaaa

SEQ ID NO: 5704 - DNA, 201 bp, Homo sapiens
acgttcctcattgatggtgagcgagccaactgccatgactgcccgttgatagaccacctggatgcaaggcaaaaaaaaaaaaaaaaaaaagagagagagaacaacagtactttacttttcctgctaacattcctgaggactgcaggccctttgtctgagtaagagcctaggggatgaaaagataacttacttcaccgatca

SEQ ID NO: 5705 - DNA, 201 bp, Homo sapiens
gctagagaaaagcagatgatagaaaacatagctcttccttgatttaaaaaaaaaaaacaccttttatgtaaaaacataaatttacaaaacggttaaaaaaatcacaagaatttccttctttacaaactatttggcttaatgggtagtcacatttaaaatatgattcgattaattttaaatcagcatatacttttcagacta

SEQ ID NO: 5706 - DNA, 201 bp, Homo sapiens
caatacagtccaagtgctagagaaaagcagatgatagaaaacatagctcttccttgatttaaaaaaaaaaaacaccttttatgtaaaaacataaatttacraaacggttaaaaaaatcacaagaatttccttctttacaaactatttggcttaatgggtagtcacatttaaaatatgattcgattaattttaaatcagcat

SEQ ID NO: 5707 - DNA, 201 bp, Homo sapiens
aaaatctctatttgatttaccacattatctctggcagcagtatagtgcctcctggcacgtagtacccatttgataaatattcatcagaaaatgtgtaaattcacaacagcacaagccctgattatgcaaatataaggaactactgtatcacagtgtggtcactcacagaaactgtctcagattccaccctgttggaaatct

SEQ ID NO: 5708 - DNA, 201 bp, Homo sapiens
catttcccaataagtccaaggaagtgttgatctccaaaaaaaaaaaaaactgaatcccaacgtaagtttgtgaccttgagcaaattgcaggatctgtctgtgcctcagttgccccattaataaaaagagggaagtcacctcactgctaacacttcattagtaaaataaggacactaacagtaccttcatgtgtggcgagta

SEQ ID NO: 5709 - DNA, 201 bp, Homo sapiens
ccatttcccaataagtccaaggaagtgttgatctccaaaaaaaaaaaaaactgaatcccaacgtaagtttgtgaccttgagcaaattgcaggatctgtctgtgcctcagttgccccattaataaaaagagggaagtcacctcactgctaacacttcattagtaaaataaggacactaacagtaccttcatgtgtggcgagt

SEQ ID NO: 5710 - DNA, 201 bp, Homo sapiens
tccatttcccaataagtccaaggaagtgttgatctccaaaaaaaaaaaaaactgaatcccaacgtaagtttgtgaccttgagcaaattgcaggatctgtctgtgcctcagttgccccattaataaaaagagggaagtcacctcactgctaacacttcattagtaaaataaggacactaacagtaccttcatgtgtggcgag

SEQ ID NO: 5711 - DNA, 201 bp, Homo sapiens
atccatttcccaataagtccaaggaagtgttgatctccaaaaaaaaaaaaaactgaatcccaacgtaagtttgtgaccttgagcaaattgcaggatctgtctgtgcctcagttgccccattaataaaaagagggaagtcacctcactgctaacacttcattagtaaaataaggacactaacagtaccttcatgtgtggcga

SEQ ID NO: 5712 - DNA, 201 bp, Homo sapiens
acctcaagaaaaaatattttttttggaaaacgtgtttttaacaatgatcatccatttcccaataagtccaaggaagtgttgatctccaaaaaaaaaaaaaactgaatcccaacgtaagtttgtgaccttgagcaaattgcaggatctgtctgtgcctcagttgccccattaataaaaagagggaagtcacctcactgctaa

SEQ ID NO: 5713 - DNA, 201 bp, Homo sapiens
ggaggtggaggttgcagcggggagagactgcaccattgcactccagcatgagcaacaagagcgaaactccgtctcaaaaaaaaaaaaaaaaaaaaaaaaaaagacttgtactccttcagctctagtttctgagtttaaagtaacaatgcaaagcatcccccacatgggagattgagtatagaatgaatctgccatctgccc

SEQ ID NO: 5714 - DNA, 201 bp, Homo sapiens
gggaggtggaggttgcagcggggagagactgcaccattgcactccagcatgagcaacaagagcgaaactccgtctcaaaaaaaaaaaaaaaaaaaaaaaaaaagacttgtactccttcagctctagtttctgagtttaaagtaacaatgcaaagcatcccccacatgggagattgagtatagaatgaatctgccatctgcc

SEQ ID NO: 5715 - DNA, 201 bp, Homo sapiens
tgggaggtggaggttgcagcggggagagactgcaccattgcactccagcatgagcaacaagagcgaaactccgtctcaaaaaaaaaaaaaaaaaaaaaaaaaaagacttgtactccttcagctctagtttctgagtttaaagtaacaatgcaaagcatcccccacatgggagattgagtatagaatgaatctgccatctgc

SEQ ID NO: 5716 - DNA, 201 bp, Homo sapiens
ctgggaggtggaggttgcagcggggagagactgcaccattgcactccagcatgagcaacaagagcgaaactccgtctcaaaaaaaaaaaaaaaaaaaaaaaaaaagacttgtactccttcagctctagtttctgagtttaaagtaacaatgcaaagcatcccccacatgggagattgagtatagaatgaatctgccatctg

SEQ ID NO: 5717 - DNA, 201 bp, Homo sapiens
tgataaatgactcatcagtcaagataagtaatattttaatatgatatttttacaaataaaaaccaatgcaaaaaaaatgatgcaaaacaaatcaaaatttgaaataaagacaagatccgactgtacttgcccaaccttagtctcagccctgctggatcctctattattatgttaatcatggaattcttggcattaatttct

SEQ ID NO: 5718 - DNA, 201 bp, Homo sapiens
aggaaaaaatatttgcaaattgtatatctgataagggattgatatccagaatatacagagaactcttaaaacctaacaacaaccaaaaaaaaaaaaaaaaagaaaacccaaacaacccaaatgtaaaatggccaaaagacttgcatatccacctctcaaaagaataaatacaattgcccaataagcaggtaaaaagcgctc

SEQ ID NO: 5719 - DNA, 201 bp, Homo sapiens
aaatttgttaaatgtaaaaagatgtaaagtccatcatcccaatcacctagcagcatctccgataacattttgatatatttctttttagtctgttttttttrcctttttttttttttccgtctctgagtttaaagaattatgatctcactttatttaactcctgccccccacagacatttttttctactttaaaaaaagttt

SEQ ID NO: 5720 - DNA, 201 bp, Homo sapiens
aaaaatatgacgaaattggtactaggttttgcataatggtgggccattagaaacggccttaattgtggaatattatgagaacagtcatattttttattttwtttacattgtgactcaaagcaggggctctggcgtaagattgatcccagacacgctgcttaatctctcaatgcctgtttcctcaaaggtggatgaaaatct

SEQ ID NO: 5721 - DNA, 201 bp, Homo sapiens
ctctccaaaacatatcgttcactgaaaaccaaactgtgacatactgcatagagtttgatagcattccacagaataaaattttattctgtgtggacatatattaatatatacaaatgcagaccgggcacggtggctcactcctgtaatcccagcactttgggaggccgaagtgggtggattactgaaggttaggagtttgag

SEQ ID NO: 5722 - DNA, 201 bp, Homo sapiens
gctctccaaaacatatcgttcactgaaaaccaaactgtgacatactgcatagagtttgatagcattccacagaataaaattttattctgtgtggacatatattaatatatacaaatgcagaccgggcacggtggctcactcctgtaatcccagcactttgggaggccgaagtgggtggattactgaaggttaggagtttga

SEQ ID NO: 5723 - DNA, 201 bp, Homo sapiens
agctcacatctctcttacctgctctctgggcctcccagcctggactcgcacaagggcaccatcccactacccctcatacttccaatcagtgcagaccagakccaccccaaccccactatcatcactcacatgagcagcaggatggagctggcacagaagacaagcctcctacacctcctctgccaaatcttcaaatatcat

SEQ ID NO: 5724 - DNA, 201 bp, Homo sapiens
aataccaaatttcaccctgtgtgctttcagctcttgtcagtttattttgtgtggcttatttttttaccaataatattcactgtgaattgggcaaaaaagadggatggttaatatttatttttttagctgataataaatcctgagtgattttgtaagacagaggcagagagaagcagagaaggggagaggatagaagagagg

SEQ ID NO: 5725 - DNA, 201 bp, Homo sapiens
gctaagaagatttgagtcatctatggatttttagtcaataccaaatttcaccctgtgtgctttcagctcttgtcagtttattttgtgtggcttatttttttaccaataatattcactgtgaattgggcaaaaaagatggatggttaatatttatttttttagctgataataaatcctgagtgattttgtaagacagaggca

SEQ ID NO: 5726 - DNA, 201 bp, Homo sapiens
tattgctaaggggctgcagcctcttgccaaccacagacccatctcagtggacaatgcaaagggtagcattaaatcatgagctttgtgagggcagggagccctgtgcctcctatctggcatagcatcccacacctggtgggtgcctagtaattgtccataggataaatggataacaacggagagacgaagaatttattgtag

SEQ ID NO: 5727 - DNA, 201 bp, Homo sapiens
ccacttcatacacactggatttccacacatgcatgggaaagaaaagaaggactattgccccacagattcactgcatctagtattgctaaggggctgcagcctcttgccaaccacagacccatctcagtggacaatgcaaagggtagcattaaatcatgagctttgtgagggcagggagccctgtgcctcctatctggcata

SEQ ID NO: 5728 - DNA, 201 bp, Homo sapiens
cccaggaggtgaaggttgcagtgagccaagatcatgccattgcactccagcctgggtgacaagagtgaaactccatctcaaaaaaaaaaaaaaaaaaaaaagtggtaggcatggcctgagcacgggaaacccagggtaatgtaagaggcgcagagaagaggccccctaattcagcctgcaatggtgcagtggagtggggga

SEQ ID NO: 5729 - DNA, 201 bp, Homo sapiens
gtgaatatatttccatgtgaatacacatagcacttttaaattcttttttgatacacttatttttattgaggtataacgtatgtgtaataaaatgcttgatraatttttacatatgtatatatccttgaaatcaccatgcagttcaaaatgtggaatgttatcatttccttagaaatcctatgcataccccagaaaataagc

SEQ ID NO: 5730 - DNA, 201 bp, Homo sapiens
ctactaaaaatacaaaaattggttgggtgtgatggcaagtgcctgtaatctcagctactcaggaggctgagacaggagaattgcttgaacccaggaggtgraggttgcagtgagccaagatcatgccattgcactccagcctgggtgacaagagtgaaactccatctcaaaaaaaaaaaaaaaaaaaaaagtggtaggcat

SEQ ID NO: 5731 - DNA, 201 bp, Homo sapiens
agaaggatgaagaggaggaggagggtggtggtgatggccatgatgatggtggtgatgatcgtggtaatgaggatgatggcaatggtcatgatgatgatgaygatgacggtgatggtggtggtgatgataatgataataatgatatcagaggcgtgtgaaccagaacactccatcttaaatagtagctgggtaaaatgaggc

SEQ ID NO: 5732 - DNA, 201 bp, Homo sapiens
ctcccccactccaagatctgtgagcatcattatgctgaatggtgctattaaaactctagagtccattgcaggaagtttccttattaacatgagagcagggyttgtggtcctctccaatctgttaacaatctagatgagtctttaaaattattgctggcaaaagttgcagtacaaaaggaacagagggaacctgatgaagta

SEQ ID NO: 5733 - DNA, 201 bp, Homo sapiens
gtgagttctccattgacttccaaggctcccccactccaagatctgtgagcatcattatgctgaatggtgctattaaaactctagagtccattgcaggaagkttccttattaacatgagagcagggtttgtggtcctctccaatctgttaacaatctagatgagtctttaaaattattgctggcaaaagttgcagtacaaaa

SEQ ID NO: 5734 - DNA, 201 bp, Homo sapiens
catgaacaaagagacttatgcagtgagttaagcaatatggactttatcaacaagtaatgggttattaataggaacatgacatttatatttcagaaaaaaawatttagcatctacaggaggatgagtgaatagaaaagcaggagggcattagaaggttgttataatcatttaaataagaaataactggacaggtgtggtggc

SEQ ID NO: 5735 - DNA, 201 bp, Homo sapiens
ataactccatgccatttagtcattgtgaggggcaaatgaaattaatataaggaccaaactccgaccattttcttctcttgcccaaagccctatctaagggrcctgaagagtcacatcctacagacaataaagtcttgtcagaggggttttattccatgctatataacatggcttagtttccaactttggcagaacatcaca

SEQ ID NO: 5736 - DNA, 201 bp, Homo sapiens
caagaaatgagggtgtctcaagaagtgacaaccgttttaagtcatttaaacataggtcagagtggagagagacaagcctagaaggccatgaacaaagagasttatgcagtgagttaagcaatatggactttatcaacaagtaatgggttattaataggaacatgacatttatatttcagaaaaaaaaatttagcatctaca

SEQ ID NO: 5737 - DNA, 201 bp, Homo sapiens
tacagcacaccaacatggcacatgtacacatatgtaataaacctgcacgttgtgcacgtgtaccctaaaacttaaagtataattaaatatatatatatataatgtaaagggagcaaatgcctgctttaagaattttcacttaaaagttataaaatattataaaattatgtacatggagattcaatttagaacactagataa

SEQ ID NO: 5738 - DNA, 201 bp, Homo sapiens
gtacagcacaccaacatggcacatgtacacatatgtaataaacctgcacgttgtgcacgtgtaccctaaaacttaaagtataattaaatatatatatatataatgtaaagggagcaaatgcctgctttaagaattttcacttaaaagttataaaatattataaaattatgtacatggagattcaatttagaacactagata

SEQ ID NO: 5739 - DNA, 201 bp, Homo sapiens
cagtcatgtttagttaaattcttccaattgttggaattgtttcaaaataacatgtcacttttattgtttaagccagaggtcactaatctttttttttttttttttatggtaaacggccaattagtaaatattttcagcactacaggccatacggtctctatcacaactactcaactctgcctttgtagcacaaaaacagcc

SEQ ID NO: 5740 - DNA, 201 bp, Homo sapiens
aagaccctgtttttctttccatagagggtaatagggtggtgtgcagggctgggttatgacttaggagagctctcagctcttcctttgatgacatcctcccsctccccaggtatggaggtgctcctctgacctcctctcccttttcccaagtctaaggcaccagatggggtgagacagtggccagggatgagtggaagagca

SEQ ID NO: 5741 - DNA, 201 bp, Homo sapiens
gcacagctaatttctctctcccttatagcttttgcccacaggtcctactcttccctgcgggacagtaactagtggctcttgtttctcctccacaggacagyccttcgtatgtttgaagactgctctctcatgccctctgcctttcttcctgagaccttcctggaatcatagctcttctctctgtgctcattctgtctgacc

SEQ ID NO: 5742 - DNA, 201 bp, Homo sapiens
tttccacagccttatttttcttagtcctccagagttttcaagagaaccttattccacagacaggaaaaataactaatgggtactaggcttaatacctgggygctgaaataatctgtactacaaacccttgggatatcagtttacctgtataacaaacttgcacatgaaccctcgaacttaatataaaagttttaaaaggat

SEQ ID NO: 5743 - DNA, 201 bp, Homo sapiens
gggagctcagtgatataagcacagattgcaaaactaagccttccctttatcaccctcagtgttcccagtgccttgctcaaatgagaaagaaaaaaaaaaaatcaacctgccaatctggtctttcctgcagtaaatgaaaactagctctgttcctgcatagaacagaagagtccaggcagctaagtcacatgaccggagaca

SEQ ID NO: 5744 - DNA, 201 bp, Homo sapiens
attcctccaggaaggaagcttagaagaaaaaatacttgctagacacatacagatgctgatttaatttttgtaatcccatgtgggtattgcctattcaaaasaaataaatatttttaaaaatgtaatcatagaaacacaatagagttgacacacagagaggtagaaggtaggtaaggatgaagtgaggattaggagctaaga

SEQ ID NO: 5745 - DNA, 201 bp, Homo sapiens
tggtcatcaaactgtcatcttccctggtagtagaatctccctgtctttccctgatgaggacacttgtgattatattgttgggtccacttggataatacagraaaatctccccatatcaagatgcttaacttaatcacattggcaaagccccttttgtcatgtaaggtaacatactcacaaggtcaaggaattagaatataa

SEQ ID NO: 5746 - DNA, 201 bp, Homo sapiens
caaactaacacaagaacagaaaaccaaacactgcatgttctcactcataagtgggagttgaacaattagaacacatggacacagaaaggggaacatcacayactgggcctgtcaggggttgggggctaggggagggatagcattaggagaaacacctaatgtaggtgacaggttgatgagcgcagcagaccaccatcacat

SEQ ID NO: 5747 - DNA, 201 bp, Homo sapiens
atctgatggttttataaagggcagttcccttgcacatgctctcttgcctgccaccatgtaagacatgcctttgttcctgctttaccttccaccatgattgwgaggcctccccagccatgtggaaatgtgagtccattaaacctctttttctttgtaaattacccagtcttgggtatttcttcatagcagtatgaaaataga

SEQ ID NO: 5748 - DNA, 201 bp, Homo sapiens
tttgggaggccaaggtggatggatcacttgaggtcaggagttcaagaccaacctggcaaacatggcaaaacctcatctctaccaaaaatacaaaaaaaaamccccaaaaaattagccaggtatggtggtgcacgtctgtagtcccagctactcctcgggaggctgaggcccaagaatcatttgaaccctagaggcagaggt

SEQ ID NO: 5749 - DNA, 201 bp, Homo sapiens
attatctccttctcagtcttgcttccaacactacccgttcctgccataataatgataaactctcatatctaaaaaataagataaaataaggccggtggcggtggctcacgcctgtaatcccagcgctttgggaggccaaggtggatggatcacttgaggtcaggagttcaagaccaacctggcaaacatggcaaaacctca

SEQ ID NO: 5750 - DNA, 201 bp, Homo sapiens
gcattaggacaaatgcctaatgcatgcggggcttaaaacctagatgatgggttgatgggtgcagcaaaccaccatggcacatgtatacctatgtaacaaamctgcacgttctgcacatgtatcccagaacttaaagtataataattaaaaacaaaaaagataaggacgtcaagttccctccatgttgcttcgaaagacatg

SEQ ID NO: 5751 - DNA, 201 bp, Homo sapiens
gggaagatcacacaccagggcctgtcagggggtagtgggcaaggggagggatagcattaggacaaatgcctaatgcatgcggggcttaaaacctagatgaygggttgatgggtgcagcaaaccaccatggcacatgtatacctatgtaacaaacctgcacgttctgcacatgtatcccagaacttaaagtataataattaa

SEQ ID NO: 5752 - DNA, 201 bp, Homo sapiens
taatatgtctatgtaacaaacctgcacacgcaccccctgaatctctctctctacacgcgcgcgcgcgcgcgcacacacacacacacacacacacacacacmcacacacggttgatggaaaatgaatgctgcctctagatactgactcaacagtctcaactatgttcttacattggcatttttttttttcacctgtctcctt

SEQ ID NO: 5753 - DNA, 201 bp, Homo sapiens
attagaggctcaaacttcagcattacataatatgtctatgtaacaaacctgcacacgcaccccctgaatctctctctctacacgcgcgcgcgcgcgcgcacacacacacacacacacacacacacacacacacacggttgatggaaaatgaatgctgcctctagatactgactcaacagtctcaactatgttcttacattg

SEQ ID NO: 5754 - DNA, 201 bp, Homo sapiens
cattagaggctcaaacttcagcattacataatatgtctatgtaacaaacctgcacacgcaccccctgaatctctctctctacacgcgcgcgcgcgcgcgcrcacacacacacacacacacacacacacacacacacggttgatggaaaatgaatgctgcctctagatactgactcaacagtctcaactatgttcttacatt

SEQ ID NO: 5755 - DNA, 201 bp, Homo sapiens
aacattagaggctcaaacttcagcattacataatatgtctatgtaacaaacctgcacacgcaccccctgaatctctctctctacacgcgcgcgcgcgcgcrcacacacacacacacacacacacacacacacacacacggttgatggaaaatgaatgctgcctctagatactgactcaacagtctcaactatgttcttaca

SEQ ID NO: 5756 - DNA, 201 bp, Homo sapiens
ctacttgggcaacaggaacattagaggctcaaacttcagcattacataatatgtctatgtaacaaacctgcacacgcaccccctgaatctctctctctacrcgcgcgcgcgcgcgcgcacacacacacacacacacacacacacacacacacacggttgatggaaaatgaatgctgcctctagatactgactcaacagtct

SEQ ID NO: 5757 - DNA, 201 bp, Homo sapiens
atatgcaaaaggctaaatctggacccctatcttttactatatacaaaaattaacccaagatggattaaagacttaaatgtaagacctcaaactataaaaaatcctagaagaaacctaggaaatactgttctggacattagcctaggcaaataatttatgactaagtcctcaaaagcaaatgcaacaaaaaaaaattgacaa

SEQ ID NO: 5758 - DNA, 201 bp, Homo sapiens
taaactcaggagacggaggttgcaatgagctgagatcacgccattgcactccaacccaggcaacagtgcaagacgctgtctcaaaaaaaaaaaaaaaaaaagaagaaaatgtttattttgtcagtattttatctttcaagatctagatatcaccttttccttcttccataaatactacaacctcacataggtattttctgt

SEQ ID NO: 5759 - DNA, 201 bp, Homo sapiens
ttgtcgattttattttatagtgtatttctgttttaacaatgtacaataaccaaaaggctcttttaaagaaataaaatgggccgagtgcggtggctcacacytgtaatcccagcaccttgaggggccaaggtgggcggatcatgaggtcaggagttcgagaccagtctggtcaacatagtgaaaccccgtctctactaaaaa

SEQ ID NO: 5760 - DNA, 201 bp, Homo sapiens
tatgacactccttcagctacaaacacacacataccagtatgttctccttctctcacagacacactcacatgtggacacacactcatgcatgcatgcgcgcrcacacacacacaccgagtaacttgattctccatgagactctgccagaaactaaactattgacaaaagtttcctgatgtgcccaactctctaggtgtgctt

SEQ ID NO: 5761 - DNA, 201 bp, Homo sapiens
ttagtgatgtcaagtatttttttcataaacttgtccatttgcatatctttaagagatgtttatttaactcatttgcccatttttaatcggattttttttttgctgttgagttccttgtatattctgcatattaatcccttgtcagttgagtagtttgcaaatattttctctcattctgcaggttgtctcttcactctgatt

SEQ ID NO: 5762 - DNA, 201 bp, Homo sapiens
cggagtttcactgcgttagccaggatagtctctatctcctgaccttgtgatccacccgccttggcctcccaaagtgctgggattacaggtgtgagccaccrcgcccagccaagatgttgttattttaatggctgaatagtattccattgtgtatacataccacattttcttcatctgttaattcagtggttgattcaatgt

SEQ ID NO: 5763 - DNA, 201 bp, Homo sapiens
agctaggactacaggcacccgccactatacccagctaattttttgtatttttagtagagacggagtttcactgcgttagccaggatagtctctatctcctsaccttgtgatccacccgccttggcctcccaaagtgctgggattacaggtgtgagccaccgcgcccagccaagatgttgttattttaatggctgaatagta

SEQ ID NO: 5764 - DNA, 201 bp, Homo sapiens
caatctctctaggctttgtattgcttccttccttcttctctcccctgcatctatcatttctttgcctctattgacttgtatgtatgtatgtatgtatgtadgtatgtatgtatgtatgtatacatgtacgtatgtatgtatttagagatggagtttcgctcttattacccaggctggagtgcaatggcacgatcttggctc

SEQ ID NO: 5765 - DNA, 201 bp, Homo sapiens
ttagctcccacttttaagtaataatatatgatatttggttatctgttcctgtgttagtttcctaaggataatggcctccagctccatccatgtccctgcamaggacatgatctcatccttttcttatggctgcatagtattctgtggagtatgtgtaccacattttcttgatccactctatcactgatgggcaaatattta

SEQ ID NO: 5766 - DNA, 201 bp, Homo sapiens
gtgtgtttttccactctatgtgtccatgtgttctcatcatttagctcccacttttaagtaataatatatgatatttggttatctgttcctgtgttagtttsctaaggataatggcctccagctccatccatgtccctgcacaggacatgatctcatccttttcttatggctgcatagtattctgtggagtatgtgtaccac

SEQ ID NO: 5767 - DNA, 201 bp, Homo sapiens
atgcagatttgttacacaggtaaacttgtgccatgggggtttgttgtacaggttatttcatcacccaggtattaagcctagtgcctattagttactttccmgactctcttcctcctcccaccctccaccctctgcaaggccccattgtgtgtttttccactctatgtgtccatgtgttctcatcatttagctcccactttt

SEQ ID NO: 5768 - DNA, 201 bp, Homo sapiens
gaagctggaaaccatcactctcagcaaactatcgcaaggacaaaaaaccaaacaccacatgttctcactcataggtgggaactgaacaatgagaacacacrgacacaggaaagggaacatcacacatcggggactgttgtggggtggggggcggggagggatagcattaggagatatacctaatgctaaatgacgagttaa

SEQ ID NO: 5769 - DNA, 201 bp, Homo sapiens
gaaaacctaggcaataccattcaggacataggcatggtcaaggacttcatatctaaaacaccaaaagcaatggcaacaaaagccaaaattcacaaatgggrtctaattaaactaaagagcttctgcacagcaaaagaaaccaccatcagagtgaacaggcaacctacagaatgggagaaaattttcgcaacctactcatct

SEQ ID NO: 5770 - DNA, 201 bp, Homo sapiens
tatacacttgagctaataacatttaccattcaagcgagtttgttattgttgttgtcatttacgtgcaatttaatggatgtaaaatactcagcactatagtrcttggtatatagcaagcattcaatatatgtatgactttagcacccaaaagactattagaaaagtacagtacttattcacgtactcgtttacttaatggct

SEQ ID NO: 5771 - DNA, 201 bp, Homo sapiens
agaggtatagagaagaatttctctgaatactgggattcaaactggggtcagggggctcctcctcctgctttcttttttccccattccccaatgtcctctawgtcaatccttctgtcctagacagagaaacttgtgccagaaaacacaggatatcctaaaataactccctacatgctaaaggaaaacgaagtgaacattttt

SEQ ID NO: 5772 - DNA, 201 bp, Homo sapiens
agcaagcacgggctatgtgcaagctgggctgcctatggacaggaagggatcattttcagaggcgtttcaaatcatcttcacgttcttgggtgattttttawaaaaaaaatcattaaatgttatacaactctcatttctctcgtccttcaatattactgcatttctctcatcattcaatattactgtcagttctggcagaaa

SEQ ID NO: 5773 - DNA, 201 bp, Homo sapiens
aagcaagcacgggctatgtgcaagctgggctgcctatggacaggaagggatcattttcagaggcgtttcaaatcatcttcacgttcttgggtgattttttwaaaaaaaaatcattaaatgttatacaactctcatttctctcgtccttcaatattactgcatttctctcatcattcaatattactgtcagttctggcagaa

SEQ ID NO: 5774 - DNA, 201 bp, Homo sapiens
tctgggccccttccaacattgcagttccatgaattttacctaattaaattaattaaagtgggtaatagatttaaagactttggataattattgttttccckacagtagcttttgcagaaatctaatattcttgaattgattaaccattttaaatcacatctcaacaagactgtgagctcctcaagggcagagatttttgtt

SEQ ID NO: 5775 - DNA, 201 bp, Homo sapiens
tccattccactggctgcttgggtcaggctgtaagaaggctggttagacaaaaggcacagacaggatgcagacagtggaggagtttctcccattacccatcyacccactgacaaggtggaagccaggggttttatatttgcaaaaaggaatgaaagaaaattcaactagatactgtccagcaaattacaagaaagaatgttt

SEQ ID NO: 5776 - DNA, 201 bp, Homo sapiens
attaaaagacagagtaatagagtttcaggagtcaaccgtcagagagatgcagaatctaaaagggaacaggcaaggataattgaggcagtgttgtgtgtgtrtgtctccaacttgcttccattccatttaaaagggaacaggcaaggataattgaggcagtgttgtgtgtgtgtgtctccaacttgcttccattccattcca

SEQ ID NO: 5777 - DNA, 201 bp, Homo sapiens
tggtgctatgaagtggtttgccaccaacagagagaataactcagaagggagaaattgcttgtctcactaaactgtatccacagtttggaggatactcaggrtagatccaagagtgcctcgtgttttgaaggcttttgatttgaggagtttggggtggaagtgagtgtccaacagaatttctggatgtgaaggaagataaac

SEQ ID NO: 5778 - DNA, 201 bp, Homo sapiens
aaaagatttccttctgccctttgcccaaacaatacctctttttagaggaaatcaacatggtaaagcagacttcaatttcaaaaaaaaaaaaaaaaaaaaaagagcaaatgcacatttctcattaccaattacagcctgttccaatcattttcaaattaatcatttcctgcctcgtggccctctttgactagcgtactgaac

SEQ ID NO: 5779 - DNA, 201 bp, Homo sapiens
atctttttttttttttttcctgaaaactttaaaatactgtggaacttttcattctctcctctaggttatttaccttgttttaatatttgcattcttttttstctctgtgctgcatttgggtaatttccaatagatgtattttcccgttaatttattcttttgttggtaatatttagctttatgttttaattttatttattt

SEQ ID NO: 5780 - DNA, 201 bp, Homo sapiens
aatatgtatatatattatatattatatacatatataatatatataacttagcacagttcctggttttgttttttggagttttgtctttttttttttttttwttttggtcattattatgtttttctgaccttgctttcccttacccctgcccccaatacccacccaagcttggaacaagacatgggaataaaagggcagaac

SEQ ID NO: 5781 - DNA, 201 bp, Homo sapiens
accactttcttgaaaaatcctctcttccaggacattgcttcctgctgcttccaccatacctccaatcacttctaggaattgcacttttgatcccataatgygacagacttgcacaatagcgcttcatgtctgcagagggattcatatgctacaagatacatttacatatgtggctttctttcatccttactgcaattgtga

SEQ ID NO: 5782 - DNA, 201 bp, Homo sapiens
acattgcttcctgctgcttccaccatacctccaatcacttctaggaattgcacttttgatcccataatgcgacagacttgcacaatagcgcttcatgtctgcagagggattcatatgctacaagatacatttacatatgtggctttctttcatccttactgcaattgtgactcccaaatttacaaagcagacaaagcaggc

SEQ ID NO: 5783 - DNA, 201 bp, Homo sapiens
ttaggtctaggagagctaaccttaatgttctgtttcaaaaactttgagaaagaggacaatttgagttaaagagaaaaaaccttctggcttttgtgcattcragttgatggatctcaatgagaggcacctgaatctcttcctcctgaaaggagagcagttaagaccaaccctcagatggagaggaaagcaaggtgaccttac

SEQ ID NO: 5784 - DNA, 201 bp, Homo sapiens
tcctttcccattggaccatcttatctaacgtagtgtctgcaccccatcactatcatgtcactatgtttttttcttcttcttgatatttattataatctgtkattattagtttgtgtgtctacatgttattttcacaactaaattctaaactgcctgatagaaaatctctatttgatttaccacattatctctggcagcagt

SEQ ID NO: 5785 - DNA, 201 bp, Homo sapiens
ctttttgggggatatgagacttcaagttccatcctctaccatatcaagtcattttttgggaaagagatttggtcctgacacttttctgataacacccattkagaaggtagtgcccactgaggaaagcccactcaaaatggcataacgtgtatgacataaaccctggctagagtgggatccttttaatgagttatagctaac

SEQ ID NO: 5786 - DNA, 201 bp, Homo sapiens
agattaaaatatttcattttgttttatccatcagttgaagtacataaaccatacttttctggtattacaagcaatatcagtgacccaaaaccattcatacratggtacaccaacgcagtataatgtattctttgtgtgtgtgtgattgagtctcgctctgtccctcaggctggagtgcagtggcacaatctcgactcactg

SEQ ID NO: 5787 - DNA, 201 bp, Homo sapiens
agcttaaatggattatcaaaaatgaaaacagtaaatccatagcgctctgaatgtaaggcagtgtccaaaatcctgttagtcaatatttcactgaagagaaygaaacatgaaagtttcactggatgccaacattacatataaatgaagacagtggaagaataagacaatgggcttggagttggtgtccacaaattggtttca

SEQ ID NO: 5788 - DNA, 201 bp, Homo sapiens
aagaataagacaatgggcttggagttggtgtccacaaattggtttcagtttacaatttgctttaagagataaagttatttttgtctctggaaaaatataakaaagttagttgactttaatataactgttttcccaggggggagatttctcaaacaactaaaagtagatctaccatttgatccagcaatttcactactgggt

SEQ ID NO: 5789 - DNA, 201 bp, Homo sapiens
cagttttcctccagagattcacgtttgtcttaaccttccctaatttgggacaaacccacttatatgggagtgccaagggggaattagtgatctgaatttcrtgatattcaacaagatagttacagtcaaaactcatttatgataaccaaacagttaatacaacactttcctttaaagacaaaaataatgctttactatgtt

SEQ ID NO: 5790 - DNA, 201 bp, Homo sapiens
catgaaggtgggcagatttgacagaacaattttttaagagacacgctcttgctctgttgcccaggctgggttgcagtgatgtgatcatggctcatggcagmctggacctcctggcctcaagtgatactcccactttggcctttcaaagtgctgggattacaggtgtgcgacaccatactcaagctggaaaacataattttg

SEQ ID NO: 5791 - DNA, 201 bp, Homo sapiens
cacatcctgtcagtgacttgtactcaaccactctgcttctgtcaacccagaccaccatagagactttactctcttgcctagaggctggatgacctgctgtsatccaccacccttagtgggggggtagtaggaggccacatctgtgtatatttacatgtgatgattagtgacctcaacactgtacagtcatgggatatgtgc

SEQ ID NO: 5792 - DNA, 201 bp, Homo sapiens
gatgccctttccctacctctgttcatttgtatcaccttcattctatgttccttcccttcttcccctatcacaggctcttccttcacctggtcaagatttcyggaagattagagagaagttttaggtgccccaggtttaagattcaaggtcacaggcatatagtggcattctttggtctccctggaaacctcagccagttta

SEQ ID NO: 5793 - DNA, 201 bp, Homo sapiens
gatgtattcaggatttcaacttcaaagaggctgacatttgtgacctcactgataaaattttctccaaaccaaaacaggccttcacaatacatttagcaatyacatattatatctttaaaatcctgatctcaaggactgagatctgggcacttgcatcttgtgtgataatagctgagactggagtttgaaacgaggaagtaa

SEQ ID NO: 5794 - DNA, 201 bp, Homo sapiens
tttcaaagggttgggcacgttcaggtgacagcattcctgccactcacttgattttgacgaacttccgacatggcacggtgttcctcacacacgtctcggtyagggggtctatgtcttccacgatgacgaatggggcctcctccagggtgacgatgctgagatggttgtcatccggctcacagtcggagaaggacttgtacc

SEQ ID NO: 5795 - DNA, 201 bp, Homo sapiens
agagacatccatccgtctcaagggcctttctgccacatatctcaacatatgcatctacttctgtgctaagacaaacgggcataaagagaaaacagaatatrgggcagttctccatcccagccgccctcatccccagaggaatcaacctgcatctctggaggcagtgcccaggcactgatacctttacagccccgcaggtgg

SEQ ID NO: 5796 - DNA, 201 bp, Homo sapiens
ctctctaagattacctcatcatatgggctggaaaatttttgctggctataaagaaacatttcctgtggctaattacaaaattgtccagcattgctgatacmtttctttttaagataggatggcgagtagagcaatttggttaaacacacacacacatgttcatttattcacgctatgatatgtaacaggctggggagaatg

SEQ ID NO: 5797 - DNA, 201 bp, Homo sapiens
tttctttttaagataggatggcgagtagagcaatttggttaaacacacacacacatgttcatttattcacgctatgatatgtaacaggctggggagaatgytgagcgcatcaaattcttcattcattcgacatagatttattgaagacctacgatgtcccagtgccagcctaggaataatgatggctaaaacagaatgact

SEQ ID NO: 5798 - DNA, 201 bp, Homo sapiens
gtaaattaaggcaaagactagcagaatctttggtgatgtcattgaccacatcacaacccccacaccatgggagtcaggcaaaagtttcagtccaacgctcrctcatggagagaaaagttgcaaaggtttatgagcccccagagtgcaataacttcctaaatcttctccaagttctactccctgttcctgacacatccaagt

SEQ ID NO: 5799 - DNA, 201 bp, Homo sapiens
gccaaacttctggttatatttatacacaaccaggacaggcaagcacgcttgtgtgtgtgtgtgtgtgtgtgtgtgtgtgctgtatacatgtacatgtatawgcacatatggatcccattgagttttcaggcatcaacttcattgctacagaacccctctcttctctcctttacatggcacaggacaagagggttcagaatc

SEQ ID NO: 5800 - DNA, 201 bp, Homo sapiens
gtatacatattcctatacatctatacatgaacctctacataaaagcacacttatatacaggtacattcatgcctacccacgctcacattataatcacataygctcacacccacacgtacaactacaaatacacacatacctaacacaaacacatatactcgaacctctacacacacacacacacacacacacacacacaca

SEQ ID NO: 5801 - DNA, 201 bp, Homo sapiens
gccatcattttcttcaggagttcatgtataatcttcagtcctccagagttcctttgttgccagatccctggggaaagataggagtcctatttctttggatyacttttaattctttgtgtgctcttaaaagtgatgggttcttgtaattagctaaaaagttaatagtgttttctctcttttggttctaccttggagtaatat

SEQ ID NO: 5802 - DNA, 201 bp, Homo sapiens
cattttcttcaggagttcatgtataatcttcagtcctccagagttcctttgttgccagatccctggggaaagataggagtcctatttctttggattacttktaattctttgtgtgctcttaaaagtgatgggttcttgtaattagctaaaaagttaatagtgttttctctcttttggttctaccttggagtaatataatgc

SEQ ID NO: 5803 - DNA, 201 bp, Homo sapiens
ccccaatatgcacagtcttccactttgggaaggggcaacattttctttccatgtggagcacaggaggtggggagaaagcagccagaggtggtcttacagtktgcttttactcatgacagttttacttcttccatttgcctgtgaattgactcttctgaggaccttgaattccaccacagaaaatacctctaacagcagagc

SEQ ID NO: 5804 - DNA, 201 bp, Homo sapiens
ctgaatgatattaagaagttttttttccctcagcaaacttgccaataagagttagaaagtggctaagagaggtagactgtgatcctgggctgacagctgaraaagccttttatttattgtgataatcaattcattcttaccagcctgaaaattatgactgaacatgactatagatatgacttctcttactctatggcaagt

SEQ ID NO: 5805 - DNA, 201 bp, Homo sapiens
taaggttacagaacctggaggtatcaatcagtggaacagcatttcatccccctcgcctgtgaaaagttattgcgttgtgagaggtgaaatgtctggaactyggtagcaggtctctgatgggcatttgttcttctgtatctggggcaaaataataaatttaagtttttgagatggacattttccttcttccaaatgaaaggg

SEQ ID NO: 5806 - DNA, 201 bp, Homo sapiens
aaatgctaacagccaaagggtgaaaggtgcaagaaatgcagagggcttcagaagtgagaggcagatctgatgagggaaggaagaaatcatgaaggagtgcratggaggggagttgtgcagtttgcaaaggacctgaaaagtcagagtggaaagaagggatgtgtaggatcagagaacagcatgcacaaaagcttagaagct

SEQ ID NO: 5807 - DNA, 201 bp, Homo sapiens
agtgaacataaaatgtggtaatgtacataaagtggttggctcaggacctgtgatggaatcacagtttaaaaactattaggcactttttttttggaatgatrcaaggaaaactaagctccattcgcttcccacttaaattctctatctcccacagcatggcacaattgcacttgctttgtagaatttgattgaagaaagtag

SEQ ID NO: 5808 - DNA, 201 bp, Homo sapiens
tggaatcacagtttaaaaactattaggcactttttttttggaatgatgcaaggaaaactaagctccattcgcttcccacttaaattctctatctcccacarcatggcacaattgcacttgctttgtagaatttgattgaagaaagtagcagaagttagtagtcaaagcatgggcttcggagtcagacaaatggggttcaga

SEQ ID NO: 5809 - DNA, 201 bp, Homo sapiens
atcttagtctcttcacctattaaaagcaggtaaatgtttctgctttccctgtatacagcatggatgtcaggatctgatacccaaaactaattgttgccctsctttcctatgttagatctgcctgtcctagtttcttcaaacacactttaattgtggaaagaaaacatatgccatcagctataatctgctggaccacataga

SEQ ID NO: 5810 - DNA, 201 bp, Homo sapiens
aatctgctggaccacatagaggccagcacggtaggaatcaacaggaattaggattcttccgattcaaattgtttgtttcaatgttaaagttaaagacaacrtaagtgagaggccattggtttctatgagtcattctacaactccctttaagggaatacgagttgattctcttgtttttccccaactttagatttttttctc

SEQ ID NO: 5811 - DNA, 201 bp, Homo sapiens
ctgtagctacagaggcaggctgacagagccacttgtagccagaagcagattgctggggggagcagctctctgttctgtccattttcttagggacagatgtyattcctgtctgttccatcagcaggcaaatggggaaataatagaacagagacaatggaaagaaagtgagaagcaggcccagacagcagccactgagctcca

SEQ ID NO: 5812 - DNA, 201 bp, Homo sapiens
gaaataaagaaaaataatgtttgtggttcagttactagaatggataagatgactgtcaccctttggatagctcttctttatcctttaggacttggtcctarcttaggtctttcaggaagttttttcacctccccagtgcccaggctggagtaggtgtcccagtgtgccatgtgcacctctcctgtttatgctcatttcaca

SEQ ID NO: 5813 - DNA, 201 bp, Homo sapiens
tctccattatctcaggtagcagagcatattacatatgtgtcaaagaaaatgctaaaccatcacagctatgcttgatgcactgctacctttctacccctacrtcctcatgtcctcacctgtttacccccacatccgcacgtcctcaccacctgcttctttgtttgatcaccaataaatagtgtgggcttccggagctcaggg

SEQ ID NO: 5814 - DNA, 201 bp, Homo sapiens
agctcagggcctttgcagcctccatacactagcgttggcctcctggacccaccttatatactcttaacctgtcttttcccattcctttgactctgccggaytttgtagcccccacagcctggtgttgggtctgatcaccccaacattccctaaaatcccggggatattttattagtcatctctgcttcgcctgtacctact

SEQ ID NO: 5815 - DNA, 201 bp, Homo sapiens
gattttgtagcccccacagcctggtgttgggtctgatcaccccaacattccctaaaatcccggggatattttattagtcatctctgcttcgcctgtacctrctacaggcctggcactgagtcagtaatcagtgaatgcttggtaaacagatcaatagtgggtaagtgggtgggttcaagagtgaatggatgcccatatggc

SEQ ID NO: 5816 - DNA, 201 bp, Homo sapiens
ttttgtagcccccacagcctggtgttgggtctgatcaccccaacattccctaaaatcccggggatattttattagtcatctctgcttcgcctgtacctacyacaggcctggcactgagtcagtaatcagtgaatgcttggtaaacagatcaatagtgggtaagtgggtgggttcaagagtgaatggatgcccatatggctg

SEQ ID NO: 5817 - DNA, 201 bp, Homo sapiens
taaagaatacgagttaagtccacacaaaagcctaggtattgtcatacccccaacttccactcaacttccaaggcagataccatccctgtgaatctccacawcctatatgaaaatttccatcattcatcctaggaactgtgcaaagtactggaacaagcactaaacttggagactcacaagacctaaatttgaatcctttct

SEQ ID NO: 5818 - DNA, 201 bp, Homo sapiens
aatcctttctcagctattaattttttaaaaatcatagaacatctctaagtttgcatgactcaaatatgaaatcagagactcacttcacagggttattatgyggctaaagtgaaataataagtacagaaggccatactgtaaggtttggtatagaataggtgctcaacaaatgcttactatttatttacgtcatattcagac

SEQ ID NO: 5819 - DNA, 201 bp, Homo sapiens
aagtacagaaggccatactgtaaggtttggtatagaataggtgctcaacaaatgcttactatttatttacgtcatattcagacaactactacagtcaatcyccttcctctacttgctttcaaacttattttagaaatattttatttttccccaaatggaagctcactttgaacctcaacataacataccaatcagatgaag

SEQ ID NO: 5820 - DNA, 201 bp, Homo sapiens
ctacccacccagagaccctggtggcactctaagttctgaaaggaatcagcattcaagggaatataattagaaaagaaaatttgccttaaagtccactgttwctttgttctctctctctcgtctccctcttcccccttctctctcccccttcctctccccagttccgtcttcctctctccctctcccccctctctctcccct

SEQ ID NO: 5821 - DNA, 201 bp, Homo sapiens
tgatgttacaactgcaacaacaacaacaacaacagcaacaacaaaagaaccagtgcaagacacacacacacacacacacacacgcacacacagttgcacasacacatgctttgggagatggcatcacttatttcagttgaatgtgttaatttgctagagatctactatattttcctcactgtgacctaacatattgtactg

SEQ ID NO: 5822 - DNA, 201 bp, Homo sapiens
agtttctcctaagcattgctactgagcagtatattccaaaggaagaaagaagcacaaaagctaagaagcaagaatcttgataacaggatgacctaaataamaccatttcagggttacacagagtaagtctatgccctaaagcagtagctttacatctttaatgggcatgagaatcactagggaggcttataaaacatgcag

SEQ ID NO: 5823 - DNA, 201 bp, Homo sapiens
agagtctttccattcattctccaaatccttattgagcctctgctattgaataccagagatataatggtaaaggagagactgaaaacacaccatgagctctmagtgctagccgtggccagaattcatggctttaccaatgggctgctattgtctttctaagcaaagagagttgtaatatgtttctccctgccggtagaatgt

SEQ ID NO: 5824 - DNA, 201 bp, Homo sapiens
cacacacacaacacacacacacacacacaaacacacacagaagcaaactgacactaacaacctgcatgttttcttgagatcttgaaactcactgggccctrctaggctaaatgtggtagtagtgatgggaaagagatggcaaggagagggagctaaaatacaataatttagataggagggagctatagcattctataatta

SEQ ID NO: 5825 - DNA, 201 bp, Homo sapiens
gcctggtaacagagtgagaccatgtctctaaaaaaaagttaaaaattacaaggtctgggagatgcaataaatgcctataccctgagttctaattagctggkttcaggtagaatcaattgcatccagtgagaggaaaggaagcagacacctttctaagggtaggaggaggaactccctaaatttctcctctagaatacctcc

SEQ ID NO: 5826 - DNA, 201 bp, Homo sapiens
caggcggacctccacttacatccttcttccatcacacaccagctgggagatcttaagctggtcactaaccagagagaaactctggttctctgaaccagaayttccatctctgaagcagggagaagaatacctactttagaagtgctattaaacaaatacctactcagatgactaaatgagataatgaatgtaaaattgtca

SEQ ID NO: 5827 - DNA, 201 bp, Homo sapiens
ggctccggtggatcaactgaaggatcaatacaagaggtgatcaataagcaatggatattgttattataattggtattcatgtcagggggttaaatatgaawgctcagtgaaaactgttagttaattgtgctgggtatcccgatctgaaggatttaaggttttgttgttttgttttgagacaaaaccttgctctgtcaccca

SEQ ID NO: 5828 - DNA, 201 bp, Homo sapiens
ctcccaggttcaagtgattctcctgcctcagcctcctgagtagctgggattacaggcaccaccaccatgccgggctaattttttgtatttcagtagagacragatttcatcatgttgcccaggttggtcttgaactcctgagctcaggcaatctgactgccttggcctcccaaagtgctaggattacaggcatgagccacc

SEQ ID NO: 5829 - DNA, 201 bp, Homo sapiens
aagatttgtgtgtgtatgtgtacgtttattaaaaaacaaacaaaaaaaacacacacacagtttttggccaggcgcgtggctcacgcctgtgatctcagcamtttgggaggctgaggcgggtggatcacttgaggtcaagagtctgagaccagcctggccaacatggtgcaactatctctaccaaaaatataaaaaattagc

SEQ ID NO: 5830 - DNA, 201 bp, Homo sapiens
ttatcattctgactaaagtattttctaatgtctttctgatttcttctttgacctataggtttagaagtgtgttgccatttccaaatatttggagattttcyagatatatttttgttactaatttttattttaatgctgttatgatcaaagaatgcaccctccattatttcaattcttctaaacacattgagacttttgttt

SEQ ID NO: 5831 - DNA, 201 bp, Homo sapiens
atttgctatatgtcaggactcagctagttggttcagggtaaataagaaaatgaacatgattcccaccctcaagaagtttagagtctaagggggaggatagwcatgaattgattaaacacagatttatgacaaatgatacaagggacgggagagtatgctataagaaagtgaaataggggtgaggcaaggctgaggaagtgc

SEQ ID NO: 5832 - DNA, 201 bp, Homo sapiens
tgagatcaggtgaggctgagaagatgaataggaacagaaagtgcaggattttagagaccatgttaaatgtctgtcttaaaaccgtgggaaggtgcaggcayggtggctcacacctgtaatcccagcactttgggaggctgaggtaggggaatcacctgaagtcaggagttcgagaccagcctgaccaacatggagaaaccc

SEQ ID NO: 5833 - DNA, 201 bp, Homo sapiens
cattcatctatccatcaatccatcaatacatttacctgtccattcatccatctatcaatacattcatcaatccattaatccatccatccatccatctatcygtcaatacattcattaatacgttcatccattcttccatccattaggcatgtttgagcatctcctatgtatcacaccctgtaccagaactatgccatgaaa

SEQ ID NO: 5834 - DNA, 201 bp, Homo sapiens
aagttgggggcaagtgggaaagtaacttgggagaggacgctagagacagacgcaggagtcagataagcaagtactatatagactgagtttagacttcatcytgtgtttatttggaatggaggcttgaaatgcaagtttgtaagaggcagatgggcaaacagatgaggctttgtagtaacgcaagcaaggaatagagacgac

SEQ ID NO: 5835 - DNA, 201 bp, Homo sapiens
agactgagtttagacttcatcttgtgtttatttggaatggaggcttgaaatgcaagtttgtaagaggcagatgggcaaacagatgaggctttgtagtaacscaagcaaggaatagagacgacggtcaaagaaagcaacaggtggaatgaagagattggacagataggcaggcaactgcaatggaatttcagtacaaaaact

SEQ ID NO: 5836 - DNA, 201 bp, Homo sapiens
ttgtagtaacgcaagcaaggaatagagacgacggtcaaagaaagcaacaggtggaatgaagagattggacagataggcaggcaactgcaatggaatttcartacaaaaactaccgacaaagaccaccaatggcctttacctcagctagcgaaaataagttaccagtcactctgtacctgctgccctaagttgataattagg

SEQ ID NO: 5837 - DNA, 201 bp, Homo sapiens
cccagccaaaacagtgattgttttaatcaagaaggtagcatacgcagttgagcacctttctttggatttacttaaaatctccttctttaatttcccatctmcatgttctccacttgttcccttttcttccatttggtagtaaaatcagatggaattagcagagtgattactgagacgcaaacactgttcttcagattatat

SEQ ID NO: 5838 - DNA, 201 bp, Homo sapiens
taaaaatacacacagaattttgaagacttcgtatttttcaaaagagtaaaaggtctcataaataattttaggttgatttcatgttggagtagtttaggcawgttgggttaaataaaatatattattaaaattaattttatctgcttctcttcacttttttaatgggctaccagaaaatttaagttacatgtgacttgcatt

SEQ ID NO: 5839 - DNA, 201 bp, Homo sapiens
tttttaactggtagactgtaatcatggaagcagggacctcatctgccttgcttagtattatatttctagtgctaaacagggtgtgcgccacagagctggtkctgaacatgtgcagaatgaataaaagaataacttgctgcttctatgttgttgaggtttcatgacatcgaggaaagagaataggctttacagtgagacagt

SEQ ID NO: 5840 - DNA, 201 bp, Homo sapiens
ataaaagcagggattttgcctggtttttccttctgctgctttttctcccttgaagaacctagaatactacctggtataaagtagatgctcaatgcaaattygtggaatgaacaaaagtctcaactctctgtctttttgttttctttcgtttttccttttgatgatgagccctactttgtctctctgtccagtgggtgtcta

SEQ ID NO: 5841 - DNA, 201 bp, Homo sapiens
tcatcaatatcctcttttcttctgccttagtaacagaaattctatttttagaggggcacagaacctccaataataaagcttacatttctagcttccctagyagctaggcatgaccctatgacaattttctggataataggaagacagaaggtatgatatgcataacttataggaagtactgtaaaagaaggaggtgagccc

SEQ ID NO: 5842 - DNA, 201 bp, Homo sapiens
gaacctccaataataaagcttacatttctagcttccctagtagctaggcatgaccctatgacaattttctggataataggaagacagaaggtatgatatgyataacttataggaagtactgtaaaagaaggaggtgagcccgtctttgttccttcctccttccttctagttgcaatgcagatatgatggctggagcagtag

SEQ ID NO: 5843 - DNA, 201 bp, Homo sapiens
aagctacttttatgttttagaatttctgccatttaaaaaaataattttagctgagttaagcagtcaactggttatttgaaccaaaatctttcagatttcawaggctttgaattaaggcgcaccagcactcatttaacctccctacacctcagttgccctctctgaaaaatgggggggtggtaccacacacttctttatttt

SEQ ID NO: 5844 - DNA, 201 bp, Homo sapiens
tagaatttctgccatttaaaaaaataattttagctgagttaagcagtcaactggttatttgaaccaaaatctttcagatttcataggctttgaattaaggygcaccagcactcatttaacctccctacacctcagttgccctctctgaaaaatgggggggtggtaccacacacttctttatttttccaactctacgatatt

SEQ ID NO: 5845 - DNA, 201 bp, Homo sapiens
atcgcgtgccaccatgcccagctaatttttttgtatttttagtagagacggggtttcactgtgttagccaggatggtctcaatctcctgacctcatgatcygccacctcggcctcccaaagtgctgggattacaggcgtgagtcaccgtgcccggcctctcttggttttcttaatccattcctcatgtgacagcacttagc

SEQ ID NO: 5846 - DNA, 201 bp, Homo sapiens
cacctcggcctcccaaagtgctgggattacaggcgtgagtcaccgtgcccggcctctcttggttttcttaatccattcctcatgtgacagcacttagcaayacattgtctcctgctattctctgaggattccactttcacacatttggtcccaccaggagcaaaggtcagatcttcccttctgtcatttatgtttatccag

SEQ ID NO: 5847 - DNA, 201 bp, Homo sapiens
gcctcccaaagtgctgggattacaggcgtgagtcaccgtgcccggcctctcttggttttcttaatccattcctcatgtgacagcacttagcaacacattgyctcctgctattctctgaggattccactttcacacatttggtcccaccaggagcaaaggtcagatcttcccttctgtcatttatgtttatccagcagactt

SEQ ID NO: 5848 - DNA, 201 bp, Homo sapiens
atccgcccgcctcagcctccgaaagtgctgggattacaggcgtgagccaccactcccggccaactatacagaattcttaataaggcaagctgaagctgacrgcaatttacaagtcagggaaataagaatcaactggtcaaggaacacatcaaaactgggaggacttgaatcaagtccaccacccttaataatagccacctt

SEQ ID NO: 5849 - DNA, 201 bp, Homo sapiens
ctacatgacaggtttgttgtgagaattagattgattaataaatagaatttagcacagtatgccagacacactctaggcacttgataaatgctaattactgyagatgtgataatacctttggttgttgttaattaatcaacatctgtacttccttcctgggattattgagagtgctgcaacaatttctcatctgccaattat

SEQ ID NO: 5850 - DNA, 201 bp, Homo sapiens
gaggggggatggatagcactaggagatatacctaatgtaaatgacgagttaatgggtgcagcacaccaacatggcacatgtatacatatgtaacaaacctrcacgttgtgcacatataccctagaacttaaagtaaaaataaaaataaaaataaaaaaagttaaaaaaatgtgtgtgtgtgtgttcattttaactgataac

SEQ ID NO: 5851 - DNA, 201 bp, Homo sapiens
attgattttaattttccttctttttttttttttttttttgagacaaagtctcactctgtcacccaggctagagcgcagtggcatgatgttggcttgctgcmacctccacctcccaggttcatgcaattctccctgcctcagcctcctgagtagctgggattacaggggcctgccaccacatccagctgatttttgtatttt

SEQ ID NO: 5852 - DNA, 201 bp, Homo sapiens
atcgtgccattgaactccagcctgggcgacaagagcaaaactctgtctcaaataataacaataataataataataataataataataataataataataataatttcactcttatgtctgtccccagaacaataacaaaattaagacttaaccttctaccttgtaacagcccatggagtatctgaacacttctcccatatc

SEQ ID NO: 5853 - DNA, 201 bp, Homo sapiens
gatcgtgccattgaactccagcctgggcgacaagagcaaaactctgtctcaaataataacaataataataataataataataataataataataataataataatttcactcttatgtctgtccccagaacaataacaaaattaagacttaaccttctaccttgtaacagcccatggagtatctgaacacttctcccatat

SEQ ID NO: 5854 - DNA, 201 bp, Homo sapiens
agatcgtgccattgaactccagcctgggcgacaagagcaaaactctgtctcaaataataacaataataataataataataataataataataataataataataatttcactcttatgtctgtccccagaacaataacaaaattaagacttaaccttctaccttgtaacagcccatggagtatctgaacacttctcccata

SEQ ID NO: 5855 - DNA, 201 bp, Homo sapiens
atgacaacctgtaggggcaggcacccaggacacaagcctcttccagaccagctctccaatttgaccccagatccctaccctcagacctgtggatgaagctrtccctcctctgcattcccatggtcccgtgaatacaatcatactgcacttgcattatgagtctctccagctagattctgaaacaaattgataacagatgca

SEQ ID NO: 5856 - DNA, 201 bp, Homo sapiens
gaggagaggaaggcttagattgtgaactcaattctgctcctccatgagccagccttccctctacagctcatcttcagctgtgggggatgacaacctgtagkggcaggcacccaggacacaagcctcttccagaccagctctccaatttgaccccagatccctaccctcagacctgtggatgaagctgtccctcctctgcat

SEQ ID NO: 5857 - DNA, 201 bp, Homo sapiens
ccccttctgccatgattgtaaatttccggaggcctcccagccacactgaactgtgagtcaattaaacctttttcctttataaattacccagtcttgggtaygtcttcattagcagtgtgagaacgaactaatacaacttaactatttgatgaagggaaaaatggacacacttatcttttaagtcattttaaattatttcgc

SEQ ID NO: 5858 - DNA, 201 bp, Homo sapiens
tgttggcttccccttctgccatgattgtaaatttccggaggcctcccagccacactgaactgtgagtcaattaaacctttttcctttataaattacccagwcttgggtatgtcttcattagcagtgtgagaacgaactaatacaacttaactatttgatgaagggaaaaatggacacacttatcttttaagtcattttaaa

SEQ ID NO: 5859 - DNA, 201 bp, Homo sapiens
gcacacacagcccagcagaacacacgtgcagagcacaaatacagtagaacttcctagagcattgcttttacttgtgatatggtttggctgtgtccccacayaaatctcatcttgaattgtagttcccatcatcctcacgtgttgtgggagggacctggtgggaggtaatttaatcatgagaatggttacccccatgctgtt

SEQ ID NO: 5860 - DNA, 201 bp, Homo sapiens
aaagtggccaaaatgttgtgaaggtgccatggaaggaaacaaaacttaagaaattcttctgatcaaaaaaacagaggttgtggagtcaggagacctgagtycagggcccagctctgttacctgcctaccagcagtgtcaccaaaaataagcttctgtgattccctgggcttcactttcctcctctctacaatgagggtggt

SEQ ID NO: 5861 - DNA, 201 bp, Homo sapiens
ctttaaaatgtttagaatggcagattctatgttatgtgtattatatcacaataaaaaattagtcaaagtggccaaaatgttgtgaaggtgccatggaaggraacaaaacttaagaaattcttctgatcaaaaaaacagaggttgtggagtcaggagacctgagttcagggcccagctctgttacctgcctaccagcagtgt

SEQ ID NO: 5862 - DNA, 201 bp, Homo sapiens
accattcacaatagctaacagatggaaacagcacaaatgcccatcaatggttgaatagataaattaaatatagtatatccatacaatggaatattattcarccatgaaaaggaataaagtactgattcatgctacgacatggatggaccttgaaaacattatgctaagtgaaagatgccagatgcaaaaggtcacataaca

SEQ ID NO: 5863 - DNA, 201 bp, Homo sapiens
ccagagacgggtaatttatagaggaagaggtttaattgactcacagttctgcatggctggggaggcctcagaaaacttacaatcatggcagaagatgaagrggaagcaaataccttcttcacggggagacaggaaagagtgtgagcatgcaggaaagactaccatctataaaactatcagatctcatgagaattcactcac

SEQ ID NO: 5864 - DNA, 201 bp, Homo sapiens
atgaggaggatcaccccaaaatacaagcgtagcttctaccttaaaaacagaaatgaaaacccttatgtgacctcgtgtccctctgtagataattctccatktctctctgttcccttttatagcaaaaatgatctagagagttggctataaccaccctgcctacttctgtgctattctttcctctgcgaactctggtcaggt

SEQ ID NO: 5865 - DNA, 201 bp, Homo sapiens
atggtggtacacacctgtggccccagctactcaggagcctgaggtgggaggatctcttgagcctggtagggcagagcttgcagtgagctgagattgcaccrctgctctccagcctgggtaacacagtgaggccctgtctcaaaaaaaaaaaaaaagaagaagaagaagaagtgtatacagggtccaaccatagcaaaatca

SEQ ID NO: 5866 - DNA, 201 bp, Homo sapiens
taagcagatcatttgagctcaggagttcgagaccaggcttgggcaacatggtgaaacaccgtctctactaaaaatacaaaaaaaaaaaaaaaaaaaaaaaatagccaggcatgcaggcatggtggtacacacctgtggccccagctactcaggagcctgaggtgggaggatctcttgagcctggtagggcagagcttgcag

SEQ ID NO: 5867 - DNA, 201 bp, Homo sapiens
ataatgtgaaagaattaattgtagaagtgtactgtaatcccagcactttgggaggccgaggtaagcagatcatttgagctcaggagttcgagaccaggctwgggcaacatggtgaaacaccgtctctactaaaaatacaaaaaaaaaaaaaaaaaaaaaaaatagccaggcatgcaggcatggtggtacacacctgtggcc

SEQ ID NO: 5868 - DNA, 201 bp, Homo sapiens
gataatgtgaaagaattaattgtagaagtgtactgtaatcccagcactttgggaggccgaggtaagcagatcatttgagctcaggagttcgagaccaggcytgggcaacatggtgaaacaccgtctctactaaaaatacaaaaaaaaaaaaaaaaaaaaaaaatagccaggcatgcaggcatggtggtacacacctgtggc

SEQ ID NO: 5869 - DNA, 201 bp, Homo sapiens
atgataatgtgaaagaattaattgtagaagtgtactgtaatcccagcactttgggaggccgaggtaagcagatcatttgagctcaggagttcgagaccagscttgggcaacatggtgaaacaccgtctctactaaaaatacaaaaaaaaaaaaaaaaaaaaaaaatagccaggcatgcaggcatggtggtacacacctgtg

SEQ ID NO: 5870 - DNA, 201 bp, Homo sapiens
tgcatatccactcatccatttattcaacattttttttttgagatggagtctcgctctgtcgcccagactggagtgcagtggtgcgatctcggctcactgcracctccacctcccgggttcaagcaattctcctgcctcagcctcctgagtagctgggattacaggcgtgtgctaccacgcccgactaatttttatattttt

SEQ ID NO: 5871 - DNA, 201 bp, Homo sapiens
gcctttaatctcagcattttgggagaccaaggcaagtggatctcttgagcccaggagtttgagaccagcctgggcaaaatggtgaaaccccatctctacaraaaaacacaaaaatgagccaggcatggtggcacacacctgtagtaccaactactagggaggctgaggcaggaggattgcttgagctcaggagatggaggt

SEQ ID NO: 5872 - DNA, 201 bp, Homo sapiens
tgggtgcagcaaaccaacaggggacatgtatacctatgtaacaaacctgcacattgtgcacatgtaccctagaacttcgagtataataataataaaaaaaraatttagggagtgtaatggccttccttcattttatcttctctgttcccttctgtccaaattgccaatgtttatgctggtaggaaatttcaaaaaccttat

SEQ ID NO: 5873 - DNA, 201 bp, Homo sapiens
aaatcccatctcttctaaaaatacaaaaattagccgggcgtggtggtgcatgcctgtaatcctagctactcaggaacctgaggcaggagaatcgcttgaamccgggaggcagaggttgcagcgagctgagattgtgccactgcactccagcctgggcaacagaatgagcagaacaagacaccgtctcaaaaaaaaaaaaaa

SEQ ID NO: 5874 - DNA, 201 bp, Homo sapiens
acatagtgaaatcccatctcttctaaaaatacaaaaattagccgggcgtggtggtgcatgcctgtaatcctagctactcaggaacctgaggcaggagaatygcttgaacccgggaggcagaggttgcagcgagctgagattgtgccactgcactccagcctgggcaacagaatgagcagaacaagacaccgtctcaaaaaa

SEQ ID NO: 5875 - DNA, 201 bp, Homo sapiens
gagatgtgaaatagtctgggcttggtggctcgcgcctgtaatcccagcactttgggagactcaggcaggcagatcacttgaagtcaggaattcaaggccascctggccaacatagtgaaatcccatctcttctaaaaatacaaaaattagccgggcgtggtggtgcatgcctgtaatcctagctactcaggaacctgaggc

SEQ ID NO: 5876 - DNA, 201 bp, Homo sapiens
cctgacccaccatggatcttgtattctcttcactaatatccctctgcctagagtggcaaaacaggaagagtaattcgccattattattagcatgttattaytgttattattactactactgttattattttacttatgagcgcttatgatgtgtcaggcactgcactaagcattttaccaccattattctcctctaagctc

SEQ ID NO: 5877 - DNA, 201 bp, Homo sapiens
tcattttgcttttcttaattataagaataatgcaaagtcccatcaacaacatttttgtgtgagttgatggatttctttatatatatatattttttttttttgagataggatctcgctctgtcgcccaggctggaatgcagtggcacaatcagagctcactgcagcctcaaattcctaggctcaagtgatcctcctgcctca

SEQ ID NO: 5878 - DNA, 201 bp, Homo sapiens
tactgaattttcattttgcttttcttaattataagaataatgcaaagtcccatcaacaacatttttgtgtgagttgatggatttctttatatatatatatwttttttttttgagataggatctcgctctgtcgcccaggctggaatgcagtggcacaatcagagctcactgcagcctcaaattcctaggctcaagtgatcc

SEQ ID NO: 5879 - DNA, 201 bp, Homo sapiens
cttactgaattttcattttgcttttcttaattataagaataatgcaaagtcccatcaacaacatttttgtgtgagttgatggatttctttatatatatatattttttttttttgagataggatctcgctctgtcgcccaggctggaatgcagtggcacaatcagagctcactgcagcctcaaattcctaggctcaagtgat

SEQ ID NO: 5880 - DNA, 201 bp, Homo sapiens
agaggcatgcggctgtcagatgtctcccagaaagtttcactttgattagttagttcctgatgcttatttcctaaaaggctctttttgtcccccaccccccmaaaaaatggggagcattaaaattttaaaaaaggaattagatgaatatcctgctaaatgtaacttggcaagatgaaaggaagcagcaaagaaacatgaaaa

SEQ ID NO: 5881 - DNA, 201 bp, Homo sapiens
atgagctattttctcccaaatcctgtaattgcctggagcacgtgatctttttgaaggtcattagaggcatgcggctgtcagatgtctcccagaaagtttcrctttgattagttagttcctgatgcttatttcctaaaaggctctttttgtcccccaccccccaaaaaaatggggagcattaaaattttaaaaaaggaatta

SEQ ID NO: 5882 - DNA, 201 bp, Homo sapiens
aggttcggctattcagaatgagctattttctcccaaatcctgtaattgcctggagcacgtgatctttttgaaggtcattagaggcatgcggctgtcagatstctcccagaaagtttcactttgattagttagttcctgatgcttatttcctaaaaggctctttttgtcccccaccccccaaaaaaatggggagcattaaaa

SEQ ID NO: 5883 - DNA, 201 bp, Homo sapiens
attgctactgggttcctgaatactcttttcacaaaggcttcacgtcagatgaacttcaagcaccaagcagcagggatcccactgaagtttattcagcgccmttctgggcactaccagctgtgaaactggtaacctattgacaaataggttatttttccagctgcacccatattcaagagcttgaccaacaaagtcccctga

SEQ ID NO: 5884 - DNA, 201 bp, Homo sapiens
gattgctactgggttcctgaatactcttttcacaaaggcttcacgtcagatgaacttcaagcaccaagcagcagggatcccactgaagtttattcagcgcmcttctgggcactaccagctgtgaaactggtaacctattgacaaataggttatttttccagctgcacccatattcaagagcttgaccaacaaagtcccctg

SEQ ID NO: 5885 - DNA, 201 bp, Homo sapiens
aagattgctactgggttcctgaatactcttttcacaaaggcttcacgtcagatgaacttcaagcaccaagcagcagggatcccactgaagtttattcagcrcccttctgggcactaccagctgtgaaactggtaacctattgacaaataggttatttttccagctgcacccatattcaagagcttgaccaacaaagtcccc

SEQ ID NO: 5886 - DNA, 201 bp, Homo sapiens
ctcctgctcaaaatgtccatagtgccaaggttaaatcttgatattataacctaaggttcccatcccaacttgaccaattaatcattttataactttctccrttctcctatttaacctactgggctttaaagccagtggccctttttcttagcttcctcattcatgaaacagttttctggggaggccctagaattttacctc

SEQ ID NO: 5887 - DNA, 201 bp, Homo sapiens
agagtccagggatgttgctatatatcttacaatgcacagaacagcccctcccacagcaaagaattctcctgctcaaaatgtccatagtgccaaggttaaakcttgatattataacctaaggttcccatcccaacttgaccaattaatcattttataactttctccgttctcctatttaacctactgggctttaaagccagt

SEQ ID NO: 5888 - DNA, 201 bp, Homo sapiens
gtgaatagggctgcagaatacatatgtatgcatatatctttatataattatttatattcctttggggatatactccataatgagactgctgggttgattgrtaattctgttttaagttcttttaggaatcatcacactgctttccacaatggctgaacaaatttacattcaactgggggagatttttaccaccaggaaatg

SEQ ID NO: 5889 - DNA, 201 bp, Homo sapiens
catgtatttgctattgtgaatagggctgcagaatacatatgtatgcatatatctttatataattatttatattcctttggggatatactccataatgagaytgctgggttgattgataattctgttttaagttcttttaggaatcatcacactgctttccacaatggctgaacaaatttacattcaactgggggagatttt

SEQ ID NO: 5890 - DNA, 201 bp, Homo sapiens
cccccaggagctcttatctttagagacgcatattgaaaagtatagagatgaaatgataggatgttgggaatttgctccaaaataatctactgtgggtggcrataaaatgaattaagattgtccatgagttgataaatgctgaagctggatggtgagtataggagagttatctctgcttatgattagagttacctctatttt

SEQ ID NO: 5891 - DNA, 201 bp, Homo sapiens
ccccccaggaaatggtgctttcctggctctgcctctggctcttcccgggccgctgccccctcagccatgtggcacttctgagctcctgacctaggccaagrggaggtctctgcccccttccccggtcctgggctacccttgggtcctggctccttaggccattcccctgtccctggccccggggaggaggctgccctgctc

SEQ ID NO: 5892 - DNA, 201 bp, Homo sapiens
agcacaccagcatggcacatgtatacatatgtaactaacctgcacattgtgcacatgtaccctaaaacttaaagtataataataataaaattaaaaaaaawtttattttttttgtgggtacatagtaggtgtatatatttatggggtacatgagatgttttaatacaggcatgcaatgtgaaataatcacatcatggaaaa

SEQ ID NO: 5893 - DNA, 201 bp, Homo sapiens
tcaggaaacatcctttctgagaaaacatttaggctgagaagctaattaagaaataacagagaaaactaatgaaacccaaagctgattctctttaaaaaaamaaaaaaaaacaaaattgataaacctaggtagactgatcaagaagaaaagagactatcagaaataaagtctggtgcattactacagactttcagatattaa

SEQ ID NO: 5894 - DNA, 201 bp, Homo sapiens
ataacaagatatatccatgtaggaagatggatgaggaaagcagggtggatctgtctcccccaaaggaaaccacaaggcataaacagcagcagtccccagargacaatgtacacacaacctctttcctccaactctggtgttgaaactgccctgagctgactttaaatccactgcaggtagttgcatgaggagtacttacag

SEQ ID NO: 5895 - DNA, 201 bp, Homo sapiens
tatgcaaaggtatatgtatatgcacatacatgcatacatgtgtatagatatatgtacagtatagcctgccagctatgttaaaagaagttttttgcaaagcyaccttttgtgtatggaactgtgtgtgaaaaaagacttatagaactgtgagaaacttggataaaatgaggcatgcgtacttccccatctgaaatagccaag

SEQ ID NO: 5896 - DNA, 201 bp, Homo sapiens
cctcggtgacaaggcaagactctatctccaaaaataataattctaaataaagcaaaataaaatgtatgcataaacatatatatgcaaaggtatatgtatawgcacatacatgcatacatgtgtatagatatatgtacagtatagcctgccagctatgttaaaagaagttttttgcaaagccaccttttgtgtatggaactg

SEQ ID NO: 5897 - DNA, 201 bp, Homo sapiens
ggcttgaacccaggaggtgggggttgcagacagctaagatcgtgccactgcacgccagcctcggtgacaaggcaagactctatctccaaaaataataattytaaataaagcaaaataaaatgtatgcataaacatatatatgcaaaggtatatgtatatgcacatacatgcatacatgtgtatagatatatgtacagtata

SEQ ID NO: 5898 - DNA, 201 bp, Homo sapiens
gtcctgattccctaggcaaaaagtgcaaagcataccgaaaaataaatatccagccttaaaaaatcagtacaacaatcccttggctcccatcaacatcgtaraccccactgtgtgcaggggccgcagtcgacggcagggtatgaggagaaacaggacaggtttccatgtcccttgtgagcgcagagtgtaggaggaagattg

SEQ ID NO: 5899 - DNA, 201 bp, Homo sapiens
tttcccaggtacttatgccctctcaataaacttcttgtgcccctaactccatctcagcatctgtttcctggaagatccaactggctcaccttggagagaamagaaactaaaagccacaacatgaagcgtatacaagaaccaggtaagttaagtaactcagagctatctcttgtcccaaaggatgaaaacctccgagcgccg

SEQ ID NO: 5900 - DNA, 201 bp, Homo sapiens
gaataaaagactacaaattggattaaatgtatactgctcgggtgatgggtgcaccaaaatctcagaaatcatcactgaactactcatgtaaccaaataccwactgtcccccctccccccccaaaaaaaaacctatggaaattttagaaaaggaaaaataaataaataaaactagtattgatttgggttatttcagtttgtg

SEQ ID NO: 5901 - DNA, 201 bp, Homo sapiens
caggtaactaatagtgttcttctttttcaattttttttaaattgtggtaaaacacacacacacacacacacacacacacacacacacacacacacacacamtttactctcttggccggtcagcatagacttccagccccacatcacctttcccaaatgtcttccaaggggcaaagtccagacacaacagtgaaagtgtgga

SEQ ID NO: 5902 - DNA, 201 bp, Homo sapiens
ttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaagcgt

SEQ ID NO: 5903 - DNA, 201 bp, Homo sapiens
cttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaagcg

SEQ ID NO: 5904 - DNA, 201 bp, Homo sapiens
tcttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaagc

SEQ ID NO: 5905 - DNA, 201 bp, Homo sapiens
ttcttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaag

SEQ ID NO: 5906 - DNA, 201 bp, Homo sapiens
ctagggtgccacagtgacactgccatcagcttctgggccacaggaatgctcaacagatgtggataatgagtatggaggagcaatgatgccaaaaataattrttccttgggccttctagatcttctcacttcccctgaggagagattgtgcattctgcctacccaggaggacaggcaagattgcaaacacataagatgtttg

SEQ ID NO: 5907 - DNA, 201 bp, Homo sapiens
actagcaccagacattctcccacatgggcttcctttaataataataaaatagaaaaatcttcaaaacctaactggcccattttcttttcctgtcattctcttttttaaaattaaaagccaacatgggtacccagggctgacttgatcacagcatgattaaatgcacttcctctagaagttagggaaaagaggactcagtga

SEQ ID NO: 5908 - DNA, 201 bp, Homo sapiens
aactagcaccagacattctcccacatgggcttcctttaataataataaaatagaaaaatcttcaaaacctaactggcccattttcttttcctgtcattctcttttttaaaattaaaagccaacatgggtacccagggctgacttgatcacagcatgattaaatgcacttcctctagaagttagggaaaagaggactcagtg

SEQ ID NO: 5909 - DNA, 201 bp, Homo sapiens
tacctagatttggagcctccaaaacattgtatggccacactccatctctgcctacgatggaattatgagagagctttggaaaatggctgttccaaaagtgrtagtcttaacacaaagatcaggaagaatatttgatttggattaccacccacagcaggcagaattctaagatgttcccaaagtgatagtcttaatccacag

SEQ ID NO: 5910 - DNA, 201 bp, Homo sapiens
cccaccgccacgtctggctagtttttgtattgttagtagagatggggtttcaccatgttggccaagctggtctcaaactcctgacctcaaatgattcactygccttggcctaccaaaatgctgggattacaggtgtgagccaccgtgcccagtcaagatcccgtaattcttgagcattcctgaaacctagggaaagatgga

SEQ ID NO: 5911 - DNA, 201 bp, Homo sapiens
aatgtgacaaaaatattaacatttgttaaatctgaattgtcagtacatggttgtttgttattttattctctgtacttatcagcatgtctgaaatattccascattgataaatcctggttttgaaagagaaaaagaaaagatttaaacacaataataggatgacttctctgagactccttagttcactgcagatatccagat

SEQ ID NO: 5912 - DNA, 201 bp, Homo sapiens
ttgcagtgagctgagatcacgccattgcactccagcccaggcaacagagcgagactctatctcaaaaaaaaaaaaaaaaaaaaaaaaaaaaaaaaaaaaargaaaaaagaaagaaagaaagaaaaaagaaaaaaaaaacagtagttggaaaaatatagtactgtttataaaaagcataaaacatactaataccattatacc

SEQ ID NO: 5913 - DNA, 201 bp, Homo sapiens
ccaatctaatacatccataaatggatatatttgaatatggagtgacaataagaagttaaaatttaattttaaaaaaccgaacagaataaagaaacaaagcyaaaaaaaggaaaatatcctacgtggataaagcagaaaccaaaagtaaaccaagcgaaaaaaaagaagccaaataaaactataagctgatcttcagaggaa

SEQ ID NO: 5914 - DNA, 201 bp, Homo sapiens
atgtgccactttaagctaagaagttcatggtaatttgttatggcagcaataggaaagtaagagacccattattcagatgatgaagctaagactcgagagcrtgtcccaggccccccatgtagttaggtggtaggatgatgtagatgtaagtgcagtcagcttaactccacactcttcctcttgtcctctgtacaaagtcaa

SEQ ID NO: 5915 - DNA, 201 bp, Homo sapiens
agtgcctcactctgtagcccaggcaggaatacggtggcgcaatctcggctcactgcaacctctgcctcccaggtcccggttcaagcaattctcccgcctcmgtctcgccaccatgcccagctaatttttgtatttttagtaaatacggggtttcacaatgttggccaggctggtcttgaagtcctgacctcgtgatccacc

SEQ ID NO: 5916 - DNA, 201 bp, Homo sapiens
tatatatatacacacacacatatatatatacacatacgtgtgtgtgtgtgtgtgtatatatatatatatatagagagagagagagagagagagagagagasagagacagagacagagacagagagtgcctcactctgtagcccaggcaggaatacggtggcgcaatctcggctcactgcaacctctgcctcccaggtcccg

SEQ ID NO: 5917 - DNA, 201 bp, Homo sapiens
gtatatatatacacacacacatatatatatacacatacgtgtgtgtgtgtgtgtgtatatatatatatatatagagagagagagagagagagagagagagrcagagacagagacagagacagagagtgcctcactctgtagcccaggcaggaatacggtggcgcaatctcggctcactgcaacctctgcctcccaggtccc

SEQ ID NO: 5918 - DNA, 201 bp, Homo sapiens
tatatgtatatatatacacacacacatatatatatacacatacgtgtgtgtgtgtgtgtgtatatatatatatatatagagagagagagagagagagagasagagacagagacagagacagagacagagagtgcctcactctgtagcccaggcaggaatacggtggcgcaatctcggctcactgcaacctctgcctcccag

SEQ ID NO: 5919 - DNA, 201 bp, Homo sapiens
atgtgtgtatatatacacacatatatatgtatatatatacacacacacatatatatatacacatacgtgtgtgtgtgtgtgtgtatatatatatatatatwgagagagagagagagagagagagagagacagagacagagacagagacagagagtgcctcactctgtagcccaggcaggaatacggtggcgcaatctcggc

SEQ ID NO: 5920 - DNA, 201 bp, Homo sapiens
acacacatatatatatacacacatatatatacacgtataaatatgtgtgtatatatacacacatatatatgtatatatatacacacacacatatatatatacacatacgtgtgtgtgtgtgtgtgtatatatatatatatatagagagagagagagagagagagagagagacagagacagagacagagacagagagtgcct

SEQ ID NO: 5921 - DNA, 201 bp, Homo sapiens
cacacacatatatatatacacacatatatatacacgtataaatatgtgtgtatatatacacacatatatatgtatatatatacacacacacatatatatatacacatacgtgtgtgtgtgtgtgtgtatatatatatatatatagagagagagagagagagagagagagagacagagacagagacagagacagagagtgcc

SEQ ID NO: 5922 - DNA, 201 bp, Homo sapiens
aattcccaagcatggagtcaatttaatacatttcgagagtttactctacaaaagccaacatctttccagacttggggcaggaggttctctctacccaggasataaatccaaagactgtacagctaatacttggacgtgtctagcatcatgctcagtggtttacctgaatcatctctaattctcacagcaaccattttgcag

SEQ ID NO: 5923 - DNA, 201 bp, Homo sapiens
ttcccaagcatggagtcaatttaatacatttcgagagtttactctacaaaagccaacatctttccagacttggggcaggaggttctctctacccaggagakaaatccaaagactgtacagctaatacttggacgtgtctagcatcatgctcagtggtttacctgaatcatctctaattctcacagcaaccattttgcagac

SEQ ID NO: 5924 - DNA, 201 bp, Homo sapiens
gaaatctgcagcttgtaaaaaataagcccaagatgcaaaccctggtttttctgcctccaaagcccatatggcttccacaacaccaacctaccacttagacrcaatagaagaataccagatctcaagagaagtaggagcctgcatcactacagttgatgtcaggggcaggaatcaagagtgaagaaaaggagatgtcaagat

SEQ ID NO: 5925 - DNA, 201 bp, Homo sapiens
tctgcagcttgtaaaaaataagcccaagatgcaaaccctggtttttctgcctccaaagcccatatggcttccacaacaccaacctaccacttagacgcaayagaagaataccagatctcaagagaagtaggagcctgcatcactacagttgatgtcaggggcaggaatcaagagtgaagaaaaggagatgtcaagatgtct

SEQ ID NO: 5926 - DNA, 201 bp, Homo sapiens
tttttcttagtcctccagagttttcaagagaaccttattccacagacaggaaaaataactaatgggtactaggcttaatacctgggtgctgaaataatctktactacaaacccttgggatatcagtttacctgtataacaaacttgcacatgaaccctcgaacttaatataaaagttttaaaaggataacatttggaacct

SEQ ID NO: 5927 - DNA, 201 bp, Homo sapiens
tggttggtgagacagacaaatagattttatgatttcagaacaatgtagtaaatgttaaagtattacagaatgctatggaataatggagagatgagaggctyattcaccctgggaaataaaggaagcctttctggagaagacaaagagttgtgtagatagtcatttgagaggcaagactggggggaaggggagaggctagaa

SEQ ID NO: 5928 - DNA, 201 bp, Homo sapiens
ggtgctaactgatccatcagatgaagggtctgcaaaatatctcaagtaccgatcttaggttttacaatagtgatgttatccccaggagcaatttggggagstttagagtcttgcagccttcaactgcatgactcctaaaccataatttctcatcctctggctttaggcaatccccaggcaggaagggtgtttgttttggga

SEQ ID NO: 5929 - DNA, 201 bp, Homo sapiens
ggcattgacaataattgcctggatccattagttcattaacgtttgcaatgtagggatattccaattctactattccttcttcatttattacccggaactaygccaaaaagagaaatcttcctttgtcagctatttggcctgaggaagaactgatacaagaagggcagaatacagtaaacgcatgcttcttcccccatgtat

SEQ ID NO: 5930 - DNA, 201 bp, Homo sapiens
gcgctattcacatacacgctgggaggaagctgcccccgcaccgctctttctcccttctcctcctgctcccacacgccattgcttgacaccacaggtcaccrctttatttgtaataccaacctcgaggaaaacacctcgtgtgaaaagctaagtgccaaatccaggcttgtctgtgttgaccagacccactcacctctcctc

SEQ ID NO: 5931 - DNA, 201 bp, Homo sapiens
gcatggtggcacacacctgtaatcccagctactctggaggctgaggcaggagaatcacttgatcctaggaggtagaggttgcagtgggccgagatcgcgcygttgcactccagcctgggtgaatgagccagactctgtctcaaaaagaaaaacttcctggcatggagtgagggctacctaaacaactgagaccaggaggca

SEQ ID NO: 5932 - DNA, 201 bp, Homo sapiens
acaagaaccaggtctgcttttctctcacttcctcccaccccaaaacaatgcagaacttgaaatcaggtgctttcagattcaggtgaacgaacctcaggaasaactgcacttccagtcccctctctttctcaatcacagaaacgatcaagttctctcctattccacctgcctgttctcaagtggaccctcccgtggagatgg

SEQ ID NO: 5933 - DNA, 201 bp, Homo sapiens
aggagaagaaatggcaccaatattggaaccatgaagtcctgggtttaaattgtggctctattatctactacctgggtgcatctatcaggtaggattcaccyggttgcaagtgacagaaaattcaaaccatcttaaacaatagagatacataagcttctgtgactggaatgaccagtggcaaagatggcttcaggagttttc

SEQ ID NO: 5934 - DNA, 201 bp, Homo sapiens
agcccctccctagcctttctactgcgggcgctgttgccaagtcctaggtgcacgtgggcagtgggccgcacacgctcataggcacgcgcgcttttctgcgyacttcctcagactgctgtagcggtgcccacggccagccggagtcctcacatgtcctcaggtggtgcacacgcatgaactgcggcaggtgcacagccctgc

SEQ ID NO: 5935 - DNA, 201 bp, Homo sapiens
ccaacgaggggagggagggttgaggggaaggctgcagtctgcagtgctcacaagcccccctatgcgcccaggggggctagacaagaggggggaagctgaakcccgatgcccacgacgcccccagtgcggatcctcagcccctgtggctgatagcgggagctccactccagggtgcacaggagaatgggagccccaggttgg

SEQ ID NO: 5936 - DNA, 201 bp, Homo sapiens
gccggagtcctcacatgtcctcaggtggtgcacacgcatgaactgcggcaggtgcacagccctgcgtacctgcaaataccagcacggtcgtgcacgcgtgycctgacgcgcgcctctcgggacggacgctgctggagccgggggaagttgaggcgaactccaagaggcctcgacgttcctgggtaagcgccgcggagcgcg

SEQ ID NO: 5937 - DNA, 201 bp, Homo sapiens
gctctgcagcagggctctaacggggcggaggagagaaggagaggcagggtcagcccaccaacgaggggagggagggttgaggggaaggctgcagtctgcaktgctcacaagcccccctatgcgcccaggggggctagacaagaggggggaagctgaagcccgatgcccacgacgcccccagtgcggatcctcagcccctgt

SEQ ID NO: 5938 - DNA, 201 bp, Homo sapiens
gcgaccgggagctgctgagcgagggaggtagggagagaaagaggaggtaacgagggtgggggggcgctggctgagtttgtgacgagccagcagtaggagakggggagggaaggacgcgggctcccgcggtcccggttccccgagggaggtggatctttcccacgcagcgaccctcttgtgatcctgccgcttcctccctct

SEQ ID NO: 5939 - DNA, 201 bp, Homo sapiens
ctccagagttgaggcccttaatcacagttctacactgctcattatctgaggaataaagcgtggattaaatcagtgaacatcaggcaaaaccatgcaaaatkgggataggagtgatcattctaaatctcaacagctgaaccataatgatgggccacaaggaacaatgacacttctcagaaacctaaaatttaacttaaatgt

SEQ ID NO: 5940 - DNA, 201 bp, Homo sapiens
caaatactttactacgttaaatgacacattggaaattttcaagacaatttcttaagcaagtaatacgggttccatccggctccatcatttgccattcactygacaaatgtcataacgccactgcacaccccaccagagcaaatattttcttccaaccttaaaataacatctacaaattaattcagtctgtcaaggggaact

SEQ ID NO: 5941 - DNA, 201 bp, Homo sapiens
aatgtgtgttctgttgttgggtggagtgttccacaagcaaatattaggtcaacttggttgtgacattgttaaaatcatctgtatctttactaactttgctygttctagcaattattaagagtattgaaatctcctactataattatgaatttatttccccttgcagttgcatcagttttgcttcattattttgaagctata

SEQ ID NO: 5942 - DNA, 201 bp, Homo sapiens
tgtgaaaagctatacgggtcaagagacttctggttgttcatcaatatcctcttttcttctgccttagtaacagaaattctatttttagaggggcacagaamctccaataataaagcttacatttctagcttccctagtagctaggcatgaccctatgacaattttctggataataggaagacagaaggtatgatatgcata

SEQ ID NO: 5943 - DNA, 201 bp, Homo sapiens
gacttgtacctgggccacacggcgtgcctcaggctcagcgtatggttctcccacttgcccacctgcagcacaaacacaaagacacagctgtgctttcttcygccgctgatttctggagaggcaaatcctttccctgccagagacatccatccgtctcaagggcctttctgccacatatctcaacatatgcatctacttctg

SEQ ID NO: 5944 - DNA, 201 bp, Homo sapiens
cacaggctacccgtgttgccttgagaaactggctcaaccccttaagcctccgtgtcctaggctgtaaaacaggaaaagcaatttccaccaacttcatagaycagatgagctcatgtacagtagctgtttactgattatttattgcattccgatcatttcttccacattatctcattcagtctttaacgaaaccccatgaag

SEQ ID NO: 5945 - DNA, 201 bp, Homo sapiens
acttagaagtaagagccaaagcctacccggaacctcccagtctcacaccaccttttccaattcagcttttcccagatttctccattgggttgtgccaaacsctcatggatccagaaatttcactttcagtatggttactgtttccagtctatcactcctttagaaaaactcaagaaggaagaagggatccgtggtaatatt

SEQ ID NO: 5946 - DNA, 201 bp, Homo sapiens
atgtctccaagaccaactctgaaagtcccaacaacaatcaggagtatcgaatcccctcctccatttttgaaccaatggaccctttcattcttcttctctcmaacccctcttaagtctctattctttatttctctggaaatgtcttttctcatcttcctcttgccctttcctgattccttttctcttcttactcttaagtga

SEQ ID NO: 5947 - DNA, 201 bp, Homo sapiens
tggcacgtatcaccaacgtttttccctaccatttgttggtttctgttaattttctttatgttattgctggaactccctgaaacgaccacaaagcaaccatytgattctgccaaaaatattgtctttgaaatatggtttctagaacgtctgtgagtcacctgctcacatgtccaagatgtctcagaaatccttctgctttta

SEQ ID NO: 5948 - DNA, 201 bp, Homo sapiens
gcaaacaggagaagaagccaacataactggcaacttagccttgataactctttgtttatccgggcaagcggaaaagggcaggattccttggtgcttgggtrgagagcttttccatagcctcagatacagacaggggcactgaaattatggggtacaagaggtttttccaggtggtccaggtgagacggagctgggagatgg

SEQ ID NO: 5949 - DNA, 201 bp, Homo sapiens
tagaaagccagaatagtctccagagacagatgaagtgaaattgcaagcttctgactctcacaactcaacccatcagcttaggttgttaaaaaagcgaggtmttgcagtgcactatattgtcatagtctgagaagggccgtgtgcgtgcccttgtgtgttccaaaacctaggccacgatgtatagggaaaaaagagcacagg

SEQ ID NO: 5950 - DNA, 201 bp, Homo sapiens
cattttggtgtcttggagactgcatcctaccatgatctcatctatgaagcaacaggaaaggaatggagtctccagtgagattggatcagcagtttcattasaggggctggcagagaacacttttgctcttcctcctggtccctaagccttcctgaaacccagggactggaaagggatcctaaccaaatctgcagctattgg

SEQ ID NO: 5951 - DNA, 201 bp, Homo sapiens
tatcattttggtgtcttggagactgcatcctaccatgatctcatctatgaagcaacaggaaaggaatggagtctccagtgagattggatcagcagtttcaytagaggggctggcagagaacacttttgctcttcctcctggtccctaagccttcctgaaacccagggactggaaagggatcctaaccaaatctgcagctat

SEQ ID NO: 5952 - DNA, 201 bp, Homo sapiens
tggcacacatggaaggagagtgctggcccctggctgcgtcctcacctctgtgctcagggctgtgagtgaggatggcagacacaacaatctatacccacccyagacctgcggcatctcttaatctgtgctccacaagatcagcgtctgatcctggggccgcgggctgtctggggaacatgcagttctttagtgtctggatat

SEQ ID NO: 5953 - DNA, 201 bp, Homo sapiens
gactctgccaggccctgggcttttgcagaaagcgaaggtggaagggagatggttattagccactgtctctgcaaacgacaagccatctgcaccccgttacytaagcatagacctctgtgggtgccaaacttcagagcccagaaagttggaagggattccgagcttggatccctcaggctaggctattcttggaagccgagc

SEQ ID NO: 5954 - DNA, 201 bp, Homo sapiens
tatatattataatgtaataatagaaataaagtacacaataaatggaatgcacttgaatcattccaaaaccatcagcccaaccccggtctgtggaaaaactktcttccacgaaactggtccctggtgccaaaaagattgaggaccactgctgtagagacagtgaatcataatctgagagtttacagaggagcacagccctgc

SEQ ID NO: 5955 - DNA, 201 bp, Homo sapiens
gtgaggtgatgacgccaaggatcaagctgatggtggctccagcaggcatgacattgaaacaggcaaatgagatccttcagcctagcaagggaagctgcctrtggtcaatgatcgccatgagctagtggccatcgtctcccacaccaacctgaagaagaatcgagactacattctggcctccaaggattcccacaagcagct

SEQ ID NO: 5956 - DNA, 201 bp, Homo sapiens
agtgatggaaatgaaaaggaaatgagcacatttctcaggagagctattttctatcacatggaaaactgggcagtgtggatttactctttgtgtttggccargacttaaccaaatgaagcagatcctcaggaagctgactgtggggatttggacaatggtacaccagacaccagcagatctgccagttcatttacccaactt

SEQ ID NO: 5957 - DNA, 201 bp, Homo sapiens
gaaggaggggtccaaaccagtctattcactcccagtcataatgaaacttccccaaacacataaatcacccaaggtcccagtcatctaataacacctctgayctcccagtgtatgctatgcttataatgtttgtgattcttgcacttacattttccaaagccctcatcccctttcctttgagtgggtccccctatatcctca

SEQ ID NO: 5958 - DNA, 201 bp, Homo sapiens
gtttatttttgaacattctgtagtgaggcaagggaagaagaaatccatcacatggaatatcaccctccatgttatcatcttacatctttggcacaaactcwcggaagtaaaggtaatagtgtgaaatacctcctttctcacttaaaaatggaatgaatgatctagatcttcaacaataggctcatttttccaatttccaat

SEQ ID NO: 5959 - DNA, 201 bp, Homo sapiens
tcttcccagtcttcctgccagaagattccagtgtccacatgatttctctccacttctttggagggtcccttccactgatagcttaaagtgtcagcaagagyttcctttcactgaaccacagttatttccttgaagcttcaacccactagctctagttctctactgtaagcaaaggagactaattctactacaatttccgga

SEQ ID NO: 5960 - DNA, 201 bp, Homo sapiens
ctcctccagggtgacgatgctgagatggttgtcatccggctcacagtcggagaaggacttgtacctgggccacacggcgtgcctcaggctcagcgtatggktctcccacttgcccacctgcagcacaaacacaaagacacagctgtgctttcttccgccgctgatttctggagaggcaaatcctttccctgccagagacat

SEQ ID NO: 5961 - DNA, 201 bp, Homo sapiens
aaaatggcacttactttatattcatagaatttctggggcagttcttctcaaactttaacatgcacgtgaatcgccgagggatcttgttaagaggcagattstagctcggtcagtctggatgggacctgagattctacattcaggctcccagaggatgtcaaagctgctggtgcatggaccacactttgaatgatgagatct

SEQ ID NO: 5962 - DNA, 201 bp, Homo sapiens
atcattttggtgtcttggagactgcatcctaccatgatctcatctatgaagcaacaggaaaggaatggagtctccagtgagattggatcagcagtttcatyagaggggctggcagagaacacttttgctcttcctcctggtccctaagccttcctgaaacccagggactggaaagggatcctaaccaaatctgcagctatt

SEQ ID NO: 5963 - DNA, 201 bp, Homo sapiens
acagaagagacagaaacatgtaaatgaacacatacaagttaaagttgtggtacagctaatgacatgagggctcctatggaaaaggttagcaggactgtcasgaagccctctcaaaggaaatgccccaaaagccaagttgtgaagaagtcatcgtcaaccagtgcagaatagtgggaagagcattccaggcatagggaacca

SEQ ID NO: 5964 - DNA, 201 bp, Homo sapiens
gtgctggtggcattcagcatccaagaacacttagagccaagtttgtgctgtctttttaacacgactaataccatcagtggaattaatagaaaaatgaaagycggcactctaattccagtaatgaaatcacaggcgcacagctcccacctttaggagcctcacaaatgatgcatgtcctctgaagccattcagctggcgtca

SEQ ID NO: 5965 - DNA, 201 bp, Homo sapiens
ggtatatacctggaaacgggattgctgggttgaatatttctgtctttaggtcttcgagaaattgccacattgtcttccacaacagctgcactaatctacaytcccaccaacagtgtataagcctcgatcagaatcacccaaaaggcttgttaaaacacagactgacaatccctgcccctcactttctgattcagtaggatg

SEQ ID NO: 5966 - DNA, 201 bp, Homo sapiens
gtacagctaatgacatgagggctcctatggaaaaggttagcaggactgtcacgaagccctctcaaaggaaatgccccaaaagccaagttgtgaagaagtcrtcgtcaaccagtgcagaatagtgggaagagcattccaggcatagggaaccatgaggacaaagcccctagggttggaaagaacaaggaggaaaatgacagc

SEQ ID NO: 5967 - DNA, 201 bp, Homo sapiens
tagtttgcaagatactgaagtcgcacgttgtttctaagaacactgatgctctaaatctccagcttttgacttcaggaaaatggcacttactttatattcayagaatttctggggcagttcttctcaaactttaacatgcacgtgaatcgccgagggatcttgttaagaggcagattctagctcggtcagtctggatgggac

SEQ ID NO: 5968 - DNA, 201 bp, Homo sapiens
tcacacatcaatcatttgcagacattcctgagcatctactatatcccagactccagaacagatcctgcaaatacagagaggacagaagcccctgtactcasgagctcatagccaggtcctggaaggatgtctgtaattattgcttgcttatcatctattcttctcattttcctctagttcgtcctgccccttcctcctttg

SEQ ID NO: 5969 - DNA, 201 bp, Homo sapiens
aaagtgtcttctgtaaaatcaggaatattaaacatgaagaaaatgtccccctttcctgtacttttttttgcctgaaactctatgtacagaaacggttgggkgtaaggtcatgaacataccttcccttgcaagcagcccctggtaccacgcccagcccatgagcaacaatatcctaactgcaccagctctttgcctgagatt

SEQ ID NO: 5970 - DNA, 201 bp, Homo sapiens
ggagtggccctctttctgtccccactgaatccatttatctatggaaaattgggagagagagtctacaagaagagcactatacctccccaccccaattgcayacacttttttttttttcttttcagacagagtttcgctcttgttgcccaggctggagtgcaatggcacaatcttggctcaccgcaacctccgccttccagg

SEQ ID NO: 5971 - DNA, 201 bp, Homo sapiens
gtctcacagctaataagtggcagaaaaagctgaaatttgattccaaagcctgtggatgtactgcagtatctccctatccacagggaatatgttccaagatscccagtggatgcctgaaactgcagatagtacagaactgtgtatgtatcatgtttcttcttacacagacatacatacctatgataaagttcatgaattagg

SEQ ID NO: 5972 - DNA, 201 bp, Homo sapiens
tggaaagacatggttgtgtggttggatgtgtgtatttactgtttaaggaccaagtttacaccagtactcgtgcgttctgctccacaatttcaacacgtccwccctctcactccccgcctagagattgctccttctgcactctcttaatgagactgtcgttgtacatttttaaaaattttattctcaaaagccccagggagt

SEQ ID NO: 5973 - DNA, 201 bp, Homo sapiens
tgttatgaggattcaagattttgtatatgagtctaaaacactatataacattattgtaataattattaattatgtctaattaggagggtaataaagcaaartgatcccatgaccccacagatcctcccaacagtcaaaagcttcatgacatgagtccttggaaaaaaagaagagaaagttgcattaaacatcacccaactt

SEQ ID NO: 5974 - DNA, 201 bp, Homo sapiens
ttaacctctcatgactaaggatcacctaaccactttgaaccagctggcacaagagccagtggaaccagctcacataatgagcttctaatccaaatgagcasaaaaaaatgtatgtaacgtggcgtgcatttccaagttcactcaatcacctgtgcctatgctgccaaattattcaagatctccaagtggcagatgtgcgtg

SEQ ID NO: 5975 - DNA, 201 bp, Homo sapiens
ctgggtagtatttataacactgttaaaatagcaccaaatgcgtcaccattaacctctcatgactaaggatcacctaaccactttgaaccagctggcacaasagccagtggaaccagctcacataatgagcttctaatccaaatgagcagaaaaaaatgtatgtaacgtggcgtgcatttccaagttcactcaatcacctgt

SEQ ID NO: 5976 - DNA, 201 bp, Homo sapiens
aatctggaaatgctgggtagtatttataacactgttaaaatagcaccaaatgcgtcaccattaacctctcatgactaaggatcacctaaccactttgaacyagctggcacaagagccagtggaaccagctcacataatgagcttctaatccaaatgagcagaaaaaaatgtatgtaacgtggcgtgcatttccaagttcac

SEQ ID NO: 5977 - DNA, 201 bp, Homo sapiens
ctcaggctgctcttggaacctggggtgaggaatctggaaatgctgggtagtatttataacactgttaaaatagcaccaaatgcgtcaccattaacctctcrtgactaaggatcacctaaccactttgaaccagctggcacaagagccagtggaaccagctcacataatgagcttctaatccaaatgagcagaaaaaaatgt

SEQ ID NO: 5978 - DNA, 201 bp, Homo sapiens
gctatgtctaaaacttgaggtaggttaggacaaagcttttttctgtaaatatgactctcctcctcccaactccacagagcatacctgaaactttgacccarctggccaaagatttcaactagaagcagggtgtatagagtagggtctaagatgcatgtcctaattctactttattgggagttattggaattctgaatgacc

SEQ ID NO: 5979 - DNA, 201 bp, Homo sapiens
gatgaagcttctatggtgcaaagcctgtaatccatgtgccaccctgggcatccaactctattcagggagcacacctgagtcaagggtgactccttaaggasaggaccctatatgctgtcttttgtaatacaaccgctatgtctaaaacttgaggtaggttaggacaaagcttttttctgtaaatatgactctcctcctccc

SEQ ID NO: 5980 - DNA, 201 bp, Homo sapiens
cctcagttctcagagtatttgtttccttttctgtaaaagtgaggtcataacagccatgtcactgggtaattatagggatcacactaaatgacgtctaatgrgatacacaacgtgataaaggccagcagagtgcttggcacattatgggtgtctgctaaactatggtaggggtagcagtagttgtcatggttttatataatt

SEQ ID NO: 5981 - DNA, 201 bp, Homo sapiens
atagcctgagttagaattcaattttgtggctttcaacctcaggtaagtatcctcagttctcagagtatttgtttccttttctgtaaaagtgaggtcataayagccatgtcactgggtaattatagggatcacactaaatgacgtctaatgagatacacaacgtgataaaggccagcagagtgcttggcacattatgggtgt

SEQ ID NO: 5982 - DNA, 201 bp, Homo sapiens
agaggcaatattgcaagaattggatagcctgagttagaattcaattttgtggctttcaacctcaggtaagtatcctcagttctcagagtatttgtttcctyttctgtaaaagtgaggtcataacagccatgtcactgggtaattatagggatcacactaaatgacgtctaatgagatacacaacgtgataaaggccagcag

SEQ ID NO: 5983 - DNA, 201 bp, Homo sapiens
ttgattccagtacaacaactgccaagaggcaatattgcaagaattggatagcctgagttagaattcaattttgtggctttcaacctcaggtaagtatcctyagttctcagagtatttgtttccttttctgtaaaagtgaggtcataacagccatgtcactgggtaattatagggatcacactaaatgacgtctaatgagat

SEQ ID NO: 5984 - DNA, 201 bp, Homo sapiens
gcataggtctctaggatcctgcacactaaatatttgattccagtacaacaactgccaagaggcaatattgcaagaattggatagcctgagttagaattcarttttgtggctttcaacctcaggtaagtatcctcagttctcagagtatttgtttccttttctgtaaaagtgaggtcataacagccatgtcactgggtaatt

SEQ ID NO: 5985 - DNA, 201 bp, Homo sapiens
atggggaaaagagtctttccattcattctccaaatccttattgagcctctgctattgaataccagagatataatggtaaaggagagactgaaaacacaccrtgagctctcagtgctagccgtggccagaattcatggctttaccaatgggctgctattgtctttctaagcaaagagagttgtaatatgtttctccctgccg

SEQ ID NO: 5986 - DNA, 201 bp, Homo sapiens
tacaaaacatacaaaaaaattaggcaggtgtggtggcacacacctgtagtcccagctacttgaggggcagaggctggataattgctcaagcccaggaggtmgaggcctgcagtgagccactccagggagtgcagcggcatgaacatggctcgctgtggccttgacctatgggctcaagcaattatctggcctcagtcccca

SEQ ID NO: 5987 - DNA, 201 bp, Homo sapiens
gtttttataattaaagcactgacagccttcactactgatatatgaacgccacccatctctaccataaggtactgtagaaacaaaatggactttgcagtctrgcagacctgagctagaatctagactttgccatatacttgctttgtaaccttaggcaaatcagcaatcatcttagagcctcagtttcttcatatgtaactg

SEQ ID NO: 5988 - DNA, 201 bp, Homo sapiens
attcatgacagcctcattttgacaaccaactcctggttccagccctgccccacatcaactcatgaatcacacagaactaatcacaggcttctgagtacatygagcttttctctcagtgccaggtttcaacacgctactcaccctgcccagaaaaccccttcccactctctgcctggcactctcctatgtgtccttcagaac

SEQ ID NO: 5989 - DNA, 201 bp, Homo sapiens
ataccatgggacaagactgaagaagcccttggatattgggctacaatccctttgtgcacattggaatttggttgcatttaagttgaaattggcaattggcyttgggaaatccctctgactcaacacctggggataatattggtgatttcatccacatatggctaggacttagtactccttacatattttgaaattgtccta

SEQ ID NO: 5990 - DNA, 201 bp, Homo sapiens
ctgaggaccttgaattccaccacagaaaatacctctaacagcagagctgcactgagctctactttgcaggcttgatgttgaattccactgctaccaacacrgacatccaaaaggcgatcagaacagcagatcaggcagagaaaatcaactgttcaaatgtgaaccatgtgtcaattaggtaatttgggggtttcaaccaag

SEQ ID NO: 5991 - DNA, 201 bp, Homo sapiens
aatcagctattagagccttaattaaattcctctcagttgaaatttcagaattgcctaattgttacacagctcacattggagaagtagattttttttcctcycgtaataactgctctcaagataatctagtatctttatggataacagcatcaactgtcttagaacccagtactgatctggtaattcatagaaacgtgtttt

SEQ ID NO: 5992 - DNA, 201 bp, Homo sapiens
atgcagactcctgtatctctggagtgttggaatcagtagatctgggataaggtgtgggatcctgacttttcaaccagcgtcctagagtcattctgctccgwgtggtctaaggaccccattttaaggagcaccaggaggggaagacctatgactaacatacaggattaaataaagcataagaacaagatggaaatctttctt

SEQ ID NO: 5993 - DNA, 201 bp, Homo sapiens
tgcctgtttactcatcttctctccttggagacaagacaatagaaattgcaaaactaaaaatcagacaggaaatttattaaaaccaacaacagaagcagagytcaggctgcctgtgctctagtctggctggacccagttagctcattgggtggtttcataaccatggggaaacaggctttaaaacaaacacattgagcttgc

SEQ ID NO: 5994 - DNA, 201 bp, Homo sapiens
tcaagttcaatggccagaatggaaaaagatttatagaagtcaccatggatatatgtccatatataacctgcctgaagatggaagcttctttgcctactccmatttttttttaattatggaaatgttcaaatgtatttaagagtagaatcatataatgaacctccgtattcccaatgtccagcttcaataattagtactcat

SEQ ID NO: 5995 - DNA, 201 bp, Homo sapiens
gtttgttcacaatcattagctgtactcttctcctatttttcagatgagtaaactgaagttgaaaaggggaagtggctttcccaaggacacactgtgagtasatgacagcaaaagcagaaagtgtccttaattatagcagttatcatgacaagaactaacacttattgagtaattactatttgctaagcactatcctaaagg

SEQ ID NO: 5996 - DNA, 201 bp, Homo sapiens
aaggactctgctgcagtagtcttgttttagtaaattaagtacctatcagtgccctgaagggttgctattctaagataccacacacgtgaatgcacacacaygctccagaacaaagaaacatcgttaaagcaacatctatagtgtctaaggagtgacccagaaatagtttagataactctctattacatcttctaatggctt

SEQ ID NO: 5997 - DNA, 201 bp, Homo sapiens
aaggtggggtttctgtgctagcaccagaagacacaaactggaggcagcaatcccactgcagttgatgtgacagaagcccctggagaagagttcaccaaaaygtgaaaggggagtccagcagctgcgtgctaagggggtgtggctctcagctcaattctagcctgaccttcttatagatggctgagagaaccctagaggcta

SEQ ID NO: 5998 - DNA, 201 bp, Homo sapiens
tcattccaaaccagaatgagcactgtgggaatgagtttttcagaaatcatagacttaacttctgaataaatgctctcccagcccctgctgagatgccaaasacattccaaaggcacagactgaaaggacagaatgctcacagccaaaactaccgggatttctatgcagaaatctgggctttgatgctttagaggggcctct

SEQ ID NO: 5999 - DNA, 201 bp, Homo sapiens
ggtgtataccaacagaaatgcgctcactcattaacaaaagaagcattattcataatggccccaaaataggacattacccaaatgtccatcaagattaggasagagacatccatgtgtgctgcattccagcaatgagaatgaaagcactgaaattacatgcaacaatcttgcaaacacaatgttgagccaaagacgacaaaa

SEQ ID NO: 6000 - DNA, 201 bp, Homo sapiens
tcagagttataccaacattgatgaattttcacaaaggaagcatttttcaaagcaaactcccttaagctaatttaattcctcgatcgatgtcttgcatagcrtagttaaattgtttccaacttttttggaaacatttttactggggtcaattcttttgtgtttaaattttataaatatttgcttcattgatcaggatttgga

SEQ ID NO: 6001 - DNA, 201 bp, Homo sapiens
ttaggaagatcctcacgtgattcttgctcatggtaaagctgaatgagctctgctgcagttcactttactcattggagcctcattttcctgctttgtgcaakggagataataagatttactccagaatattatataaaggcttactaggatattatatgtgatgtgcttggcatagtgctgaaccatagatgagaggaccta

SEQ ID NO: 6002 - DNA, 201 bp, Homo sapiens
tccaccctagacccactgaaacagtctttgttttaggaagatcctcacgtgattcttgctcatggtaaagctgaatgagctctgctgcagttcactttacycattggagcctcattttcctgctttgtgcaagggagataataagatttactccagaatattatataaaggcttactaggatattatatgtgatgtgcttg

SEQ ID NO: 6003 - DNA, 201 bp, Homo sapiens
gctggtagcctcagcatcacctggcagcttgttagaaatgctgggtctcaggctccaccctagacccactgaaacagtctttgttttaggaagatcctcasgtgattcttgctcatggtaaagctgaatgagctctgctgcagttcactttactcattggagcctcattttcctgctttgtgcaagggagataataagatt

SEQ ID NO: 6004 - DNA, 201 bp, Homo sapiens
atgatcagaattggactcagatgaactagagccaattgttacctctataaaagtctgaacagggtgttgtccattggctggtagcctcagcatcacctggsagcttgttagaaatgctgggtctcaggctccaccctagacccactgaaacagtctttgttttaggaagatcctcacgtgattcttgctcatggtaaagct

SEQ ID NO: 6005 - DNA, 201 bp, Homo sapiens
ctccactgagtcctgcagtaagggaacagcaacaggggtggacatggatagcgtatgccctcgaggaatctataatgcagtgcactcaagtggcccagggsacatggagaggccaacaatggcatctaatgtgtgccaggcatggactagcttctttatgtttattttcatatttaatccttaaagaattctgattttaaa

SEQ ID NO: 6006 - DNA, 201 bp, Homo sapiens
cttacagaaagtcgaaaaggagcacttgcaaattggagaaactacctgcactgctggcaggaatgtaaattggtttacattttcagaacactggttcaaaktatctactaaagttgagtagacgcgctctattacccagcaatttcattcctaggtatatttccaaaccaataagtgcctttgtgcacaagaaaggtacaa

SEQ ID NO: 6007 - DNA, 201 bp, Homo sapiens
tgggcacccaccccacatgttcctcaagggtcttgcttgcagggagctcagtgatataagcacagattgcaaaactaagccttccctttatcaccctcagwgttcccagtgccttgctcaaatgagaaagaaaaaaaaaaaatcaacctgccaatctggtctttcctgcagtaaatgaaaactagctctgttcctgcatag

SEQ ID NO: 6008 - DNA, 201 bp, Homo sapiens
taatcatttgaaaaaattgcatctagcaacatgcatcaaagtaattagtttaagaaattacttctttgccagcacttattttaaataactattgatataawaagtgacagcgaagatttagatatcagaagctacttatattctgggccaatgtacccttaaaagttgatttctctcctgctttctctcagacaactgctg

SEQ ID NO: 6009 - DNA, 201 bp, Homo sapiens
caaataaaataatcatttgaaaaaattgcatctagcaacatgcatcaaagtaattagtttaagaaattacttctttgccagcacttattttaaataactaytgatataaaaagtgacagcgaagatttagatatcagaagctacttatattctgggccaatgtacccttaaaagttgatttctctcctgctttctctcaga

SEQ ID NO: 6010 - DNA, 201 bp, Homo sapiens
acaacatgggaacctgccaacattccacaagtgcttccatgcatgctcttgtatctttagaaggttctcagaagccctccaataaaatctcccatctcatygttcttaactatgattcatgctaatcaatgagccagtcaccatggccagtgaatcagaattgcatggattggcttaagcctgagtcacatggcctgcttt

SEQ ID NO: 6011 - DNA, 201 bp, Homo sapiens
taatctccccatttcaagagccttaacttaatcacagttgtaaaatctcttttgccaaattaggcaacacatccactggttccaagcattagggcatggayacatttggtgagtccttctcgtaccacatgtgaagaacatgcatgtgttaaccactgcggctatttctacactactcctactattacagagaaagaaagt

SEQ ID NO: 6012 - DNA, 201 bp, Homo sapiens
ggcgtcacttgtagatatatccctccgagggaagccactatccatccggtggccagcctgacaccacatcgcgtgacaaatgacatctgagaaccaagtcktaccaggcaaaggctgccacatgagtggaatacaaaatagttttctgcatgtgttcagttcactgctgtaaataagattcactggagacctgaaacagga

SEQ ID NO: 6013 - DNA, 201 bp, Homo sapiens
gagccaagtttgtgctgtctttttaacacgactaataccatcagtggaattaatagaaaaatgaaagccggcactctaattccagtaatgaaatcacaggygcacagctcccacctttaggagcctcacaaatgatgcatgtcctctgaagccattcagctggcgtcacttgtagatatatccctccgagggaagccacta

SEQ ID NO: 6014 - DNA, 201 bp, Homo sapiens
ataaaatgctcagaaatgaaagctatgcctttctggaacccaggcaccaggcattcaggtgtgaacaaagctatccatgcagtccgggaggggagccagasagaagcaagcatgtgcgaccagcattaaaggggcagctgcagtcagtcctctctggagccctgtccttgttcttcccaacacagccttgtgcgtatgctg

SEQ ID NO: 6015 - DNA, 201 bp, Homo sapiens
tagattttatgatttcagaacaatgtagtaaatgttaaagtattacagaatgctatggaataatggagagatgagaggctcattcaccctgggaaataaargaagcctttctggagaagacaaagagttgtgtagatagtcatttgagaggcaagactggggggaaggggagaggctagaaggctatttcaggaattctat

SEQ ID NO: 6016 - DNA, 201 bp, Homo sapiens
cttatacacactacagttcaagaatcacactctaggtagagccaaccttgacgtcaaagaaatctcgagttcttgttctgcaccaagcattgggatcgctratacagaaaaaagcagctcaaattcaatgtttgagtaagcacttgacttcagccttcaggatacaacctgctaggcctccaggtgaataatttaacttgt

SEQ ID NO: 6017 - DNA, 201 bp, Homo sapiens
ccaccatccaccctggctttaaaatctttagtggtttctttctgctcttatagcaaagatgcaacacccaaatgtggcctgagggtctcagcacggttctkctctgacctccttcactcttaccctccaagcaccagggtcttctcaggcaatttttttcagaccagacatttgctatgatccctccggccacagggccta

SEQ ID NO: 6018 - DNA, 201 bp, Homo sapiens
tcaccaccatccaccctggctttaaaatctttagtggtttctttctgctcttatagcaaagatgcaacacccaaatgtggcctgagggtctcagcacggtyctgctctgacctccttcactcttaccctccaagcaccagggtcttctcaggcaatttttttcagaccagacatttgctatgatccctccggccacagggc

SEQ ID NO: 6019 - DNA, 201 bp, Homo sapiens
cagagagcccgtagacagtggtgcacaataattacccatggaatggtgaatgtttcttagcaactgtaacttactgcctgcactcctctcccctgcagccrgttctccacgtggccaccagaggatgcttctggaaggtaaatctcatgttcaccaccatccaccctggctttaaaatctttagtggtttctttctgctct

SEQ ID NO: 6020 - DNA, 201 bp, Homo sapiens
agagctcaccattacaattaaactctgagcacaaatggaattaggagcataaacaaggggtggaaaagggagagattttaacagaaaaaaatgatggtttstttttttctccgaagtgacatagaaaaagaaattgaatgtcagcctctgaaaagtgtccaaattactatttgaaaggagaaaaacacaatcaaataaggt

SEQ ID NO: 6021 - DNA, 201 bp, Homo sapiens
actcaatatctgagtcagacggcctgcattagactcttggcttccacaggtaccggctctttgatcatggtccaggtactctactttaatctatccaactrctcatccattcatgtatttatttttctatttaacaaaattacataaaatagactgtccttcaggtactatactagagtttaaaaaaattaactcatgtaa

SEQ ID NO: 6022 - DNA, 201 bp, Homo sapiens
atacactcaggtattaatacactcaatatctgagtcagacggcctgcattagactcttggcttccacaggtaccggctctttgatcatggtccaggtactstactttaatctatccaactgctcatccattcatgtatttatttttctatttaacaaaattacataaaatagactgtccttcaggtactatactagagttt

SEQ ID NO: 6023 - DNA, 201 bp, Homo sapiens
caagaaagtagccacccggtgtactgaccctgctgatggagaagagcaacccaggccggtcggagcacacgcccgtgaaacagaagcgcagcttccagtaraagaggtgctcccagatgaaggtgatgaggctaagggccatggcggcagccagcatgtagaatacgcccgccatgttgtcaatgtccagctggctgctca

SEQ ID NO: 6024 - DNA, 201 bp, Homo sapiens
cccctcctgcacttcgccgctgggctccctcccgctttccctctccctctctagcctgatccctctcccgctctccctccggtcgagtctccctcctcccyggcccaaggagccctgatctccctctgggacgtacctgtagcccgagaaggtcgaggatgcagtggggcgcgctgcgcgcacgagcatctcggccgcctc

SEQ ID NO: 6025 - DNA, 201 bp, Homo sapiens
ctgactgtttcaaagcagcatgaagtttggattttcttttcaatgggatgtcttccaactttaaaatgttggcaaagaattagaagttgaaagatcaaggrtgggggatgcaggacaaacaaaagacaccaattaataaccttataatgtctcatttatgtgatgacttatcagaggctaccaactctctattacaaacca

SEQ ID NO: 6026 - DNA, 201 bp, Homo sapiens
ttctgtattctccagctatcctgaatttcttgtctcttctcccctccaggcacaaaaatgataaggaaactttgcttgggaagaatttcgcagaggcacgwtcgtggagccaggttttggggtttcgggtttcaaagtgcataccaccccagggttctcaaacagaggcacacacagcccagcagaacacacgtgcagagc

SEQ ID NO: 6027 - DNA, 201 bp, Homo sapiens
gtttaagaaacaaaacttgatctcaatatattgtggacaaatgctcaatcgaacagaaagctcactgttaatttgctcttcctccttctgtattctccagmtatcctgaatttcttgtctcttctcccctccaggcacaaaaatgataaggaaactttgcttgggaagaatttcgcagaggcacgttcgtggagccaggtt

SEQ ID NO: 6028 - DNA, 201 bp, Homo sapiens
gctgttttaatgaattcttctaaccggttgcaccgccccaaattgaccgtaaaagttaacagatttgtttaagaaacaaaacttgatctcaatatattgtkgacaaatgctcaatcgaacagaaagctcactgttaatttgctcttcctccttctgtattctccagctatcctgaatttcttgtctcttctcccctccagg

SEQ ID NO: 6029 - DNA, 201 bp, Homo sapiens
aagatacactataaaggtattattttagatagataatatatattattttatagatagctaaatgatacacaaatatattattctttgtgagagagaatatsaaagctcaaattccatcccagatcgcctaactcaaagctccacatttttgcaatacaaactatcgttctcattatgtggaacccacccaaagaaggccag

SEQ ID NO: 6030 - DNA, 201 bp, Homo sapiens
acccacgtatactgggcactgaggggaggaagatgaaaatggctacagcaagggtatagaagaggaataaattcacagtcatgtggggaggccattctgtytgtcttctggcataaaaaaagactgagtgcataggaggcagaaggcgattgcttcaagcctaagaaatggaaaaggcaccttggagaacttgacacttaa

SEQ ID NO: 6031 - DNA, 201 bp, Homo sapiens
aagcacattccaagatgcaactaatgagggaagagaaataaggaaagaaagtatgtttgacagaggcagtgtggctatagctttctccacttctgattgaygacaagatggtttctcctgcaagtaggcacagatttgctctttcaacccacgtatactgggcactgaggggaggaagatgaaaatggctacagcaagggt

SEQ ID NO: 6032 - DNA, 201 bp, Homo sapiens
tccccctccccacctacaccacaacaaccagccatgctccatctggtcccacaagtgaggcgatatggcgcagaagtcgtagccaaccctcggtgggcacrttgcatgaacgagaaataagcctttattgttataagccattaagatacaggggctgtttgtgcagcagggcctcatccatcctagctgatccagctttcc

SEQ ID NO: 6033 - DNA, 201 bp, Homo sapiens
tcaactccatggatcccatgtgccaatcttcccccagctccactattgaaattctatacatccactgagtccagtccgttttccccccaaccatcactcastctgacctggttcattctccaggagcctcagctgatttttctctagcttgatcacccttcttggtttcatgttcagttcaccattgcctttattgataaa

SEQ ID NO: 6034 - DNA, 201 bp, Homo sapiens
ttatttttgccaaagttagcatttaacgtggacataatgatggttcaactccatggatcccatgtgccaatcttcccccagctccactattgaaattctayacatccactgagtccagtccgttttccccccaaccatcactcactctgacctggttcattctccaggagcctcagctgatttttctctagcttgatcacc

SEQ ID NO: 6035 - DNA, 201 bp, Homo sapiens
atccattaacttagtctctaccaaggcctccgagttcgaggcattaaaggctccccaagtggaattaccagcgtgttataaacgaaagaatctgagtcacmaaaacagcccagcctctgtctgacctccgaccctcctcatctgacactacagcttttcccaaggcagctgcaggtgagatattcattcaaaccagcagga

SEQ ID NO: 6036 - DNA, 201 bp, Homo sapiens
tttggctgcatagcaaccactactgccatcaatgccctcggggaatgctcactcttcctgtccgccatcttgatgagtctattaaatgcacttgcttgatmgagagctgagatgcaacatgcaagctgtgtccaacaggctttttaattttgagtagcatgccctcagagtcctgcctagtcccctcaacctctcaagttt

SEQ ID NO: 6037 - DNA, 201 bp, Homo sapiens
tctctgcgtcttccccatctcaacaaatgtcaactccatccagcacgttaactataccatattaaaactctaactaaaaataaagctaacatatgacccarcaatcctactgctaggcacatatccaaaagaaaggaaatcagtatatcaaagagatatctgcactcctatgtttattgcagcactattcacaatagccaa

SEQ ID NO: 6038 - DNA, 201 bp, Homo sapiens
tttccttaaactgactccattttaaatgaattttttattacgaaaattaccaaatataaaagagtggagcattctgtgaccttaaatactatctaaatgcygacagctgcacccacaacccaggctctctcctgagctccgtgttcacagatctagccaacctgtttgatatctgcttccacttgaatgtgaaatgatttg

SEQ ID NO: 6039 - DNA, 201 bp, Homo sapiens
aaaacattttctactggccatttgtagaaaagtatgacctaagttatcagttaatcatatttccttaaactgactccattttaaatgaattttttattacraaaattaccaaatataaaagagtggagcattctgtgaccttaaatactatctaaatgccgacagctgcacccacaacccaggctctctcctgagctccgt

SEQ ID NO: 6040 - DNA, 201 bp, Homo sapiens
actacgtgcgtgacttacttttttaaaacagggtctcgctctgttgcccaggctggaatgcagtggcacgatcagagctcactgcagcctcaaatttctgkgctcaagtgatcgtcctacctcagcttcctatgtagctgggactgcaggtgtaagccatgacacctggtgaagtcattttagtttttagtagagacaaag

SEQ ID NO: 6041 - DNA, 201 bp, Homo sapiens
caagggaggcctgatgcaactggagagtcatagaaattctggctcccagctattaacaatagtatttcttaccatggcagtttcaatgcacatatgtgcaygagtgtgtctgtgcatacctgagcacgctcttatttcatccccgtaaccaatctttattcatttaacagatatttattaagcacctactatgtgcatcac

SEQ ID NO: 6042 - DNA, 201 bp, Homo sapiens
tctgcttttataaaccttgtcttttggcctacagcaccagtctacactttttaccagctctgaggaccttctgagtcacactctgaagtcctgacctcacyataaacaaagagccttttctgggggagttggagctgccctaagccagtgaaagccaatgctcatacgcttgccctatccaactgctttcattagctccat

SEQ ID NO: 6043 - DNA, 201 bp, Homo sapiens
attcattcattcatgatatttataagttggcccgtgtgtcaggtgttgtacaagacagagcagaggccccactctcaaggagcaaccatttcacagaagaracagaaacatgtaaatgaacacatacaagttaaagttgtggtacagctaatgacatgagggctcctatggaaaaggttagcaggactgtcacgaagccct

SEQ ID NO: 6044 - DNA, 201 bp, Homo sapiens
actccacattaaaacacacaggaaaacagatcttctctctggaagacacctgcaatctctttgtttcctttcttatattaggtcttccgcatggtcaaggmaagagacccactccagttagttcaagagaaactgtttattgtaaggacacatgcagattgctaccagaagccttcatattctctccccactcccctgccc

SEQ ID NO: 6045 - DNA, 201 bp, Homo sapiens
ctgttcaccaaccaggaacaccattacatcagcaggaagcaaacttctactatgttataccactgatatttgagggcttatttgttatagcatctaccatyatcctttgaattacgaagctaagggaaaaaaagcccattggctttaaaacccagcagagttcagtaggaggaggaagatggagaaagttataaagtaatc

SEQ ID NO: 6046 - DNA, 201 bp, Homo sapiens
ctctacaagcacctgttttgcaattttcaggttaacaagtaaaatcttccttgagtgtatacctctaagcctgtgaacaatatttctcatccattcatccsctctgaaaatattttacatgcccaatcctctggtaggtaattaggatatagaaattgggcacaatctatgtcttccagtcctggtatggcggagaagaaa

SEQ ID NO: 6047 - DNA, 201 bp, Homo sapiens
ccgatacttgcgacatcaatgtactgctgtgggtacagctctacaagcacctgttttgcaattttcaggttaacaagtaaaatcttccttgagtgtatacytctaagcctgtgaacaatatttctcatccattcatcccctctgaaaatattttacatgcccaatcctctggtaggtaattaggatatagaaattgggcac

SEQ ID NO: 6048 - DNA, 201 bp, Homo sapiens
ttattctctggttcatttaattttttgagtttgcagcccttgctgtgcatgttccttccctgcttaaaatgtgctgctttcaatgctctgttgcaattgtrtataaagtaaaagtaaactagcctggagagacagtcttaagacggctctcctttgtgtagaatacatggactttgttgaccactcttttgcatgatctaa

SEQ ID NO: 6049 - DNA, 201 bp, Homo sapiens
ccaccttcgggcacaacctctctccataactgagtggtccacagatttgcactacgggttccccagctcctttccagggagagaggaggagaggtcctgarggctctgcagcccctcgctgagcatcccctacagagtcgggcctgctccctgggccaggctgcctgggggcgccccccagcccagccagccaggctctca

SEQ ID NO: 6050 - DNA, 201 bp, Homo sapiens
cccacaacaacttcctgattctcccatggttcatagatttcatagctgatgaggtagacctaacttcagccctgacccggaagatcatgctgaagacaccrctgatctcttcccctatggacactgagacagaggccgacatggccatcgcgatggctctgatgggaggtattggtttcattcaccacaactgcaccccag

SEQ ID NO: 6051 - DNA, 201 bp, Homo sapiens
tcggcgccaactgccgcacccacaacaacttcctgattctcccatggttcatagatttcatagctgatgaggtagacctaacttcagccctgacccggaakatcatgctgaagacaccactgatctcttcccctatggacactgagacagaggccgacatggccatcgcgatggctctgatgggaggtattggtttcattc

SEQ ID NO: 6052 - DNA, 201 bp, Homo sapiens
ccttgcggcagcatggcggaccatctgatcagtggcggcaccggctacgtgccccaggactggctcaccgtgcagcagctcttcctcggcgccaactgcckcacccacaacaacttcctgattctcccatggttcatagatttcatagctgatgaggtagacctaacttcagccctgacccggaagatcatgctgaagaca

SEQ ID NO: 6053 - DNA, 201 bp, Homo sapiens
gccttgcggcagcatggcggaccatctgatcagtggcggcaccggctacgtgccccaggactggctcaccgtgcagcagctcttcctcggcgccaactgcygcacccacaacaacttcctgattctcccatggttcatagatttcatagctgatgaggtagacctaacttcagccctgacccggaagatcatgctgaagac

SEQ ID NO: 6054 - DNA, 201 bp, Homo sapiens
cattaaaaattatgcttacagttcccaggcccacagcgtcagcagcagcggcagcagcggcaggcggccgcgcgggtgtttgtcgcttcgcggggccttgmggcagcatggcggaccatctgatcagtggcggcaccggctacgtgccccaggactggctcaccgtgcagcagctcttcctcggcgccaactgccgcaccc

SEQ ID NO: 6055 - DNA, 201 bp, Homo sapiens
accactatgggcattaaaaattatgcttacagttcccaggcccacagcgtcagcagcagcggcagcagcggcaggcggccgcgcgggtgtttgtcgcttcrcggggccttgcggcagcatggcggaccatctgatcagtggcggcaccggctacgtgccccaggactggctcaccgtgcagcagctcttcctcggcgccaa

SEQ ID NO: 6056 - DNA, 201 bp, Homo sapiens
cactaagtggttaaataaccaccactatgggcattaaaaattatgcttacagttcccaggcccacagcgtcagcagcagcggcagcagcggcaggcggccrcgcgggtgtttgtcgcttcgcggggccttgcggcagcatggcggaccatctgatcagtggcggcaccggctacgtgccccaggactggctcaccgtgcag

SEQ ID NO: 6057 - DNA, 201 bp, Homo sapiens
atgaaaatgaccaaggcacccaacactaagtggttaaataaccaccactatgggcattaaaaattatgcttacagttcccaggcccacagcgtcagcagcwgcggcagcagcggcaggcggccgcgcgggtgtttgtcgcttcgcggggccttgcggcagcatggcggaccatctgatcagtggcggcaccggctacgtgc

SEQ ID NO: 6058 - DNA, 201 bp, Homo sapiens
ttttaaagaagagaaaattgagtgtattagtccattttcatgctgctgataaagacataactgaaactgggaagaaaaagaggtttaatggacttacagtwccacatggctgggaaggcctcacaatcatggtggaaagcaagaaggtgcaagtcaagtcttacatggatggcagcaggcaaagacagagagcttgtgcag

SEQ ID NO: 6059 - DNA, 201 bp, Homo sapiens
caggacatggagggattcatgaagggagagaaggaaggcagggaagctgggctgtgcaataagcagcaagcctgggtgttatttcagcctcccgagaacaygccagaatagacattgccattacctccattttcagaggaagaaactaagacaaatgaatcagacagaagacatgatgttcatctcataaatggacatgtg

SEQ ID NO: 6060 - DNA, 201 bp, Homo sapiens
aaaaaaggagaataaggcaggaattcaaaatactcttatgaacagaaaggcaacaggtagagcaggacatggagggattcatgaagggagagaaggaaggyagggaagctgggctgtgcaataagcagcaagcctgggtgttatttcagcctcccgagaacatgccagaatagacattgccattacctccattttcagagg

SEQ ID NO: 6061 - DNA, 201 bp, Homo sapiens
ctttggggaagttggctccttcacttctagagaaaaaaggagaataaggcaggaattcaaaatactcttatgaacagaaaggcaacaggtagagcaggacrtggagggattcatgaagggagagaaggaaggcagggaagctgggctgtgcaataagcagcaagcctgggtgttatttcagcctcccgagaacatgccaga

SEQ ID NO: 6062 - DNA, 201 bp, Homo sapiens
agggtgaggggtgtgagggaaatggtggcagcaagaagttgagcctgggcatctgggaggatggtggtgccatgccctggaggaggaccagtttgaagaargaatatcataggagtccaataaatactactagaatgaatgacttaataatcagtatgtaagttacattcattcccctctgcttctggctttccatctgat

SEQ ID NO: 6063 - DNA, 201 bp, Homo sapiens
aaaccagtttgaagaaactattcgacgtattcattctgtcatctgttcattcatctgttattgaacctttcaaggtaaaagattagaggattctggccagsagagaaaagagaaaagtggatggatatgaacactatgtagaaggtgtagtcacagggtgaggggtgtgagggaaatggtggcagcaagaagttgagcctg

SEQ ID NO: 6064 - DNA, 201 bp, Homo sapiens
tccttttaacaagctcagtttatcaatgtccttcttaaaatacagaactcacacatgagcataaccgaagatacaatatttgtgaagggactgtgaaaacragagtaggcagaggcaaagggttgttattttttctctaggactaaataaaaatataaatgctatttctcttaacacaaaccagtttgaagaaactattcg

SEQ ID NO: 6065 - DNA, 201 bp, Homo sapiens
ctttttttttaaggacaaagaaagtaaatatgggaaaatgtaaacttgtccaaagacatacatctagtcatgagaaagctgaaacccaaaacagctaagcygatgtatcacagcctctgaatcaccatcactgaaagaaacaacacacttggggatgggggagtggctctccttgcacaagctgggatgcaatttgcagac

SEQ ID NO: 6066 - DNA, 201 bp, Homo sapiens
atgaatgatccttgacatcaagaagctcaaagactagctggaaagatactaatatagcaattccttttattttctctaataggagacccactcgcaactaygaggaatagatactatcagcagcaacagcaactttttttttaaggacaaagaaagtaaatatgggaaaatgtaaacttgtccaaagacatacatctagtc

SEQ ID NO: 6067 - DNA, 201 bp, Homo sapiens
atttgggataccaattataaacttgggacaagagcctaatctcccagcaaggaaaacctgggctgtcagtctactttaccaatccctgccttggaaattgytatatatctcaggctacaagaaagtagagggagacaagagaaaaagcatccctcacacaaccttcagatcttccgctggagagatagccccactctagga

SEQ ID NO: 6068 - DNA, 201 bp, Homo sapiens
ctcttgtcccaaaggatgaaaacctccgagcgccgtggaagagaacagtctgattaagttggctcaaactgccaggaagctttctgagcaacagcagatgytggggcttcgagaaagattgctctctgcttttggccagaatccctggggtcatttaggtggtgatgttgccagttcttctcccctctggccaacacctct

SEQ ID NO: 6069 - DNA, 201 bp, Homo sapiens
atgaacagcaggtgcaaagggcccatgtcagacaggtgaaggggggacatgagggcaactgcaagaaggccaatattacttttgcaaggagcaggtgagasgtggggctccagaggtagccgaggtcagccatgaagtgcttggaaggccacagagacaaattttattcctatcaccatagcaacgggaagccatgaaacc

SEQ ID NO: 6070 - DNA, 201 bp, Homo sapiens
tcagctaactagtgttcccctggctcaaagaaaatgtggaagttggtggtttttcacaaggatgatactatctggagctgctgtcctctgagagtaggacrggtcagaagagatctgcacctgctctgttaaggtagtcttgccatctctaagggtttgatttgctggcttgtttactggagtcagaaacagaataaaggt

SEQ ID NO: 6071 - DNA, 201 bp, Homo sapiens
aagctttataaaataagcacaacaatgaatgttaaatatgtaaccaccataagtgttaccaacgagaagcatatggtgggttccaggagggcagttgatayaggttatggtttaggaacgatttttctaaggagtaatgatgaggttgaggtctggagaatgtctaagaattatgagagagtttggggtatgtgtgcttct

SEQ ID NO: 6072 - DNA, 201 bp, Homo sapiens
tgggggatgtgcctgtgtgctccacgggtgtcctcttgaatgttataacctctacatgaagcaaaatcctatgtcctgcacacagtaggcactcagaaagygtttgttgaattggatgacacctgagtttgtgcttctggacattctaaatacttttttatgcaaatctccagctttccttcccatggagactcacagcac

SEQ ID NO: 6073 - DNA, 201 bp, Homo sapiens
cagcagtgagccgagatcatgccactgcactccagcctggacaacagagtgagaccctgtctaacaacaacaacaaaaggcattcagttgtaaaaattaamtaagttgacaaatatcaaaggcttagaacctggtgacatgtcttcagcacacagtaaacactcaatgactatttatattctttactgagcacctactaag

SEQ ID NO: 6074 - DNA, 201 bp, Homo sapiens
gcctataatcccagctacttgggggttgaagaaggagggtcgcctggacccaggaggtcaaggcagcagtgagccgagatcatgccactgcactccagcckggacaacagagtgagaccctgtctaacaacaacaacaaaaggcattcagttgtaaaaattaaataagttgacaaatatcaaaggcttagaacctggtgac

SEQ ID NO: 6075 - DNA, 201 bp, Homo sapiens
cttcccctgctactcctgtctgcatcctggactgaacttaccaaacacgctcatagagctgcttctctttacaatgttcttttctgcacctcaccccccayccctactctcctacctgacgaatttatctttcaagacatgctttataaagtcaccttctctaagaagtcttcttgaattctttctatgaagagtccttag

SEQ ID NO: 6076 - DNA, 201 bp, Homo sapiens
ctcttcccctgctactcctgtctgcatcctggactgaacttaccaaacacgctcatagagctgcttctctttacaatgttcttttctgcacctcacccccsacccctactctcctacctgacgaatttatctttcaagacatgctttataaagtcaccttctctaagaagtcttcttgaattctttctatgaagagtcctt

SEQ ID NO: 6077 - DNA, 201 bp, Homo sapiens
ctagaggtttcctttcatgaagataaagtttctagctggaactggctgtttttgcagggaagcacacatgagacgagctttttggagtctctccaatacckgcctgtttcataaatggcacagtctccaaatctgatgctcactggaccagggtcaggctatggaactgattaaaataagtaggaacctccaaggccctat

SEQ ID NO: 6078 - DNA, 201 bp, Homo sapiens
tgtttgcagagtcccaactgcagaagagagtgacatgccataaacaggtcaaatgtcgttaatataaatatctaccatggggcaatttccgaggctcttayatgcttcgtcctgaggttagcatgaggcaactgcactcactgctacgccttcccacacttattctaagggacagccagctaggatggagtgggagctgat

SEQ ID NO: 6079 - DNA, 201 bp, Homo sapiens
actaagaaagcaggaaagagcttggcacaggctgggaagaagcgacagaaagaaggttgctatgataacgcaatggtgtaatcagtgtgatttttatgtgyttgtatcagagaaccctgggtgcaattcctgtatgaagaattgcatgagcactttgtatgagaatgagcaagttaccctctgtgcaatgctgctctcagc

SEQ ID NO: 6080 - DNA, 201 bp, Homo sapiens
tgtttgttgcttacaagctacccagtttatgacattttgctatagcagcccaaacagactaagaaagcaggaaagagcttggcacaggctgggaagaagcsacagaaagaaggttgctatgataacgcaatggtgtaatcagtgtgatttttatgtgcttgtatcagagaaccctgggtgcaattcctgtatgaagaattg

SEQ ID NO: 6081 - DNA, 201 bp, Homo sapiens
atgtttgttgcttacaagctacccagtttatgacattttgctatagcagcccaaacagactaagaaagcaggaaagagcttggcacaggctgggaagaagygacagaaagaaggttgctatgataacgcaatggtgtaatcagtgtgatttttatgtgcttgtatcagagaaccctgggtgcaattcctgtatgaagaatt

SEQ ID NO: 6082 - DNA, 201 bp, Homo sapiens
aagcagagtccagggggaggcaaattgagatgcaggagggaaggagataagagcaatagggaatcctcagagcacctggcaggcccccagcccctgggggmaggagaagccaggccacgtagtcatgtccccatggagaatgcagctgctcctctgtgctctgccctcggttgctactgccctgcgaggcaaactcgaggc

SEQ ID NO: 6083 - DNA, 201 bp, Homo sapiens
cagcaagctgtgcatgaccacctttcccaatgcagtgaaggatagatcccacgtcttgggcttaggcagttaggtggatggtgagtgcaattactaaagaragaaagacctgggaaggaacagttaagggtggggagcaagaggaagacaatcaagaaatgctcagtacctgtgggttccctcttgcctatccacccctcc

SEQ ID NO: 6084 - DNA, 201 bp, Homo sapiens
ggccactcatacagccatacagggtccagcaagctgtgcatgaccacctttcccaatgcagtgaaggatagatcccacgtcttgggcttaggcagttaggyggatggtgagtgcaattactaaagagagaaagacctgggaaggaacagttaagggtggggagcaagaggaagacaatcaagaaatgctcagtacctgtgg

SEQ ID NO: 6085 - DNA, 201 bp, Homo sapiens
tcccttgcaatgcgtcagtcccccacagccagtggatctgctctgcagtcaacccaggcagtgcagctgcacacacccacctcgtgctgcagtagaaggamccagatccctttccaccagggacagatatagtagcaggtttggccaggggccattagatgcacacacttgagcagaacaaagtacatcaagcccagaaca

SEQ ID NO: 6086 - DNA, 201 bp, Homo sapiens
cactgggtggtcaggctgggcagccaaggttaaaaggctaagtgtcatccagggaagagaccatcacacgatttgaggttgctgagaacagacaacacacrcaccaggctcaagtggtagagcaagaggagacagactacacaagatgcagtcccttgcaatgcgtcagtcccccacagccagtggatctgctctgcagtc

SEQ ID NO: 6087 - DNA, 201 bp, Homo sapiens
aaggagaataattatacattgcactagactctggtggggatgagagaaagagaatgttccaccattcactgggtggtcaggctgggcagccaaggttaaarggctaagtgtcatccagggaagagaccatcacacgatttgaggttgctgagaacagacaacacacacaccaggctcaagtggtagagcaagaggagacag

SEQ ID NO: 6088 - DNA, 201 bp, Homo sapiens
tggcaagaggagagggataagacaggtgggtaaggaccccgcagttcatgagaaggcacctaggttctagccaccaagatgtcatgagaagcccttaaagrctattcagaagagaagtgacctgatccaatttaccctggctgcaaaggaaaggatgaagtaggggaggagtagaggtagaagcagggagaccagtggagg

SEQ ID NO: 6089 - DNA, 201 bp, Homo sapiens
aaagagacccatgtttccacccaggatctatcactctgagaccttaggatgagtgactgaagcatcttaagctgcccctcccagtgtttgctaaatgtcayggcagagggttaacctcccaggagattgagaaggttaaatgagataccacgtgtgcagaggccagcatggtgcccagctcagcagtaggcacttgggaaa

SEQ ID NO: 6090 - DNA, 201 bp, Homo sapiens
cctgaagacagatgtatgctgcaaaatagcagttccatacaaatgcaagagggcgtcaaagtcaacagggacaaaactatgggctatttcatgttcctcaytgagtaagacctcactcacaatcacttattctgattataaaaatgatgacctacaaagagacccatgtttccacccaggatctatcactctgagacctta

SEQ ID NO: 6091 - DNA, 201 bp, Homo sapiens
cacggtcagtgcattcatccaaacggacgaatccccatgcctcatcaattgttacactttttcaatgtcacctacctaagaaaatcagaatacaccgtaasgtggagaatccatatgcagataaatgaaagaggagagtcaggaccatgcaaaaaattacagggaaatttagcaaagtctggtgataacatagactctcca

SEQ ID NO: 6092 - DNA, 201 bp, Homo sapiens
ctagactatggggaaatctccattgtttcagggcaagattgatattcagctggttgtttatggctggcaagcattcacacggtcagtgcattcatccaaayggacgaatccccatgcctcatcaattgttacactttttcaatgtcacctacctaagaaaatcagaatacaccgtaacgtggagaatccatatgcagataa

SEQ ID NO: 6093 - DNA, 201 bp, Homo sapiens
gatggacagcttcactccatgttaacccagcgactccatcaaacctatgcttgtttctactgttcatgcctctacattgatgtttctcaagcttttatgayccaggtctccttgataaacatttttaacctcacattttcctctaatgctatttgaaatggcaagagaaattaatatggtgactaaaacatatcaagagat

SEQ ID NO: 6094 - DNA, 201 bp, Homo sapiens
agcaacatgcaggggccctgcatcaacaggtacttgaatgctggtgaatgcgtcccaggcacctcacttcgttcgcccattttggtgcatcagaacaacgwtgtcactggtctaacctcatcttcactccctggggactgaggtcttgcctgattcccaaagccctgcaccagagatcctcaaacattttcaactaggact

SEQ ID NO: 6095 - DNA, 201 bp, Homo sapiens
ttcagaatcaggggctgactcttctatttttcaaacaacccccaaaactagccacagcaacatgcaggggccctgcatcaacaggtacttgaatgctggtraatgcgtcccaggcacctcacttcgttcgcccattttggtgcatcagaacaacgttgtcactggtctaacctcatcttcactccctggggactgaggtct

SEQ ID NO: 6096 - DNA, 201 bp, Homo sapiens
cagcaaccataagcctcccacccaaaaatctattctctccttctttaacatgagaaggaaataaaattcttacttaagccattgataatctggattttctrtcataaaccaccaaactgaatccaattgatttagtatcccgtgaatatttgttgaatgaataaataattctcaagcaaatcagaggatctaaattacatg

SEQ ID NO: 6097 - DNA, 201 bp, Homo sapiens
tgaactgggatgagatggaaacccaggtccggtacttgctgacttctccactgatgtacataccttctttatggattgcgagtatccacttctacctaagrcaggagttgataagctttctctgtaaaaggtcaaataggaaacacttcagattacaactactcacccctgctgttgtagtaaaaagcagccctagacagt

SEQ ID NO: 6098 - DNA, 201 bp, Homo sapiens
ggatcagatagggtaatggccggaccaaagtcacataaaaaatgaatggctgaactgggatgagatggaaacccaggtccggtacttgctgacttctccaytgatgtacataccttctttatggattgcgagtatccacttctacctaaggcaggagttgataagctttctctgtaaaaggtcaaataggaaacacttcag

SEQ ID NO: 6099 - DNA, 201 bp, Homo sapiens
tcacagtgatgaatagaacatgttggaaagtggctcagagagtaggaattaaagaatgccagctccagtaaatgtcacatatcaatcaaaagtgaagaaakggagttccctccaaaagtggcagaggggacaccttcataaacagaacataaaggccaatcgaactcagcagcaaaatgggacgtattcagccagagcctg

SEQ ID NO: 6100 - DNA, 201 bp, Homo sapiens
tctgaaaaagactcccaaacccacagtgaagtcagtctggggcagagagaggtggtgtgatattatatatgtcattataaactctaagtgcctcttttccraactcttagaaggttagtagtggcaaaggcaacaaaaaagtcacagtgatgaatagaacatgttggaaagtggctcagagagtaggaattaaagaatgcc

SEQ ID NO: 6101 - DNA, 201 bp, Homo sapiens
aggctaccggagcagacccgggaacaaagtcctcacagcccaatcctctatactagaaagagaaggaaaatcaataggtactaggcacgaaccacatgccrgggtctgtgcttcacgttttctgatgttgcctcagttctgtcccacacattatctgtttagcccctactgtgacctatcttatagataagaaaattaagg

SEQ ID NO: 6102 - DNA, 201 bp, Homo sapiens
gcaagtgcaggattcagctacccctggctttgactggtggtagaaatgggtaggttgatgatatattttggaggtaaaatcaaatttgttctaaaaatttytgaagttcagaagcaaataataactttagaaaggagcccatgcctcagacaacagagcgtcttaaacaacagaggaaggacttttgactttctcctgtag

SEQ ID NO: 6103 - DNA, 201 bp, Homo sapiens
ccaaagaaaggaaaagatcctacgtggataaagcagaaacctccacacaagagctgtattattagttggtgcaaaagtaatcgtggtttgtaatggcaagraccacaaatacttttgcaccaatctaatacatccataaatggatatatttgaatatggagtgacaataagaagttaaaatttaattttaaaaaaccgaac

SEQ ID NO: 6104 - DNA, 201 bp, Homo sapiens
gagtgacgaatgaagcagagtcactggtatcttttgagcaggtggtgacaagttcataggagttttaggagggcaaatgttgcactaaggtggattgccckggggagaaaatggagccaggattagaccactttgcctagtctacatcctgccacctgctgttacaacgtccttctgttgtcagggtcactcatgaaatgc

SEQ ID NO: 6105 - DNA, 201 bp, Homo sapiens
gtgagtgacgaatgaagcagagtcactggtatcttttgagcaggtggtgacaagttcataggagttttaggagggcaaatgttgcactaaggtggattgcyctggggagaaaatggagccaggattagaccactttgcctagtctacatcctgccacctgctgttacaacgtccttctgttgtcagggtcactcatgaaat

SEQ ID NO: 6106 - DNA, 201 bp, Homo sapiens
taggccctgtccttaaggaatcgccatctgccccaggggacatgaatgatgcttctagccagggagaggggtgggctaagatattccgccttcaggttgcwgggagggtaagtgtgaccagggctggctggcggtaaagacctcccggaaaatgtaggtcctgtgctggatataaagaaaagatctgttgaggcaggaagc

SEQ ID NO: 6107 - DNA, 201 bp, Homo sapiens
gtcttgtttgtgctgagagatctcaaactacctcttttactgaagacttcaagggggaaactacagaattataatggcctggaaggaaatgtctctgaaasacaaggatagtggccagtagacaatggcacacatgcccaaaacattgtcatcaggaaattcaagaggtcattaaattctactgtaggaggaaattaacac

SEQ ID NO: 6108 - DNA, 201 bp, Homo sapiens
gtagtaactcaaagtagtttttaaagtgctccaagtatacaaagctggaaggaattaattctgccttgcatgtgtgtgtctgagggggtgtatcagggacyggaccattcgaattgaatattgccgaattcacacaacttggcaaagagaaagggtattccagggagagagaactgcatgtacaagagcaaggaggtagaa

SEQ ID NO: 6109 - DNA, 201 bp, Homo sapiens
cctcctgcatgggtctcagagtctgatggaaagggcagtcgtaagtgagtagtaataaaacattgggaagaaaaactccatgggtgcagggcattgccttktcacaggagtatccccagagccaagatcaatggctgacccatagtaggcacttaataaatatttgttgagtgaatgaatgagtagtaactcaaagtagtt

SEQ ID NO: 6110 - DNA, 201 bp, Homo sapiens
actgtttttcctctccatggaattctaagctcaaataactgcagtcagttgtaaaagtgcacagacaggaacaagacacctcctgcatgggtctcagagtytgatggaaagggcagtcgtaagtgagtagtaataaaacattgggaagaaaaactccatgggtgcagggcattgccttttcacaggagtatccccagagcc

SEQ ID NO: 6111 - DNA, 201 bp, Homo sapiens
tatttatagctgctccccattgcttgcattaccacctgagctccacctcctgtcagataagtggcagcattagaatctcataggagcaccaaccctattgygaactgcacatacgagggatctagatggcatgctccttatgagaatctaatgcctgttgatctatcactacctcccatcaaccccagatgggaccatcta

SEQ ID NO: 6112 - DNA, 201 bp, Homo sapiens
tggccgagaagacttcacagaagtgattgaggatcttgatatggggagattatcctgaagtccctggtttggcccaatgtaatcagaagtattcttctaasagggaggtagaaagggcagagggagacaaggacttgaagatgctacacttctagccttgaagatgaaggaagaagccaggagccaaggaacaaatacagg

SEQ ID NO: 6113 - DNA, 201 bp, Homo sapiens
gccacaaggggctcaaaatgtctcaacccataaaagacttctctccccatttcctctctccatctcaaccttggagggtttctgttcctaatgctattctwcatggcagctgggatcagtgcaagctccagggccaagttctacaagcctccttcctgctgacgtggaggaaggagccgagggagagatctctctggcccc

SEQ ID NO: 6114 - DNA, 201 bp, Homo sapiens
cctgccctcaagtaatttatatccttctataaatgatcatttattttataacataaaacaaccacaaccattatttggtagcagatagatctaggtcccastctccgctagcttgtggatgttactgtctcgatctcagtttcttcatccagaaaatcggggtgataaagtctacctctctagatcattttcagaattcag

SEQ ID NO: 6115 - DNA, 201 bp, Homo sapiens
tacaatttagatattatcacccctactttacagatgaggaaactgaggcttgatgccgttaaataacttttcctaggtcacatagctagtgagaggcaccrctaggattcagtacaggcctttgaactcaaagttgacattcgttccaacccaccaggctgatgatcaaagtggcacgctaagaaagcaccccaggatttg

SEQ ID NO: 6116 - DNA, 201 bp, Homo sapiens
agatgacatcaacaaaggcaatgtggttgccttctctcttttggatcactcactctgaggaagttggctgccatgacatgagggacttcaagcagccccayggagaggttctcaaaatcaataaatgaggccccctgccagcagcctcggaaacaagccatccatgccagccagtcctccagcctcagtccagcctttaga

SEQ ID NO: 6117 - DNA, 201 bp, Homo sapiens
caactctcttctcatgaatggagtgggggacaaaagacagtgtgatttctgagatgacatcaacaaaggcaatgtggttgccttctctcttttggatcacycactctgaggaagttggctgccatgacatgagggacttcaagcagccccacggagaggttctcaaaatcaataaatgaggccccctgccagcagcctcgg

SEQ ID NO: 6118 - DNA, 201 bp, Homo sapiens
acacagacacccaaaatggtaaccaacagtcgtgaaagatgtgttaattaattcgatggtggtaatcatttcacagtctacacactcatcaaaacatcacwttgtacaccttgaatacaaaccactttatttgtcagttaaacctcaataaagctgggaggaaaaaaacagtataccaaagaaatgaaaagatgggccagg

SEQ ID NO: 6119 - DNA, 201 bp, Homo sapiens
aatgaataagttctgaggatggtgactacagttagtaatatcatactatacacttgaaatttgtgaagcgattagatcttaattatactcacaccacatayacagacacccaaaatggtaaccaacagtcgtgaaagatgtgttaattaattcgatggtggtaatcatttcacagtctacacactcatcaaaacatcacat

SEQ ID NO: 6120 - DNA, 201 bp, Homo sapiens
gatctatcactcctaaagagatgacattctggctgtggctagaagaacccaatcatgtaaatttcattttatttcttaaaaaatgttatgggtacatagtrggtgtatatatttatggagtacatgagatattttggtacaggcatttaatgcataataatcgcatcagggtaaaatgaggtttccatcacctcaagcatt

SEQ ID NO: 6121 - DNA, 201 bp, Homo sapiens
ccctggtgaagaaaaggtgaggaacttcagaagaattcaggcccaaatctctttcaaagatttggaaactgggttcccaaaaagagagttgacacatccarggtcggagtgatagtgacacagtcaagactagaatccaagtcttccctgactctcaatctagtaaatttttctattataattcaaataggtagcctatgg

SEQ ID NO: 6122 - DNA, 201 bp, Homo sapiens
cttctctagagatggaagccggagaagcctggagaagcctggggaagccagaaggccctgaacccctgacaaaaagcctaaggatcctcacccagcaatgytgaccacgaccattaaaacatgaagcccacccccaaagaggaaaatccttgccctttaatgaagctgccaaaaacctccaaatttaacagtttgcactgt

SEQ ID NO: 6123 - DNA, 201 bp, Homo sapiens
agattttgagcaagaagcaaagatgcttgtgcaaaggagagtaattcgaagacctttggtagtcctggcaagagatgttgagtgttggatcacagagctgstgatggaaatggggagatgtatttcgactgatgttggtcaagttacttctttctgcacctccatttcctcatctgtaaactgggagtaataagcccactc

SEQ ID NO: 6124 - DNA, 201 bp, Homo sapiens
gcatgagctaccacacccagcctgctgactgtaatttctgatgaccaaaaacttcactgatcactctggaagttatttagtattactatgtggtaaatacygtgctaaacagtacttttcatgcggcacctcaatgaatatgacaatctctagaacattggtcctcaaagcacagcccctagaccaagaacatcaacatca

SEQ ID NO: 6125 - DNA, 201 bp, Homo sapiens
tcactcttttcctaatgctgacaacattaaaagacagagtaatagagtttcaggagtcaaccgtcagagagatgcagaatctaaaagggaacaggcaaggrtaattgaggcagtgttgtgtgtgtgtgtctccaacttgcttccattccatttaaaagggaacaggcaaggataattgaggcagtgttgtgtgtgtgtgtc

SEQ ID NO: 6126 - DNA, 201 bp, Homo sapiens
agtttctgggtttgcttctgccatggttccaggaattttcaatgtatgagtttttgtatggaaaaatttttactttgattactacaccatttaagtagcayacatttgaactcacatgctcatttgggctttaatttcttactgacagcttcaaacagatggtaaacctccttgcattttcttcactttgatggacagaga

SEQ ID NO: 6127 - DNA, 201 bp, Homo sapiens
ttaagttctttctcagggtttcactaagcatactccaggctagagacagctccaggctggatattgcaccaaatgaattcacacatacactccctcacccmctagaagttcatatccctggacagctggtagcagtcattccagttaacagcatttctgaatgcagagaaaaccaggcaacaaatacttaatgagcatttc

SEQ ID NO: 6128 - DNA, 201 bp, Homo sapiens
ttcataactcaagaagtcaatccaaaacacataaatggtcatgccaggtgtcatcaatgaaggccaaataacttcccttcaatactaattcataactctcytgggataagactttttttgccccctcatttgtgctatagatctacttgagctcttctacttgatttccagtgcagtaacttctccatgtcctacttccct

SEQ ID NO: 6129 - DNA, 201 bp, Homo sapiens
tgtgtagcatgtgcaggtttgttacataggtatacacgtgccatggtggttggctgcccctatcaatctgtcatctatattttaagccccgcatgcattasgtatttgtcctaatgctctccctcctcttgccccccacccctgacaggccccagtgtgtgatgttcctctccctatgttcatgtattctcattgttcaac

SEQ ID NO: 6130 - DNA, 201 bp, Homo sapiens
gctacaccagcacactccctagctcacgatattttaagtggatgaataaatgaatgagcaaaaaaagagcaccctacctctaactggatcccccagctgtraactctctcacattttttctctagcaaattccctcttttttgctgtttctttctcctcttttctgttctattctctttcttcatcccctatgctttaaaa

SEQ ID NO: 6131 - DNA, 201 bp, Homo sapiens
aatagattgtgaaaaagaatcaacagagtgatatggggaaaggggaggttcacctggtgttggtacccatgatgaacacattatgcagcaggatggggaaycataatacatggaagagggattcagacaaaggccctgtaacaggagaagaacttgggcatcagaagaacaggaggacagtccatgttgctggagtgaaca

SEQ ID NO: 6132 - DNA, 201 bp, Homo sapiens
tcatccctccacccatttaccctttcactcatccacctttccacccttgatccattcaaccctacatctttccactcatccattcaaataatcattcaccyttctctttatacaacaactcctttaccaatccatcctcttccccttccagccaggctggtcctcccttcccattctacacctacccattaagccaccttc

SEQ ID NO: 6133 - DNA, 201 bp, Homo sapiens
aacagtggtgaaaatcttagctaaaggcattcaaattcatttaaatgtaaatgaaataaaaccgatctactggctgctcatttggactgtctgttctaaaygaactgaaaaatattcatgttccttcctctcgcaaaaacctaggcttccttctataccagtacagttcacgggactgcatcccttctggggcagagcgat

SEQ ID NO: 6134 - DNA, 201 bp, Homo sapiens
ccagggtctcacagaccctaggccaggggctttcaaacttgagtgtgcatgggcatcacccactggagtcaccgaccaggagatctcaggggaagcccaaraatctgcattcccaagtgatgctgatgctgctggtccagggaccacactttgagaaccactgcactggatgatcgatttttttttttttttttttgagat

SEQ ID NO: 6135 - DNA, 201 bp, Homo sapiens
ctaagatgcaaatgcttttcttgtccccatattacacctgagggagccgacgtggagttcagtgactcacccaaggtccgaagtctaaaaaagtacagatyaggttcgaacccatgcaacctggccccagtgcccatgctcttaaccgtgatgccactgcctcccagggggccctggccactcctgaactggacagattct

SEQ ID NO: 6136 - DNA, 201 bp, Homo sapiens
acaggcaatacactaatacagatgaaaatacgttatatgtcaagtgctgataaagtcccgtatttatgctggaatttgggtgaatcatgtcaatttgctgrtaagtgaccactttgatccataaagaaggtgattttgaaaggcttagccaaatacatactcagacaaaatgatgtacaagaaacagcaattcctccagga

SEQ ID NO: 6137 - DNA, 201 bp, Homo sapiens
cttcaaagaggctgacatttgtgacctcattgataaaattttctccaaaccaaaacaggccttatttttatatgttttatatatatataaaaatatatatkttatatatttttaacatgaaaatatatggtttatatatttttaatatataaaaatatattggtttctatattttaatatatgaaaatgttttatatattt

SEQ ID NO: 6138 - DNA, 201 bp, Homo sapiens
tgggaggatggtggtgccatgccctggaggaggaccagtttgaagaaggaatatcataggagtccaataaatactactagaatgaatgacttaataatcartatgtaagttacattcattcccctctgcttctggctttccatctgattagatcaaaagcactcttgcatatggaaagcttgcacgagcacaattttacgt

SEQ ID NO: 6139 - DNA, 201 bp, Homo sapiens
aacacattatgcagcaggatggggaatcataatacatggaagagggattcagacaaaggccctgtaacaggagaagaacttgggcatcagaagaacaggargacagtccatgttgctggagtgaacatagcaataggagacagaggaaatggcgacaaagatggagcagctgcagatgtgctgggccccacagactatggg

SEQ ID NO: 6140 - DNA, 201 bp, Homo sapiens
ggtaatttatagattcaatgccatccccatcaagctaccaatgactttcttcacagaattggaaaaaactactttaaagttcatatggaaccaaaaaagarcccacaatgccaagttaatcctcagccaaaagaacaaagctggaggcatcacgctacctgacttcaaactatgctacaaggctacagtaaccaaaacagc

SEQ ID NO: 6141 - DNA, 201 bp, Homo sapiens
aagtaagtgctcggtaaaatgttagttgtactttgtcaactactgtagtaatcaatagggacaaaacggtgagtgaaaactaatacagttcctgcccctaygaagccgatgatccccgaggagaaatatacattaatcacataccctggaggttaaagatatattcagtactccttgattttggtgatggtatcacagatg

SEQ ID NO: 6142 - DNA, 201 bp, Homo sapiens
atatttgtgaattttctgcatttttgttatacttcaaaagtttaaagaaatcattccaaaccagaatgagcactgtgggaatgagtttttcagaaatcatrgacttaacttctgaataaatgctctcccagcccctgctgagatgccaaagacattccaaaggcacagactgaaaggacagaatgctcacagccaaaacta

SEQ ID NO: 6143 - DNA, 201 bp, Homo sapiens
accagcatgcactgagaaaaggccatatgagcacacagagagaagacagctgtctgcaaaccagtaagagagcccttactcaaacccaaccacgccagctycctgatcttggacttccagcttttagaaccatgaaaaaaataaatttttgttgtttaagacacccagtctatgatattttgtcatggaagcctgagctca

SEQ ID NO: 6144 - DNA, 201 bp, Homo sapiens
aaatgttagttgtactttgtcaactactgtagtaatcaatagggacaaaacggtgagtgaaaactaatacagttcctgcccctacgaagccgatgatcccygaggagaaatatacattaatcacataccctggaggttaaagatatattcagtactccttgattttggtgatggtatcacagatgtatgcatatgtctaga

SEQ ID NO: 6145 - DNA, 201 bp, Homo sapiens
taagaaaggcagagaccctgtactagtctgttcttgcattgctataaagaaatacctcagactgggtaatttataaagaaaagacgtttaattggctcacmgttctgcaggctttacaggaaacatggtactggcatctgcctggcttctggggaggcctcaggaagcttacagtcatggtggaaggtgaagggggagcag

SEQ ID NO: 6146 - DNA, 201 bp, Homo sapiens
gaattgaactgactttgttggtgagtgttttgtttcttccacgagaacagatattccttcagaatcaggggctgactcttctatttttcaaacaacccccraaactagccacagcaacatgcaggggccctgcatcaacaggtacttgaatgctggtgaatgcgtcccaggcacctcacttcgttcgcccattttggtgca

SEQ ID NO: 6147 - DNA, 201 bp, Homo sapiens
taattgattcacccatacatatatccaagcaaccaaccattcatccctccacccatttaccctttcactcatccacctttccacccttgatccattcaacyctacatctttccactcatccattcaaataatcattcacccttctctttatacaacaactcctttaccaatccatcctcttccccttccagccaggctggt

SEQ ID NO: 6148 - DNA, 201 bp, Homo sapiens
actgaatttggaccccagtccaatgactggtgtcctgaagaggagaaaacacaggaacacacacaaggagaaggccacataaatatggaaacagagactasaatgatgtacctacaagccaaagaacgccaagggttgatggcaaccaccagaagttagaagatgcaggggagggtcttcccttagcatccttggaaagag

SEQ ID NO: 6149 - DNA, 201 bp, Homo sapiens
ttatcagattctgttgttttctgtactattcttttttcaatattaaaaaaagaattcttattcctaagtttgtctttagataaatttcccccaccttgatmagactgtatggtgtttgaggagagaaattatatcttaattcatctatgtatcccaggggctagcacagagtctgttggttggaagcaatgatagacagag

SEQ ID NO: 6150 - DNA, 201 bp, Homo sapiens
ctatcttacacacacaccctctttaggaaaactcctgggttcacagttgttaataacttatacttggtaaatatgtggtaaattcatagtcaagtctgtcmtactacctagaccatgaagttttcttgatgccacactgccctcttcccaatggccatatttctcccaaggtaatcctttggtaagagggttttggtctga

SEQ ID NO: 6151 - DNA, 201 bp, Homo sapiens
gtacagtaatagcacacagcccagctcccagtacatggggagctgagaacacattcagtgaaggtataagtaagcaggtgaatggatggacagacgaatgsatggatggatggacggacggatgaatagattggatggatagatggatgaatggatggacagatggatggatggatggtcaaataggacaaatggatggac

SEQ ID NO: 6152 - DNA, 201 bp, Homo sapiens
ctcttgactttgagtttgatcacgtgacttagtttggccaattacgtgagggagacgtgccagtgtgccggttttggcttttgcccagggtgtctaagacygtagggaagagattgtctgggaaactctgcccaagacatcaccagagagcccacgtagtgtggtttctctccttgtatcaatgagaatgaaacccaaaga

SEQ ID NO: 6153 - DNA, 201 bp, Homo sapiens
cggctaaaaatatgaggtttctttttgtggttttggaactgttctagaattagggagtggtgatggttgcacaatatagtcaatatactaaaaagcattgractgtgaactttaacatgataaattttatgtgaattatatctcaaaaacatttaaacgtaagactaggtatcacttattgaccaatttctccttgctggc

SEQ ID NO: 6154 - DNA, 201 bp, Homo sapiens
gggtgtttcagcatctccataccaacagctagaacagattcctctcctaaccctctgtgccgtatcaaccagctggtctagtctgactcacaaatggctayagcctggtggtaaacggaactttgttaaccatttgcaaaaaattccaggcaactggggagatggaacaaaaatgccccccaaagctgcctcaatatcatt

SEQ ID NO: 6155 - DNA, 201 bp, Homo sapiens
ttaaaaaaaaaaaaaaaaacaaaattgataaacctaggtagactgatcaagaagaaaagagactatcagaaataaagtctggtgcattactacagactttmagatattaaaaggattaaaaaacccttatgcctataaatttgacaacctagatgaaatggacaaattcctggaaagatacaaattaccaaagctttttca

SEQ ID NO: 6156 - DNA, 201 bp, Homo sapiens
tgatcagaaggggaaatctagtgtgttaaaattgataaaccagcttaagtaatacctacataaaagaaccatgcctagcacatggctgaatgttgaatacygttgcatggaaatttgggatttctagttagaggctttataaaggtagaatcatgcagacacatatacctggaaatattcggaacattctattagcagaaa

SEQ ID NO: 6157 - DNA, 201 bp, Homo sapiens
agggaacagaaggaaagtcagaacagctgaagtttaaggagcaagagagagtggtgagacatgagttaggacaggaagcagaggccacatcacacaatgartgccctgtagtcaggatagggagtctgtatctaattcctaggtcaactgtattgcaaacaactcctctgctaaatgtgccaccagtgtctcccaataggg

SEQ ID NO: 6158 - DNA, 201 bp, Homo sapiens
gaaggtgtagtcacagggtgaggggtgtgagggaaatggtggcagcaagaagttgagcctgggcatctgggaggatggtggtgccatgccctggaggaggrccagtttgaagaaggaatatcataggagtccaataaatactactagaatgaatgacttaataatcagtatgtaagttacattcattcccctctgcttctg

SEQ ID NO: 6159 - DNA, 201 bp, Homo sapiens
aacaagcatctattgtctgctctgtgccatcccctatggtaggcactgggacgaaaagaatgaatgatccttgacatcaagaagctcaaagactagctggraagatactaatatagcaattccttttattttctctaataggagacccactcgcaactatgaggaatagatactatcagcagcaacagcaacttttttttt

SEQ ID NO: 6160 - DNA, 201 bp, Homo sapiens
ttgtaactcttgtaagatgcttttcagttcacatctttttaaatgattgtctgtccacactgttcactccatctgtgcagctttatgttatttgaaggcayagtgcccccctgctggattcactttataacaatcagttctcccaccaggatgattagcgcccagaaagtgtaagtaaatatttgtggagaaaactgattt

SEQ ID NO: 6161 - DNA, 201 bp, Homo sapiens
attaaatgtatactgctcgggtgatgggtgcaccaaaatctcagaaatcatcactgaactactcatgtaaccaaatacctactgtcccccctccccccccmaaaaaaaacctatggaaattttagaaaaggaaaaataaataaataaaactagtattgatttgggttatttcagtttgtgttctccaaatagttgttaaaa

SEQ ID NO: 6162 - DNA, 201 bp, Homo sapiens
acgtttcttgtctccaaggtaaactcaggcctggatcagacagctctgcttttagccatccacgtgaaccaggataaggtatttctctctctaagcctctktttcctcatctgcaaaatgcggttgtggtaagggctgaataccattgtggtgatggttccacaggtatatgcctacatcagcactcatccagctgtgcgg

SEQ ID NO: 6163 - DNA, 201 bp, Homo sapiens
ctcttgttaaggaaatgtttcaggcccaaggccactcatacagccatacagggtccagcaagctgtgcatgaccacctttcccaatgcagtgaaggatagrtcccacgtcttgggcttaggcagttaggtggatggtgagtgcaattactaaagagagaaagacctgggaaggaacagttaagggtggggagcaagaggaa

SEQ ID NO: 6164 - DNA, 201 bp, Homo sapiens
tttttaaagcaaatattgaaacccccagtatgactaagaaaaagaaagcagattggaaccaaatactttactacgttaaatgacacattggaaattttcargacaatttcttaagcaagtaatacgggttccatccggctccatcatttgccattcacttgacaaatgtcataacgccactgcacaccccaccagagcaaa

SEQ ID NO: 6165 - DNA, 201 bp, Homo sapiens
ttcttttctcttctttatcctttattattaccacctccttctccttttttccccctctaatttctccctcatatatctctatccctttttccttccccacmctatttgtctttctttcttcttgttctcatcttcatcttctcccttctcttaggagaactggacaaccaactttaagtcttctttttttttttttttttt

SEQ ID NO: 6166 - DNA, 201 bp, Homo sapiens
acacatagacctgaggtagaaaacaaataatcagaggagaaggcaagagaaaggtgaagccaccttaggtagaatggtcaggaaacatcctttctgagaaracatttaggctgagaagctaattaagaaataacagagaaaactaatgaaacccaaagctgattctctttaaaaaaaaaaaaaaaaacaaaattgataaac

SEQ ID NO: 6167 - DNA, 201 bp, Homo sapiens
gtaccattgctcttgcagcctgcaggtcccaaaggaaattgtgtcattttatcttgcctagctccaaaaggagcagcctctgtcagaagatctcaatcatsataggcacatcccaggtgtgtgtcctgcttctcatcaggcctccccatcttactagaccactaggttcagccctgacttgtaggaggggctgggcctcca

SEQ ID NO: 6168 - DNA, 201 bp, Homo sapiens
gaagcagctttatttctgcaataaaaaggagtgtcttgggctttcccataacacttgctaggggcaggccctggtggtaaacattatcgtcgaaatgtccrtttcaaaaatatcccagtgttctcaaagaaatgtctccaaacagctctgaatgctcaagttccagaagaaattgcttcttctccctttgggagtctgtat

SEQ ID NO: 6169 - DNA, 201 bp, Homo sapiens
gaggcctcaccagaagccaagctgaagccagcaccatgcttcctgtatagcctgcagaaccgtgagccaattaaacctctcttctttacaaattacctaaygttgggtatttctttcttctttttttcttttttttcttttcttttttattgggggggacagagtctcactctattgcccaggctgtagtgcagtgttgtg

SEQ ID NO: 6170 - DNA, 201 bp, Homo sapiens
gtgtcctaagtggccaatcagaaaatctcttctccatgcacacattgattcatctaaaggaaggcatgaaattcatgtgaggctcatcatactctttgagrgggggatagatgtggatgcttggatagaaggagttgcagacttaccatcatgtgggggtgtgagcctatcagtgaagccattgcagtgaaaagtagagcc

SEQ ID NO: 6171 - DNA, 201 bp, Homo sapiens
attccttgtgtgtttgtttgtgtgtgagtctattcaatgtagttagaactgggttttagttactagtcacagtgaagagttctgatgacacagtgacaccrcctttaaatccatccagggaactgaatgacttaagggctcctgggcagcccaaatacaagcacctccatctatatgtcttctcattttctactctttctt

SEQ ID NO: 6172 - DNA, 201 bp, Homo sapiens
aacaatagcatataaaattagatttttatttatttatttttattattatactttaagttctagggtacatgtgcacaacgtgcaggtttgttacatatgtrtacatgtgctgtgttggtttgctgcaattagatgtttttaaccaaagagttttcaccatttttcaaatcctaattaatgaagttcttccaaggcaaaaaa

SEQ ID NO: 6173 - DNA, 201 bp, Homo sapiens
cccaaagtgctaggattacaggcgtgagccaccgtgctcagaccctttggagtctgggaggacacaaaaatgggtcttctcactatgactcatcagattcycagaacatcttcctttcggtgttgcctcaaaccaagccaggtttgtaagcctgtaaggagggcagtctgatataagaaacatcatctcgattcttttcag

SEQ ID NO: 6174 - DNA, 201 bp, Homo sapiens
tgagggcccaacttcattaattccaccatcttgactcaaagccatgtgaggcaagtccaccctcccagatgcagcagtgagaaactcattcctttctctcytccctgtggtgacccaacacccatgttgttttaaagacaaatttaaaaactctcaaaaggacaaaacaaaggcccaataaatctgacaaataagaaaaaa

SEQ ID NO: 6175 - DNA, 201 bp, Homo sapiens
tgtgacctctgttctcacgatctcagagggtcactgaactatttgccgaagtgaaaaaatacttttgatggtggtggtgataggaaatagtacaagattckggacacaaatagattgaatttgggagataaatattccttatttaaatgtcagaatattccatttctgtataatgctgagaagtcacaaaaccaaaataaa

SEQ ID NO: 6176 - DNA, 201 bp, Homo sapiens
taatgctgagaagtcacaaaaccaaaataaaaatagggctaggcttaaatgtatccagttagaggcagggacaggctgtctttggcataaatgtttcaccrccaccttccaactgagatttctgctccatggatgaaacttgagtattgttaagttcattgctacttgtcacattgcaggatttcacaggccacgtgatta

SEQ ID NO: 6177 - DNA, 201 bp, Homo sapiens
aaaaatagggctaggcttaaatgtatccagttagaggcagggacaggctgtctttggcataaatgtttcaccgccaccttccaactgagatttctgctccrtggatgaaacttgagtattgttaagttcattgctacttgtcacattgcaggatttcacaggccacgtgattagtcgcacaagttggatggagttggggga

SEQ ID NO: 6178 - DNA, 201 bp, Homo sapiens
aatcacttgaacctgggaggtggaggttgcagggagctgagatcgcgccattgcactccagcctgggcaacaagagtgaaactgtctcaaaaacaacaacmacaaaaaacccaactacaacttgtgcagcttcccaaccagtgtctctttcagaagaaaaattaaaaagaggattggacaataaaagattggacaactcta

SEQ ID NO: 6179 - DNA, 201 bp, Homo sapiens
aaggatagcaataacttcagatcccgtgctgttttgagagccactggctaaactgggtttccagtactacagcagctaacaaccctgccctaatgaccaaygaggggaagtaaatctgggtgtttacacgtgcctttcacaggatgcttcttttacctagtagacaacctcatgcctagttttcctatccatgaccagggg

SEQ ID NO: 6180 - DNA, 201 bp, Homo sapiens
ctgttttgagagccactggctaaactgggtttccagtactacagcagctaacaaccctgccctaatgaccaacgaggggaagtaaatctgggtgtttacaygtgcctttcacaggatgcttcttttacctagtagacaacctcatgcctagttttcctatccatgaccaggggatctctcccaggaggaacttatttataa

SEQ ID NO: 6181 - DNA, 201 bp, Homo sapiens
caaggtaacctatgctgtgttgctcagttctacatgccaagaaatagctcctcttttcagcaagtaaaattatctcactgcttttcagtttcttttttatygaagtgttgtcaacaagttccttgaagctgtaaaatccagaagcgaaatggatcacttccatttgatctgtattccccattgcttagtatacacaaggag

SEQ ID NO: 6182 - DNA, 201 bp, Homo sapiens
agctcctcttttcagcaagtaaaattatctcactgcttttcagtttcttttttatcgaagtgttgtcaacaagttccttgaagctgtaaaatccagaagcraaatggatcacttccatttgatctgtattccccattgcttagtatacacaaggagcttaatgggcatcggagacttagttgtggaatgaagagagaagga

SEQ ID NO: 6183 - DNA, 201 bp, Homo sapiens
caaaataaggcaatgttgatgttggggcaagaatctggatctctaaatgactggtggcaacagccaaccacacagccactgatgaagacacctagagttcwgttgcacaagccagctttacctcttacagaaagtcgaaaaggagcacttgcaaattggagaaactacctgcactgctggcaggaatgtaaattggtttac

SEQ ID NO: 6184 - DNA, 201 bp, Homo sapiens
tagtacaggtataagtgttcttttactttgggggttaagtgaggtaataataaggaaagttgaagaaaacagactttctaaaccagaggagagaaaaatayaaacttttttaagcgtgatatttctttacaaaaagagaaaatttctttaaggataaggggaaaccagtcatgtttagttaaattcttccaattgttggaa

SEQ ID NO: 6185 - DNA, 201 bp, Homo sapiens
atgtcacttttattgtttaagccagaggtcactaatctttttttttttttttttatggtaaacggccaattagtaaatattttcagcactacaggccatayggtctctatcacaactactcaactctgcctttgtagcacaaaaacagccatagacaatgcgtaatacaggaatgagtgtggttgtgttccagtaaaactt

SEQ ID NO: 6186 - DNA, 201 bp, Homo sapiens
atactagccaaatatcaaaatgtgtagcatttggaaaataatgtaatggtttctggtttaataaagatgatgacattttatgcaaaaaattaaaataattrtgaaagcagatagtatagttacataagaatgcttaaaatgtaataataagtgaaaaatcatggactataaaagtatatataaccaataattataattaaa

SEQ ID NO: 6187 - DNA, 201 bp, Homo sapiens
gatgatgacattttatgcaaaaaattaaaataattgtgaaagcagatagtatagttacataagaatgcttaaaatgtaataataagtgaaaaatcatggamtataaaagtatatataaccaataattataattaaagaaatgtgtctgcaagtaacagggatcaggagataatacataaattaaaaacaattatgttaaag

SEQ ID NO: 6188 - DNA, 201 bp, Homo sapiens
tagactgagagggatttggggccactgtttatccatgccataaattttgcacaagcctatgtgacatcaatgtttgacttaccaacaagccattcattatrtcttatttccactttgatggttctcttgacatttgactttctctggtttgagcaattcactgcttgtcaggcatgggcctggcatgctgaccttgtacta

SEQ ID NO: 6189 - DNA, 201 bp, Homo sapiens
gaagccctgagagaaagagaatgaataaaactcagggcaaagattcaatatcatggaccccaactgagtgattggatggcaactgatatgtgtactcaacrtctgccaatcacaggataaaatgtttctaaatggtaaatattgttactttaaagagtgattcttaaaccttatggatggagctgaagaccattattctca

SEQ ID NO: 6190 - DNA, 201 bp, Homo sapiens
attggatggcaactgatatgtgtactcaacgtctgccaatcacaggataaaatgtttctaaatggtaaatattgttactttaaagagtgattcttaaaccktatggatggagctgaagaccattattctcagtaaactaacaaaggaacagaaaaccaaataccccatgttctcactttcaagggagagctaaaggatgag

SEQ ID NO: 6191 - DNA, 201 bp, Homo sapiens
ccccaaactggcagggttgaatgatctcaaaaattaggctgggcctgctcccacggtgctggggcctgaggcatggacgagtctccttcaccatgaacaayggaaaaaaagtgtaggtcattttctctcccaccctaaacttctgtcgcaaagtgattttgcccagtaccttctgcagggtaatgatgctgtttcattagt

SEQ ID NO: 6192 - DNA, 201 bp, Homo sapiens
agactctaagaaattaatttgccccaggtcacaccactaggaaactgcagaaccttcatcttacttatttcacttctcttgctttgctaaatgccacaagygtagagataagggagttcacaggcagggtatctagcttagaggtctttatgggagtattcacagaggagcgcagaggctgaaggatggatgagatgtcat

SEQ ID NO: 6193 - DNA, 201 bp, Homo sapiens
cctttctgtgcttctgccatggccaggaaaagagcttccccaggtagctgctaccttttcagcccgagacacagcagaaacacgtgtggagcagagaccayaccactgattcgtacgcttgtggcaggaagcagaggcactatccccaccccaggcagagcttctccactcaacctgcactaccatgaggaaaataaatgc

SEQ ID NO: 6194 - DNA, 201 bp, Homo sapiens
ctatccccaccccaggcagagcttctccactcaacctgcactaccatgaggaaaataaatgcttactgttgtacgcctctaagatctcacagcaaaaagckgaccaacacagccacaaatcattattacacagcagagaacatggccagtgatctgaggaaggtacaaatgccctatggagaattcaaagactcacatgtt

SEQ ID NO: 6195 - DNA, 201 bp, Homo sapiens
tgcttactgttgtacgcctctaagatctcacagcaaaaagctgaccaacacagccacaaatcattattacacagcagagaacatggccagtgatctgaggraggtacaaatgccctatggagaattcaaagactcacatgttctcatttgggagttaaatataaaacacatttagaatgcctgatggcactgtgagaatct

SEQ ID NO: 6196 - DNA, 201 bp, Homo sapiens
gatggcactgtgagaatctaggatttaactctgtgaatagaaagaagataagaagccacaagtaattgtgcacttcattcgaattcacactaaccctatgmactagctaacctctgcctattttgatattgcatttcactgtagtggtaactagatttttctctcccacctgtagcctggcataacacgttctgtaatcat

SEQ ID NO: 6197 - DNA, 201 bp, Homo sapiens
cactaaccctatgcactagctaacctctgcctattttgatattgcatttcactgtagtggtaactagatttttctctcccacctgtagcctggcataacaygttctgtaatcatctctgaatatagcctccactatttgaacggggcttctgccctctggcttgagcctttctatcctcctcataccgagctcatttttgg

SEQ ID NO: 6198 - DNA, 201 bp, Homo sapiens
tagcctggcataacacgttctgtaatcatctctgaatatagcctccactatttgaacggggcttctgccctctggcttgagcctttctatcctcctcatascgagctcatttttggtgttaacctgctatctgagctgactttgcttttcctatttcctccgtgttggcaattgaaaggaaaccaacctgccattccaagc

SEQ ID NO: 6199 - DNA, 201 bp, Homo sapiens
cggccagcctctagaggccatgccaggaaaccccgggctatagtgagatcaccagctatgaagtagaaagggcagacaggaggaaatgcttctggtgacayagctggcccaagcggctttacagttctataaatgccacagtctcattagactgcaatagagattgcctttccttcattcctccacgggataagaacatga

SEQ ID NO: 6200 - DNA, 201 bp, Homo sapiens
gtgtgtatgaaggggaaaggaactaaataggaatattttttcctcccaaaagaaatacatgtgctgcttatttatcatacagaaattattgcagaattttwaaaaatccaaataatatagaaaagtattaaaaatacaattaaaattaaagctacctataattctataactcagattcaacctttgttaacatgttagtga

SEQ ID NO: 6201 - DNA, 201 bp, Homo sapiens
ttaaaattaaagctacctataattctataactcagattcaacctttgttaacatgttagtgaacagccttccaaatgttttagtgagtatgcacaaacacrcatacacagagattggcaaactttcttctataaagacaagataataaatagttgaggctttgtaggacataccgtctctgttgcagctattaaactctgc

SEQ ID NO: 6202 - DNA, 201 bp, Homo sapiens
gaacagatccctccctggagccttcggtggaagcgtggtcctgcagatgccctgatcttggacatctagcctccagagctgcgagacagtcatttctgttstttaagctgctcaggttgcattcctttgttatggctgccctaggaaaccaagacatagtgccaaagcagccatagagaatgtgtaaacaaacgaactttg

SEQ ID NO: 6203 - DNA, 201 bp, Homo sapiens
ggtcttgaactcctggcctcaagtgatccacccacctcggcttcccaaagtgctgggattacaggtgctaattatgattagatccctatcagtagtcctgkatattgtttccaaatgttaaagttatttaacgaggctgaaatgatcactgtggaatgcagggatgaatgtctcaactctaaaatgggtaagaaaactaaa

SEQ ID NO: 6204 - DNA, 201 bp, Homo sapiens
gcaggtttacagccgtgttcttcattttaatttttttttgtttctataatggtttgaggtggcgcaaaactgtaggacttgtctcatccacagaaacactmtgaagctttgatctcaaggtaggggtatcagagacttggttttaggctctgagagtattaaagggaatcagatcaagcagcagcagaagagaactgggca

SEQ ID NO: 6205 - DNA, 201 bp, Homo sapiens
catgaatggaggtgcacaccattatcctgagcaaactgatgcaggaacaaactatgaattaaaataaataataacaaatggaatcactaataatcactttwaaaaaagagatggccattgtctgcaagatgttttataaaataatacttagcatttcacagacatcatcccactgaggcctcacaactgtccagtagcaag

SEQ ID NO: 6206 - DNA, 201 bp, Homo sapiens
tggaatcactaataatcactttaaaaaaagagatggccattgtctgcaagatgttttataaaataatacttagcatttcacagacatcatcccactgaggyctcacaactgtccagtagcaagatattattattgttattatttttctattctgtctataagcagacaaggttcagaaagcctaaggcagcctggggcttg

SEQ ID NO: 6207 - DNA, 201 bp, Homo sapiens
ggccattgtctgcaagatgttttataaaataatacttagcatttcacagacatcatcccactgaggcctcacaactgtccagtagcaagatattattattrttattatttttctattctgtctataagcagacaaggttcagaaagcctaaggcagcctggggcttgttggtgatatttccagactttatattataaaacc

SEQ ID NO: 6208 - DNA, 201 bp, Homo sapiens
cctaaatctctgagatttgtcaacagggactttgggcaaagcaactgcatttctcaggctcagttttccctatgaaaaatggagccaacttgccgggcacrgtggctagcgcctaaagtcccagcactttgggaggccgaggtgggcggatcacctgaggtcgggagtttgagaccagcttgaccaacatggagaaacccc

SEQ ID NO: 6209 - DNA, 201 bp, Homo sapiens
tcccacctgttgtgggagggacccagtgggggataaatgaatcatggggccagtttcccccataaggttcttgtggtagtgaataagtctcatgagatatkattgttttagaagagttttcctcttttacttggttctcattctctcttgcctgccaccatgtaagacatgcctttcaccttccaccatgattgtgaggcc

SEQ ID NO: 6210 - DNA, 201 bp, Homo sapiens
acagaggactccccaacgatccttaacacagccatatgactgatagccctcatcccacccccccaaaaaaagtctagtgagaagaaaatgcttaaaaataytctgatgcatgcatatcatggagttctttccagcagtcaaagagaatgaaggcaaaaaatggaaagctctccaaaacatatcgttcactgaaaaccaaac

SEQ ID NO: 6211 - DNA, 201 bp, Homo sapiens
aaaaatcagctgggcgtcatggcgcacccctgtagtagcctgtaaacccagctactctggtggctgaggcaggagaatcacttgaacctgggaggcagagrttgcagtgagccaagatcgtaccactgcactccagcctgggcaacagagcaagactctgtctcagaaaaacaaaaacatatgcaaatgcatataataaaa

SEQ ID NO: 6212 - DNA, 201 bp, Homo sapiens
agattggcattgagatgccaagccaaaggaatgcttatctgtattttcatttttttttttttacaatgaggatacattttttaatgagaagcaatatagcrtaatggttaagggcatagctcctagagccagttcaaatcccagctctgaagcttaccagcactgtgcctgcgtcatgacttaagctgtctgtatagtgga

SEQ ID NO: 6213 - DNA, 201 bp, Homo sapiens
aagaatccactttgcatacctgtgtgctgtgcattcctgtggaatacaccaccactccccacagcacacccagataaagtactgggcagcatggcctcttyccctggtccccaagacacctgaggacagcctccactggcagcactgatgtcggatacctatcaggaggtgatgttgggaaaaccacactacagcctaggt

SEQ ID NO: 6214 - DNA, 201 bp, Homo sapiens
cttcatgggtgagagcaacttcgcatctcctaaccccacgaccttgtaacagataggtacaacccttgccagagctgttcccttctcaggacaagcagagsgttagcacaacatcatgggtcagaaaagatgttgggtcttcaactgaatgctggcactgctactcattagatgttaaccttcagacgaactgtggcttct

SEQ ID NO: 6215 - DNA, 201 bp, Homo sapiens
ttttacattgtgactcaaagcaggggctctggcgtaagattgatcccagacacgctgcttaatctctcaatgcctgtttcctcaaaggtggatgaaaatcytgatggtcaccgtcatataggtttgtcatgatgtttaaattagataatggaggcaaagcatttaacacagtacctggcactcaggtaagctcccaataaa

SEQ ID NO: 6216 - DNA, 201 bp, Homo sapiens
taaattagataatggaggcaaagcatttaacacagtacctggcactcaggtaagctcccaataaatggaatctgttagttagaaatgcctcacttaagccrgtcacggtaactcacgcctgtaatcccagcactttgggaggccgaggtgggaggatcacctgaggccaggagttcaagaccagcctggccaacatggcga

SEQ ID NO: 6217 - DNA, 201 bp, Homo sapiens
tacttgggaggctgcagcatgagaatcactcaaacctcggagatggaggttgcactgagctgagatagtaccgctgcactccagtctgggtgacagagcgmgactctgtctcaaaacaaaaacaaaaaagaaagaaaaaagaaataaacaataaaataaataaaaacacacaataaaaaaatttaaaaaacaaagaattgc

SEQ ID NO: 6218 - DNA, 201 bp, Homo sapiens
gaagaatcatgcattaagctctgaattgtgcggtaatccaagcaaaaagaaaaccataagttgttataagaattgtgttgtcaacaagatcaaagcgtgcstcaaacagaacaaagcaatgctcttcatcgtacagaagtgtgagggatgctacaggacgacattctccacaagctgtcctgtaataaccgtatcagcaac

SEQ ID NO: 6219 - DNA, 201 bp, Homo sapiens
aaaataactatttcttgtagtacccttcagtgctagttaaggcatgatgaaaacacaaagcagtaaaagctaaattaattaatattcctctagctcaatgraattatcacctggtccttaaatgtggaaactaaacaacagaactgtctactttaattgagaaaagcaaaacaaatttgcatatgcaccgactcaacttgt

SEQ ID NO: 6220 - DNA, 201 bp, Homo sapiens
agaaatgataatgctgtgattttatcagttctcagatcatcaattaatatgatatgtactctataatatatgcacatatgtaatatctaactttagttttmaattctcccctgaaccataaccccgtatttccaactgcctaggtggcatttccaagtggggaagtaagcctaacttctatacttactaattctgcaatgt

SEQ ID NO: 6221 - DNA, 201 bp, Homo sapiens
cagttctcagatcatcaattaatatgatatgtactctataatatatgcacatatgtaatatctaactttagttttaaattctcccctgaaccataaccccrtatttccaactgcctaggtggcatttccaagtggggaagtaagcctaacttctatacttactaattctgcaatgtagttacttagctgaatagcctattg

SEQ ID NO: 6222 - DNA, 201 bp, Homo sapiens
acactgttcttttgtttttacagacatgtcactgaggacaactcaagccttttagaaaaatatttattggtaaaaagacaatactccctaaattttttttwaaatgtgcatcaaaagacactatcaatgtaatagctagaatataaaaaggtaacccatggaataggaaaaaatatttgcaaattgtatatctgataaggg

SEQ ID NO: 6223 - DNA, 201 bp, Homo sapiens
atcatgtgattcaggtacagttggtccattggccaggcttggaggcacccaattttggggcatgattctaaatcctttctgcaaaactgacagttgtttgyatatgtggtttgtctgagtcttcctaagtgtttgacacagataaaagaatctcatgaactagtttagagatcaaagaattcaaccatttcacttcttaga

SEQ ID NO: 6224 - DNA, 201 bp, Homo sapiens
tccattggccaggcttggaggcacccaattttggggcatgattctaaatcctttctgcaaaactgacagttgtttgcatatgtggtttgtctgagtcttcmtaagtgtttgacacagataaaagaatctcatgaactagtttagagatcaaagaattcaaccatttcacttcttagatggggaaactagaaagtgacttgg

SEQ ID NO: 6225 - DNA, 201 bp, Homo sapiens
aaagtgcaaatttatatctcagcatactttttacctattagcaaaattttgaaagattaattacacattgtattggcaaaactttggagaaataagctctytcatgcactgatggggtaagtatgaatttcctttggagggagatttggcaatatctgttaaaattgcaactgtgacccactctttcaagaaatttattct

SEQ ID NO: 6226 - DNA, 201 bp, Homo sapiens
ctgttaaaattgcaactgtgacccactctttcaagaaatttattctacactgaatgtgacgcaatacaaagatattcactacagctttgtttgcaatagcraaagattggaaacaacctaaatgtccaacaatagaggcctgaccaaataaaatatggtatatttgcataatgaaagattatgactctataaaaaataact

SEQ ID NO: 6227 - DNA, 201 bp, Homo sapiens
cccagctactcaggaggctgaggtgggatgattacctgagcccagggaagtccaggctgcaataagctatgattacactactgtactccaacctgggtgayagagtgagaccctgtctgaaaaaaaaaaaaaaatttaaataattaatcaaggagcctgttaaacatgtatgtggtttccccaaatattaactccaatgaa

SEQ ID NO: 6228 - DNA, 201 bp, Homo sapiens
taagatggatgttataattattatatggcttccagaaaccaatttgtacaatttatggccacgaatggtttccatttctctcctttttgctattatattaraaaaaagattgaaaaagaaagaaaacaacccattttgtgctctggttaataaatggagggagagaaagccagctaggcatcaaccactgtctccaaccat

SEQ ID NO: 6229 - DNA, 201 bp, Homo sapiens
cctttttgctattatattaaaaaaaagattgaaaaagaaagaaaacaacccattttgtgctctggttaataaatggagggagagaaagccagctaggcatyaaccactgtctccaaccattatcatctgcatttgtgcgcatggtctgtccaaaacaacagtatatgttgattaaaagaccacaatggaaacaaacaaaaa

SEQ ID NO: 6230 - DNA, 201 bp, Homo sapiens
aagaaaacaacccattttgtgctctggttaataaatggagggagagaaagccagctaggcatcaaccactgtctccaaccattatcatctgcatttgtgckcatggtctgtccaaaacaacagtatatgttgattaaaagaccacaatggaaacaaacaaaaatcccaaacccatggctaaactgtaaagtcatcaacaat

SEQ ID NO: 6231 - DNA, 201 bp, Homo sapiens
tgcgctcactcattaacaaaagaagcattattcataatggccccaaaataggacattacccaaatgtccatcaagattaggacagagacatccatgtgtgstgcattccagcaatgagaatgaaagcactgaaattacatgcaacaatcttgcaaacacaatgttgagccaaagacgacaaaaaagaaaagagtgtggctt

SEQ ID NO: 6232 - DNA, 201 bp, Homo sapiens
ttagaggggcctctgtctccccctaccagacacaaagccagcagcaaggccttcacaatgggcttgccgaacagccgaaaaggaggttatttattaagccrcaaggagaatgcacctacagtcatgtttccatgcaggaatctgtgacaactgaaatgccccatatgagctaattttctggataatcaaaatcccctcatt

SEQ ID NO: 6233 - DNA, 201 bp, Homo sapiens
gaaactgccatccttaccccgttttcaggctgaccaaggcgtcctctactcctttctgattaaatttggtcatgtactgatgcatgtagggatagttattscgaatgtttctctccgtgcttccattaggcactgtcccaaatcgaaaaggtggggaatagtcatgaggtctctgaaactggagagagaacgagaaaggaa

SEQ ID NO: 6234 - DNA, 201 bp, Homo sapiens
tccgtgcttccattaggcactgtcccaaatcgaaaaggtggggaatagtcatgaggtctctgaaactggagagagaacgagaaaggaagagagagagtagraaaagaaagagaagggaggagggggaggagagaacaaataataaattagtgatcattttgtctggtgttaggaggtaaatgcatgcattagggcaggatg

SEQ ID NO: 6235 - DNA, 201 bp, Homo sapiens
ataaagggttaatcttacaactacagagaaataattgtggggagagtaggaggaagagaaagagggaacaaaggaggagaaagaggaaaagaagagaagtyaaagagaagaaaacccaggggaagaaggagaagaagaagacagaccaacaggagagtaaagggagaagtgtgggaaaaggaaaagggctgttttcttaca

SEQ ID NO: 6236 - DNA, 201 bp, Homo sapiens
aggagatttataagtacttcatattcaagaatagagataaaataattctccgagttgcgtagtgtgtcttattggaggaggatcattatgatgagcaaatragcatatacatgaaagtgtttgttcgtgtgtgaggcacacaatatacagacaatatactgagtggaatagctgtgtgattccaggattaaagccagaaat

SEQ ID NO: 6237 - DNA, 201 bp, Homo sapiens
gagcagtgctggagctcaaaagaatgccatgctatgctggctacatgacaggctcaccccctgccaggcatcttagtggctgtgcgggtgccattaccttytccatcaccggcagtcctcaaggagcacaaatgattagaaatgacagtaattcagaacaagagggggaaataagacctcctctctgtaaattagcaaaga

SEQ ID NO: 6238 - DNA, 201 bp, Homo sapiens
aaagcccttacctatccctcaaggcacatctcatgtgtcacctcccctgtgaagctctgcctgacttctccagggtctcacagaccctaggccaggggctytcaaacttgagtgtgcatgggcatcacccactggagtcaccgaccaggagatctcaggggaagcccaagaatctgcattcccaagtgatgctgatgctgc

SEQ ID NO: 6239 - DNA, 201 bp, Homo sapiens
gacctgtaaaactagaaaacggattatctgctccccagatgcaattgtggaacaggcatgggatatcagttacaggggtttttgatcaaaaaaggaatcawtgaaaagaaaaaacaagttaccacatccaaacaattttggaattcagttaggcagtccggatgcagtggctaatccctgtaatcctaacactatgggagg

SEQ ID NO: 6240 - DNA, 201 bp, Homo sapiens
gtgactgcttaaggcaactgggccttaagatcactagagacatctgggatatagcatgaaatatctactctacatcacagttatcctgcctacaagacaamggactggagtgcttatccacaaatccctaccgttggctgcttccagcaccttcactccccctgcaggtgggctaaacctgcttccaaagccagaaaagac

SEQ ID NO: 6241 - DNA, 201 bp, Homo sapiens
catttaaaaggagaacaaaaatgaggctcagagaagataaagtaacttgcttaaatgaggaggctggattgaaagcaggcctgactctaaagtcacattcytgccccctacacatgctgacaggtgttcctattttctccatcttagtttgagccatatcacccacacctggaggtctgcaatgacctaatgctttcacct

SEQ ID NO: 6242 - DNA, 201 bp, Homo sapiens
aaatggtttatttttgccaaagttagcatttaacgtggacataatgatggttcaactccatggatcccatgtgccaatcttcccccagctccactattgawattctatacatccactgagtccagtccgttttccccccaaccatcactcactctgacctggttcattctccaggagcctcagctgatttttctctagctt

SEQ ID NO: 6243 - DNA, 201 bp, Homo sapiens
acgtggacataatgatggttcaactccatggatcccatgtgccaatcttcccccagctccactattgaaattctatacatccactgagtccagtccgtttyccccccaaccatcactcactctgacctggttcattctccaggagcctcagctgatttttctctagcttgatcacccttcttggtttcatgttcagttcac

SEQ ID NO: 6244 - DNA, 201 bp, Homo sapiens
tcactcactctgacctggttcattctccaggagcctcagctgatttttctctagcttgatcacccttcttggtttcatgttcagttcaccattgcctttawtgataaacccactcttccgctagttaaatccatgtcaccttcttgacaagcaatagtgctgaggtcagaactctccccatagccataccctaaaagatgg

SEQ ID NO: 6245 - DNA, 201 bp, Homo sapiens
taccctaaaagatggtacatccagacaatagaatattattcaacgcaaaaaggaagtgtgacatcaagccgtgaaaagacattgagggaccttaaatgcayatttctaagtgaaagaagccaatctgaaaaggttacatactgtatgattccaactatatgacattctggaaaaggcaaaactatggagacagtgaaaaga

SEQ ID NO: 6246 - DNA, 201 bp, Homo sapiens
attcctgagggacagacagtcactgttagctcaatcatatcctgatatagccttcctattccatgaatcctcacagtcttctgttagagacctaattgccraagcttattcctcatatcaagatgaaactttactccttatagtttcactcttggccaggtgccgtggctaacgcctgtagtccagcactttaggaggcca

SEQ ID NO: 6247 - DNA, 201 bp, Homo sapiens
ggctggtctcaaactcctgacctcaaatgctccatctgcctcggcctcccaaagtgctgggattacaggcatgagccaccacatcccacgcctgaccaggkaaaatatctttatattaatcaattaaacaaataaactagaagacaattaagatatttgctcatccatgctgctacaaaagaactctggtcttcaaatcag

SEQ ID NO: 6248 - DNA, 201 bp, Homo sapiens
aaaaacttcactgatcactctggaagttatttagtattactatgtggtaaataccgtgctaaacagtacttttcatgcggcacctcaatgaatatgacaakctctagaacattggtcctcaaagcacagcccctagaccaagaacatcaacatcacccaaaaacttgaaagaaattgcaaattctctgggctcaccccata

SEQ ID NO: 6249 - DNA, 201 bp, Homo sapiens
tgcttttccatacgccacacactggtctaagatgcaaatgcttttcttgtccccatattacacctgagggagccgacgtggagttcagtgactcacccaargtccgaagtctaaaaaagtacagattaggttcgaacccatgcaacctggccccagtgcccatgctcttaaccgtgatgccactgcctcccagggggccct

SEQ ID NO: 6250 - DNA, 201 bp, Homo sapiens
cttctttaagctacttttatgttttagaatttctgccatttaaaaaaataattttagctgagttaagcagtcaactggttatttgaaccaaaatctttcasatttcataggctttgaattaaggcgcaccagcactcatttaacctccctacacctcagttgccctctctgaaaaatgggggggtggtaccacacacttct

SEQ ID NO: 6251 - DNA, 201 bp, Homo sapiens
cttaattgtttggcacccttttaaattttgcatccaaggagggattcttaatctcctcttccttgtcctggccctgatacgtggctttccaattttctacratgagagtagttacttttacatttagaagaatcaaatgatatgacttttttaaagagatgagttattaaaaggagacgtgatcagaagacatttagcttc

SEQ ID NO: 6252 - DNA, 201 bp, Homo sapiens
acacaatcaaataaggtccatttgtgttcatgctgagccccagggcttcctggctcccatcacactcagagctggttgcaggcgagagcccaagtcagccmatgtgttcttcaacctcaggtaagtttgtcttctccagtgttgatgaacacagaaggcactccttcctcagggctcagaggacagagaagccctgacact

SEQ ID NO: 6253 - DNA, 201 bp, Homo sapiens
gtcattcattccataaatatgtgttgagtggttactaggttccaagcactgtgctagacactgagaatactgtaatggaagtgataaaatgtttgcttgcrtgaaatttttgtgctaattgagaagacacatgagtcaaatgattacacaaaaacatatgttcatacaaattgggaggaagaaatgaaacatgggtctaag

SEQ ID NO: 6254 - DNA, 201 bp, Homo sapiens
gagagtggaaaggaaagaaaagaggacagggaagagaaggaggaggaagaaaaaggggaatggagaaggacagaaagtgagaaataaaactattacagaarggaccctatatcagctgtcagaaccatccgtaactaaagcagaaggaagaccctgtttttctttccatagagggtaatagggtggtgtgcagggctgggt

SEQ ID NO: 6255 - DNA, 201 bp, Homo sapiens
caaaaaaatcaagcagtgtaacccaaaaatccagataccagacagatccaagaatgtggctagtgccatttccatttgctcaaaattagcatcaaagttargaagagtcagggttaaaatacaaacaccccatgctccaaccaaagcgatctgcatatggctgtccatacgcaccatgtacttggccacctacgtgtcttt

SEQ ID NO: 6256 - DNA, 201 bp, Homo sapiens
gcctatactccacacggctcacttcctcacctcctcagagagacctttcctgctcagcctctcttaaatactccacctttatccatccacagcactctctstcttacctctccctgctttatttccctgtctagtacttaacactacctaaaattaacttatatgcttcttcattctgtttatcatcttgcttctctgaaa

SEQ ID NO: 6257 - DNA, 201 bp, Homo sapiens
tggtaggcactgggacgaaaagaatgaatgatccttgacatcaagaagctcaaagactagctggaaagatactaatatagcaattccttttattttctctwataggagacccactcgcaactatgaggaatagatactatcagcagcaacagcaactttttttttaaggacaaagaaagtaaatatgggaaaatgtaaact

SEQ ID NO: 6258 - DNA, 201 bp, Homo sapiens
caagttacttctttctgcacctccatttcctcatctgtaaactgggagtaataagcccactcacctcccagtgaaatgagatggcatgtagaaagcacctkgcacatcctgatgattcaataaacgatagtcgttgttatagtgatgatctttgtaactcttgtaagatgcttttcagttcacatctttttaaatgattgt

SEQ ID NO: 6259 - DNA, 201 bp, Homo sapiens
taatgatgaggttgaggtctggagaatgtctaagaattatgagagagtttggggtatgtgtgcttctttccgggagggttgaggggctctgtttcagacasaagaggcaacatgtaggaaggtcctctcaatatctaacactgttagacatataaaacccttgataataataatcaaataatcagataataataacagagg

SEQ ID NO: 6260 - DNA, 201 bp, Homo sapiens
aaggagctttaaaaactactgaagctggggtcccatgccctgagtttctgttttgatttgtctgcactgtgtcctaggatggagggaagttgtaaagttcycctaggtgattatagtatgcagtcaagtttgagaaccactggacttagcctctcttgggatctcagaataagtttgggtgggtaggcttctagaataagg

SEQ ID NO: 6261 - DNA, 201 bp, Homo sapiens
tgcgtgtgatggcatatgtctataatcccggctactcgggaggcagtggtagaagaattgcttgaacctgggaggcagaggttgctgtgagcagagattgygccactgcactccagcctgggtgacagagcaagactctgtttcaaaaaaaaaaaaagaagaagaaaagaaaaacattgggttagcaaaaagacacatgca

SEQ ID NO: 6262 - DNA, 201 bp, Homo sapiens
ccgtttatgtgatttatatgtttaggtatttatgtatttgtccattcatttactcgctcattcatcccccaaattctgaatgtttctgacattcctgacartatggttagtgctagcaatatacaaggccaaaaagacagatgtggtgtcttccctaatgagcttatattctagtgggcagagacagtcaataagcagata

SEQ ID NO: 6263 - DNA, 201 bp, Homo sapiens
atgcagtgagccgtgatcacaccactgcactccagcctgggggacagagcaagaccctgtcattatataaaaaaaattaatgttttatatatttttaacasataaaaatatataatgttttatatatttttaacacataaaaatatatgttttatatatttttaacacataaaaatatatgttttatattttttaacaaaa

SEQ ID NO: 6264 - DNA, 201 bp, Homo sapiens
ttgcattttgaaagatcccactggcttcagtagagaggatagattttgagcaagaagcaaagatgcttgtgcaaaggagagtaattcgaagacctttggtwgtcctggcaagagatgttgagtgttggatcacagagctggtgatggaaatggggagatgtatttcgactgatgttggtcaagttacttctttctgcacct

SEQ ID NO: 6265 - DNA, 201 bp, Homo sapiens
atgatgaccacaataataagaaaaataaaattataataatgacctgatagttatttgtaaaatgccttctccatgcctggcaccatgctaaatgtatatastttaagatgttacaagaagaagagatgtctatcttacacacacaccctctttaggaaaactcctgggttcacagttgttaataacttatacttggtaaat

SEQ ID NO: 6266 - DNA, 201 bp, Homo sapiens
tttatgggaaattgctatgtttcaacaggaatttgaagaaaggcccacaaaatattaaaaggcatcttctgtatctggaaatggagtgtatcaagggcagstgtcacctgcactgcagtggcctccttgtgtaccagctccctggaagatgagtcagattctaaggtagcacagaaaattcacaggtgtgagtcaagcctg

SEQ ID NO: 6267 - DNA, 201 bp, Homo sapiens
atagttcaatagaccctgctactaacaaccccaggtgcaaatctttgcttcacatgctattctctgactcttacttgcatagtctgttttgacttctccaygtgcttcagtgaaatgcaaattactgtttgatcccatggactagactatggggaaatctccattgtttcagggcaagattgatattcagctggttgttta

SEQ ID NO: 6268 - DNA, 201 bp, Homo sapiens
gtagagctaggattcaaacttaggtctctccaaaatcaaagactacatttatcctcccttcctccactgttctagatcactcttgcactggggcactcttsctctgagagacgtatcccactcacagacatggagtggatgcctcggttgctgcatcatttaacaagcatctattgtctgctctgtgccatcccctatggt

SEQ ID NO: 6269 - DNA, 201 bp, Homo sapiens
gggtactttgccctctaagaagcctactttcctcttttcctctcctcctctccctatttctctttgttgagagagcagtcagattaacccaacaactcttrgagtgccttggtcacctgagagcatggaaagtccatgccctcaccagagtaatgactaccatttctccaaaactctcctcatgccatccgataggcagta

SEQ ID NO: 6270 - DNA, 201 bp, Homo sapiens
gttaattaatcaacatctgtacttccttcctgggattattgagagtgctgcaacaatttctcatctgccaattatttgccaactttgtcttctggagttgsaggcataagagttaggtcaatctctttgtgtaatcttggttatatgatgtcacctctgtgaacattatctgtaaaattggaataatcccatgcaactcaa

SEQ ID NO: 6271 - DNA, 201 bp, Homo sapiens
tctttatgtttcccctctatatagaaataattaataataatattaaattgagggtccaacatcggctaggcacagtgctgggtgtttaacataagttatcrcattttatacttcagcagctctggaactaagcagctaatgcattcaattgagagagtgtttgcatgtttcggaaattgggccttgtatcctggaaaagag

SEQ ID NO: 6272 - DNA, 201 bp, Homo sapiens
gatttttttctttgcaaacgattttttgtattttcaatagctaatatacatgtagttgaaaatatgctttataagaaaaataacctccctctctaactcawgatttacagaagtgatacatttaagtttttaaaattagtttatttaaagcaaaagactgagtacatgaaaatacagagggttcgttcatatggcaatgac

SEQ ID NO: 6273 - DNA, 201 bp, Homo sapiens
accacaaagagtctgtactcttaaaactgcaataatagagtcaaggagtcttacgggacgagccatgaatcttgttaagaatttgggcatgtatctcttcyggttgtcctgattatgtaagtcccttcttcaccctaataacactgtattgagaaaaacttcaagtgcattatgcccccaggatgaagctataccttgtta

SEQ ID NO: 6274 - DNA, 201 bp, Homo sapiens
agtagagacagggtttcaccatgttgcccaggctggtctcgaactcctgacatcaggtgatccacccgccttggcctcccaaagtgctgggattacaggcrtgagtcaccgcgaccagcccacaacttgcctgggactccgcagtcctcttccctcctgatttttttccattatacttagcaccctccaatacattatata

SEQ ID NO: 6275 - DNA, 201 bp, Homo sapiens
cttggcctcctaaagtgccgggattacaggcatgagccatcatgcctggccttcttttctcttctttatcctttattattaccacctccttctcctttttyccccctctaatttctccctcatatatctctatccctttttccttccccacactatttgtctttctttcttcttgttctcatcttcatcttctcccttctc

SEQ ID NO: 6276 - DNA, 201 bp, Homo sapiens
gtgcaccaagagcctttagtatcatttctagcatcatggtatatttatatataagaataattgcctgtttatctgtctccccagcctttttatagcatgawctatgtccttcaccactgtatccctagcaactagcacagagcctggcacctagctcacaatcaataaatatttgtggaattgatggatgaattcaggcac

SEQ ID NO: 6277 - DNA, 201 bp, Homo sapiens
tgtctccctgaatatgtgagtaagagcgatcacttaaggataagggactaaaatgtatttagcctctaatatatgttgaatggtgtgccagatactttccrtatgttacctgaattctcacccaaagaactaagtgcagattttctcattttacagagagaaaacagaggtgggttttataatggtgtgaaaagctatacg

SEQ ID NO: 6278 - DNA, 201 bp, Homo sapiens
atatttccagactttatattataaaaccctctaggacaacactgtccaatagaactttctgcaatgctggaaatgctctgacaccatctactatggatatygagcacttgaaatatgtttagtgcaaatgagttgtaaatttcatttaatttcattaatttagattgtaatgtagggggtcccacgtgcctatgggctatt

SEQ ID NO: 6279 - DNA, 201 bp, Homo sapiens
ctaccttggcctcctaaagtgccgggattacaggcatgagccatcatgcctggccttcttttctcttctttatcctttattattaccacctccttctcctkttttccccctctaatttctccctcatatatctctatccctttttccttccccacactatttgtctttctttcttcttgttctcatcttcatcttctccct

SEQ ID NO: 6280 - DNA, 201 bp, Homo sapiens
agttttcagggttttcatacaccttatttcattcgatcctaataagaaccctgagaggtagatttcaactgtgctttccaaaagtaaagatggaggtgggrggaagaactcagcgatggagctagaactatgggcacgtgaaagaaagaacaagttatctaattcacctgatgggtgcactgtgggagacagagcctggtg

SEQ ID NO: 6281 - DNA, 201 bp, Homo sapiens
atggcgacaacagtagtagcacgatattatgggttcttcctctgacatatgctaataaccccactaatatcaccagacctcaagaataaatacaatctaastaaatacaatgggcttgctatgcaaactgaacttcaaggtaagttccctaggtattcctgccacttgtaactatgttggtggcacttaggcccttccaat

SEQ ID NO: 6282 - DNA, 201 bp, Homo sapiens
agttaattctttccactcccacccactccccttgaggaacgggtctctcctccgctcctctggcccagggcttctcaaactccccacctctgttcctctarctgcagagtcagaggaagcatgacattttttctgcccttttgtgctttacctaaaaactttgcattttcttccagaacctacccacatttaataattttt

SEQ ID NO: 6283 - DNA, 201 bp, Homo sapiens
cttcttcattccagccttcttccttccctccacttctgtgtaattcccaaaccaggctgtcataacatcgccttcaaatcttcaaatctctctcccttctwctccaaaccaaagctcccaggctgtccacaaaaaagaccctccctctcattcagagccaactgatttttgtacactctttcttgcattttgagactctcc

SEQ ID NO: 6284 - DNA, 201 bp, Homo sapiens
tctcttggtatcacccaactcctctcaatatcaccgttccacatggggaccagacatataccccgatgttacctccactgagctctttgcttccctgccamcttgcctcatctccctacagttccaccagaatcacagagagtggccaatgtctccaagaccaactctgaaagtcccaacaacaatcaggagtatcgaatc

SEQ ID NO: 6285 - DNA, 201 bp, Homo sapiens
aaggaagggctgttcacctctcagacaatctcctttctaaatacatccccagtttctcaaaatacgaccttttaaaccaacttctcttggtatcacccaamtcctctcaatatcaccgttccacatggggaccagacatataccccgatgttacctccactgagctctttgcttccctgccaccttgcctcatctccctac

SEQ ID NO: 6286 - DNA, 201 bp, Homo sapiens
ctggagtatagaattgaagaaaccttcccaaacacagcacaaacagagaactggaaaaaaaaaaaaacaagatacatggagaattgactgagaaattacayatatatatatagtacagtcatgtgctgcataaggaggtttaggtcaacaatggaccacaagtacacaatgctggtcccataagattatattctaagtttt

SEQ ID NO: 6287 - DNA, 201 bp, Homo sapiens
atgatgtagttaactggagtatagaattgaagaaaccttcccaaacacagcacaaacagagaactggaaaaaaaaaaaaacaagatacatggagaattgaytgagaaattacatatatatatatagtacagtcatgtgctgcataaggaggtttaggtcaacaatggaccacaagtacacaatgctggtcccataagatta

SEQ ID NO: 6288 - DNA, 201 bp, Homo sapiens
cttcacaactgaagaaggaaagatgctagagcaatcagagaagaactttataatacatattttttaatctttgaagggacaggggagggagttacatgcamaaagtgagaagagtttttcattatttataacacaaaaaaacagggaggtgtaaagaggaaccaattattatcttggaaataaagtatatccttgttgaaa

SEQ ID NO: 6289 - DNA, 201 bp, Homo sapiens
gaacatccaactaactgattctacaaatgaaggacttcacaactgaagaaggaaagatgctagagcaatcagagaagaactttataatacatattttttartctttgaagggacaggggagggagttacatgcacaaagtgagaagagtttttcattatttataacacaaaaaaacagggaggtgtaaagaggaaccaatt

SEQ ID NO: 6290 - DNA, 201 bp, Homo sapiens
tggactcctaagcctgtaccacaggccacgtagaatgggaagagagtacaaacctgagctgctgacatgggctctggcttaaaatacacaccctcacagayacagggcataagaaatcataaagttgccttgaaaataagttcacaaacaaaaattaaagaacatatgtgaacatccaactaactgattctacaaatgaag

SEQ ID NO: 6291 - DNA, 201 bp, Homo sapiens
taaaaaaatatataaaagcaggttgtgaaataaaacggggtcaaaatccgagtgaacacactcagtaaccttccttttctgctcctaagacatagaatttwtaaagaaacctttagttatttttaaatttacatagtattgcttgcaaataagaaaagagaatcacagatcaaaaatagagagtaatccctaaaaataaat

SEQ ID NO: 6292 - DNA, 201 bp, Homo sapiens
tttcgtatgtaaccccccaatttatgctaatcctcaggatggctggtaattatctgcccactagagagaagagaaaaattggcaaacacctatgaaatcastcagcattgagggaacaaacactgcacgaatgccctgaaccatattgtgatatgttcatccggaagctccaacaagctggcatcggagccaatgactaga

SEQ ID NO: 6293 - DNA, 201 bp, Homo sapiens
agccctctttctctctctttccccactcactctgcctacagtagcattttccatctgaggctatgagaaagaagataaacaccgctgcaaacccaccagaycacagctcttcagggcccaaacgattgtcagcaacccctgagggctacttggagtgtgagtcacgctaccgggaggacgcctgttggtctctgatgactt

SEQ ID NO: 6294 - DNA, 201 bp, Homo sapiens
aggagaaccagaggttcagacaggtgaagggccttttctaaggtcacacaggtatttttgaaaattgaatttcattcttcagactctttgtccaaggtttycttggatcttccaactcaagttgattcatcatggctgcctggagtactgtgttgagaaggccttaaggccagtgggctcaacagggccaggtgttatagg

SEQ ID NO: 6295 - DNA, 201 bp, Homo sapiens
attgaggctcaagatattaagaacttccccatgatcacccagccagtaagaggtggaatccctgaatttaaattcaggcaatctaactcaaagtacaatayattaaccacttgataatgacattctttaaaagattaaagcagccatgagtctaccaccccaaagataactgctattcatattttggtatgtttgttgcca

SEQ ID NO: 6296 - DNA, 201 bp, Homo sapiens
agagcataccctcatgtaaccacatcatccttaatcactctttctggttattaaaaagtacatgtacactggagaaaaataaaaactaaaaaatgcagacrcaataacaatagcattcctgtaataagcatttattataaggtaggcactgagacatggactaatatccatgatgtcatttaaatctcacaactctacaaa

SEQ ID NO: 6297 - DNA, 201 bp, Homo sapiens
ggtccagttggtggagtcatttagtgcaaaggtcaatgagatagtcttctcctacgatcactttcatgctggccacatttagcttccgtttgccaggatamagctctcagcaagtcctacaaaggcaaaggaagcttctgattgtctcagttaagaaaatacaaatcatttcatgttagaccctccacttctgacagttct

SEQ ID NO: 6298 - DNA, 201 bp, Homo sapiens
ccctaggttctagttacagctttgaacaatgcacaaattactgcaactcccagatcctttatttcctcatctgaaaatagagattctttaaacaaatacckttggagctgccaggttccccaggctatcactgagttattaatccttggcagagataaaatgagaaactatatatgtccacactctaaatccctaagcctc

SEQ ID NO: 6299 - DNA, 201 bp, Homo sapiens
caagggaagaggattgcttgagtccaggagttcaagaccagcctgggcaacatggtgagacccccgtctctaccaaaaatttaaaaattagccggatatcrtggcacacgcctgtgttcctagctacttgggaggctgagatgagaggatcacctaagcccaggaggttgaggctgcagtgaactatgatcatgccactgc

SEQ ID NO: 6300 - DNA, 201 bp, Homo sapiens
ctgtctatgttattggtaaggcttctgatcaacagtgggctatagtttatgggaatcaaaagttatacatggattttaaactgcatgggggttaatgcaastagcgcctgcattattcaaggatcaactgtgtttaataaaccaataaataaatcaaatccaaggaagtctatgaaagggtttcagagggtctgtgatccc

SEQ ID NO: 6301 - DNA, 201 bp, Homo sapiens
ttctaagacagggactcagttcctcaaagcaggagcctagtgtccagaaagggagcccacatgagaagaacaaagtcagtgttagagcaggtggaggtctsggttctgagctgaggtgtcttgactccactgaggctcagttacagaagaggagtgaggagaagccttggaattaagctctaactacctcccaacctctct

SEQ ID NO: 6302 - DNA, 201 bp, Homo sapiens
cagtctctccatttcaagatccttaatttaattatatttgcaaagtccctttagccatataaggttagtattcacaggttccaggaattagaatgtggatrtctttgggtggggaagagggggtggtggggacatgattctgcctaccacaccccctaggactatttgagtaaaaattcctgagaagcattgaacctagaa

SEQ ID NO: 6303 - DNA, 201 bp, Homo sapiens
atttagcccaactttcttacttgcaggagaaactgaatttcagagtttgccgcaagtcaaggaatgcagttctggaagctagtaaaggaaaggaaacagaytcttccccagagtctccagagggagcacagctttgctgacaccttcattttggtgcagggaacctgatttcagacttctgccctccagggctgtaagagg

SEQ ID NO: 6304 - DNA, 201 bp, Homo sapiens
ttccaagcaaggaaggcttggacaacaggaataccattgacagagagaagaaatccagaataagcatgaatcaaagaggacaggcctgggcaggttcagtrtgaggcacccatggccatgtcaaggagagaagcccaccaagcacctaggggaacaggtcaggaacccagggcaagaggttgaggctacaactgtagattg

SEQ ID NO: 6305 - DNA, 200 bp, Homo sapiens
gggcttcactttcctcctctctacaatgagggtggtggtcctcggatccctgcctgcaacactctgcctgcacatcagggagctcaatatacatccgtcctcatgttccttccaagcaaggaaggcttggacaacaggaataccattgacagagagaagaaatccagaataagcatgaatcaaagaggacaggcctgggc

SEQ ID NO: 6306 - DNA, 201 bp, Homo sapiens
gattcatgctacgacatggatggaccttgaaaacattatgctaagtgaaagatgccagatgcaaaaggtcacataacagacgatcccatcccatctagaaygagtaaatccacagatacagaaagcagattaaaggtttccaggagctggaggggtggggaaatagatcgtaactgcttgatggttactggtctccttttg

SEQ ID NO: 6307 - DNA, 201 bp, Homo sapiens
atcaccaaagctttaagagtggagagtaacatgtccaatgcgccccttgagtaggagagcttcccgtataagcaggaaactcagaagactggaatcaaagytcaggtggaaggtgataaggaccaggtgccagggatggagacgaaccaagagttgggcagtggaagaatggaaaacaccagagggccaggtatagtgtca

SEQ ID NO: 6308 - DNA, 201 bp, Homo sapiens
aggcaccttggagaacttgacacttaaaacttaaaggacttaaaggcaaagcgggactaacaatgacatgtttcacacttgtatttcttcttacagttttsagggttttcatacaccttatttcattcgatcctaataagaaccctgagaggtagatttcaactgtgctttccaaaagtaaagatggaggtgggaggaaga

SEQ ID NO: 6309 - DNA, 201 bp, Homo sapiens
acagaaatccattttaagtggtaggagggaccctggacgatgaaaagggtgatctagcccagggtccaggaaaactgtcaggcttcctgcccatctgcccmctctgcacctgcacgcatacctgacttctttctccctagaagagctcctgtcccccacagtgattttcaactctcttgctatgcatgaggtcagccattt

SEQ ID NO: 6310 - DNA, 201 bp, Homo sapiens
aggtgagatttaggtggggacacagccaaaccatatcaagttcaaaggctcaaaggacttcaaaagaaggggcaagaataaataatcgcacagaaatccaytttaagtggtaggagggaccctggacgatgaaaagggtgatctagcccagggtccaggaaaactgtcaggcttcctgcccatctgcccactctgcacctg

SEQ ID NO: 6311 - DNA, 201 bp, Homo sapiens
gatcccatgatgtacagcatctcttaaatttattttggcttaaacttttttctgtagggtcatattcctcagagccctctttgggaaagtctagagcaaaytgcaaaatgaggagagaactgagttgaagctcaaaaggtcagcaggggtcagaaatcagggatttgtgcagccaggagtttacattttatctgaaggcaa

SEQ ID NO: 6312 - DNA, 201 bp, Homo sapiens
caacaagaacaagtgttgtataaaaaacagaaggggagtcttctgatcaaatagatttgggaaacattcgttcaaacagcaggaaataagtttaaaccgtktctgtagcgcaggacttctcagagctttgaagaggctcatgtgcattgtaaatatctgaggatcccatgatgtacagcatctcttaaatttattttggct

SEQ ID NO: 6313 - DNA, 201 bp, Homo sapiens
atttagagcaatgtgggtttttgttatattttagcaatcagggcaatggtttttgtcatattttatcaagccaacaagaacaagtgttgtataaaaaacaraaggggagtcttctgatcaaatagatttgggaaacattcgttcaaacagcaggaaataagtttaaaccgtgtctgtagcgcaggacttctcagagctttg

SEQ ID NO: 6314 - DNA, 201 bp, Homo sapiens
tctcagagggcatggcttctgagatgagttttgaaggatatgagacagacagaaatagcagcacagacaagtgccagaaaatgtgaaagaggcacatttaragcaatgtgggtttttgttatattttagcaatcagggcaatggtttttgtcatattttatcaagccaacaagaacaagtgttgtataaaaaacagaaggg

SEQ ID NO: 6315 - DNA, 201 bp, Homo sapiens
agtaatttcagcttttcaaagaaatttcaaatccattaacttagtctctaccaaggcctccgagttcgaggcattaaaggctccccaagtggaattaccarcgtgttataaacgaaagaatctgagtcaccaaaacagcccagcctctgtctgacctccgaccctcctcatctgacactacagcttttcccaaggcagctg

SEQ ID NO: 6316 - DNA, 201 bp, Homo sapiens
tggaagcgaggtgcagaaacagctggatccattacagcttggcatttgccctacttgagcccagtttgaacagttggtcccccttgattggctgaaactcrgttgtttggacaacagtgggttacagtctgtttacacatccagttaggttgcagttcactacttatggagaaacctttaaagtatgtaaagaggcagctt

SEQ ID NO: 6317 - DNA, 201 bp, Homo sapiens
atttacaaagacaggtggcaggccatagtttatagatccgtaaagtaggtgataccttgatatggcaaaatccaggaaggtgatacaggaaagactgaaakaagaacagcattcagttactgggaccctgagtctcctctctttagagaaattaataaattcttatgaattcagtcttactcagagacagctataggacac

SEQ ID NO: 6318 - DNA, 201 bp, Homo sapiens
acgaaagcacccatagaaagcacatctacagatgggtgcaattctgttctaataaaactttatttacaaagacaggtggcaggccatagtttatagatccstaaagtaggtgataccttgatatggcaaaatccaggaaggtgatacaggaaagactgaaataagaacagcattcagttactgggaccctgagtctcctct

SEQ ID NO: 6319 - DNA, 201 bp, Homo sapiens
tgattgtggccatggtttcacaggcacatgcatacatccaaactcatcaaattatgtatattaaacacacgcagtttttaatattatttagatgtcaatgsagctgtttttaaaaaaaaaaaattgaccatgagttgaagctgaattgagggtacatgagtgttcattacacattctctctattcttgtatgtttgctaat

SEQ ID NO: 6320 - DNA, 201 bp, Homo sapiens
agagctggcatgatggaaaatagcggcaggggctgatcaagatggcatggagtgaggcttctgaaaacacttattgaccagcttgcatgctgtgggtgatmgataaatattaaacaccgaggctagtggagaacaggttttaatgaggcccagaacagcatgtagagtgggctgtagtagtgaggggccatggagatgcta

SEQ ID NO: 6321 - DNA, 201 bp, Homo sapiens
ataaatattaaacaccgaggctagtggagaacaggttttaatgaggcccagaacagcatgtagagtgggctgtagtagtgaggggccatggagatgctaascaaccagtctcatgcctgcaggtcccccatgtccatgcttctccctaggctgttctcagttacaaagacaaagcaaaccaactcggggggaaattcatcg

SEQ ID NO: 6322 - DNA, 201 bp, Homo sapiens
gagatgctaagcaaccagtctcatgcctgcaggtcccccatgtccatgcttctccctaggctgttctcagttacaaagacaaagcaaaccaactcgggggsaaattcatcgggaagttggaagctaaagggtccctcctagcatggccaaggcctgccgctccagtctcttctcaccacttatcccatttttttttttttt

SEQ ID NO: 6323 - DNA, 201 bp, Homo sapiens
acatctccttctctgactcttccatgcccgcctcttataagtacagtcacaattatattgggcccaccagataattttggatgaggctctcatctcaagayggatccataacttaatcacatcttcaaaatcccttttgccataaatcataacatttatacaggagtcagagtttagaaggtgaacatctttgagaggtcg

SEQ ID NO: 6324 - DNA, 201 bp, Homo sapiens
accctttcctaacatgctttcctgatagtaaatctcctaattttagcatcttttgcaatccagataggctgagaatttcccaagtcatcaaatcttgcttkctttttgcttaacagttcttgcttcaatctctttcctctcacattttactaaaaggagcaagaagaaaccaggctgccccttcaacactttaccaagttc

SEQ ID NO: 6325 - DNA, 201 bp, Homo sapiens
tgagcgggagacatatattaagaaatacatgacaaggaattggcttacatgattgtggggaatgggtaggtaagtccaatatccacagggcaggctggaayttctgggcatgagctaaaccttctctcctcaggtggaatttactcttcagagaagcctcagctctactcttaaggcatctgactgattgaatcaggccca

SEQ ID NO: 6326 - DNA, 201 bp, Homo sapiens
gccaaggtccagataagcacatataagttaagtgagcaagtctaaaagcagatgcgcttatcctttcaatcactctacttttcatcactctcccttttacmctctgctccaccatccaaccccactggttctgaaggtttcctattgaaccaccctcccagaaagcccatcatcttctgctttggaaagccaatattgtaa

SEQ ID NO: 6327 - DNA, 201 bp, Homo sapiens
cacacacgcaatatcatcccacctcttcaacagatgaaggcgaaaacaactaaaatccaagagtaaatctccagctaaaaacaagctcaaatagcaacaaraacttcaaggaggagattcatttgcaactaggtgctaatgaaaccaggtcctccttccaagaaaatcaaactgtgtaactcagaatagccaatttaggat

SEQ ID NO: 6328 - DNA, 201 bp, Homo sapiens
tgaaggcgaaaacaactaaaatccaagagtaaatctccagctaaaaacaagctcaaatagcaacaagaacttcaaggaggagattcatttgcaactaggtkctaatgaaaccaggtcctccttccaagaaaatcaaactgtgtaactcagaatagccaatttaggatgcaagaggcatttggctaattatactcaattgta

SEQ ID NO: 6329 - DNA, 201 bp, Homo sapiens
aatttatctgtcagtggaaatgtcttgaaagaataagttcactccaccttcacaaggatggtaatgatgatgatgtttatagcagctaccatttatcgggsaactgaccttgggcctcacgactgtgctaagcacttaacatacaatgtttcgttttatcattattatgacctgaggccctgaaaaagaatttgagctccc

SEQ ID NO: 6330 - DNA, 201 bp, Homo sapiens
ctgggtaatttataaggaacagaggtttaattgactcaccgcttggcatggctggggaaggagacctcaggaaacttacaatcatggtggaagacgaagasgaagcgaggaacatctcacacagcggaaggatggggatgggtagaaaagaagcaattgacacacacttttaaaccatcagatctcgtgagaactcgctta

SEQ ID NO: 6331 - DNA, 201 bp, Homo sapiens
taaggtctgagtacctagatttcagaattcttggtatgggagttctccagtggggaaacaaaaagccttgcaattaagaaaactgaaaaagaacagaacargcttggcccagttgccgaagaccagtcgtgtgtgaaatgcctcagaacaccggatggagacagcacggatcaagccaagtaaaaattgagagcatgaaac

SEQ ID NO: 6332 - DNA, 201 bp, Homo sapiens
agcctggtcagtcagtgtattcctatcctgaacaatgtgattggttgatttatgggcaagtgaggaagaggagtccaatcagagttagccctgggacttcygatgaagcgaccaggaagtggactctgcactctgtttcccctaagtcacttaactgacagaataaagatgcaacacttctgctagtgactgtcttgccac

SEQ ID NO: 6333 - DNA, 201 bp, Homo sapiens
taagtcacttaactgacagaataaagatgcaacacttctgctagtgactgtcttgccacactgggagttggggtggggagacattccctgaataaagtcartacaggctgggtgtggtggctcctgcctgtaatcccagaaattttggaggccaaggtgggaggactgcttgagcccaggagtttgagaccagcctgggca

SEQ ID NO: 6334 - DNA, 201 bp, Homo sapiens
gctgatgccagctcaaagcttcattgcaaaattcttccaggctacctgttctgagttataggaaatatcccaaagcgcccatgtcctaccattccagggtrcaaaagagcacgaacccacaagaagatattggaagatttactgagccacagggaaatgaggaaatgagagcaaagtaaggaagttatataagggtcacac

SEQ ID NO: 6335 - DNA, 201 bp, Homo sapiens
ggttgtgaaaacaaggacactgtaagacctttcataccattcaaagaagaaagtggacaacgccttccgctaagggcctccttaacgtggtgtattccagkgtgtggtatactgatggtgtacaagatcattttagatggtgcagggatacattttcctcttaaattttcaaaaattcaggagccattctactatattaaa

SEQ ID NO: 6336 - DNA, 201 bp, Homo sapiens
gtgaacatgagggtacagatatttctttgagatcctgatttcaattctttgggatatgtacccagaagtgggattgctggatcataagatagttccattasgctggtgctattacttttaattgcaaaaaccacaattacttttgcaccaaccgataataaaaatttaaaaatttttcgaggagccgccatactgtttttc

SEQ ID NO: 6337 - DNA, 201 bp, Homo sapiens
gaacatgagggtacagatatttctttgagatcctgatttcaattctttgggatatgtacccagaagtgggattgctggatcataagatagttccattacgytggtgctattacttttaattgcaaaaaccacaattacttttgcaccaaccgataataaaaatttaaaaatttttcgaggagccgccatactgtttttcat

SEQ ID NO: 6338 - DNA, 201 bp, Homo sapiens
ctacagttagtaatatcatactatacacttgaaatttgtgaagcgattagatcttaattatactcacaccacatacacagacacccaaaatggtaaccaayagtcgtgaaagatgtgttaattaattcgatggtggtaatcatttcacagtctacacactcatcaaaacatcacattgtacaccttgaatacaaaccactt

SEQ ID NO: 6339 - DNA, 201 bp, Homo sapiens
cacaaggatagcaaggaggaaatgtttaatctgtaaggatttcaaagagggaagctaaaattgtatttctaagcagaaatttgtggacccattttaatgamaagataaaacacatttctagttagcagcattccttgtacataaacaatttatctacccaaggctagaaaacggtatgccctcaagtagattaaatcaacc

SEQ ID NO: 6340 - DNA, 201 bp, Homo sapiens
tgcatggaaagcatctatcaccgtctggcatacagcagaggcacaataaatggaagatattgtcacaaggatagcaaggaggaaatgtttaatctgtaagsatttcaaagagggaagctaaaattgtatttctaagcagaaatttgtggacccattttaatgaaaagataaaacacatttctagttagcagcattccttgt

SEQ ID NO: 6341 - DNA, 201 bp, Homo sapiens
tgtttactgtcctggttccctgtgtgtgctgcctctcactattacccatgaaagggaatcaaaagggggctgggaaagtttcacggagagggttgagaacwcacaaataaagaggacaattaggcccggcatggtggctcacacctgtaatcccagcattttgggaggctgaggcgggcacatcacgaagtcaggagtttg

SEQ ID NO: 6342 - DNA, 201 bp, Homo sapiens
tgctatacaagcccatttataacagaacagaatggaaattttataaaagttcaagaacaagcaaaactaatctatgatgattgaattcagaataatggttwtcttggggttggtgagaagggagcaaataagaacttcatagggaactagaaatgttctatatctttgcaatgtatctatgtaataaaactgcacttgcac

SEQ ID NO: 6343 - DNA, 201 bp, Homo sapiens
gtttcaccatgttgaccaggctggtctcaaactcctggcctccagcgatccacccacctcggcctcccaaagtgctaggattacaggcatgagctaccacrcccagcctgctgactgtaatttctgatgaccaaaaacttcactgatcactctggaagttatttagtattactatgtggtaaataccgtgctaaacagtac

SEQ ID NO: 6344 - DNA, 201 bp, Homo sapiens
actcacccaaggtccgaagtctaaaaaagtacagattaggttcgaacccatgcaacctggccccagtgcccatgctcttaaccgtgatgccactgcctccyagggggccctggccactcctgaactggacagattcttgtgatggaaccggacacaacagccgggattccaccagccaaacaggtcaaggtttaccttcac

SEQ ID NO: 6345 - DNA, 201 bp, Homo sapiens
cacaatcttggctcaccgcaacctccgccttccaggttcaagggattctcctgcctcagcctcccaagtagctggaattacaggcatgcaccacccacacstggcaaatttttgtatttttagcagagagggtttctccatgttggtcaggctggcctcaaaccccttaggtcaggtgatcctcccgcctcggcctcccga

SEQ ID NO: 6346 - DNA, 201 bp, Homo sapiens
aagcaggcagagtcccctaccttaagaaaattacaggctggtaaactctcaacaggagaaatattggatatatcaaatatagttccttcccctgagaaacrcagactggttggtgagacagacaaatagattttatgatttcagaacaatgtagtaaatgttaaagtattacagaatgctatggaataatggagagatgag

SEQ ID NO: 6347 - DNA, 201 bp, Homo sapiens
agtcatctctgtagcctccacagcccttcataaacagcagattcaaacaaacaaaagcttcattcaagaaaggaaggaaggcggctttttgtctagccccrtggttctcaacagggaaagattattttttaactttcattttaggttcaggggtacatgtgcaggttatataggtaaactgtgtgtcacagggatttggta

SEQ ID NO: 6348 - DNA, 201 bp, Homo sapiens
caacaatgaatgttaaatatgtaaccaccataagtgttaccaacgagaagcatatggtgggttccaggagggcagttgatacaggttatggtttaggaacratttttctaaggagtaatgatgaggttgaggtctggagaatgtctaagaattatgagagagtttggggtatgtgtgcttctttccgggagggttgagggg

SEQ ID NO: 6349 - DNA, 201 bp, Homo sapiens
gaggttgtggtgagccgagattgtgccattgcactccagcccgggcaacaagagcgaaactccgtttcaaaaaaaaaaaaaaaaaaaggtacattcctaawtcccacaggctttgcaaacctgtgctctaggataggaattcagtgctcatttgtttttcaatgcaaaactttctatgaagacatttcaaacacatacacg

SEQ ID NO: 6350 - DNA, 201 bp, Homo sapiens
tccagaatattatataaaggcttactaggatattatatgtgatgtgcttggcatagtgctgaaccatagatgagaggacctaaaacaattttttccttccmttttctcagcatcacttgtgactgaataataaaattaggcattcttgttcttctcagtatcttttgttctggcccccagatatgagaagggtttgacctt

SEQ ID NO: 6351 - DNA, 201 bp, Homo sapiens
ttagaaaaaaaacatgaattgcattttggctttacatgtgtaagaggaaaaaaaatcaggatttgaaagatggataagagaaagtaatgatataagaaaayattataggcaacaacaacaacaaaagcatattcaaagtcccaaatgcatgaaggaacccagtatatacattcatggagttgcaaatcacttgcatggtgg

SEQ ID NO: 6352 - DNA, 201 bp, Homo sapiens
attctcctgcctcagccttcagagtagctgggactacaggcacctaattttttttttgtatttttagtagagacggggtttcatcatgttagccaggatgrtctccatctcctgacctcgtgatccacccacctcggcctcccaaagtgctgggattacaggtgtgagccaccgtgcccggctagagaatttcttgactgg

SEQ ID NO: 6353 - DNA, 201 bp, Homo sapiens
aacattcaagaagcctttaacaagacactgcttgtcttgatgaattaatgaaaccagcatgtgcacatgagtgtgtgtgtgtgttactgaaaattaaaacrtctctttgatgataactgaatatatttttttcagatcaaaccaaacccttgccaggaagaggaacacattagcacttgaggtcagttggcatgtttgggc

SEQ ID NO: 6354 - DNA, 201 bp, Homo sapiens
ggtgggattacaggcgtaagccaccatgcccagcacgattaatggatttctatggaatttaatttcctttctgcctactgctttcaggtaaaaacgatgawtgattcagattcccctgatgatctcacttgcataactgagatcaggggtttttctgaaattcaccaggacttctccccttttcaatcactttgtgtgatt

SEQ ID NO: 6355 - DNA, 201 bp, Homo sapiens
ctttgtagggacatggatgaaggctggaaaccatcattctcagcaaattatcacaaggacaaaaggccaaacaccacatgttctcactcataggtgggaaytgaacaatgagaacacatggacacaggaaggggaacatcacacaccggggactgttgtggggtggggggaggggggagggacagcattaggagatacacc

SEQ ID NO: 6356 - DNA, 201 bp, Homo sapiens
gtctctattgtcaatcgtcaccaggtattttaggtgtctatttaaatagctgtctccatgcaaccagattaatgctaattcatctgtacagtaatagcacmcagcccagctcccagtacatggggagctgagaacacattcagtgaaggtataagtaagcaggtgaatggatggacagacgaatgcatggatggatggacg

SEQ ID NO: 6357 - DNA, 201 bp, Homo sapiens
tcagtatttctggagatattattattgcctgaaatcagggaagctggggggtgggatggaccacataatgctctctgtgcccttctaactcactctatctrtgattccaagaacgcaagtccagggagaaggttcagctctccatggagactctcttatatccaaagtaagagaaattagttctctatttgccctaagact

SEQ ID NO: 6358 - DNA, 201 bp, Homo sapiens
tgcatctttaggtgaggtcatatcccctctgtggcttcagtttccatattactggactaagtagcaatttatgatccactacagttgtaaaagccagggartatataattctgttggttatatgcctcatattgcacatattaaatatgtgcatatatgtgcctcatatgcatattgcatatattgcattaaagagcataa

SEQ ID NO: 6359 - DNA, 201 bp, Homo sapiens
actgctgcactccagcctgggcaacaagagcaaaactccatctcaaaaaaaaaaacaagaaagaaaaatggagccaacaatatttgcccttagagggctgytgggaataaagtgttattatataagtaaagtatgtgtgcaatgctcagaacataacaaatgctcgaaacacataaatgcattcaatcaaattcagatttt

SEQ ID NO: 6360 - DNA, 201 bp, Homo sapiens
gtttaggtatttatgtatttgtccattcatttactcgctcattcatcccccaaattctgaatgtttctgacattcctgacaatatggttagtgctagcaayatacaaggccaaaaagacagatgtggtgtcttccctaatgagcttatattctagtgggcagagacagtcaataagcagataaacaagatagttataggct

SEQ ID NO: 6361 - DNA, 201 bp, Homo sapiens
acgtgggttgattgcaaatttggagagggctcccaagaaaacacaacacagcctgaggatgaagcagcagagattgcaggtgactctttggaggaggcaasagcatccttgaaggcatgtgtgcaaaggcactgccgcatggacttgaagggaatcgtcaaatatccaaatggagtttcataccatggagcttacatgaat

SEQ ID NO: 6362 - DNA, 201 bp, Homo sapiens
ctccctgtgtcacacagcatcgagtaagtcatttctttcaaactctctctcaccgccagcttcaacaaaccaggaaacccatcaggctgtatcacctttgrgcagaaatccccaggggcttgggcatcacgctgacaaagtctctgccaggtgttaggtgctggttcctatcattggttccatcaccccttaaagcggctt

SEQ ID NO: 6363 - DNA, 201 bp, Homo sapiens
gatcatctaatgtattgggagaggcagataatagataatgtacaaaccaaactaaggttagtgccatgagagtaaaggacagaggccagagactaacaccyaatctagggtgatcagggaatctgtctctggggaagcgacattgaagcagagacctgaaggatggcagagttttggggattggtgctggttccagacaga

SEQ ID NO: 6364 - DNA, 201 bp, Homo sapiens
tacaccagcacactccctagctcacgatattttaagtggatgaataaatgaatgagcaaaaaaagagcaccctacctctaactggatcccccagctgtgarctctctcacattttttctctagcaaattccctcttttttgctgtttctttctcctcttttctgttctattctctttcttcatcccctatgctttaaaaga

SEQ ID NO: 6365 - DNA, 201 bp, Homo sapiens
ccaaagtgctgggattacaagtatgagccaccacgcccggcctaataactttagatctacaagtttcatccatagtagtaaccatttacagactgcttttscatacgccacacactggtctaagatgcaaatgcttttcttgtccccatattacacctgagggagccgacgtggagttcagtgactcacccaaggtccgaa

SEQ ID NO: 6366 - DNA, 201 bp, Homo sapiens
tatacatattcctatacatctatacatgaacctctacataaaagcacacttatatacaggtacattcatgcctacccacgctcacattataatcacatatrctcacacccacacgtacaactacaaatacacacatacctaacacaaacacatatactcgaacctctacacacacacacacacacacacacacacacacac

SEQ ID NO: 6367 - DNA, 201 bp, Homo sapiens
gtaaatataaaactagttaacctaaaaagtttattcaaaaactgtttttgaattcaaaagggagagttttttaaaaacagcaaatatgttctcagacacaragtagcaaagttgccaggagtttaaactttggagccagccactctggcttcaaatcccagctgtaccacttgtgagctgtgccacttgggcaaatttctt

SEQ ID NO: 6368 - DNA, 201 bp, Homo sapiens
gtttctccagtcatggccccctgattggaaatccagtgtctcctcacatacaataggaggtaagctgtgatgagtgagtgtgcaatgtctcattcaaattscaaatgtgtacaatggtgctaccatgtggaggaaggtcaccagtcaactctatcctggtgacacagtcactattagagtcctgtcctgatttcagagtca

SEQ ID NO: 6369 - DNA, 201 bp, Homo sapiens
aaggacagcccagtgtaggcattgagaatgtggttctgacgccaggccacatgggttaaaatctcagccctgaacttgctgggactttgcatgggtcctcwcctatgcagtttcctcatctgcatgtcggggaatataatggtatccagtacctggcgcgtagtcagcacctagtaaattttggttgatcacttaaaggtc

SEQ ID NO: 6370 - DNA, 201 bp, Homo sapiens
agtgtagattagtgcaaccattgtggaaagcagtgtggcgattcctcaaagacctatactgggtatacacccaaaggaatgtaaatcattctattataaayacacaggcacacatatgttcactgcagcactattcacaatagcaaagacatggcatcaacctcaatcaaacccaccagtgacagactagataaagaaaat

SEQ ID NO: 6371 - DNA, 201 bp, Homo sapiens
ctcctaggtgattatagtatgcagtcaagtttgagaaccactggacttagcctctcttgggatctcagaataagtttgggtgggtaggcttctagaataargcagtgcctctaaagacgtggtctgtggaccccctgacatcagaatcacctgggaatctgcttaaacatgtgcatcctaggctctatccctaaatttaga

SEQ ID NO: 6372 - DNA, 201 bp, Homo sapiens
cacctacatgacaggtttgttgtgagaattagattgattaataaatagaatttagcacagtatgccagacacactctaggcacttgataaatgctaattaytgtagatgtgataatacctttggttgttgttaattaatcaacatctgtacttccttcctgggattattgagagtgctgcaacaatttctcatctgccaat

SEQ ID NO: 6373 - DNA, 201 bp, Homo sapiens
ttaaaggtgaatgatctgagccaaggaacaaatgctattgaatttcatatctaaaaggcagtaatagctgtgctgttcagcaaaagtggatgggaggattmcaaggcagataattcagctggacccaaatagtctccacatagaagagttttaaggttatctatctaaaccaacagaactgctccctctgcccttggcctc

SEQ ID NO: 6374 - DNA, 201 bp, Homo sapiens
tcctctcatcatcagattttccagatgataagtttttagcaggcccttcttccccctctactcctgtgtggacctctgggctgcctttttcaggttttgcraactggctatgaattgttcagcggttggattagccagttctgcagactgcctcacacgcagaccatctggaccgcttatagagaagacatgttccaagta

SEQ ID NO: 6375 - DNA, 201 bp, Homo sapiens
gagaccatcctggctaacatggtgaaaccccgtctctactaaaaaaaaaatacaaaaaatttgccgggcatggtggtaggctcctgtagtcccagctactygggaggctgaggcaggagaatggcatgaacccgggaggccgagcttgcagtgagccgagatcgcgccactgcactccagcctgggtgacagagtgagact

SEQ ID NO: 6376 - DNA, 201 bp, Homo sapiens
taaaagtgaacaccacactcagctgagtctgtaactttagatcagcattcctgactcataaaagctattctgaagtgtgagccaataccagggttgcaccrcatttcctccagcagtgcttccaggagtaaggtttcaatccatttcctccagcagtgcttccaggaataaggtttcaatgcatcagagcaagtgaaatca

SEQ ID NO: 6377 - DNA, 201 bp, Homo sapiens
attcatatattgaagccttaacctgccattgactatatttggagatagggcttttaggaggtaactaaggttaaatgaggtcataagagtaggaccccagkttgataggactggtgaacttgtaagtagaggaagaagagagatttctctctctctctctctccaccagcatgcactgagaaaaggccatatgagcacaca

SEQ ID NO: 6378 - DNA, 201 bp, Homo sapiens
ctctttagtttgacatggaaattttccctaatcccaagacatagatgataccatgtgataaaaaaaaatcttaagatacatttatccatttattttacagyttttttagtatttaggacctaccaggcattatatgaggtgctaaagacacaacggtgaccaagacacagtctactggtctctgtcccctatactctattt

SEQ ID NO: 6379 - DNA, 201 bp, Homo sapiens
gagacagagtgacggctaaaaatatgaggtttctttttgtggttttggaactgttctagaattagggagtggtgatggttgcacaatatagtcaatatacyaaaaagcattggactgtgaactttaacatgataaattttatgtgaattatatctcaaaaacatttaaacgtaagactaggtatcacttattgaccaattt

SEQ ID NO: 6380 - DNA, 201 bp, Homo sapiens
aggcttgtctgtgttgaccagacccactcacctctcctcctgtaatgtttaagtgtcaccagaaatgaatctcaaacccttaaagagaattcaaacatgcyggacaccaggagaggtgacagggtgggaggagagaaaagaatcagtgctctctaagattacctcatcatatgggctggaaaatttttgctggctataaag

SEQ ID NO: 6381 - DNA, 201 bp, Homo sapiens
aggtgtggtgctgcatgcctgtaatcccagctactcaggaggctgagacaggagaattgcttgaacccgggaggcagaggttgcagtgagctgagattgcrctactgcactctagcctgggccacagagtgagactctgtctccaaaaaaataaataaataaataaaagtatatatatacaaaaagaaactcaatggaggc

SEQ ID NO: 6382 - DNA, 201 bp, Homo sapiens
atatttaaatatataaaatatactgttttatatatttaaatatataaaatatataatttctatatatttatatataatgttttatattttaatatattaaratatgttttatatttattttaatatacaaaaatgttttctatattaaaaatataaagatattttttgaatatgtatgttcaaaaataaataaatgaataa

SEQ ID NO: 6383 - DNA, 201 bp, Homo sapiens
aagtgtggccctggaaccagtgacccaatcctgcatctaccacttgataaatatgggaccttgcacaattactcagccttgaattcttcttcctgaaaatrtgaccactgttagtgcttaattgaggttcttgtgacaatttaatgggatcagccatggtgcgttcattttctattgctgctatgacaaattaccatcaac

SEQ ID NO: 6384 - DNA, 201 bp, Homo sapiens
taaaacttaaagtataataaaaaaaaattttactctaagttccaggatacatgtgtagcatgtgcaggtttgttacataggtatacacgtgccatggtggytggctgcccctatcaatctgtcatctatattttaagccccgcatgcattaggtatttgtcctaatgctctccctcctcttgccccccacccctgacaggc

SEQ ID NO: 6385 - DNA, 201 bp, Homo sapiens
taaaatccctaaaggacccagatcatagtaagttttcataagcagtatgtttgctactatttactgttgtgaagaaaatgcctaacacagtgcctggcctrtggcaatcctcaaatatgtgtgtttctttttctctctctctttagaacattcaggattacttagaaaagtcacacatgagcagcatacttagggcacaaa

SEQ ID NO: 6386 - DNA, 201 bp, Homo sapiens
gagcgcagagtgtaggaggaagattgacaggaaaaccaaaataagacacctgaaactccacgatatgataaatgatatgacaacagggggaggtgctaaaygttacgagagtgcagcagaggcataaaataaaagaagcctgaagcaaacttttaattcgttacacaaaaaagtctttagtcttctttgccgagattaaag

SEQ ID NO: 6387 - DNA, 201 bp, Homo sapiens
cagagatactaggggttaggacccaatatatgacttttagggagatacaattcagtgcattctcaacaataaacaacatatcagagggttctcctaccctyggatgaaaccagagacgtgcttctttctcctgaagcccatttgaaaacctccatgaaccaggacagggatggaggatttcctatttcggaggagggaagg

SEQ ID NO: 6388 - DNA, 201 bp, Homo sapiens
atctgtaaactgggagtaataagcccactcacctcccagtgaaatgagatggcatgtagaaagcacctggcacatcctgatgattcaataaacgatagtcrttgttatagtgatgatctttgtaactcttgtaagatgcttttcagttcacatctttttaaatgattgtctgtccacactgttcactccatctgtgcagct

SEQ ID NO: 6389 - DNA, 201 bp, Homo sapiens
ttactgacagatccagttgaagtaaggggaaaaccacaaagagtctgtactcttaaaactgcaataatagagtcaaggagtcttacgggacgagccatgartcttgttaagaatttgggcatgtatctcttctggttgtcctgattatgtaagtcccttcttcaccctaataacactgtattgagaaaaacttcaagtgca

SEQ ID NO: 6390 - DNA, 201 bp, Homo sapiens
ttttagcacacttgatttcctcctggcatcaccaacaggaaaatataaccctatggggaaatatatcacttcatagttatatttattgtcaaactaatgtraattgattcagtagtttgaggaatgttcttaaactagattttataaagtcattttctttgcatagactgaagttgaaacccatgacaattttagcatttg

SEQ ID NO: 6391 - DNA, 201 bp, Homo sapiens
ccttctgctgacttagcaccatgtctacagagatgctgctcttgtccttcgtcctgagaaggagacacagtgtgcctgaaggagcccatctcagacacccygcccctggcagcagccaccagggaagccagtacaatagtggtctcagtaagggaggacctaggactgcgcaaaaaaatcaagcagtgtaacccaaaaatc

SEQ ID NO: 6392 - DNA, 201 bp, Homo sapiens
tgctgggactttgcatgggtcctctcctatgcagtttcctcatctgcatgtcggggaatataatggtatccagtacctggcgcgtagtcagcacctagtamattttggttgatcacttaaaggtcctcctccctccttccctttcatcctgagtttgagagtttcacagtcatactaaatcagattaggaaactgagccct

SEQ ID NO: 6393 - DNA, 201 bp, Homo sapiens
agaagagctgaggcaggactagcttctctgtcataatgtaaaagagtcttggaacgtgtcctgggcccaggctctaaaccccctcatggcctttggaacaycaagctctgtgccaaagggtggaaggctgccctgccacaccacaatctaagcccagggcataaaacccctcgtggcttggatacaatccaaggctcaggg

SEQ ID NO: 6394 - DNA, 201 bp, Homo sapiens
tggggaagaaattgcctatagacaccaatgaacttaaaacccttttcctcataagcaaatattttctgagggttaaaataagtccaataatacttcttgartagtaaacatattattattttaaaattgttttcctagtgaagctacttataataataaagagctaggttgatagcaggccaccttcttattagagtatga

SEQ ID NO: 6395 - DNA, 201 bp, Homo sapiens
ccaggctggagtgcagtggtgtggatctcagctcactgccacctccacctcctgggttcaagtgattctcctgcctcagcctccagagtagctgggattayaggtacctaccaccatgcctggctgatttgtgtatttttagtagaaatggggttttgccatgttggccaggctggtctcaaactcctaacctcgagtgat

SEQ ID NO: 6396 - DNA, 201 bp, Homo sapiens
atacaaacccatctctccatttttcaatcccttgccgagcaaaattttcaggccacaaattagaggtacccctggcttaaaacaaaacaaaacaaaaaggytgggattttaatgagccttctgcctctaaataaatctctctacccggcactcaagtcctctccagacttaaatgaaatgcatcgacaaagcaagtcatgc

SEQ ID NO: 6397 - DNA, 201 bp, Homo sapiens
agtatgtaagttacattcattcccctctgcttctggctttccatctgattagatcaaaagcactcttgcatatggaaagcttgcacgagcacaattttacstggttatgggaaggaatggtgttctctatgtgtatttttattttttccaatgattggattctccagggtgcgcacatgacagagacaagtttctgtactg

SEQ ID NO: 6398 - DNA, 201 bp, Homo sapiens
acctggccaacatggcaaaactccatctctactaaaaacacaaaaattagttgcgtgtgatggcatatgtctataatcccggctactcgggaggcagtggyagaagaattgcttgaacctgggaggcagaggttgctgtgagcagagattgtgccactgcactccagcctgggtgacagagcaagactctgtttcaaaaaa

SEQ ID NO: 6399 - DNA, 201 bp, Homo sapiens
tctgatgagggaaggaagaaatcatgaaggagtgcaatggaggggagttgtgcagtttgcaaaggacctgaaaagtcagagtggaaagaagggatgtgtasgatcagagaacagcatgcacaaaagcttagaagctgagttttaatgacatgtttgtgaactaggaagttgtccaaacaggaagaaacacaaatatataaa

SEQ ID NO: 6400 - DNA, 201 bp, Homo sapiens
gggagtggtgatggttgcacaatatagtcaatatactaaaaagcattggactgtgaactttaacatgataaattttatgtgaattatatctcaaaaacatktaaacgtaagactaggtatcacttattgaccaatttctccttgctggcctaagtgctattatacatagataaaatttctggctcaatccttcaaagaatc

SEQ ID NO: 6401 - DNA, 201 bp, Homo sapiens
tctctcacattttttctctagcaaattccctcttttttgctgtttctttctcctcttttctgttctattctctttcttcatcccctatgctttaaaagacrcttgcatctggggctttttctgaagccgttttttccctcatttttttctgtccacaaaacagcaggaaataatttgctttaaatccacataaaataccca

SEQ ID NO: 6402 - DNA, 201 bp, Homo sapiens
tcttctcattcttccctcattttcaataccacttattgggaaggaaggtactgaaatgaaaacaatttggaaccaaaaggcacaactctcagagccacagygatacagtgacaagtgaaatgggctttctaatagtatcctgctgcggattaacagacacctggtattccacctcggaggtggctggtgatgcagccttct

SEQ ID NO: 6403 - DNA, 201 bp, Homo sapiens
cttggaggagaaaactagaatgcatataggtctgcaaaaaaagtttaggaggagatgtgaaggtaactaggacaatcacagaaacaggaattggggctggrgaaggttaaacacataacattggatgagaacttgacctaaggacagtcctttgttacagtaacagtgataactattattattttttaatacctgcataaa

SEQ ID NO: 6404 - DNA, 201 bp, Homo sapiens
atattttttttggaaaacgtgtttttaacaatgatcatccatttcccaataagtccaaggaagtgttgatctccaaaaaaaaaaaaaactgaatcccaacstaagtttgtgaccttgagcaaattgcaggatctgtctgtgcctcagttgccccattaataaaaagagggaagtcacctcactgctaacacttcattagta

SEQ ID NO: 6405 - DNA, 201 bp, Homo sapiens
tctcccatttcatcttcacaccagccttattaggtaattatttctgtaccctttcacagatgaataaaccgaggctaaaaaagatcacttctttcatagargtatttgtaaatgggacagtagatttagttcagatgtgcactaaattactccttcctaaaggatttatacatctcaagagtttagtcatctttgatagat

SEQ ID NO: 6406 - DNA, 201 bp, Homo sapiens
gctggcagaacaaagactgcagggtgtttcagcatctccataccaacagctagaacagattcctctcctaaccctctgtgccgtatcaaccagctggtctrgtctgactcacaaatggctacagcctggtggtaaacggaactttgttaaccatttgcaaaaaattccaggcaactggggagatggaacaaaaatgccccc

SEQ ID NO: 6407 - DNA, 201 bp, Homo sapiens
taagtgatagagctaaaattcaaaccaggcagcctgattccaaagcccacactcttggccactacataaaagattcttcaccagaatgaccttggtaccayaggttcatgatcagaaagtgatgatacctctatctggggacttggaaacatccatagctccttcaatgagcccaggacaatctttcaccatcgtgagagt

SEQ ID NO: 6408 - DNA, 201 bp, Homo sapiens
ctgacctggccgcctgcaaaccaggtttctccttgcagcttggtttagtaggaaatgatcagaattggactcagatgaactagagccaattgttacctctrtaaaagtctgaacagggtgttgtccattggctggtagcctcagcatcacctggcagcttgttagaaatgctgggtctcaggctccaccctagacccactg

SEQ ID NO: 6409 - DNA, 201 bp, Homo sapiens
tggaatcgcacttagttcacgtcacttcccagatctggcttccaatggcctcttctcaccctctaaataaaatacgtaaatcctcaatgtggcctttacartctgcctcttttaatccttctctgcagccacaatgacttctatgatggtcttccaataccctgagcctgttcccacctcagggtctttgccattgctgtg

SEQ ID NO: 6410 - DNA, 201 bp, Homo sapiens
agtgttggatcacagagctggtgatggaaatggggagatgtatttcgactgatgttggtcaagttacttctttctgcacctccatttcctcatctgtaaamtgggagtaataagcccactcacctcccagtgaaatgagatggcatgtagaaagcacctggcacatcctgatgattcaataaacgatagtcgttgttatag

SEQ ID NO: 6411 - DNA, 201 bp, Homo sapiens
cacctttcccaatgcagtgaaggatagatcccacgtcttgggcttaggcagttaggtggatggtgagtgcaattactaaagagagaaagacctgggaaggracagttaagggtggggagcaagaggaagacaatcaagaaatgctcagtacctgtgggttccctcttgcctatccacccctccctcctacttctgtttctc

SEQ ID NO: 6412 - DNA, 201 bp, Homo sapiens
ttcaggagttttcaagtcagtagaccaatgatgtcatcaagattttgctccttccaactctctgccctacataccctctgctgaaactatcttatggctgrtgccccatcgtgaacacaacatgggaacctgccaacattccacaagtgcttccatgcatgctcttgtatctttagaaggttctcagaagccctccaataa

SEQ ID NO: 6413 - DNA, 201 bp, Homo sapiens
ccctatccatcatgcttctttggttttggacagcaccttgtaaatatcattttcctctttctcctttttcttctcttccgctgctgtcttcatttatttayttttctatttctccagaaatgggtgcaatactgcatatcttcagcttcttcagttttgtactcccattactttggtcctagtcttggttatactcaaagg

SEQ ID NO: 6414 - DNA, 201 bp, Homo sapiens
cttaacttaatcacagttgtaaaatctcttttgccaaattaggcaacacatccactggttccaagcattagggcatggacacatttggtgagtccttctcstaccacatgtgaagaacatgcatgtgttaaccactgcggctatttctacactactcctactattacagagaaagaaagtttttttttctcctcctaaaag

SEQ ID NO: 6415 - DNA, 201 bp, Homo sapiens
aatcaagctgtccatcaatgagactggataaagaaaatgtggcacatatacactatggaatactatgcagccataaaaaaggatgagttcatgtcttttgyagggacatggatgaagctagaaaccatcattctcagcaaactaacacaagaacagaaaaccaaacactgcatgttctcactcataagtgggagttgaaca

SEQ ID NO: 6416 - DNA, 201 bp, Homo sapiens
gatcacaaagtatgctctttaaatttttataaaaattggcaaattgccttgcaaaatcttactccctttatgtttttgtattactgtatatatctctatgyatctttctcaactaatttcagaatcagtctcactcttctctctctctctccttctccctccctccttttctctcccccttgccttcctctccaactctct

SEQ ID NO: 6417 - DNA, 201 bp, Homo sapiens
ctgaggattgacgtccccgagatgttaacctctgtgtgtcaatgaagcagggaaactggacagttggttcacttttctaaatgcaggagcaagatgagggwaattattgatttctatcaaaacagacaagaagcaaatagaagagaagaccatgggcagggaagggtttgaatacaaatggaaaccaccaggcatagcatt

SEQ ID NO: 6418 - DNA, 201 bp, Homo sapiens
tttccaatttccaatgcgaactgctgaagagggccctgcacctgtcagaatgcaaagcccatttgtcagttcctggatagtttctttcagctatttcaagrggtgacctgggttacttcccccatcttctctgtactcaggccttgtagctccttctctctaaggcaataaagtaaactgtcattgttccagagaatgtgg

SEQ ID NO: 6419 - DNA, 201 bp, Homo sapiens
tcggaagtaaaggtaatagtgtgaaatacctcctttctcacttaaaaatggaatgaatgatctagatcttcaacaataggctcatttttccaatttccaaygcgaactgctgaagagggccctgcacctgtcagaatgcaaagcccatttgtcagttcctggatagtttctttcagctatttcaagaggtgacctgggtta

SEQ ID NO: 6420 - DNA, 201 bp, Homo sapiens
aagtttatttttgaacattctgtagtgaggcaagggaagaagaaatccatcacatggaatatcaccctccatgttatcatcttacatctttggcacaaackctcggaagtaaaggtaatagtgtgaaatacctcctttctcacttaaaaatggaatgaatgatctagatcttcaacaataggctcatttttccaatttcca

SEQ ID NO: 6421 - DNA, 201 bp, Homo sapiens
acctaaatctgcccctaactccaacccccattcgtaaagaccccagtctccaagtcaacagaggcaagagatcccaggtccatcatgagtcaggacaggcrgctcatgtggggaaaaggatgcattctttgtttttgctcctggctcagatttcggacacatcattgtaatcctctggtcttctgttgcaccatcatgtct

SEQ ID NO: 6422 - DNA, 201 bp, Homo sapiens
cccacatgcccatcaacaatggaatggataaagaaaatgtgatatatatacactatggaatgctacacagccataaaaaagagtgaaatcatgtcctttcsagcagtatggatgcagctgaaggccattatcctaagtgggttaacaagggaacagaaatccaagtaacacatgttctcactaataagtaggaactaaaat

SEQ ID NO: 6423 - DNA, 201 bp, Homo sapiens
tgaatgggcaaggcaatcctaagcaaaaagaataaagccaaagccatcacattacctaacttcaaactatactacaatgctacagtaacccaaacagcatrgtactggtaaaagacacatagaccaatgaaacagaatacagaccccctaaaataaagctgcacacctacaaccaactgatctttgacaaagtcaacaaaa

SEQ ID NO: 6424 - DNA, 201 bp, Homo sapiens
taatttgatacttactggtatggctgtttgttattgcagagcatgtctggtccctgcaaccagattactaattatgaaaaaacagaatctaaccctaaccytaacatggcccagacctcgctaaatgattttaggcattaggccaatacagatggcctaaagactttttatatttcttccttttataaaacattaattttg

SEQ ID NO: 6425 - DNA, 201 bp, Homo sapiens
ccaggaatctatattctgaaccagcatacttggcatcattgatgcaggaggtccatagactccagtaagagacattgtattagggactccacttttcactragcacataatttgatacttactggtatggctgtttgttattgcagagcatgtctggtccctgcaaccagattactaattatgaaaaaacagaatctaacc

SEQ ID NO: 6426 - DNA, 201 bp, Homo sapiens
ttttaagtaaaaatacatcataagttcatactgatactttttaaattgacattgtatattaatatttatggggtacggtgtgatacttcaatacatgtatrcaatgtgtaatgatcaaggcaaggtaattagcttatccatcacctcaaacttgtcatttcttgtatttagaacattaaaaagtctgcttttctagctatt

SEQ ID NO: 6427 - DNA, 201 bp, Homo sapiens
gttccatctttggccagttgatttcagattggcttctgagtccctttgacctgtagtctttggtaactgctttgctcattgcagtgacaagacactctagraaggtttatcttgttcatttccaccctacaccttgaatcacccactttcccagtggtctccctcagtggaaaataatttaaaaaccaaactctaagtgga

SEQ ID NO: 6428 - DNA, 201 bp, Homo sapiens
tgtcaaacatagaaaacagaaaaaatagtataacaaacccccatgtatcctccactcaattttaactattttcaattcgtgactgatcttgttttgtccayattcttaccaatgttctccttccaatgcattattttgaagtgaactccagatatcatatcattcatctgtaaatatttcagtatacatctctaaaagtca

SEQ ID NO: 6429 - DNA, 201 bp, Homo sapiens
tggtctagaaagcaagggccactcacttttcaaagtatccacggagaagctatgtgactcaggcaaatgcagttacagggacctggctcagcctcttcctrtctgtgtgaacttgggcaagtcttttcaccttgcttaccctcagtttgctcatttcgagaaaggtgataattcccagccttgctggtttattgtgatgat

SEQ ID NO: 6430 - DNA, 201 bp, Homo sapiens
ccccatattctgggaaacacttatgtaacctaactctctcacatgtccaaaggaggacaggacactaactggtctcctgtaaccaaacaagttgctgccasatcccggtgttctgatcctttgttgaacgttccttcctctgttctgtgagtcttttattagcattaagagtggaacccaagcctcctctttaaagttggc

SEQ ID NO: 6431 - DNA, 201 bp, Homo sapiens
cacaaccagaaaatgttagaagaatggaccatctttattagcatcagataaaacagacttcaagacagtattcccggaggggcatttcataatgagaaaarggtcaattcatcagaaagatataataaccataaatgtgtatgaacttaataacagaacccccaaaaatacagaatggaactaaaaggaaaaatagacaac

SEQ ID NO: 6432 - DNA, 201 bp, Homo sapiens
catggatcctactcacaagtcccctgaaaaacagagaactttctccagctggagtcagagaagtagcagagaagaagtcagagagactcaaagtgtcagargatcttcattcaccattgctggaggagctacatggaaagcatgagaaagaagtctctaggagcaaagaccagcctgccatccacagactgcaaataaatg

SEQ ID NO: 6433 - DNA, 201 bp, Homo sapiens
gaatcccccaaagatgtccacacctttaaccctggaacctctgaatgtgttatgttacatgaaaaaagtgattatggacctaaaaacggagagattatccwggtttattccatggatcctactcacaagtcccctgaaaaacagagaactttctccagctggagtcagagaagtagcagagaagaagtcagagagactcaa

SEQ ID NO: 6434 - DNA, 201 bp, Homo sapiens
ttgagatgagaggtatagattaaaagccaataaataagttaaaacaaagtgtgtaaatactctaaaaatccataaaaaggcagatataatgggcaaaatgratcccccaaagatgtccacacctttaaccctggaacctctgaatgtgttatgttacatgaaaaaagtgattatggacctaaaaacggagagattatcctg

SEQ ID NO: 6435 - DNA, 201 bp, Homo sapiens
aataggacaaatgtggagaaaaccatgctaggcacatcacagtcaaactgatgaaaatcaaaagaaagaaaatctcaaaattagcaagagaaaaatagcamattatatatagagaacaatgattcaaatttttcacagacttaagattagaaactacagagtccagaagacagtggaataatgtctttataagtgctgggg

SEQ ID NO: 6436 - DNA, 201 bp, Homo sapiens
gggccacaaggccagatgagccagtttatcaatctgggtggtgctaactgatccatcagatgaagggtctgcaaaatatctcaagtaccgatcttaggttktacaatagtgatgttatccccaggagcaatttggggaggtttagagtcttgcagccttcaactgcatgactcctaaaccataatttctcatcctctggct

SEQ ID NO: 6437 - DNA, 201 bp, Homo sapiens
gaaagaggagacttagagaagggaattcttggcatgtatatgtaaactctgcccaagcctctggccagtccttgaacaaagggtgagtagacaaggctcaragtagtttgcatttaaacccaacaggactgagaactaagcctccacctgagagacagatatggaaatgtaagtataaccaggttagttacctgctaagac

SEQ ID NO: 6438 - DNA, 201 bp, Homo sapiens
caatagccagctccatccacttagccatgtcatgagccatctcatacatttcagcccaactgtgctctcagggaactgtagcctcagctgttattacatgsagcagaaaaaccacctagtagagcccagtcaacccacagaactgtgactgacaataaaatgattcttgtttctagctcctgtatcttgtagcaagaatat

SEQ ID NO: 6439 - DNA, 201 bp, Homo sapiens
tcagtaaaacagaagcttccacttcttccctgatataacaattgcccttgggtatgtcaactcaaaactcaaccaccatgctttgtgaaatccaagccacwtaaaaaggttacattaggcagtgagctacgcccccaagccaatagccagctccatccacttagccatgtcatgagccatctcatacatttcagcccaact

SEQ ID NO: 6440 - DNA, 201 bp, Homo sapiens
tctcctcttgaatctgaccagcacagtgactatgtgaccaatagaaaagcctaattttcagtaaaacagaagcttccacttcttccctgatataacaattkcccttgggtatgtcaactcaaaactcaaccaccatgctttgtgaaatccaagccacttaaaaaggttacattaggcagtgagctacgcccccaagccaat

SEQ ID NO: 6441 - DNA, 201 bp, Homo sapiens
gcagactggttggtgagacagacaaatagattttatgatttcagaacaatgtagtaaatgttaaagtattacagaatgctatggaataatggagagatgaraggctcattcaccctgggaaataaaggaagcctttctggagaagacaaagagttgtgtagatagtcatttgagaggcaagactggggggaaggggagagg

SEQ ID NO: 6442 - DNA, 201 bp, Homo sapiens
aatcttatacacactacagttcaagaatcacactctaggtagagccaaccttgacgtcaaagaaatctcgagttcttgttctgcaccaagcattgggatcsctgatacagaaaaaagcagctcaaattcaatgtttgagtaagcacttgacttcagccttcaggatacaacctgctaggcctccaggtgaataatttaact

SEQ ID NO: 6443 - DNA, 201 bp, Homo sapiens
tccagataccctagaccagtggttctcaacatgcaatgactgtgctccaccaggggatatttcgctatgcctggagatgcatttagctgtcacagctaggrggcagggtatgactggcacccagtgggtaaagaccagggttgctgctaaacatcctacaatgcacaggaaagctccctattcacaaataattatctagcc

SEQ ID NO: 6444 - DNA, 201 bp, Homo sapiens
tggacattttatccatccttcatggttttaaatatatgccaatgccttccaaatccagatcattccactgggctttgatatttaaagaactggatgttcayggtgccccataagccagttaagctcagcagactctaaaactgaccttgtcatccaccacccaaacttactcagtgatacctcaatccacagccatccaga

SEQ ID NO: 6445 - DNA, 201 bp, Homo sapiens
tagtgttccccaaggctctgtgttgcatccattgttcctcactgggtacatcatttacttggacattttatccatccttcatggttttaaatatatgccartgccttccaaatccagatcattccactgggctttgatatttaaagaactggatgttcatggtgccccataagccagttaagctcagcagactctaaaact

SEQ ID NO: 6446 - DNA, 201 bp, Homo sapiens
ttcaactcactatattatcattttaatgtgcaatcaatataaaaattattattaatgagatatttcacattcttttttttcacagcaagtctgaaattcasagtgaatttaacacatatagcacatttcaggtcacactagccacacttcaaatgctcagtagacacagggagtcaatggccatcctgttgcacaaaacag

SEQ ID NO: 6447 - DNA, 201 bp, Homo sapiens
ttattcaactcactatattatcattttaatgtgcaatcaatataaaaattattattaatgagatatttcacattcttttttttcacagcaagtctgaaatycagagtgaatttaacacatatagcacatttcaggtcacactagccacacttcaaatgctcagtagacacagggagtcaatggccatcctgttgcacaaaa

SEQ ID NO: 6448 - DNA, 201 bp, Homo sapiens
atgtatcttattcaactcactatattatcattttaatgtgcaatcaatataaaaattattattaatgagatatttcacattcttttttttcacagcaagtytgaaattcagagtgaatttaacacatatagcacatttcaggtcacactagccacacttcaaatgctcagtagacacagggagtcaatggccatcctgttg

SEQ ID NO: 6449 - DNA, 201 bp, Homo sapiens
ggtgggcaccaccacacccagctaattttgtaattttagtagagatggggtttctccatgttggtcaggctggtctcaaactcccaacctcaggtgatccrcccgcctcagccttccaaagtgctggtaattacaggtgtgagccactgcgccctgccctcaaaccacatatattaaagtaaaaagaaaaagttgaaatta

SEQ ID NO: 6450 - DNA, 201 bp, Homo sapiens
ccatacctggtcgtatttatttttttgacagagttttgctcttgttacccaggcgggagtgcggtggcgtgatctcggctcactgcaacccctgactcccrggttcaagagagtctcctgcttcagtctcccaagtagctgggattataggtgggcaccaccacacccagctaattttgtaattttagtagagatggggtt

SEQ ID NO: 6451 - DNA, 201 bp, Homo sapiens
tttgggagggggtgagggataaaagactacaatagttagtagtcttaggtgatgggtgcaccaaaatctcagaaatgaccactaaacaacttatccctgtraccaaaagcacctgtaccccaaaaactattgaaatagaaattaaaaaaattttaaaacagtatgaattattaatgcattaggaggcaaagacagtgaaat

SEQ ID NO: 6452 - DNA, 201 bp, Homo sapiens
gcgagactccatctcaaaaaaaaaattacataatggactttggggacttaggggtagggaaagtttgggagggggtgagggataaaagactacaatagttrgtagtcttaggtgatgggtgcaccaaaatctcagaaatgaccactaaacaacttatccctgtaaccaaaagcacctgtaccccaaaaactattgaaatag

SEQ ID NO: 6453 - DNA, 201 bp, Homo sapiens
gtaactcgggaatggaaaaccaaatatcgttatgttctcacttataagtgggagctaagctatgacgatgcaaaggtataagaatgatacaatgggccggrcacagtgactcacgcctgtaatccccgcactttgggaggccaaggcgggtggatcacttgaggtcaggagtttgagaccagcctggctaacgtggcgaaa

SEQ ID NO: 6454 - DNA, 201 bp, Homo sapiens
ccacacttcagccttcagcagtagtgaaacatgagtcactgttaagttctcacgatgaaattctcactattagttcagcactattaagtgactcatgttcsacacttcagtggtagattctgtgttcagcaggtcccacattttgaaatttggggtgaattcttcctgcgactctgtggtaataaagaatatgaattatgc

SEQ ID NO: 6455 - DNA, 201 bp, Homo sapiens
ctgagaatgtgcatattttggccctatctcaagtgatagtgatgatgctggtccagaaaccacactttgagaaccacagcacaaaggttacccagtgcccwtccttgtttaatagtgactcattttccacacttcagccttcagcagtagtgaaacatgagtcactgttaagttctcacgatgaaattctcactattagtt

SEQ ID NO: 6456 - DNA, 201 bp, Homo sapiens
caatccctgcccctcactttctgattcagtaggatgcatatgggcctgagaatgtgcatattttggccctatctcaagtgatagtgatgatgctggtccasaaaccacactttgagaaccacagcacaaaggttacccagtgcccttccttgtttaatagtgactcattttccacacttcagccttcagcagtagtgaaac

SEQ ID NO: 6457 - DNA, 201 bp, Homo sapiens
agtaattgtgggtggggtaggggagaaatctagctgctgctatcagatgcaatgtgaaataaagaaaaataatgtttgtggttcagttactagaatggatmagatgactgtcaccctttggatagctcttctttatcctttaggacttggtcctaacttaggtctttcaggaagttttttcacctccccagtgcccaggct

SEQ ID NO: 6458 - DNA, 201 bp, Homo sapiens
tgaagtgtttctttttaactacaaatcatctaaactctccttaaaattattcaatctttttccaggcaaagagattttctttggtgaagagaaaaattgcytaaagtggtttgacccacacctctctctctggcctccttcctcttcctagaaatccagctattgattcagcttctactcatgcctgtaatctcttgctca

SEQ ID NO: 6459 - DNA, 201 bp, Homo sapiens
ccatgtcaccttcttgacaagcaatagtgctgaggtcagaactctccccatagccataccctaaaagatggtacatccagacaatagaatattattcaacrcaaaaaggaagtgtgacatcaagccgtgaaaagacattgagggaccttaaatgcacatttctaagtgaaagaagccaatctgaaaaggttacatactgta

SEQ ID NO: 6460 - DNA, 201 bp, Homo sapiens
attgcttgaacccaagaggcagaggttgcagtgagccgagatcacacgactgcactccagcctggacaacagagactgtctcaaaaaaaaaaaaagagagwgataccatctcataccagttagaatggcgatcattaaaaagtcaggaaacaacaggtgctggagaggatgtggagaaataggaacacttttacactgttg

SEQ ID NO: 6461 - DNA, 201 bp, Homo sapiens
aaaaaaccaaacaccacatgttctcactcataggtgggaactgaacaatgagaacacacggacacaggaaagggaacatcacacatcggggactgttgtgrggtggggggcggggagggatagcattaggagatatacctaatgctaaatgacgagttaatgggtgcagcacaccaacatggcacatgtatacatatgtaa

SEQ ID NO: 6462 - DNA, 201 bp, Homo sapiens
acactatgtagaaggtgtagtcacagggtgaggggtgtgagggaaatggtggcagcaagaagttgagcctgggcatctgggaggatggtggtgccatgccmtggaggaggaccagtttgaagaaggaatatcataggagtccaataaatactactagaatgaatgacttaataatcagtatgtaagttacattcattcccc

SEQ ID NO: 6463 - DNA, 201 bp, Homo sapiens
tatgaggtcagttctattttatcccttttaacaaataagtaaactagagcacagatgggttaagtgacttgtccaagatcacacagcaagctagtagagaygggattcaaactaaacggtaactcaagtcccttctcttaagccctccatctcatgtactcagaggcattaaatctcaaggtatacataaaagataaggta

SEQ ID NO: 6464 - DNA, 201 bp, Homo sapiens
ggctcgaatagaagaaattcatttcctccacgctcttgctccacacattcatttattttccttatctcaatggaagaagaaacattgccccttttgaaacrgtagtaaagattttaaagaaaaaaggagaacttttgaagtaaaaatatgacgaaattggtactaggttttgcataatggtgggccattagaaacggcctt

SEQ ID NO: 6465 - DNA, 201 bp, Homo sapiens
tggtggtaattctcatattctggttttcataatcatctgaggagttgaagtcatgtctcataccacccaccaagaaaaattccaaatattaaaaaatgcarccaaaaaagaagaaaacacgaggtaattatcttgtaataaagaatgatgaaagacttttgaattacgtctcaaaattcaacagccataagcaaatggttg

SEQ ID NO: 6466 - DNA, 201 bp, Homo sapiens
tgaatgatccttgacatcaagaagctcaaagactagctggaaagatactaatatagcaattccttttattttctctaataggagacccactcgcaactatsaggaatagatactatcagcagcaacagcaactttttttttaaggacaaagaaagtaaatatgggaaaatgtaaacttgtccaaagacatacatctagtca

SEQ ID NO: 6467 - DNA, 201 bp, Homo sapiens
gctgaggcttgagaaccactgcctagaaattaggtgctattatcatcactttgcaataaacacctgaggcccagaaaagtaaaatgatgtgcaagtcatayagaaagtggacgagacaagctttgaacccagacaagtctaactccagagttgaggcccttaatcacagttctacactgctcattatctgaggaataaagc

SEQ ID NO: 6468 - DNA, 201 bp, Homo sapiens
aaaaaaaaagatgtctgtgtttacttgagtttttattaaggaaaaaactttctaactctatgatgtggaagcaattatttttgagctttgtttgcagtgtkggggtggatctcagaaaccaggtcattgttgatctgattttctctggagatgacgctaccccatttagaacagctcactgaaccctgatgtctatgcccg

SEQ ID NO: 6469 - DNA, 201 bp, Homo sapiens
ctgtagtgcagtgttgtgatctctgctcactgcaaccttcgcctcctaggttcaagcaattcttgtgcctcagcctcccaagtagctgggattacaggcaygcaccaccatgccaggctgccttgggtgtttctttatagcaacacaagaatggactaacatgggctcagagaggttaggtaacttgtctaagaccacaga

SEQ ID NO: 6470 - DNA, 201 bp, Homo sapiens
tgaacatgtttcataatcttcccataactcggttttatcatatttacaatgggcaaaactactcacctcatattgctggtggaattaaatgaatgcaagtktggcacatctctaggaatttatctaagtcttttttaaattgattattgtattatacctactataacgacgtgtattttctatgacattttgtgattcaag

SEQ ID NO: 6471 - DNA, 201 bp, Homo sapiens
cggccaacctttctgaaacccagaagaaagaagagcaagtggggctcagagtcacagttgctcagcactgcaggcagggtccgtatgtcataataacagayggggtaggtaccattgctcttgcagcctgcaggtcccaaaggaaattgtgtcattttatcttgcctagctccaaaaggagcagcctctgtcagaagatct

SEQ ID NO: 6472 - DNA, 201 bp, Homo sapiens
tagccaaatgtggtagtgcgcacctgtagtcccagttacttaggagggtggggcgggagaattgcttaatccaggaggcagaggttgtagtgagccgagaytgtgccacagcactccagtctgggagacagagcgagactctgtctaaaaaaaaaaaaaaaaaaaaaaaaaaaaggagatataatcctttttgtttttttg

SEQ ID NO: 6473 - DNA, 201 bp, Homo sapiens
ttagcatttgacaagcattttttaaattaattgtcagaaaagttccttcaaatctgctttcccaacaaattgaacatcagtggttttcacctaacaactawtgacttcaggttatgacaagattaaaatatttcattttgttttatccatcagttgaagtacataaaccatacttttctggtattacaagcaatatcagtg

SEQ ID NO: 6474 - DNA, 201 bp, Homo sapiens
gtttgcagatgctctctgggggtctcagcacatttaaaggctaattatatagttaaagttaattattcattcattaacattcaagaagcctttaacaagasactgcttgtcttgatgaattaatgaaaccagcatgtgcacatgagtgtgtgtgtgtgttactgaaaattaaaacatctctttgatgataactgaatatat

SEQ ID NO: 6475 - DNA, 201 bp, Homo sapiens
agcgagggttcgtcaagttcagggaacagaaggaaagtcagaacagctgaagtttaaggagcaagagagagtggtgagacatgagttaggacaggaagcaraggccacatcacacaatgaatgccctgtagtcaggatagggagtctgtatctaattcctaggtcaactgtattgcaaacaactcctctgctaaatgtgcc

SEQ ID NO: 6476 - DNA, 201 bp, Homo sapiens
acatggaattagttactaatatttaaaaatggaaaggtttctaacaaaatcagatgacattttctctttttaaaaaactagaagacctgataatattgackctacattcccataagacaatactcagcaggagttgaggatggctgccacgctactggtgaggtaaacatcatgcaattggccacagtcctcagtattccc

SEQ ID NO: 6477 - DNA, 201 bp, Homo sapiens
attcccattctctagcaaaatctcattttggaattgcatgttgggtgcctgcctcttactaccatgcctcttctcagctggtgtcatctcctctggggaartttttcatcatctttgctcaattaggaattaatctccctcatctgacttttctagtatgatttttcattcatgtcttaatcaccacctgacactttattt

SEQ ID NO: 6478 - DNA, 201 bp, Homo sapiens
ccctgtgcccagcaatgtgcctaacatgcaaactgtgcttaatgcacattcattcattctgtattaaaacaatttatttataacaattttacttataacartgtctgtgttatttcactgtaaaggaattcagcaaaaatcattaaaacattcctgaccccaaaacatggtctgtttcacacaattatgaatcatgatgaa

SEQ ID NO: 6479 - DNA, 201 bp, Homo sapiens
acttgcacacatatgtttatcagagcacaactcacaattgcaaagatatggaatcaacctatgagcccatcaactgatgattgcataaagaaaatgtggtrtatatacattgtggaatactactcagccataaaaaagaatgatgcaatgtcttttgcagcaacttggatgaaactggaggccatcattctaaatatatga

SEQ ID NO: 6480 - DNA, 201 bp, Homo sapiens
ctaaagatgttaacttccttgtcatcagtaagaacaaacctaatgatgttattacaacatccagatatggggccaattatttatatgttcattttatatgrtcccgcatttagaatagaatgaaattttaatttattattttggtttttacctgcctttatcattaggaagtgatgtttattagtcagtgaattaagagga

SEQ ID NO: 6481 - DNA, 201 bp, Homo sapiens
aatacccacccaagcttggaacaagacatgggaataaaagggcagaacgtgacaatagaaagacttcattgcaattctgacttgatcatctgctagctgcrtggcctcggagctacagttatcctgtctgtgaaataggcataataatagaacatacttcctagagtcgccatgaggattgaatgagatgagaatgtataa

SEQ ID NO: 6482 - DNA, 201 bp, Homo sapiens
tgcttttctcatgggtactttgccctctaagaagcctactttcctcttttcctctcctcctctccctatttctctttgttgagagagcagtcagattaacmcaacaactcttggagtgccttggtcacctgagagcatggaaagtccatgccctcaccagagtaatgactaccatttctccaaaactctcctcatgccatc

SEQ ID NO: 6483 - DNA, 201 bp, Homo sapiens
atccatctatccacccatccatccatcattcatccattcacacatactttatttagggtctatgtgccaagtgttgttctgtgtgctaagtgtacaatggygacaacagtagtagcacgatattatgggttcttcctctgacatatgctaataaccccactaatatcaccagacctcaagaataaatacaatctaagtaaa

SEQ ID NO: 6484 - DNA, 201 bp, Homo sapiens
cgtgccatggtggttggctgcccctatcaatctgtcatctatattttaagccccgcatgcattaggtatttgtcctaatgctctccctcctcttgcccccmacccctgacaggccccagtgtgtgatgttcctctccctatgttcatgtattctcattgttcaacttccacttatgagtgaaaacatgtggtgttaaacaa

SEQ ID NO: 6485 - DNA, 201 bp, Homo sapiens
tgttaatttctttggctgcatagcaaccactactgccatcaatgccctcggggaatgctcactcttcctgtccgccatcttgatgagtctattaaatgcasttgcttgatcgagagctgagatgcaacatgcaagctgtgtccaacaggctttttaattttgagtagcatgccctcagagtcctgcctagtcccctcaacc

SEQ ID NO: 6486 - DNA, 201 bp, Homo sapiens
agagatcagggtgtcttcaagagtttgaatttctctcttctcaagaatagaaggaaaattaagcattatttttttctctcaatgattttgccttttataawaagtaactcttatagactccttactatgtgacatgccctgtttcaaacatataaaatatattaactaatttaatgctcataacaactctatgaggtcagt

SEQ ID NO: 6487 - DNA, 201 bp, Homo sapiens
taaaggaagttttctttgggaacaaagtttataaaagcacaatgctgaaaagtcagaggcaggacagctgcaaaagatgtggttgactctgaccaaagcarttacacattggcatgactggggtgggctggtggtcatgctgtcagaggggtctggccatggaggcacacaattgggccagccctccatggcctgactgtc

SEQ ID NO: 6488 - DNA, 201 bp, Homo sapiens
catcctgtctccctcccttgcacccccttcctcagctaactagtgttcccctggctcaaagaaaatgtggaagttggtggtttttcacaaggatgatactrtctggagctgctgtcctctgagagtaggacgggtcagaagagatctgcacctgctctgttaaggtagtcttgccatctctaagggtttgatttgctggct

SEQ ID NO: 6489 - DNA, 201 bp, Homo sapiens
gtagacacagggagtcaatggccatcctgttgcacaaaacaggtttctgtggtcaaggtgatctcctcgtcccatggtccttttttgaacttggtgttacygaatctttcctctactgacatcacctcccttttctccttgacacactctcctccattgctgcctgaaacatctttttctccttgtccttctcttatatcc

SEQ ID NO: 6490 - DNA, 201 bp, Homo sapiens
cagctggggagagggcttaacagagattgattacatacaattaccagaagaatggaaatgagtgttaagataaaaaatacacaggttcattccataatgasaatagaaatatagtggacatagaatatctttcctcatcaagcatccattctagttttttactgaagaattgtccctgcttgcccctttatccctgtggac

SEQ ID NO: 6491 - DNA, 201 bp, Homo sapiens
atctctagaacattggtcctcaaagcacagcccctagaccaagaacatcaacatcacccaaaaacttgaaagaaattgcaaattctctgggctcaccccayattttctattacattagaaactctgagattgaggcccagtaatttgtgtcttaacaagtcctcccagagattctgatgcctgctgaggcttgagaaccac

SEQ ID NO: 6492 - DNA, 201 bp, Homo sapiens
tagagaaaaagctatagaaactaacacagcttcctttggctcttaccaggtgaaccttgagaaatctctgagatggcctcatgtatcacactagagcttgmaaatggcataaaataatcagataaaacaaggtacaagatgaggaggcatcaggttccttaatgctttaacatcagctcagtgcaaatggtgaactgatag

SEQ ID NO: 6493 - DNA, 201 bp, Homo sapiens
acaagcaaaactaatctatgatgattgaattcagaataatggttatcttggggttggtgagaagggagcaaataagaacttcatagggaactagaaatgtkctatatctttgcaatgtatctatgtaataaaactgcacttgcacctcttaaatttaaacaaaatttttgagatttttcgtgaaaacggccatactgccca

SEQ ID NO: 6494 - DNA, 201 bp, Homo sapiens
ttacaggtgtgtgccaccacacccagctaattttatttttagtagagatggggtttcaccatgttagccaagctggtctcaaactcccaacctcatgatcyacccgtcttggcctcccaaagtgctggaattacaggcgtgagccaccgtgcccagccaatgtcacgcacagttttaagcaaaactatgtttcagtctcag

SEQ ID NO: 6495 - DNA, 201 bp, Homo sapiens
atgggaaggttatgaggactttttaatatcacaaaggagttcttgtgttttaaacacatacagatttaagaaaaaaaaggatagcaataacttcagatccygtgctgttttgagagccactggctaaactgggtttccagtactacagcagctaacaaccctgccctaatgaccaacgaggggaagtaaatctgggtgttt

SEQ ID NO: 6496 - DNA, 201 bp, Homo sapiens
atgccagaaacctatctggaggaggataagcagagcatccatccatgtgcacaccctggggcctgcgcccccccataaatcattatctgaaccaacaggayaggctgctgggacacccactctacttatcagagcccagcagttgtgcccaaggcaacagcacctgaattttataattctgcaggtgaaatttagtgcaaa

SEQ ID NO: 6497 - DNA, 201 bp, Homo sapiens
ctactctgagcctggagctgggtgctggatattcaacaacagataagaaaggcagagaccctgtactagtctgttcttgcattgctataaagaaatacctsagactgggtaatttataaagaaaagacgtttaattggctcacagttctgcaggctttacaggaaacatggtactggcatctgcctggcttctggggaggc

SEQ ID NO: 6498 - DNA, 201 bp, Homo sapiens
ttctagaaatgcaaattgtcagtctctttgcctccagacctaatgaaacaaactccagaaataacattcggaaatctgttttcacaagctttccaggtgastgacacacactaaagtttgaaaaacattgggttaacacgccgggcacagtggctcacacctgtaatcccctgtaaacccaacattttgggaggccgaggt

SEQ ID NO: 6499 - DNA, 201 bp, Homo sapiens
caactctctgtctttttgttttctttcgtttttccttttgatgatgagccctactttgtctctctgtccagtgggtgtctacctgctttctgtgaattacmactagacatccagtgaggtaactcaaaggcagagaggaaaggtcgggggtgatatgccaatgggactctaacattcctaactccacttacatcgttaata

SEQ ID NO: 6500 - DNA, 201 bp, Homo sapiens
ctgtatctctggagtgttggaatcagtagatctgggataaggtgtgggatcctgacttttcaaccagcgtcctagagtcattctgctccgtgtggtctaakgaccccattttaaggagcaccaggaggggaagacctatgactaacatacaggattaaataaagcataagaacaagatggaaatctttcttcttgggttac

SEQ ID NO: 6501 - DNA, 201 bp, Homo sapiens
ttatcacaaggacaaaaggccaaacaccacatgttctcactcataggtgggaattgaacaatgagaacacatggacacaggaaggggaacatcacacaccrgggactgttgtggggtggggggaggggggagggacagcattaggagatacacctaatgctaaatgatgagttaatgggtgcagcacaccaacatggcaca

SEQ ID NO: 6502 - DNA, 201 bp, Homo sapiens
cagcctgggtgacagagcaagactctgtttcaaaaaaaaaaaaagaagaagaaaagaaaaacattgggttagcaaaaagacacatgcactcatatgttcgytgcagcactattcacaataacgaagacatggaatcaacctaggtgcccatcagtggtggattggataaagaaaatttggcacatatataccatggaatat

SEQ ID NO: 6503 - DNA, 201 bp, Homo sapiens
actccctcctcaaaactcccctcacttcctctgcagctccatttccaccttagagtttttcaaacacatacattctcttctttgctggagggtaagctccygggaaacagggatcatgtctgagccctcgctgcgtgccctcacccctgcacagtgtctggcatgtggtaggcggtcagtgaccatttgctgaatgagcag

SEQ ID NO: 6504 - DNA, 201 bp, Homo sapiens
agtcacttcatctcttggcattgattttgtattttgggcttctgatcagacacatctgtgtttctagcttttgtccccactgatttatagtataacttgayagatgtcccatctgtattttttgaatcctcatccattttcagtgagatgacaatgcctcaatgcaaagcctccatgtcattttggtaatgaaactcaaat

SEQ ID NO: 6505 - DNA, 201 bp, Homo sapiens
tggggtggagagaggagccccactctaggtcatctgatctgctacattggagctgatcaaaatgatatgaagaaggagtcatccaggcaaagattaggggygagatgagagtagggagagccattccagcagaagacacatatgccaaggtaagcgagggttcgtcaagttcagggaacagaaggaaagtcagaacagctg

SEQ ID NO: 6506 - DNA, 201 bp, Homo sapiens
gttttgccggcaaaacacacagtataccatgacgataaaaagccgcaggataagaagagtccctggtgaagaaaaggtgaggaacttcagaagaattcagrcccaaatctctttcaaagatttggaaactgggttcccaaaaagagagttgacacatccagggtcggagtgatagtgacacagtcaagactagaatccaag

SEQ ID NO: 6507 - DNA, 201 bp, Homo sapiens
aattaatgtctttttactttaatgaatcttatcacctttatcataaaaaagtgaagggaatgtgtaagacttcacttcttccatgagaccttcccattttygtaagctcatttttaccagctaattcttccaacaacccagcctacaaaaggtataacgcagagtaggaattccagggggaaagatgtgcaaagtaaatct

SEQ ID NO: 6508 - DNA, 201 bp, Homo sapiens
taccagctccctggaagatgagtcagattctaaggtagcacagaaaattcacaggtgtgagtcaagcctgctccaggactggttaaaaccaaccaaagggratgatttggtggctccaaaagtgaatcgcagattgtgtaacatcaaaaggttgaaaaccccaaaatgcaacaacataaggcagaaaggctccaactctct

SEQ ID NO: 6509 - DNA, 201 bp, Homo sapiens
tgttcctccatgtcccaccttgacacctctagaaatctcttccctctgtctagaatgtctttccctatccccttcacctgtggaggttttactgtgattaygaggcacacatcaaaacaccacagcatccaacatatagcaggtgcttgataaatatgtgttgaataagtgaatacaaactccctagcagaatagaatgca

SEQ ID NO: 6510 - DNA, 201 bp, Homo sapiens
acccaggcaaaataattttgaaatagaaaaacaatggtgaaggacttacattaccctcatttcaaacatattacaaagctacagaaatcaagagagtgtgrtattaagggaaagagacaaatcactggaacaaaactgaacgtttagaaataagctctgacactgtcaattgatttttgacaaacatgacaggataatttg

SEQ ID NO: 6511 - DNA, 201 bp, Homo sapiens
ctacccaaaggaaaagaagttattatatcaaaaagacacttgcacacatatgtttatcagagcacaactcacaattgcaaagatatggaatcaacctatgwgcccatcaactgatgattgcataaagaaaatgtggtatatatacattgtggaatactactcagccataaaaaagaatgatgcaatgtcttttgcagcaac

SEQ ID NO: 6512 - DNA, 201 bp, Homo sapiens
ttaactaatttaatgctcataacaactctatgaggtcagttctattttatcccttttaacaaataagtaaactagagcacagatgggttaagtgacttgtycaagatcacacagcaagctagtagagacgggattcaaactaaacggtaactcaagtcccttctcttaagccctccatctcatgtactcagaggcattaaa

SEQ ID NO: 6513 - DNA, 201 bp, Homo sapiens
ccatctctgaatgaggaggctaggtttttccaacggtggagccacaaaagtctgttttgacaagttatctccccgtaaacatactggtttatctcatgctraacaattagatgtgctatttaggcaaaataaaaaatatattgcacattttctagacagcctgttagcatccatgccaatgacacgaacatcaggacatgg

SEQ ID NO: 6514 - DNA, 201 bp, Homo sapiens
tcagtatacatctctaaaagtcaaggactcctttttacaaatatcatcacaataccatcatcacactcaaaatttaccttaatccttaatattatcaagtrtctggtctgtgttcatatttcgctgattgttctatatacttttagaaaaatcgtattcttttgacttagaatacacacaaggtctatatgattaatatgg

SEQ ID NO: 6515 - DNA, 201 bp, Homo sapiens
gcctggagttcttggggtgagcctgggctgtgatggaaggcataacaagaaagctgaaactgttacgagccaaacttcctaatctcttgcacatgtcaatygcactacagtgcagatgcattcttaactgtttttattttgtctgtgtcaggtttacatgcacaccatattgcttattctgtattagagaaaccattaggc

SEQ ID NO: 6516 - DNA, 201 bp, Homo sapiens
aaaatagacccaggcaaaataattttgaaatagaaaaacaatggtgaaggacttacattaccctcatttcaaacatattacaaagctacagaaatcaagasagtgtggtattaagggaaagagacaaatcactggaacaaaactgaacgtttagaaataagctctgacactgtcaattgatttttgacaaacatgacagga

SEQ ID NO: 6517 - DNA, 201 bp, Homo sapiens
ttcaagggctgcttgaagcccgagatcctagtgacactgagatatttataaggtttcccttcgtattctctgagcactcctctcatcatcagattttccasatgataagtttttagcaggcccttcttccccctctactcctgtgtggacctctgggctgcctttttcaggttttgcaaactggctatgaattgttcagcg

SEQ ID NO: 6518 - DNA, 201 bp, Homo sapiens
tctatttttcaaacaacccccaaaactagccacagcaacatgcaggggccctgcatcaacaggtacttgaatgctggtgaatgcgtcccaggcacctcacytcgttcgcccattttggtgcatcagaacaacgttgtcactggtctaacctcatcttcactccctggggactgaggtcttgcctgattcccaaagccctgc

SEQ ID NO: 6519 - DNA, 201 bp, Homo sapiens
attgtggccatggtttcacaggcacatgcatacatccaaactcatcaaattatgtatattaaacacacgcagtttttaatattatttagatgtcaatggarctgtttttaaaaaaaaaaaattgaccatgagttgaagctgaattgagggtacatgagtgttcattacacattctctctattcttgtatgtttgctaatct

SEQ ID NO: 6520 - DNA, 201 bp, Homo sapiens
ccactgatatttgagggcttatttgttatagcatctaccattatcctttgaattacgaagctaagggaaaaaaagcccattggctttaaaacccagcagarttcagtaggaggaggaagatggagaaagttataaagtaatcaagttgggtgggaacctcaggttagatcctcattacacttagaatgagcgttacccatt

SEQ ID NO: 6521 - DNA, 201 bp, Homo sapiens
tattttaaaaaaaagaacaagaatgctgtataaaacagtaaacagtaaaacataatgcagcaattaaaagttaatgccccaacatttattttggggatacrgcatatgtctcacctagtctgggactaaaaagtttcctgccttattcatgcaggggcttcttcatggtttgcgtaaggcagccaattaaagtagaaactc

SEQ ID NO: 6522 - DNA, 201 bp, Homo sapiens
tttttgtacgttagacagaagtatgcattgggaatacggttgcacatgtatgtgtattgaaagtacgaacacatgtacatggatttggatgtaaaccaaaytgattatcatgttttcccttctatggagagaacaggagaaaactgggacagggaaacagatagaatcagaacttctacattatcattaatgttttattgc

SEQ ID NO: 6523 - DNA, 201 bp, Homo sapiens
ggtaaaggaagttctaacacattagacaccatttttgtacgttagacagaagtatgcattgggaatacggttgcacatgtatgtgtattgaaagtacgaamacatgtacatggatttggatgtaaaccaaactgattatcatgttttcccttctatggagagaacaggagaaaactgggacagggaaacagatagaatcag

SEQ ID NO: 6524 - DNA, 201 bp, Homo sapiens
gatcctcccgcctcggcctcccgaagtgctgggattagaggcgtaaaggctgcagtcacgtagactcaaaagaaaaacagtattttaaaaaaaagaacaasaatgctgtataaaacagtaaacagtaaaacataatgcagcaattaaaagttaatgccccaacatttattttggggatacggcatatgtctcacctagtct

SEQ ID NO: 6525 - DNA, 201 bp, Homo sapiens
atcaataaaataaatgcaattgaattatcttcatagagggattttgaaaacataaggttgaggtaaaggaagttctaacacattagacaccatttttgtamgttagacagaagtatgcattgggaatacggttgcacatgtatgtgtattgaaagtacgaacacatgtacatggatttggatgtaaaccaaactgattatc

SEQ ID NO: 6526 - DNA, 201 bp, Homo sapiens
atttgcaacctccctgctacataggaggaatagtgagagctatttgtttatcagatgctttgcagagtaagaccttaatccagctgcaaatgtaatttttwagcttgaagtgaagaactcctaactccagagtcctgggcttctattgaacaagctggtagatctaacacaggctacagataggtctgttctctgctttca

SEQ ID NO: 6527 - DNA, 201 bp, Homo sapiens
ataataagagggtttgaacacagcactgtctaagtctacattccacaaagtcacatagctttgggaaaaatgatttgtgttcctctggattctctcacctygtatctcttgctgatttactttgagactcagctgtttttcccacttctgagttcagagtcccaatcagatgtacagcaaaggcccacaggacagcttggc

SEQ ID NO: 6528 - DNA, 201 bp, Homo sapiens
tagcacatgtcaccaaattactaaatttcaaaatgaaaacttctctagtattcatccctggaggaaatagatcaatgtgcctttttgttcggcattctggktccaaaatcctaagacttacatctggcctaaggcaaatgtgaacaatatttgtgctttatgtgtgaccccaaaacaacccaaaccacctttccctcaagg

SEQ ID NO: 6529 - DNA, 201 bp, Homo sapiens
cctcatccgtcgagacccaaagcttcatcacttccttatctctccaaagccaaaacttgacttgccatactttctcaatgtactgattaaataaaactgcyggtaggattaactctgcaaggatgcacccaacccagatatattcaccatagccatagattacacatttttggaaggcctactacgatgtctatcatggag

SEQ ID NO: 6530 - DNA, 201 bp, Homo sapiens
gatcattagcaggtcaggatatgggattattatcactaactccatctttttcatggtaaacaaaaaatataatttttgtgaaatctgatgatagtgtttaracattgggactttacttttggaaacaggaaaaacactctaagtttaaaaaaaaaaaaacatgcacacaacacaggtcaatttgcagcctctgaaagtcgt

SEQ ID NO: 6531 - DNA, 201 bp, Homo sapiens
aatgtcccctggcctagataattgcaactagtccttcaaaaatcagggcagtgtcacctcctccaggaagccccctggccccctcatcccccaaacagcascaaattcactgcgtgtttactttagctctttcccacatcagactgaaaccaggtctgcttctattttgtgcccctgacgctagcacagtgcccgcccggc

SEQ ID NO: 6532 - DNA, 201 bp, Homo sapiens
aggcaggagaaggtggaggttgtagtgagccgagattgcaccactgcactccagcctgggcagcagagtgagacttggtctcaaaaaaaaaaaaaaaaaamaaaaaaaaaacaaaaacctcatgcgtttaacaatctagtttttgtttaattgcttttcattcttttgtgatgatccatattctgtttggtattactttct

SEQ ID NO: 6533 - DNA, 201 bp, Homo sapiens
tagggagtgtgatgatattgcaaaagcacccagaagcctgctttgtacaaaggagaaaaataattacaagttaatggcctaagtgatctccagcatccctkcctgctctgacatcatgaaatacaattccagattattgtaaccaacaccatcaatctgcagatttaaaaaaaaaaaaggagaatcagaaaagttaagaat

SEQ ID NO: 6534 - DNA, 201 bp, Homo sapiens
aaaaaccaaggataagaggggactactgtataggttcgagtcattcaaaagcgactaacatatacgaagcacaaattatgtccattgagaagttttctgtytgaaattaaagtccaaagtatcttgtgcaaaagtgtttctcaaattcttacttaaaatgtcactttgttaacattcagctttgttaaatgtaaccatgta

SEQ ID NO: 6535 - DNA, 201 bp, Homo sapiens
tctcactccccgcctagagattgctccttctgcactctcttaatgagactgtcgttgtacatttttaaaaattttattctcaaaagccccagggagttggwataatgaaacatacttaattaagctatgcaaagcaatcctgccatctaggtggcattttttgttctattttccttggttattccgagaattatattatta

SEQ ID NO: 6536 - DNA, 201 bp, Homo sapiens
gtaataattattaattatgtctaattaggagggtaataaagcaaagtgatcccatgaccccacagatcctcccaacagtcaaaagcttcatgacatgagtscttggaaaaaaagaagagaaagttgcattaaacatcacccaacttctcaagagaaccagaaattgtgagtaggagcttttcatacaccctgaatctgccg

SEQ ID NO: 6537 - DNA, 201 bp, Homo sapiens
tattgtatttcacccacaggggttctttttacttgttgctgattttcaaaagaaaaaaagaaaagaacaaaattacaaaatccattacgtgaaggcattakaactgagtgtgaaaaacaatttagaatagaggctcccaagaatgtttgatttggagagaactagaaaatcattcttggttaaaaaaaaaaaaaagatgca

SEQ ID NO: 6538 - DNA, 201 bp, Homo sapiens
ctgagcctgcttaaaatgtagaaggcagataacgtttgggcttgaagtttgaaataacatttttttttccatttctcctttgggagggatattgtatttcmcccacaggggttctttttacttgttgctgattttcaaaagaaaaaaagaaaagaacaaaattacaaaatccattacgtgaaggcattagaactgagtgtg

SEQ ID NO: 6539 - DNA, 201 bp, Homo sapiens
gcacttaatgccactgaattatacagtttaaattgttaaaatggcaaattttttgttttctgtatttttccacaacaaagaatcattttaaatgaaagtamcaaagaaagcaagcagatggctgaatagaactgagctaattcaaggatacaataagtagttgaaaagcagtcatagctgagatatgagatttaaactcat

SEQ ID NO: 6540 - DNA, 201 bp, Homo sapiens
cacactgctgataaagacatacctgaactgggaagaaaaagaggtttaatggacttataattccatgtggctggggaggcctcacaatcatggtggaaggsaaggaggaccaagtcatgtcttacatggaagggagcaggcaaaaagagtttgtgcagggaaactccacctttttaaaaccatcagatctcatgagactta

SEQ ID NO: 6541 - DNA, 201 bp, Homo sapiens
tgtttttcacactgctgataaagacatacctgaactgggaagaaaaagaggtttaatggacttataattccatgtggctggggaggcctcacaatcatggkggaaggcaaggaggaccaagtcatgtcttacatggaagggagcaggcaaaaagagtttgtgcagggaaactccacctttttaaaaccatcagatctcatg

SEQ ID NO: 6542 - DNA, 201 bp, Homo sapiens
ggctgggggatgaatggtcagccaggagcaagtggtgggaattaaagatgctgagtgagaggttgacttaagcatgggatctaggagacagggagtgttaktagtctgtttttcacactgctgataaagacatacctgaactgggaagaaaaagaggtttaatggacttataattccatgtggctggggaggcctcacaat

SEQ ID NO: 6543 - DNA, 201 bp, Homo sapiens
ccacaccgtggcctggcaccaggccctccctggtgacattgggaaagtaggtcagtttcagagctggctgggggatgaatggtcagccaggagcaagtggkgggaattaaagatgctgagtgagaggttgacttaagcatgggatctaggagacagggagtgttattagtctgtttttcacactgctgataaagacatacc

SEQ ID NO: 6544 - DNA, 201 bp, Homo sapiens
accacaccgtggcctggcaccaggccctccctggtgacattgggaaagtaggtcagtttcagagctggctgggggatgaatggtcagccaggagcaagtgktgggaattaaagatgctgagtgagaggttgacttaagcatgggatctaggagacagggagtgttattagtctgtttttcacactgctgataaagacatac

SEQ ID NO: 6545 - DNA, 201 bp, Homo sapiens
cagcaaacaggaagggagcagtgaggggatgcaccacaccgtggcctggcaccaggccctccctggtgacattgggaaagtaggtcagtttcagagctggstgggggatgaatggtcagccaggagcaagtggtgggaattaaagatgctgagtgagaggttgacttaagcatgggatctaggagacagggagtgttatta

SEQ ID NO: 6546 - DNA, 201 bp, Homo sapiens
tgggcgagcagcaaacaggaagggagcagtgaggggatgcaccacaccgtggcctggcaccaggccctccctggtgacattgggaaagtaggtcagtttcwgagctggctgggggatgaatggtcagccaggagcaagtggtgggaattaaagatgctgagtgagaggttgacttaagcatgggatctaggagacagggag

SEQ ID NO: 6547 - DNA, 201 bp, Homo sapiens
cgagcaatctgcccaccttggcctcccaaagtgctgggattacaggcatgaatcacgatgcctgaccacaaaagtcttgtttttctattcagccatcgaargacatttaggtgttttacagtttggggcaattatgaaaagagattataaacatttgtgcacaggtttttgtgtgaccataggttaaatacctaagagtga

SEQ ID NO: 6548 - DNA, 201 bp, Homo sapiens
tttcatttcctgataatagatcttcccccacgaaccctggagggcatctctggccacagagattggttcagggatcggtacgtgactcaatctcattcaawcacatttcttctctgggaattttttattgcaactagaagggatcactgtctttctggattaaaaaagtatgtgaatcaatacttagtttagatgagttca

SEQ ID NO: 6549 - DNA, 201 bp, Homo sapiens
acttgactccttcaggttagacgcatcctcttccaactctcaacccctgttcttcatgtggcacacaccacttagagggcaccttctttatttatgttggkcccaaccactcaggactaattttaaaaagacacctctttctgaagaccctttactaccatttgccaaaacaactgtcaaaataaaacacaaatgtttgat

SEQ ID NO: 6550 - DNA, 201 bp, Homo sapiens
ttaacaaggctgatttcaagctgtttcttcattgtggggtttcctaataatctttccttctcttggttctgtttttttttttttttttttggcgggggggkgggggggtgggtgggggtgacggagtctcactctgttgcccaggctggagtgcagtggtacgatctcggctcattgcaacccccacctcctggattcaag

SEQ ID NO: 6551 - DNA, 201 bp, Homo sapiens
ttttaacaaggctgatttcaagctgtttcttcattgtggggtttcctaataatctttccttctcttggttctgtttttttttttttttttttggcgggggkgtgggggggtgggtgggggtgacggagtctcactctgttgcccaggctggagtgcagtggtacgatctcggctcattgcaacccccacctcctggattca

SEQ ID NO: 6552 - DNA, 201 bp, Homo sapiens
taaggcgcaccagcactcatttaacctccctacacctcagttgccctctctgaaaaatgggggggtggtaccacacacttctttatttttccaactctacratatttaattttctctcctcatcttcccctactcccatgaatacacaatgcatttggtcctaaccccatctcttagtatatgctgttcctcccacccaga

SEQ ID NO: 6553 - DNA, 201 bp, Homo sapiens
atatttgctcatccatgctgctacaaaagaactctggtcttcaaatcaggagacctagaatcttgtcctgtctccctgaatatgtgagtaagagcgatcamttaaggataagggactaaaatgtatttagcctctaatatatgttgaatggtgtgccagatactttccatatgttacctgaattctcacccaaagaactaa

SEQ ID NO: 6554 - DNA, 201 bp, Homo sapiens
ttgtatttttagtagagaaggggttggtcaggctggtctcaaactcctgacctcaaatgctccatctgcctcggcctcccaaagtgctgggattacaggcrtgagccaccacatcccacgcctgaccagggaaaatatctttatattaatcaattaaacaaataaactagaagacaattaagatatttgctcatccatgct

SEQ ID NO: 6555 - DNA, 201 bp, Homo sapiens
agtgcaatggtgcgacctcggctcactgcaaactccacatcccgggttcaagtgattctcgtgcctcagcctcccgagtagctgagattacaggtgtgcamcaccacacctggctaattgtttgtatttttagtagagaaggggttggtcaggctggtctcaaactcctgacctcaaatgctccatctgcctcggcctccc

SEQ ID NO: 6556 - DNA, 201 bp, Homo sapiens
atctggaaatgctgggtagtatttataacactgttaaaatagcaccaaatgcgtcaccattaacctctcatgactaaggatcacctaaccactttgaaccrgctggcacaagagccagtggaaccagctcacataatgagcttctaatccaaatgagcagaaaaaaatgtatgtaacgtggcgtgcatttccaagttcact

SEQ ID NO: 6557 - DNA, 201 bp, Homo sapiens
cttaaacatcaaggcagagaaggccaggcgcggtggctcgcacctgtaatcccagcactttgggatgccaaggcaggtggatcacctgaagtcaggagttygagaccagcctggccaacatggtgaaactccatctctactaaaaataccaaaaattagccaagcgtagtggcaggcatctataatcccagctactcatgt

SEQ ID NO: 6558 - DNA, 201 bp, Homo sapiens
atatacagtactcattggtggtttcctgttccccgtgaacaattaaaaagtcttaacagcagagccagaacttaaacatcaaggcagagaaggccaggcgyggtggctcgcacctgtaatcccagcactttgggatgccaaggcaggtggatcacctgaagtcaggagtttgagaccagcctggccaacatggtgaaactc

SEQ ID NO: 6559 - DNA, 201 bp, Homo sapiens
gtcttttgacggcagcaccttcctctttgccctggtgctcaatttcatatacagtactcattggtggtttcctgttccccgtgaacaattaaaaagtcttracagcagagccagaacttaaacatcaaggcagagaaggccaggcgcggtggctcgcacctgtaatcccagcactttgggatgccaaggcaggtggatcac

SEQ ID NO: 6560 - DNA, 201 bp, Homo sapiens
cctctgaatatccttgcgctgtcttttgacggcagcaccttcctctttgccctggtgctcaatttcatatacagtactcattggtggtttcctgttccccrtgaacaattaaaaagtcttaacagcagagccagaacttaaacatcaaggcagagaaggccaggcgcggtggctcgcacctgtaatcccagcactttggga

SEQ ID NO: 6561 - DNA, 201 bp, Homo sapiens
tttgtcatttaatttacatgtttttgaaaacacagtcagttttctttaacctcttttcaattctcaagatactttcattttcacagagtgttttttttttkttttttttttttctcttacaagcattctcctggtgtttgcaaatcccttcaactttgatgtctatcttagtgctttctcatcttccattaactattccct

SEQ ID NO: 6562 - DNA, 201 bp, Homo sapiens
gtttgtcatttaatttacatgtttttgaaaacacagtcagttttctttaacctcttttcaattctcaagatactttcattttcacagagtgtttttttttkgttttttttttttctcttacaagcattctcctggtgtttgcaaatcccttcaactttgatgtctatcttagtgctttctcatcttccattaactattccc

SEQ ID NO: 6563 - DNA, 201 bp, Homo sapiens
cagtaaaatcttgtcattgttttgcttatctctacaaaattgatcataaagctttagtggtcagataaaatgtcagaaattctgactgcttctaagcctcmaattacagcttcaatatctccatcaggagcaataagtacacagaagcatgctggcaaatagagaaggggaagactctagtgatttgccaagacgacttct

SEQ ID NO: 6564 - DNA, 201 bp, Homo sapiens
tccagagcagagttctttacctagggaaataccattttacaccacattgatcagttcccattaacacctgctgggcacttgtattaaacagtaaaatcttrtcattgttttgcttatctctacaaaattgatcataaagctttagtggtcagataaaatgtcagaaattctgactgcttctaagcctcaaattacagcttc

SEQ ID NO: 6565 - DNA, 201 bp, Homo sapiens
atttagtaaattatcaagaaatttggaaatatccagtttgttatctgtttggaaatgctggatcagggaacaaatgttttggtttcgataaagacacttgstcctggggagagccattcacaaggttgcgtaacatgaactgaatgtcacagcaactttttttttttttggaaacagggtctcactctgccacccaggatg

SEQ ID NO: 6566 - DNA, 201 bp, Homo sapiens
aggaaggaaaagttgagcagctcttgctcatgcacatggagaaaatgcaaagtccaaggcagaaaaccctgaaacatcatgatgtgttcaatgagctgccrtcagttcacaataagttgggggcaagtgggaaagtaacttgggagaggacgctagagacagacgcaggagtcagataagcaagtactatatagactgagt

SEQ ID NO: 6567 - DNA, 201 bp, Homo sapiens
gagtcaaattcctcattattagcaggacttcaaagtaactaattgagcctaagttaagctgtttttattttttaagctgacattttggttccgtttcccakggttatttttagccccgtcacattgtctggcatactgtgggggctcagttaatgtttggcaagtatgttgacagatcatcaccaaagggaaatccaccca

SEQ ID NO: 6568 - DNA, 201 bp, Homo sapiens
gagaactggagtcaaattcctcattattagcaggacttcaaagtaactaattgagcctaagttaagctgtttttattttttaagctgacattttggttccrtttcccagggttatttttagccccgtcacattgtctggcatactgtgggggctcagttaatgtttggcaagtatgttgacagatcatcaccaaagggaaa

SEQ ID NO: 6569 - DNA, 201 bp, Homo sapiens
agagacgacggtcaaagaaagcatatttactgtatgcctggtatataggtcagggcttatagtaagtcttatagatacagaaataaaaaacacagtgtttrtcttctttcttacccacattcttataattcaatggcatagacacataaacaatgacagtacctataatgccacttattcactgatggagagtaaatgtaa

SEQ ID NO: 6570 - DNA, 201 bp, Homo sapiens
ggttttgccatgttgaccaggctggtcccgaactcctgacctcaggtgatccgcctgcctctggctcccaaagtgctgggattacaggcatgagccaccayacctgccggaaggatattttcttgatttaacaactaattactctatttattatagagacgacggtcaaagaaagcatatttactgtatgcctggtatata

SEQ ID NO: 6571 - DNA, 201 bp, Homo sapiens
acattccattattcattatttattcaactaatatatatgaagcatttgctatatgtcaggactcagctagttggttcagggtaaataagaaaatgaacatrattcccaccctcaagaagtttagagtctaagggggaggatagtcatgaattgattaaacacagatttatgacaaatgatacaagggacgggagagtatgc

SEQ ID NO: 6572 - DNA, 201 bp, Homo sapiens
aatataatctttcatgtcttcacgtaatataatctttcgtgtctttctttgattccatataatgtttttcaattcatccatgttgttgtacatattactargccattctgttttattaatataccataatttgttcattcatttccttgttgatggacattgaattatttctgatgttttgctataatgaataaagttgca

SEQ ID NO: 6573 - DNA, 201 bp, Homo sapiens
tgcatgaaggaacccagtatatacattcatggagttgcaaatcacttgcatggtgggctacagggtgtataagagggaagaaaggaggttaaaaccaaggwcagttaactagatgctaacactttccttaagcatgacagaagcccatagaatcccagccgactccatctccatatacacactaagatctaagtttcttga

SEQ ID NO: 6574 - DNA, 201 bp, Homo sapiens
atctagggttttgtttttgagcatctctgggaagccttggactcatcaaactctaaggcagaccaaaatcactgaagaacaagggagagagaaaaggcatrgaagtcccgatttgtgagagaaagtctgctccattctgagttctgtgtctgcagtatacaggcaggcctggtgtttggcgtctgtataatccacaccagc

SEQ ID NO: 6575 - DNA, 201 bp, Homo sapiens
attttttttttgtatttttagtagagacggggtttcatcatgttagccaggatggtctccatctcctgacctcgtgatccacccacctcggcctcccaaastgctgggattacaggtgtgagccaccgtgcccggctagagaatttcttgactggcccaagttcacccttctctccgcctatgtagcacttatagccattt

SEQ ID NO: 6576 - DNA, 201 bp, Homo sapiens
aaaatggtaaccagaattattctcaaagcattttttttcaggtagaataagtagttcagcctagagcaatccaatttattactcaaggctcaactccaatrcctctagctttacaaagaatttctctaagtgagaaattctcacttagagaatttctttttttttttttttttgagatggagtctcactctgtggcccagg

SEQ ID NO: 6577 - DNA, 201 bp, Homo sapiens
tcgggaggctgagacaggagaattgcttgaacctgggaggcagaggttgcagtgagcccagatcgtgccactgtactccagcctgggtgacagtgtgagawtctgtcttgaaataaataaataaataataaaataaacaaagctactataaccctaaaatggtaaccagaattattctcaaagcattttttttcaggtaga

SEQ ID NO: 6578 - DNA, 201 bp, Homo sapiens
cagcctggccaacatggtgaaacttcatctctactaaaaacacaaaagttagccaggagtggctgcacgtgtctgtaatgccagctattcgggaggctgaracaggagaattgcttgaacctgggaggcagaggttgcagtgagcccagatcgtgccactgtactccagcctgggtgacagtgtgagattctgtcttgaaa

SEQ ID NO: 6579 - DNA, 201 bp, Homo sapiens
taccagttcatttggatttttggctcattgcagactaatgatgcacaagtggtctcattaatggtatgcatgtttgtttgtttgtttgtttgagacggagsctcgctctgtcacccaggctggagtgcagtggcaccatcttggctcactgcaacctccacctcctgggtcaagcaattcttctgcctcagcctcctgagt

SEQ ID NO: 6580 - DNA, 201 bp, Homo sapiens
gttgaaggtgggtcttacctcataagccccctacccacccagagaccctggtggcactctaagttctgaaaggaatcagcattcaagggaatataattagmaaagaaaatttgccttaaagtccactgttactttgttctctctctctcgtctccctcttcccccttctctctcccccttcctctccccagttccgtcttc

SEQ ID NO: 6581 - DNA, 201 bp, Homo sapiens
ccactattctccagcctgggcaacaaagcaagaccctgtgtcaggtgttagaaaaaagaaagaatgaaagaaaaagaaataaggacaaatactgcatgttytcacttgtaagtgggagctaaataatgcatacagttagatgcagaatgtgtaatgatagacaatggagactcagaaaggcaagtgggtgtgagggaggag

SEQ ID NO: 6582 - DNA, 201 bp, Homo sapiens
tcacttctctggtcctcatttttctcatctataaaataatatgtaccatttggggttgtagtgaacataaaatgtggtaatgtacataaagtggttggctyaggacctgtgatggaatcacagtttaaaaactattaggcactttttttttggaatgatgcaaggaaaactaagctccattcgcttcccacttaaattctc

SEQ ID NO: 6583 - DNA, 201 bp, Homo sapiens
gtaacccaagctttcttggatccttgtgtcaaacagtgtgaccttatgcatacacttgctagtgttcacttggctaagaagctgtattggggaaaaaatgmaaagaaatagaaaaaaaaagatagaaatttcagataatagacacactggaagacacatcctagccagaaagctgcgtgtcattatgtggataataataca

SEQ ID NO: 6584 - DNA, 201 bp, Homo sapiens
gccacactggcctcaaactcctgacctcaggtgatctgcctgcctcaacctcccaaagtggtgggattacaggcatgagccaccgtgcctagcccaaatcrtcactttaaatacctctgtgtatctggcccttccactccccagcttgtggccttttaatggttccccactgcagctggaatcaagtgaaaatgcctgacc

SEQ ID NO: 6585 - DNA, 201 bp, Homo sapiens
agtgagaggcagatctgatgagggaaggaagaaatcatgaaggagtgcaatggaggggagttgtgcagtttgcaaaggacctgaaaagtcagagtggaaaraagggatgtgtaggatcagagaacagcatgcacaaaagcttagaagctgagttttaatgacatgtttgtgaactaggaagttgtccaaacaggaagaaac

SEQ ID NO: 6586 - DNA, 201 bp, Homo sapiens
tattaaacaattaacgagtataattgttggcatttattgaggtactgtgatcaccccaacgggcattttctattttaccctcacaatcctctgataaaaaygccattattagactcgttttgtatgttggcaaacagggaatttaagtgacttgcccaagatcaaacagcaagtgagaagacctggaatctgagcttggac

SEQ ID NO: 6587 - DNA, 201 bp, Homo sapiens
tcagacacagagtagcaaagttgccaggagtttaaactttggagccagccactctggcttcaaatcccagctgtaccacttgtgagctgtgccacttgggmaaatttcttaatatctatttgcctcagtttcatcacctgaaaagtaggatgatgttaatagtataattcacaggattgctgagaggactaaattaatgta

SEQ ID NO: 6588 - DNA, 201 bp, Homo sapiens
cagcatcatcctaacaccattttaaaaagggactccagccaccagagtattcagggagaaagaaagaaccaatgggttgaatcctgaagacctcagtttcractgtcatattgtttctgcttgtctccatttccacagtggcatggagtatgtatgctccaaatgcctttatttagaagttatatccaaaatggaaggacc

SEQ ID NO: 6589 - DNA, 201 bp, Homo sapiens
tatggaagtatcaaggacctgtattctctcccttgctcttactgcaacttcagcccccgagactcagagccattgagggtggccgtctgaatagcctttgrgtattaaatttccccagagaaagcaaacagcatcatcctaacaccattttaaaaagggactccagccaccagagtattcagggagaaagaaagaaccaat

SEQ ID NO: 6590 - DNA, 201 bp, Homo sapiens
ccatatgtgcctcagctttggaatcttgtaccctaggcaaaatatggaagtatcaaggacctgtattctctcccttgctcttactgcaacttcagcccccsagactcagagccattgagggtggccgtctgaatagcctttgggtattaaatttccccagagaaagcaaacagcatcatcctaacaccattttaaaaaggg

SEQ ID NO: 6591 - DNA, 201 bp, Homo sapiens
tagaatgattaatgtgtccatatgtgcctcagctttggaatcttgtaccctaggcaaaatatggaagtatcaaggacctgtattctctcccttgctcttamtgcaacttcagcccccgagactcagagccattgagggtggccgtctgaatagcctttgggtattaaatttccccagagaaagcaaacagcatcatcctaa

SEQ ID NO: 6592 - DNA, 201 bp, Homo sapiens
atgggtagtttttggtggagtgaataaacatacagcctgtattttttacatgtgcatgagtcagaaagtgttagaatgattaatgtgtccatatgtgcctyagctttggaatcttgtaccctaggcaaaatatggaagtatcaaggacctgtattctctcccttgctcttactgcaacttcagcccccgagactcagagcc

SEQ ID NO: 6593 - DNA, 201 bp, Homo sapiens
cgtaatgattggtttctatgtccacagcttctaactcagggcatgccacatggagggacttaatgggtagtttttggtggagtgaataaacatacagcctrtattttttacatgtgcatgagtcagaaagtgttagaatgattaatgtgtccatatgtgcctcagctttggaatcttgtaccctaggcaaaatatggaagt

SEQ ID NO: 6594 - DNA, 201 bp, Homo sapiens
gtgtttatgtatatgttttacttatgagactatgatttcccagtctaccaggaattttatatgcgtaatgattggtttctatgtccacagcttctaactcmgggcatgccacatggagggacttaatgggtagtttttggtggagtgaataaacatacagcctgtattttttacatgtgcatgagtcagaaagtgttagaa

SEQ ID NO: 6595 - DNA, 201 bp, Homo sapiens
ctaaacatcatttgcttcacaatattatacctcaataatctacaataatctatgtgtttatgtatatgttttacttatgagactatgatttcccagtctascaggaattttatatgcgtaatgattggtttctatgtccacagcttctaactcagggcatgccacatggagggacttaatgggtagtttttggtggagtga

SEQ ID NO: 6596 - DNA, 201 bp, Homo sapiens
tgttttatatatatataaaaatatatattttatatatttttaacatgaaaatatatggtttatatatttttaatatataaaaatatattggtttctatatkttaatatatgaaaatgttttatatattttaacatataaatatatattttatatataaacttgtacattaactatatattttatctataaacatatagttt

SEQ ID NO: 6597 - DNA, 201 bp, Homo sapiens
ggctgacatttgtgacctcattgataaaattttctccaaaccaaaacaggccttatttttatatgttttatatatatataaaaatatatattttatatatktttaacatgaaaatatatggtttatatatttttaatatataaaaatatattggtttctatattttaatatatgaaaatgttttatatattttaacatata

SEQ ID NO: 6598 - DNA, 201 bp, Homo sapiens
caggatttcaacttcaaagaggctgacatttgtgacctcattgataaaattttctccaaaccaaaacaggccttatttttatatgttttatatatatatawaaatatatattttatatatttttaacatgaaaatatatggtttatatatttttaatatataaaaatatattggtttctatattttaatatatgaaaatgt

SEQ ID NO: 6599 - DNA, 201 bp, Homo sapiens
atatataatgttttatacatttttaacatataaaaacatacgttttatacatttctaacataacagtaggggcatatttatttattccatgatgtattcargatttcaacttcaaagaggctgacatttgtgacctcattgataaaattttctccaaaccaaaacaggccttatttttatatgttttatatatatataaaa

SEQ ID NO: 6600 - DNA, 201 bp, Homo sapiens
ctcaaagaacacccacccaaattagaacatcctctgacaactttcccacatcatcccctccatcctccttgtaactcatcactctctagcactgcactggktttcattccgtttcccaaactcccaagctcctttcctccccagggcctttgcacctgccattgcctctacctggaaggctttgcccagatattcacatgt

SEQ ID NO: 6601 - DNA, 201 bp, Homo sapiens
aaggaaagagatttaattgactcacagttccacatggctggggagtccccaggaaacttacaatcatggcagaagaggaagcagacacgtcttacatggcrgcatgtgagagaagtgaagcgaagggggaagagccccttattaaaccccttataataataataatataatgagagccccttattaaaccgtcagatctca

SEQ ID NO: 6602 - DNA, 201 bp, Homo sapiens
atcacttaaagggtagaggcaataaaatagtagatggatagatggttatttccactaaaagtagttttcatcagctcatttgcatgtaacttaggcagtargtggatgtcttagaagggcaggccaagtcataaggctctaagccttgtaacactctagaaaggtaagaaatattatgtaaaataagattactattcaact

SEQ ID NO: 6603 - DNA, 201 bp, Homo sapiens
aaaaagcatcacttaaagggtagaggcaataaaatagtagatggatagatggttatttccactaaaagtagttttcatcagctcatttgcatgtaacttargcagtaggtggatgtcttagaagggcaggccaagtcataaggctctaagccttgtaacactctagaaaggtaagaaatattatgtaaaataagattacta

SEQ ID NO: 6604 - DNA, 201 bp, Homo sapiens
gccaccatgcccagctaatttttgtatttttagtagagatgggtttcaccatattggtcaggctggttctgaactcctgacctcatgatccacccacctckgtctcccaaagtgctgggattacaggcgtgagccaccatgcctggtctagagtaatgtgttctaaaactgaaattttcattaaaggtaaatgaaattgca

SEQ ID NO: 6605 - DNA, 201 bp, Homo sapiens
aatatttcattttgttttatccatcagttgaagtacataaaccatacttttctggtattacaagcaatatcagtgacccaaaaccattcatacgatggtamaccaacgcagtataatgtattctttgtgtgtgtgtgattgagtctcgctctgtccctcaggctggagtgcagtggcacaatctcgactcactgcaacctc

SEQ ID NO: 6606 - DNA, 201 bp, Homo sapiens
tgattcgtaccttaaagtttttcctgcttcgaagcaagggagcagcttagcctttgtattctcacacagattagtctttggttacaggtgaccacaaagaytgagggaacttaaattgccaggcatttaccattccagtgcccaaaggcaaaaatctgctgaggatccctgaagtgaggctttgtcagcaaagcacagaaa

SEQ ID NO: 6607 - DNA, 201 bp, Homo sapiens
agggaaaatatttgtaatcacatcacaaaaggctcatctgtccaatatataaattaataagaaaaagaccaacaaaccaatagaaatattaataaaagtaraaaaggaattgccgatggctcttaagtatataaatatggccaaaatttactgagaaaagtgcaaatttatatctcagcatactttttacctattagcaaa

SEQ ID NO: 6608 - DNA, 201 bp, Homo sapiens
aacattatggtaagtgaaataagctagtcacaaaaagacaaataccgtatgattccacttagatgaggtacttagagcagtcaaaatcataaagacaaaamgtagaatggtggttgccaggcgctagggaaaagggggttgaggagtttttgtttagtggatagagagttgcagttttacaagataaagagctttggagac

SEQ ID NO: 6609 - DNA, 201 bp, Homo sapiens
gaacccggaaggcagaggttgtggtgagccgagattgtgccattgcactccagcccgggcaacaagagcgaaactccgtttcaaaaaaaaaaaaaaaaaawggtacattcctaaatcccacaggctttgcaaacctgtgctctaggataggaattcagtgctcatttgtttttcaatgcaaaactttctatgaagacattt

SEQ ID NO: 6610 - DNA, 201 bp, Homo sapiens
ctctactaaaaaatacaaaattgacagggcatggtgttgcatacctgtaatcccagctactcgggaaggctgaggcaggagaatcgcttgaacccggaagkcagaggttgtggtgagccgagattgtgccattgcactccagcccgggcaacaagagcgaaactccgtttcaaaaaaaaaaaaaaaaaaaggtacattcct

SEQ ID NO: 6611 - DNA, 201 bp, Homo sapiens
gaggattaattgagattaggcatatgaagtgctcaggtctgtagctcactaattgtcaggtcacattaagtgcaaagatgcctggacatatgatgatggtrttccaaaggcacttccaacttaatatgcctaaacctaaactcacattttgccacatctccacccatcctgcaccctccttctgaaatatcctccctcttc

SEQ ID NO: 6612 - DNA, 201 bp, Homo sapiens
catgtgagttcagcaagcaataacaagaggtgggccaggtgtggtggctcatgcctgtaattccaacactttgggaggccgagacaggcggatcacttgargtcaggagtttgagaccagcctggtacaacgtggcaaaaccctgtctctactaaaagtgcaaaaattagccagacatggtggtgcacatttgtggtccca

SEQ ID NO: 6613 - DNA, 201 bp, Homo sapiens
ctcttcccctggtccccaagacacctgaggacagcctccactggcagcactgatgtcggatacctatcaggaggtgatgttgggaaaaccacactacagcytaggtgagtatacctccaaattcatgtacacctgggacatcagagtatgcccttatttgaaaatcatgtctttgcagatataattgtttaaggatcttga

SEQ ID NO: 6614 - DNA, 201 bp, Homo sapiens
caacagattggcattgagatgccaagccaaaggaatgcttatctgtattttcatttttttttttttacaatgaggatacattttttaatgagaagcaatawagcataatggttaagggcatagctcctagagccagttcaaatcccagctctgaagcttaccagcactgtgcctgcgtcatgacttaagctgtctgtatag

SEQ ID NO: 6615 - DNA, 201 bp, Homo sapiens
cttggagaaatggaacgtacatcaaacagacaacagattggcattgagatgccaagccaaaggaatgcttatctgtattttcatttttttttttttacaaygaggatacattttttaatgagaagcaatatagcataatggttaagggcatagctcctagagccagttcaaatcccagctctgaagcttaccagcactgtg

SEQ ID NO: 6616 - DNA, 201 bp, Homo sapiens
ttctcagaggaattccaggaaataggattttacacatgtgggaaacaggctgagagaggttatttaatttgccaaaggtcacacagctggtattagagacmgaatattaaagtaggcgtttcttaccccaaaatccactctctgcaccaagaggccactcagaaaatataaaaataagcaaatcaaataaattgactacgt

SEQ ID NO: 6617 - DNA, 201 bp, Homo sapiens
acagaggcagagagaagcagagaaggggagaggatagaagagaggaagagaactagggaggaggaagagatccagatggaaggaggtaccaagcaaaacaygaagacggagacagaaagagagaaaaacgatgagaaagagaaagtgaggaagagaaacagagaaggagaaagagatgttagtaaggtacagagagggaga

SEQ ID NO: 6618 - DNA, 201 bp, Homo sapiens
agtcaataccaaatttcaccctgtgtgctttcagctcttgtcagtttattttgtgtggcttatttttttaccaataatattcactgtgaattgggcaaaaragatggatggttaatatttatttttttagctgataataaatcctgagtgattttgtaagacagaggcagagagaagcagagaaggggagaggatagaaga

SEQ ID NO: 6619 - DNA, 201 bp, Homo sapiens
acccatctcagtggacaatgcaaagggtagcattaaatcatgagctttgtgagggcagggagccctgtgcctcctatctggcatagcatcccacacctggygggtgcctagtaattgtccataggataaatggataacaacggagagacgaagaatttattgtagttgtgtttttgcaatagtttctctcccccactgggt

SEQ ID NO: 6620 - DNA, 201 bp, Homo sapiens
ccacagacccatctcagtggacaatgcaaagggtagcattaaatcatgagctttgtgagggcagggagccctgtgcctcctatctggcatagcatcccacwcctggtgggtgcctagtaattgtccataggataaatggataacaacggagagacgaagaatttattgtagttgtgtttttgcaatagtttctctccccca

SEQ ID NO: 6621 - DNA, 201 bp, Homo sapiens
accacagacccatctcagtggacaatgcaaagggtagcattaaatcatgagctttgtgagggcagggagccctgtgcctcctatctggcatagcatcccasacctggtgggtgcctagtaattgtccataggataaatggataacaacggagagacgaagaatttattgtagttgtgtttttgcaatagtttctctccccc

SEQ ID NO: 6622 - DNA, 201 bp, Homo sapiens
cctcttgccaaccacagacccatctcagtggacaatgcaaagggtagcattaaatcatgagctttgtgagggcagggagccctgtgcctcctatctggcayagcatcccacacctggtgggtgcctagtaattgtccataggataaatggataacaacggagagacgaagaatttattgtagttgtgtttttgcaatagtt

SEQ ID NO: 6623 - DNA, 201 bp, Homo sapiens
gctgcagcctcttgccaaccacagacccatctcagtggacaatgcaaagggtagcattaaatcatgagctttgtgagggcagggagccctgtgcctcctawctggcatagcatcccacacctggtgggtgcctagtaattgtccataggataaatggataacaacggagagacgaagaatttattgtagttgtgtttttgc

SEQ ID NO: 6624 - DNA, 201 bp, Homo sapiens
ggctgcagcctcttgccaaccacagacccatctcagtggacaatgcaaagggtagcattaaatcatgagctttgtgagggcagggagccctgtgcctcctmtctggcatagcatcccacacctggtgggtgcctagtaattgtccataggataaatggataacaacggagagacgaagaatttattgtagttgtgtttttg

SEQ ID NO: 6625 - DNA, 201 bp, Homo sapiens
gcatctagtattgctaaggggctgcagcctcttgccaaccacagacccatctcagtggacaatgcaaagggtagcattaaatcatgagctttgtgagggcmgggagccctgtgcctcctatctggcatagcatcccacacctggtgggtgcctagtaattgtccataggataaatggataacaacggagagacgaagaatt

SEQ ID NO: 6626 - DNA, 201 bp, Homo sapiens
gttttctattggaaaaaataattgttcctgttgttaaaaagaaaaaaaaatcccctaaatctctgagatttgtcaacagggactttgggcaaagcaactgyatttctcaggctcagttttccctatgaaaaatggagccaacttgccgggcacagtggctagcgcctaaagtcccagcactttgggaggccgaggtgggcg

SEQ ID NO: 6627 - DNA, 201 bp, Homo sapiens
atttccttagaaatcctatgcataccccagaaaataagcatcaggtaatctctccaagggcacaactgtgcctaaatattattattattattattattatwattcagatggagtctcactccattgcccaggctggagtgcaatggtgcgatctcagctcactgcaacctccacctcctgggttcaagtgattcttgtgcc

SEQ ID NO: 6628 - DNA, 201 bp, Homo sapiens
ttatcatttccttagaaatcctatgcataccccagaaaataagcatcaggtaatctctccaagggcacaactgtgcctaaatattattattattattattwttattattcagatggagtctcactccattgcccaggctggagtgcaatggtgcgatctcagctcactgcaacctccacctcctgggttcaagtgattctt

SEQ ID NO: 6629 - DNA, 201 bp, Homo sapiens
agctgggcatagtggctcacactgtaatcccagctctttgggaggtcgaggtgggaggatcacctgaggtcagcctggccaacatgataaaaccccgtctytactaaaaatacaaaaattggttgggtgtgatggcaagtgcctgtaatctcagctactcaggaggctgagacaggagaattgcttgaacccaggaggtga

SEQ ID NO: 6630 - DNA, 201 bp, Homo sapiens
gtagctgggcatagtggctcacactgtaatcccagctctttgggaggtcgaggtgggaggatcacctgaggtcagcctggccaacatgataaaaccccgtytctactaaaaatacaaaaattggttgggtgtgatggcaagtgcctgtaatctcagctactcaggaggctgagacaggagaattgcttgaacccaggaggt

SEQ ID NO: 6631 - DNA, 201 bp, Homo sapiens
tcttgaggtctgcattgggaccccttttctgtaactacaatggtgatggctaacatttattgaaccacttgtatgttacagggtctatgctaagctaagcyatgcactttacatgtattctcccatttcatcttcacaccagccttattaggtaattatttctgtaccctttcacagatgaataaaccgaggctaaaaaag

SEQ ID NO: 6632 - DNA, 201 bp, Homo sapiens
tgaacagcctttttcctagggaaatgcatggcaggcttcatgtaagaggttccctcaataaccaaacactccattcaaaggttatatttacacagctcatwaggaaaattttttatacttttgacactcattagactcataatcgtccactgaagctactgtgtaacaagagataaacactccattctagaggatgaataa

SEQ ID NO: 6633 - DNA, 201 bp, Homo sapiens
acacgtgtgtatatgtatgtctacatatgtgtatatatacacgtgtgatataaatttatatatgtgaattactagaaacgtttcgattttaggattagatrttttgcatttatacatttgtcagcctactggactgtaagttcattgagggtaagaagaaaaagaccatgataaccccttctgggaatatcagtgcctacg

SEQ ID NO: 6634 - DNA, 201 bp, Homo sapiens
ggctcccccactccaagatctgtgagcatcattatgctgaatggtgctattaaaactctagagtccattgcaggaagtttccttattaacatgagagcagsgtttgtggtcctctccaatctgttaacaatctagatgagtctttaaaattattgctggcaaaagttgcagtacaaaaggaacagagggaacctgatgaag

SEQ ID NO: 6635 - DNA, 201 bp, Homo sapiens
actgtcataccattcctaagccagccctaagaagactggctgtgaaggcctctcagggatacgccgtcctcagaatggacacatgtgtggtcatcactgcmtgagctgtgggactgtccagctctaccccagactcggatgtcagcccaaagatattaagctgggaagttgatcaagggcagtgttgaggatattagcaac

SEQ ID NO: 6636 - DNA, 201 bp, Homo sapiens
cggaggtcgcagtgagctgagatcgcaccaccgcactccagcctgggcaacagagcaagacttcatctcaaaaaaaaaaaaaaaaaaagaaaaaaaaaaaraaaaagaaaggaaaggaaaagaaaaaaaagaaataactagaatcttactaagggtaggaggaaagaatagagaggaagaaaaagacttgaaagatccaca

SEQ ID NO: 6637 - DNA, 201 bp, Homo sapiens
gggaggcggaggtcgcagtgagctgagatcgcaccaccgcactccagcctgggcaacagagcaagacttcatctcaaaaaaaaaaaaaaaaaaagaaaaaraaaaagaaaaagaaaggaaaggaaaagaaaaaaaagaaataactagaatcttactaagggtaggaggaaagaatagagaggaagaaaaagacttgaaaga

SEQ ID NO: 6638 - DNA, 201 bp, Homo sapiens
tctgcccttcttatctgtctccagacagtctagactaggtgccatcaaacttgttctgtaaaaggccagataataaacatactggcctttgcaggccttayggtttctgttgcaatgactaggctttacatgtgattgggtttcaataaaacttcattttcaaaaccaggcagtaaccgggatttgggtcatgggttttga

SEQ ID NO: 6639 - DNA, 201 bp, Homo sapiens
cacacctggctaatttttgtattttttagtagagaaggggtttcaccatattggccaggctggtctcgaactcctgacctcgtgatccaccctcctcggcytctcaaagtgctgggattacaggtgtgagccactgcacccagccttctctgcccttcttatctgtctccagacagtctagactaggtgccatcaaacttg

SEQ ID NO: 6640 - DNA, 201 bp, Homo sapiens
ctttaagtcttcttttttttttttttttttctgagacagagtctcattttgttgcccaggctagagtgcagtggcgcgaactcgactcactgcaaactccrcctcctgggttcaagtaattctcctgcctcagcctcctgagtagctgggactacaggcacccaccaccacacctggctaatttttgtattttttagtaga

SEQ ID NO: 6641 - DNA, 201 bp, Homo sapiens
accacctccttctccttttttccccctctaatttctccctcatatatctctatccctttttccttccccacactatttgtctttctttcttcttgttctcrtcttcatcttctcccttctcttaggagaactggacaaccaactttaagtcttcttttttttttttttttttctgagacagagtctcattttgttgcccag

SEQ ID NO: 6642 - DNA, 201 bp, Homo sapiens
gggttcaagtgattctcctgcctcagcctccagagtagctgggattataggtacctaccaccatgcctggctgatttgtgtatttttagtagaaatggggktttgccatgttggccaggctggtctcaaactcctaacctcgagtgattcacctaccttggcctcctaaagtgccgggattacaggcatgagccatcatgc

SEQ ID NO: 6643 - DNA, 201 bp, Homo sapiens
ctcactgccacctccacctcctgggttcaagtgattctcctgcctcagcctccagagtagctgggattataggtacctaccaccatgcctggctgatttgkgtatttttagtagaaatggggttttgccatgttggccaggctggtctcaaactcctaacctcgagtgattcacctaccttggcctcctaaagtgccggga

SEQ ID NO: 6644 - DNA, 201 bp, Homo sapiens
cagtcaaaagatacatgaaaaaatgctcatcatcactggccatcagagaaatgcaaatcaaaaccacaatgagataccatctcacaccagttagaatggcratcattaaaaagtcaggaaacaacaggtgctgcagaggatgtggagaaataggaacacttacactgttggtgggactgtaaactagttcaaccattgtgg

SEQ ID NO: 6645 - DNA, 201 bp, Homo sapiens
gtgaacgggcaacctacagaatgggagaaaatttttgcaatctactcatctgacaaagggctaatatccagaatctacaatgaactcaaacaaatttacargaaaaaaacaaacaaccccatcaaaaagtgggtgaagcatatgaacagacacttctcaaaagaagacatttatgcagtcaaaagatacatgaaaaaatgc

SEQ ID NO: 6646 - DNA, 201 bp, Homo sapiens
cgagatctcaccactgcattccagcctgggctacaagagcaaaactctaacaacaacaacaaccaaaaaaaaaaaacaaacaaacaaaaaacctaaaaccmtaaaaaccctagaagaaaacctaggcaataccactcaggacataggcatgggcaaggacttcatgtctaaaacaccaaaagcaatggcaacaaaagccaa

SEQ ID NO: 6647 - DNA, 201 bp, Homo sapiens
tcaccatgttgcccaggctagtcttgaactcctgggctcaagcaatccccccaccttggcctcctaaagtgctgggattacaggtatgagtcactgcaccyagggttaacaaaccttttgggcatcaatatgacgccatatatcaagactcctagagatctttagaaccagtaacctttaaattctacatctaagagtttg

SEQ ID NO: 6648 - DNA, 201 bp, Homo sapiens
cgaagtgttgtcaacaagttccttgaagctgtaaaatccagaagcgaaatggatcacttccatttgatctgtattccccattgcttagtatacacaaggarcttaatgggcatcggagacttagttgtggaatgaagagagaaggagagagtggaaaggaaagaaaagaggacagggaagagaaggaggaggaagaaaaag

SEQ ID NO: 6649 - DNA, 201 bp, Homo sapiens
ttttcctttagaacattcagctctgtctgtaattacacacagttactgtgacttcgttatttgatgcctgtgtccccgtctagattgataagctctgtgaragcagagtgcaagcctgtatagcctagcccagctaataaatgggtaggtggtgagttgtgagtgaatgtgtaggggagtctgacttgtcaatattctgct

SEQ ID NO: 6650 - DNA, 201 bp, Homo sapiens
tgtgcagccctgccaccctccaccgcacccgacacgcattatccagagtgatcattctaaaaagtatattggactaagttacttaaaacctgcttaaaacmctttaatgtttccccttccctaagataaagtctaaaccccttagcatgatattcaagggtcttcattcatctccatctgacagcttctctactcctattt

SEQ ID NO: 6651 - DNA, 201 bp, Homo sapiens
cctggtgctgccttggaagatgaggaaggggccttgagccaaggaaatcaggcaaggaaaaagcagcttcttcccctagagcctccagaaagagttcagcyctactaacaccttgattttagctccatgagacccatttcagctttctgacctgcagaactgtaggataataaatttgtattattttaagccagtaagttt

SEQ ID NO: 6652 - DNA, 201 bp, Homo sapiens
cctggatggatggagcactggaatttgggctaccagagagttccgcctcggttagcagaagtaatttgcccgtgtccttatgcaacatgctgacctggtcrgtcatttaaatgaaagggcacggcagccatgcaaaactctatctccctaatgcttttcttcccattgctttcttcttcttgaaatataaaaacgaccctg

SEQ ID NO: 6653 - DNA, 201 bp, Homo sapiens
caaataaggtcacatcctgaggtactgagggttaggacttcaacatatattttgttttggtgggggatacagcccatgatgccttgtcagatgacacctcygatcccaggaggatccatgccgtggagacaaacaactcattatttgccttgatgacctgtcatctcatagacacctccctggatggatggagcactggaa

SEQ ID NO: 6654 - DNA, 201 bp, Homo sapiens
cctttcttccagcttctggtagcctcaggcattccttggctcatagatggtgttctatttatgccataataaaaatattagtacttactttttttttttcyttttttttttttttttttttttttttgagatggattctcactctgtcacccaggctggagtgcagtggcgcaatctcggctcattgcaaacgccattctc

SEQ ID NO: 6655 - DNA, 201 bp, Homo sapiens
tccaccacaacggcctttgagaatatatttaacttctcttagtttcagtttactcattgataaaccaggataacacctacctttaattaggattagatgcwgggatatttatcaatcattcattctggcatttagtttaccctggcagcatttttctaataaaatgtagctactaatatcatcattattatcagcaccatt

SEQ ID NO: 6656 - DNA, 201 bp, Homo sapiens
tactgcaaacttggtggcttgaacaatataatttttttctctcatagttctggaggctgaaagtgtaagatcaaggtgtcggtggttccctctggagtctytgaaggacaatctatttcatgcctttcttccagcttctggtagcctcaggcattccttggctcatagatggtgttctatttatgccataataaaaatatt

SEQ ID NO: 6657 - DNA, 201 bp, Homo sapiens
ggcgtaagccaccatgcccagcacgattaatggatttctatggaatttaatttcctttctgcctactgctttcaggtaaaaacgatgattgattcagattyccctgatgatctcacttgcataactgagatcaggggtttttctgaaattcaccaggacttctccccttttcaatcactttgtgtgattggtattagcatt

SEQ ID NO: 6658 - DNA, 201 bp, Homo sapiens
agacggggtttcaccatgttggccaggctggtctcgaactcctgacctcaagtgatccgcctgcctgggcctcccaaagtggtgggattacaggcgtaagscaccatgcccagcacgattaatggatttctatggaatttaatttcctttctgcctactgctttcaggtaaaaacgatgattgattcagattcccctgatg

SEQ ID NO: 6659 - DNA, 201 bp, Homo sapiens
agcagagacggggtttcaccatgttggccaggctggtctcgaactcctgacctcaagtgatccgcctgcctgggcctcccaaagtggtgggattacaggcrtaagccaccatgcccagcacgattaatggatttctatggaatttaatttcctttctgcctactgctttcaggtaaaaacgatgattgattcagattcccc

SEQ ID NO: 6660 - DNA, 201 bp, Homo sapiens
gcttatgggatctatgtgggatcatcaatgagtctaagataataacagagggatttgcagggaggtagagaaataaactaggagagctagaagggcattgmccaagagtgagcaaagaggtaaaacaatagatcaaggaagaaaaggaataggaggaataaaaagaaagcaggcagagggtggcaaaaaaaaaaaaaaaaa

SEQ ID NO: 6661 - DNA, 201 bp, Homo sapiens
ctgtacttcctttctctcaccctcctctccatataccctccaaactgtactgctcctctgaagaagtctcacacatctatatctccctgcctctgctccayttcaaatgtccttccctggctcctttcaaagcccttacctatccctcaaggcacatctcatgtgtcacctcccctgtgaagctctgcctgacttctccag

SEQ ID NO: 6662 - DNA, 201 bp, Homo sapiens
tcactctggtcttaaatgtcaagactcaagtgatcctcctgccttggcctctcaaaatgctgagattacagatgtgagccaccactccccacccatcctcmctgcccaccatgtgtctgtacttcctttctctcaccctcctctccatataccctccaaactgtactgctcctctgaagaagtctcacacatctatatctc

SEQ ID NO: 6663 - DNA, 201 bp, Homo sapiens
aatggaaaaaggcaaatgcctggtatttcttaatgaaacactacactcagcacattataggagttatcagatttaatgcttccaacgacttaatatcaggyagtattattaactccatttgcaaagaagggatccaagtcctagatagaggaaatggcatccccaaggtggagaaccagttcaatcttggtcctctggctc

SEQ ID NO: 6664 - DNA, 201 bp, Homo sapiens
ggttctttccacaatactgcaggtccctccatgctcccacttttgatggaatgtagcccaagatcccccagaacagaaccatgataaccagacaggaggasggtcctacaactaactctcattttcccttcaagccaatattgaagacttgatatcttggtccattattctgtccaaataaggaaaggaaacaatgttgaa

SEQ ID NO: 6665 - DNA, 201 bp, Homo sapiens
caaattacacattgatactttagcctacagtaatctttctaaaactcttcagcggcccccattaaatataaactcatcctggctcacaaatcctttacaayatgacaacatctttgacttcatcttcactttcttttaacgtgtttagagacagggtctcgttctgtcacccaggctggagtgcagtggcaccatcacaac

SEQ ID NO: 6666 - DNA, 201 bp, Homo sapiens
caatttgaacacatccatacaaccattttccaaaatcaagcttcaagatacagaacaccagaaaccttcctccagctcccccaagtctatatcaaatcccyaccatggttgtccagccatctctctccttctctgtgtgtaccaattaatctctctctctctctctctctaacacaaacacacatttttagcaaagacaat

SEQ ID NO: 6667 - DNA, 201 bp, Homo sapiens
atgtctggtccctgcaaccagattactaattatgaaaaaacagaatctaaccctaaccctaacatggcccagacctcgctaaatgattttaggcattaggscaatacagatggcctaaagactttttatatttcttccttttataaaacattaattttgtaggtgcatatgaaagccaactcactcccatttataactcag

SEQ ID NO: 6668 - DNA, 201 bp, Homo sapiens
ctgcactcccatatttgttgcagcactactcacaatagccaagatttggaatcaacctaaatgtcaacagacaaatggataaagaaaatgtggtacatatrcacaatggagtactgtacagccatgaaaaagaatgagatcctgtcatttgcaacaatatggatggaactggaggttagtatgttaaatgaaataagccag

SEQ ID NO: 6669 - DNA, 201 bp, Homo sapiens
tggctcagaactgatggagccacactttgagaaggatgttgacttgctggctaatgaatgattaaggtcaagaggtaaaggtgtcactcatctttaatagycccaggtggaagaaaactggtctatctattcaggagacttactggtccttggctttcttaaagattccccaaatctagagttctcctgacattggtgtga

SEQ ID NO: 6670 - DNA, 201 bp, Homo sapiens
taggaggctgaggcacgagaattgcttgaacccaagaggcagaggttgcagtgagccgagatcacacgactgcactccagcctggacaacagagactgtcwcaaaaaaaaaaaaagagagtgataccatctcataccagttagaatggcgatcattaaaaagtcaggaaacaacaggtgctggagaggatgtggagaaata

SEQ ID NO: 6671 - DNA, 201 bp, Homo sapiens
tatatgtatatgtatgtatttatctaggacttatattctgtgtgtgtgtgtgtgtgtgtgtgtgtgtatgagataaaagtatatatacccaagatatttayattatattgaaaatgaaactatagactctggtgatattggaaaattcccctatataactagggaatagtccagacatggtagctcagtcctgtaattcca

SEQ ID NO: 6672 - DNA, 201 bp, Homo sapiens
catcaggacctcctttttatccttcagatttcagcttaaacgtctcatgctctgagaggccttttcttgctagagcagggtctttgtccatcagtcttcaycacagctctgcttattacctcccccataacactgtccaaaatctgtaattagttttttcacctgtgtattgatgtctccctatactagaatctggacatg

SEQ ID NO: 6673 - DNA, 201 bp, Homo sapiens
agttcccaatgcaagttagagttgtgtgtgatttggtctagaaagcaagggccactcacttttcaaagtatccacggagaagctatgtgactcaggcaaaygcagttacagggacctggctcagcctcttcctatctgtgtgaacttgggcaagtcttttcaccttgcttaccctcagtttgctcatttcgagaaaggtga

SEQ ID NO: 6674 - DNA, 201 bp, Homo sapiens
gagccatgactgtgtcactgcactccagcctgggcaacagagcaatactcttggagcaagggagggaggggggagggagggaggactgaccggagtttgartcctgggtttatcatttgctaattgagtgattttaggaagttatttaagccttgaagtctccatttcctaatctgtaaaactgaaaaaatagtattacct

SEQ ID NO: 6675 - DNA, 201 bp, Homo sapiens
aggatcgcttgagcccaggaatccaaggctgcagtgagccatgactgtgtcactgcactccagcctgggcaacagagcaatactcttggagcaagggaggraggggggagggagggaggactgaccggagtttgagtcctgggtttatcatttgctaattgagtgattttaggaagttatttaagccttgaagtctccatt

SEQ ID NO: 6676 - DNA, 201 bp, Homo sapiens
tgatcatagtgattaatctctcaccagccagtttattacatagtcctgctcaatctaaagctggcatgcaagacaccattttcaaaaattaaacaagccasgtgtggggacacatgcctgtaatcccagctacttgggaggctgaggcaggaggatcgcttgagcccaggaatccaaggctgcagtgagccatgactgtgt

SEQ ID NO: 6677 - DNA, 201 bp, Homo sapiens
tcactttaaaaatgcaaatagagataatttcacttcttcctttccaatttggaagccttttatttctttttctggcctaattgctctggctaggacttccmgtactatgctgaatagaagtggtgagattgaacatctttgtcttgttcctgatcatagaggaaaagctctcaattttcaccactgagtatggtgtttgtt

SEQ ID NO: 6678 - DNA, 201 bp, Homo sapiens
agtgcggtggcgtgatctcggctcactgcaacccctgactcccgggttcaagagagtctcctgcttcagtctcccaagtagctgggattataggtgggcaycaccacacccagctaattttgtaattttagtagagatggggtttctccatgttggtcaggctggtctcaaactcccaacctcaggtgatccacccgcctc

SEQ ID NO: 6679 - DNA, 201 bp, Homo sapiens
atgtatgtatgtatgtatgtatgtatgtatgtatacatgtacgtatgtatgtatttagagatggagtttcgctcttattacccaggctggagtgcaatggyacgatcttggctcactgcaacttccgcctcccgggttcaagcaattctcctgcctcagcctcccaagtagctggaattacaggcatgcgccaccacacct

SEQ ID NO: 6680 - DNA, 201 bp, Homo sapiens
atccccgcactttgggaggccaaggcgggtggatcacttgaggtcaggagtttgagaccagcctggctaacgtggcgaaacccgtgtctactaaaaatacraaaattagccgggcgtgctggcgtgcgcctgtagtctcagctacttggggaggctgaggcagtagaatcgcttgaacctggaaggtggaggtttcagtga

SEQ ID NO: 6681 - DNA, 201 bp, Homo sapiens
tgagccattaaacaacagtggtggaacacacaccaaacaacaaatggggaaactgaggcccagagagctttcatcatagcttctgcctgactcccagctgsaactcctaacataagtctctgctcatgtgaaagagttcagtgtcctcacccaatggagagtttccttatcattgtccttaaccaatggagagtttcttgt

SEQ ID NO: 6682 - DNA, 201 bp, Homo sapiens
tatatacccaaaggattataaatcatgctgccataaagacacatacacacgtatgtttactgcggcactattcacaatagcaaagacttgaaaccaacccraatgtccaacaatgatagactggtttaagaaaatgtggcacatatacaccatggaatactatgcagccataaaataggatgagttcatgtcctttgtagg

SEQ ID NO: 6683 - DNA, 201 bp, Homo sapiens
ctactcatctgacaaagggctaatatccagaatctacaatgaactcaaacaaatttacaagaaaaaaacaaacaaccccatcaaaaagtgggcaaaggatrtgaacagacacttctcaaaacaagacatttatgcagccaaaaaacacatgaaaaaatgctcatcatcactggccatcagagaaatgcaaatcaaaaccac

SEQ ID NO: 6684 - DNA, 201 bp, Homo sapiens
gcctagccatatgtagaaagctgaaactggatcccttccttacaccttatacaaaaattaatccaagatggattaaagacttatatgttagacctaaaacrataaaaaccctagaagaaaacctaggcaataccattcaggacataggcatggtcaaggacttcatatctaaaacaccaaaagcaatggcaacaaaagcca

SEQ ID NO: 6685 - DNA, 201 bp, Homo sapiens
atcacgctacctgacttcaaactatgctacaaggctacagtaaccaaaacagcatggtactggtaccaaaacagaacagaacagagccctcagaaataatrccacatatctacaactatctggtctttgacaaacctgacaaaaagaagcaatggggaaaggattccctatttaataaatggtgctgggaaaactgcctag

SEQ ID NO: 6686 - DNA, 201 bp, Homo sapiens
tcatttacgtgcaatttaatggatgtaaaatactcagcactatagtgcttggtatatagcaagcattcaatatatgtatgactttagcacccaaaagactrttagaaaagtacagtacttattcacgtactcgtttacttaatggctctttattaagcctcaaccatgtaccaagaactactatctcactgaagctgtggt

SEQ ID NO: 6687 - DNA, 201 bp, Homo sapiens
gaatggatggatgaatggatagacggacagatggatggatgggtagacgggtgggtggatggatgaatggagagatgggataaacagatggacagatggayggacagatggatggatggacagataaatggatgggtggttggatggatggacggacagataaatggatggatgggtgggtgggtggatggatggatggat

SEQ ID NO: 6688 - DNA, 201 bp, Homo sapiens
tcagacagaaaggttttcttgttgatgttttctactgcattctctcttaagctcaagactttttattttgtgttttttacattgatgagttataaaggggyctctctcatctttcccttctttttaccttcttctttgctgaatctctgctctctggccaggagtcattacatagaaacttaagtgcagggtgatcatcta

SEQ ID NO: 6689 - DNA, 201 bp, Homo sapiens
gcttccttagaatgtgcagctgggggagaggaacagatttcatacacccactttggttctgaagcaaaagcacttctctccccatgctcactgctctgcgkaagacagaacaaactgttttaaacacagagcgagggaggcaggagggtgtgggattctgggtgtctgctctagactctgtgtttcagtaccatcataact

SEQ ID NO: 6690 - DNA, 201 bp, Homo sapiens
acacaaggaatacagaaagctctcaacaagacacacgctaaaggcaccattggaacctaataaaaagggtctatgagacacttccttgggaagattggtaytggtggagaggtggaggtcagacatgccagatggtgatggaatgtgggatcctccaacacccttgctctatgtactctgagctagacatgaccagggtac

SEQ ID NO: 6691 - DNA, 201 bp, Homo sapiens
tgagagagctcctgttgctccaagtcctcaccacccttttcattgtcagtgttagtgttagtgtttggggttttagccactctcatagggatgtagtgctmgctcattatttcaatttgcaattccctaatggtatataatagtcccatctttttttttttttttcctgaaaactttaaaatactgtggaacttttcattc

SEQ ID NO: 6692 - DNA, 201 bp, Homo sapiens
cactttgtctttggtgtgaagtctaggtgtgggtttgttttattggttcggctctggacttagtacgattcttcaatctgaatacttagaactttagttcwggcaaaaattcacctgctatggctttgaatattacttctccctatcatatcttttttaaaaagttaatagattttatttttttagagtggttttatagtt

SEQ ID NO: 6693 - DNA, 201 bp, Homo sapiens
ttttgagaatttcactttgtctttggtgtgaagtctaggtgtgggtttgttttattggttcggctctggacttagtacgattcttcaatctgaatacttasaactttagttctggcaaaaattcacctgctatggctttgaatattacttctccctatcatatcttttttaaaaagttaatagattttatttttttagagt

SEQ ID NO: 6694 - DNA, 201 bp, Homo sapiens
atctatattttctctctagttgcttttgagaatttcactttgtctttggtgtgaagtctaggtgtgggtttgttttattggttcggctctggacttagtaygattcttcaatctgaatacttagaactttagttctggcaaaaattcacctgctatggctttgaatattacttctccctatcatatcttttttaaaaagtt

SEQ ID NO: 6695 - DNA, 201 bp, Homo sapiens
aagttggctaatcatctaattgtcgttactttctatgcaatctatattttctctctagttgcttttgagaatttcactttgtctttggtgtgaagtctagrtgtgggtttgttttattggttcggctctggacttagtacgattcttcaatctgaatacttagaactttagttctggcaaaaattcacctgctatggcttt

SEQ ID NO: 6696 - DNA, 201 bp, Homo sapiens
atcaaagttgacaattatttttccttgaccttttggagatgttaaattttcctctgatctggatggcagttgttgaaaagttggctaatcatctaattgtygttactttctatgcaatctatattttctctctagttgcttttgagaatttcactttgtctttggtgtgaagtctaggtgtgggtttgttttattggttcg

SEQ ID NO: 6697 - DNA, 201 bp, Homo sapiens
cttcaacggtcaagtagacagacagaaggaaaatgtggcacatacacaccatggaatactatgcagccataaaaaaggatgagttcatgtcctttgtaggsacacggatgaagctggaaaccatcattctcagcaaactaacgcaaggacaaaaaaccaaacaccgcatgttctcactcataggtgggaattgaacaatga

SEQ ID NO: 6698 - DNA, 201 bp, Homo sapiens
aaaacattagcacctccattgtaaattaaattaacaccacaaaaatccaccacatttgcatgacatttcaattgttataaggctttgttattttcttcaayggtcaagtagacagacagaaggaaaatgtggcacatacacaccatggaatactatgcagccataaaaaaggatgagttcatgtcctttgtagggacacgg

SEQ ID NO: 6699 - DNA, 201 bp, Homo sapiens
acaataaatgtaaccatgtgaggtaatggatatgttaattagtttgatggtgacaatcatctcacatttacttgtatatcagaatatcatttggggctggrgacggtggcttatgcctgtaataccagcactttgggaggccaagggaagaggattgcttgagtccaggagttcaagaccagcctgggcaacatggtgaga

SEQ ID NO: 6700 - DNA, 201 bp, Homo sapiens
attcttcttcaaactattgagagaggttggtcaaaaggcaccaacttccacttgtaaggtaaataggttctagagacctaatgtatagcatggtgactggkgatagcatggtgacaatacaaaaatatattgtatacaggcaatttgctaagataccacatcttaagtaatctcatcacacaataaatgtaaccatgtgag

SEQ ID NO: 6701 - DNA, 201 bp, Homo sapiens
agtgaaaattcttcttcaaactattgagagaggttggtcaaaaggcaccaacttccacttgtaaggtaaataggttctagagacctaatgtatagcatggkgactggtgatagcatggtgacaatacaaaaatatattgtatacaggcaatttgctaagataccacatcttaagtaatctcatcacacaataaatgtaacc

SEQ ID NO: 6702 - DNA, 201 bp, Homo sapiens
ttgaacccaggcggcagaggttgcagtaaaccaagatcgtgccattgaactccagcctgggcgacaagagcaaaactctgtctcaaataataacaataatrataataataataataataataataataataataataatttcactcttatgtctgtccccagaacaataacaaaattaagacttaaccttctaccttgtaa

SEQ ID NO: 6703 - DNA, 201 bp, Homo sapiens
atactgcacttgcattatgagtctctccagctagattctgaaacaaattgataacagatgcatccacaaagcattttggtccaaggacaaagccaagaaakgtatgaagaatgaacatacatttgacctgtgaacaacacactgcatgcgtctacctatacgcaaatttcttctccctctgccaacccctgaggcagcaag

SEQ ID NO: 6704 - DNA, 201 bp, Homo sapiens
atgaagtcatcaatacaagcgggatatggtctccccaaaccaagagaacaggagcacacagcacaagtgggcgtggaccaagggcatgtgaactgtggatrggatgtagacttgagcaagttcgtttctagcttctaaattccaccccagcaagtaccccagacctggctttaggaaccacgatatggcagcatgaagtgg

SEQ ID NO: 6705 - DNA, 201 bp, Homo sapiens
tggagggctctcgcctgtacagaggtgtaggtcccccaagcatgcaaaaggcagatcatcatcaatgaggctggagtgactcctgacttccaagaagcagyggagtctgtcaaggagtggaccttagcccaatcccattttacagatgaggaaaggtaaggtccagaagggagagaggaaggaagaagatacactataaag

SEQ ID NO: 6706 - DNA, 201 bp, Homo sapiens
agcccaccaagcacctaggggaacaggtcaggaacccagggcaagaggttgaggctacaactgtagattgtggaggcatctgcaaagctccaactactaasgactatatctagagaagaggagctgatgggatgcttggagggctctcgcctgtacagaggtgtaggtcccccaagcatgcaaaaggcagatcatcatcaa

SEQ ID NO: 6707 - DNA, 201 bp, Homo sapiens
gaaccaagagttgggcagtggaagaatggaaaacaccagagggccaggtatagtgtcagagattgttttatgtcttacttagatgagacacaaaataataytaaaagtatgcaggataaaactctgattatctttcaatccttctaattagtcagtgaggaagtctcatcttggtgctaataggtcttcaacacctttcta

SEQ ID NO: 6708 - DNA, 201 bp, Homo sapiens
taacgtttggtataacgatttaatgtattatcttttccactgaaagagctctgtattagtctgttctcacactgataataaagacatatcggagactggtracttataagggaaagaggtttaatggactcacagttccacatggctggggaggcctcacaatcatggcagaaggcaaatgagaagcaaggtcacatctta

SEQ ID NO: 6709 - DNA, 201 bp, Homo sapiens
acaatggagtactaatcagccataaaaagaataagatcctgtcatttggaacaacatggatagaactggaagtcatgacgttaagtggaaaaagccagacmcagatagacaaacttcacatgttctcacccatctgtgggagctaaaaatgaaaacagttgaacccacagacagagagagtagtgcaatggttaccagagg

SEQ ID NO: 6710 - DNA, 201 bp, Homo sapiens
aaaaaaaaaaaaaaaaaaaaaaatagccaggcatgcaggcatggtggtacacacctgtggccccagctactcaggagcctgaggtgggaggatctcttgarcctggtagggcagagcttgcagtgagctgagattgcaccgctgctctccagcctgggtaacacagtgaggccctgtctcaaaaaaaaaaaaaaagaagaa

SEQ ID NO: 6711 - DNA, 201 bp, Homo sapiens
aagactgagaaaccctgctaaaagaagacacagattttaaagaaatgataatgtgaaagaattaattgtagaagtgtactgtaatcccagcactttgggargccgaggtaagcagatcatttgagctcaggagttcgagaccaggcttgggcaacatggtgaaacaccgtctctactaaaaatacaaaaaaaaaaaaaaaa

SEQ ID NO: 6712 - DNA, 201 bp, Homo sapiens
gtggcacacccctgtaatcccaactactcaggaggctgaggtgggagaattgcttgtacccaggaggcggagactgcagtgagctgagatcgtgccactgyactccagcctgggcgacagagcaagaccctgtctcaaaaaaaaaaaaaaaaaaaaaaaagagagatgaatgaataaagaaaatgtgacatatttatacaa

SEQ ID NO: 6713 - DNA, 201 bp, Homo sapiens
atattttggatattagccccttatcagatatataatttgcaaatattttctcccattctataggataccttttcattctgttgattgtttcctttgcttcrcagaagtttcattgcagcattattcagaacagccaagatacggaaataacctaaatgtccatcaagagatgaatggagcctggccaacatggtgaaacct

SEQ ID NO: 6714 - DNA, 201 bp, Homo sapiens
tcaagtcctttgtccattttttaattgtccatttaataattttcactactgagtcataggaatttcttatatattttggatattagccccttatcagatayataatttgcaaatattttctcccattctataggataccttttcattctgttgattgtttcctttgcttcgcagaagtttcattgcagcattattcagaac

SEQ ID NO: 6715 - DNA, 201 bp, Homo sapiens
gataatgccataatgaacatgagtgaacatgagggtacagatatttctttgagatcctgatttcaattctttgggatatgtacccagaagtgggattgctkgatcataagatagttccattacgctggtgctattacttttaattgcaaaaaccacaattacttttgcaccaaccgataataaaaatttaaaaatttttcg

SEQ ID NO: 6716 - DNA, 201 bp, Homo sapiens
atatgtttccacaactgctgaaagcaactcattataggaatttggtatacttaggatagattaccttaattctattttctgtttatccaattagatttgcyggtcttaattgtactataaattgtgttgagctggtgaagatgactatgaagttgttgttccttcagatttcatggttggtatgcatgtcgctggtgtttg

SEQ ID NO: 6717 - DNA, 201 bp, Homo sapiens
tagctacttacaaaacggaggacgaagttcaaactccatattcaggcactcgattattcccgtcagctggctgtatggccactgtatgccttcctgccccrgccctggcctacatttccttaattcaactcacgtgccatttttcttcttttcaataaaaattcactgtgcacctattctgtgtgagacactatagtttcc

SEQ ID NO: 6718 - DNA, 201 bp, Homo sapiens
acagttgttgcattcatcatactccgtccctaacactcaagacagcttctcacgcattcctctatctcctcccctggggccaaggtccagataagcacatrtaagttaagtgagcaagtctaaaagcagatgcgcttatcctttcaatcactctacttttcatcactctcccttttacactctgctccaccatccaacccc

SEQ ID NO: 6719 - DNA, 201 bp, Homo sapiens
tctgccactatataacaaggatgtcctttcctccagttttcaataacatttccttcgtaggtagccctccctggtaatgcttttaacgtccatatttccamcaaaagtctgttcatgatgatttaggtagtctctaaaatgatgtatgccttctctaacatgtttcttacttctgagtccccagaaacagaactgttagca

SEQ ID NO: 6720 - DNA, 201 bp, Homo sapiens
agaccaggaagtcgaaggtgcagtgagtgatcacatcaccacactccagtctggccttcagggtgagacactgtttccagaaaaaaaaaaaaaaaaaaaawggagaggagagattcagttaggcaaacattaggcttcaaagcctagaaataatcctctcccatctctgtcctttgagcttgaggctctaccctctgagta

SEQ ID NO: 6721 - DNA, 201 bp, Homo sapiens
gaattcagttaggcagtccggatgcagtggctaatccctgtaatcctaacactatgggaggccaaggtggttggaatgcttgagcccagacattggagacsaacctggacaacgtggtgaaaccccacctctaaaaaagaaaaaaaaaatacaaaaacagattagctgggtatggtggtgcatgcctgtagtccaacctac

SEQ ID NO: 6722 - DNA, 201 bp, Homo sapiens
tctctccaactgtggacctgtaaaactagaaaacggattatctgctccccagatgcaattgtggaacaggcatgggatatcagttacaggggtttttgatyaaaaaaggaatcaatgaaaagaaaaaacaagttaccacatccaaacaattttggaattcagttaggcagtccggatgcagtggctaatccctgtaatcct

SEQ ID NO: 6723 - DNA, 201 bp, Homo sapiens
gtccaaaattttcatcaaaatctcatcagaccaggcacagtgactcatgcctgtaatcccagcattttgggaggccaaggcgggtggatcacctgaggtcrggagttcgagaccagcctggccaacatgatgaaaccagtctctactaaaaatacaaaaattagccaggcacggtgctgtgcacccataatcccagctact

SEQ ID NO: 6724 - DNA, 201 bp, Homo sapiens
aactcacgatagtgtcaaagtccaaaattttcatcaaaatctcatcagaccaggcacagtgactcatgcctgtaatcccagcattttgggaggccaaggcrggtggatcacctgaggtcaggagttcgagaccagcctggccaacatgatgaaaccagtctctactaaaaatacaaaaattagccaggcacggtgctgtgc

SEQ ID NO: 6725 - DNA, 201 bp, Homo sapiens
cacccatataagaactcaacagcagaccccaaaaaagactctgcacgccaaggctcagtgagcttcccttgttggcaacgtcccatgcttattttcatccrttgttgctgagaaggtggcactgtccatgattccgtaggaagatcaccactggcagctcacggttggacctttcatgattctgcctatgtgtccctcttt

SEQ ID NO: 6726 - DNA, 201 bp, Homo sapiens
agccttttctgggggagttggagctgccctaagccagtgaaagccaatgctcatacgcttgccctatccaactgctttcattagctccattctttttagtytaaaagccttcctgacagcaacaggggccaagaatttctctcatgaaccccattttcttgatttcaaaatccacttgccttgggagaaacgcttgaacct

SEQ ID NO: 6727 - DNA, 201 bp, Homo sapiens
actgaattttcattttgcttttcttaattataagaataatgcaaagtcccatcaacaacatttttgtgtgagttgatggatttctttatatatatatattwtttttttttgagataggatctcgctctgtcgcccaggctggaatgcagtggcacaatcagagctcactgcagcctcaaattcctaggctcaagtgatcct

SEQ ID NO: 6728 - DNA, 201 bp, Homo sapiens
aaaatcaaagttttttcccagcacagggagatggggccgatctctcttggatcaaaagtcctttttgtcctctcacatttgcagatgtgtaaattccaggsagatctaatgaaggagttaccttttcaatccctagattgtgtttgccaaaacttcacttgcaatagggacactccagcaaccctggctcggggctccctg

SEQ ID NO: 6729 - DNA, 201 bp, Homo sapiens
attctcttttttaaggattccgatgtctaagaaagcagccatgaggacctaataaagaactagagctgaataagttgtccagtgactatgatcaaatatayagctagcaatggcaatgtttcacatcaaagaagaaaatcaaagttttttcccagcacagggagatggggccgatctctcttggatcaaaagtcctttttg

SEQ ID NO: 6730 - DNA, 201 bp, Homo sapiens
gggccccctgctggagagccaacctgagggaaattgacgcacgatcagcatattccttccccaaaatgaggcgactcggaaatacacaatatcaatcatcrtctatgcaaccactcattattttgactcaaacagaacgacatacatcattggtaaagcccacgtggacatttccaggtccctggggcatttataagctgg

SEQ ID NO: 6731 - DNA, 201 bp, Homo sapiens
ttttgtcccccaccccccaaaaaaatggggagcattaaaattttaaaaaaggaattagatgaatatcctgctaaatgtaacttggcaagatgaaaggaagyagcaaagaaacatgaaaagggtgcagaccttcttgggccccctgctggagagccaacctgagggaaattgacgcacgatcagcatattccttccccaaaa

SEQ ID NO: 6732 - DNA, 201 bp, Homo sapiens
tttattcagcgcccttctgggcactaccagctgtgaaactggtaacctattgacaaataggttatttttccagctgcacccatattcaagagcttgaccarcaaagtcccctgataatatttggccatgagtcagaatgtattaggcaccttctgtagccagagccaaaaaaactctggctacaggagaaacctggcactg

SEQ ID NO: 6733 - DNA, 201 bp, Homo sapiens
ctccatccatgttgctgtgaagtacatgagttcattctttttatggctgtgtagtactccatgctgtatatgtaccagattttctttatccagtctaccaytgatgggcgtttaggtggattccatgtatttgctattgtgaatagggctgcagaatacatatgtatgcatatatctttatataattatttatattccttt

SEQ ID NO: 6734 - DNA, 201 bp, Homo sapiens
agtatttggttttctgttcctgcgttagtttgctaaggatactggcctctggctccatccatgttgctgtgaagtacatgagttcattctttttatggctrtgtagtactccatgctgtatatgtaccagattttctttatccagtctaccactgatgggcgtttaggtggattccatgtatttgctattgtgaatagggc

SEQ ID NO: 6735 - DNA, 201 bp, Homo sapiens
tttagctcccacttataagtaagaacatgtagtatttggttttctgttcctgcgttagtttgctaaggatactggcctctggctccatccatgttgctgtraagtacatgagttcattctttttatggctgtgtagtactccatgctgtatatgtaccagattttctttatccagtctaccactgatgggcgtttaggtgg

SEQ ID NO: 6736 - DNA, 201 bp, Homo sapiens
gtttagctcccacttataagtaagaacatgtagtatttggttttctgttcctgcgttagtttgctaaggatactggcctctggctccatccatgttgctgygaagtacatgagttcattctttttatggctgtgtagtactccatgctgtatatgtaccagattttctttatccagtctaccactgatgggcgtttaggtg

SEQ ID NO: 6737 - DNA, 201 bp, Homo sapiens
cccctccctatgtccctgtgttcgcactgtttagctcccacttataagtaagaacatgtagtatttggttttctgttcctgcgttagtttgctaaggatamtggcctctggctccatccatgttgctgtgaagtacatgagttcattctttttatggctgtgtagtactccatgctgtatatgtaccagattttctttatc

SEQ ID NO: 6738 - DNA, 201 bp, Homo sapiens
aactatttgtctgttgttcccctccctatgtccctgtgttcgcactgtttagctcccacttataagtaagaacatgtagtatttggttttctgttcctgcrttagtttgctaaggatactggcctctggctccatccatgttgctgtgaagtacatgagttcattctttttatggctgtgtagtactccatgctgtatatg

SEQ ID NO: 6739 - DNA, 201 bp, Homo sapiens
ggttctcaacagggaaagattattttttaactttcattttaggttcaggggtacatgtgcaggttatataggtaaactgtgtgtcacagggatttggtacmcacatttggtacagattattttgtcacacaggtaatatgcacatagtacctgacaggtagttttttatcctctccctcctcccaccctccgccctcgatt

SEQ ID NO: 6740 - DNA, 201 bp, Homo sapiens
gggtatgccaacttctatccctcatcattaaagacagttctggggggcatttatttatcccctgccacttcaggtctgccatatgcaggagccaaacacartcgtatggccagagaacattcttaggcagagagatgcctgtgcttgaggtgagaagccatcactgtgttgggaactgtccatctaagcttcaggtgaccc

SEQ ID NO: 6741 - DNA, 201 bp, Homo sapiens
ccctccaataacagtgtaggacacacctcattactgtctccctgagcagcaaagaagccagggtatgccaacttctatccctcatcattaaagacagttcyggggggcatttatttatcccctgccacttcaggtctgccatatgcaggagccaaacacaatcgtatggccagagaacattcttaggcagagagatgcctg

SEQ ID NO: 6742 - DNA, 201 bp, Homo sapiens
gctaatgcatatggggcttaatacctaggtgataggttgagaggtgcagcaatccattatggcaaatgtctacctaggtaacaaacctatgttctgtacaygtatcccagaacttaaaattaaatagaaatttttaaaaaggaaatagaaccatggaagcttaagcaaaatgaagcaaaggggaattacttcagttaagtt

SEQ ID NO: 6743 - DNA, 201 bp, Homo sapiens
acaccagagtctgttggtggtggggaagggagagcatcaggataaatagctaatgcatatggggcttaatacctaggtgataggttgagaggtgcagcaawccattatggcaaatgtctacctaggtaacaaacctatgttctgtacatgtatcccagaacttaaaattaaatagaaatttttaaaaaggaaatagaacca

SEQ ID NO: 6744 - DNA, 201 bp, Homo sapiens
ccggtcccagcgatcccaggaagtgaatagctagtttgttttgggtagctaagaacactgcccactcaaccaaaataagagtgacttcttcaaaaggttaygaacccactgatttctgacagtatttcccaagaaggcaaacagagcccaaagcctgtgcttaaaaagctagtgatctaataaccaaagaatcacaaatta

SEQ ID NO: 6745 - DNA, 201 bp, Homo sapiens
cctgctccctgggccaggctgcctgggggcgccccccagcccagccagccaggctctcaggccctgcgcctgcctcaggtctttcttgctgcagcatgctmcagcatggcccccaccccagggacaggaggccccacctggcttctcctgtagggtacctccctgcccccagcccccccaggaaatggtgctttcctggct

SEQ ID NO: 6746 - DNA, 201 bp, Homo sapiens
ggggagcaagttggtgggcatcatctcctcccgagacatcaactttcttgctgagaaggaccacaccaccctcctcagtgaggtgatgacgccaaggatcragctgatggtggctccagcaggcatgacattgaaacaggcaaatgagatccttcagcctagcaagggaagctgcctatggtcaatgatcgccatgagcta

SEQ ID NO: 6747 - DNA, 201 bp, Homo sapiens
tttttacctggggaatgtcgtggaactgtttgttttaataaagatttcttaacagaatatggagaagcaagtggcaagggggcaaagtggaagagagataycaatgaggaagctattggagtgatccaggggagtgatggcgccagccaggactggggggtgcatgggcaagggagaaaagtgggtaagtcaagggatatt

SEQ ID NO: 6748 - DNA, 201 bp, Homo sapiens
aggtaggctgaaatccaaagaacaagaaataatcagattacaaaaaaaaaaaaaataggaagaatgaataagacctaccatttaataaatagcacaacagkgtgactatagtcaataattgaacatttttaaataacaaaaaatatataattggatcgtttgtaacacaaaggataaatgctcaaggggatggagacctca

SEQ ID NO: 6749 - DNA, 201 bp, Homo sapiens
cacaccatgaaggtaggctgaaatccaaagaacaagaaataatcagattacaaaaaaaaaaaaaataggaagaatgaataagacctaccatttaataaatrgcacaacagggtgactatagtcaataattgaacatttttaaataacaaaaaatatataattggatcgtttgtaacacaaaggataaatgctcaaggggat

SEQ ID NO: 6750 - DNA, 201 bp, Homo sapiens
atgagcagatcaaatagaaaaatgtaacaaaaggcaatgcattataaccaagtacgttcacaccatgaaggtaggctgaaatccaaagaacaagaaataaycagattacaaaaaaaaaaaaaataggaagaatgaataagacctaccatttaataaatagcacaacagggtgactatagtcaataattgaacatttttaaa

SEQ ID NO: 6751 - DNA, 201 bp, Homo sapiens
ttccttttattttctctaataggagacccactcgcaactatgaggaatagatactatcagcagcaacagcaactttttttttaaggacaaagaaagtaaakatgggaaaatgtaaacttgtccaaagacatacatctagtcatgagaaagctgaaacccaaaacagctaagccgatgtatcacagcctctgaatcaccatc

SEQ ID NO: 6752 - DNA, 201 bp, Homo sapiens
tatatctcaggctacaagaaagtagagggagacaagagaaaaagcatccctcacacaaccttcagatcttccgctggagagatagccccactctaggaggraatggttattgctataatttgggggatattttggcaggtttgggaaaatctattcaaagtttagtttagtctcaatttctagaacatcgagccacttttg

SEQ ID NO: 6753 - DNA, 201 bp, Homo sapiens
cctaatctcccagcaaggaaaacctgggctgtcagtctactttaccaatccctgccttggaaattgctatatatctcaggctacaagaaagtagagggagmcaagagaaaaagcatccctcacacaaccttcagatcttccgctggagagatagccccactctaggagggaatggttattgctataatttgggggatattt

SEQ ID NO: 6754 - DNA, 201 bp, Homo sapiens
ataaacttgggacaagagcctaatctcccagcaaggaaaacctgggctgtcagtctactttaccaatccctgccttggaaattgctatatatctcaggctmcaagaaagtagagggagacaagagaaaaagcatccctcacacaaccttcagatcttccgctggagagatagccccactctaggagggaatggttattgct

SEQ ID NO: 6755 - DNA, 201 bp, Homo sapiens
tgctctctgcttttggccagaatccctggggtcatttaggtggtgatgttgccagttcttctcccctctggccaacacctctcaatccattatttgggatmccaattataaacttgggacaagagcctaatctcccagcaaggaaaacctgggctgtcagtctactttaccaatccctgccttggaaattgctatatatct

SEQ ID NO: 6756 - DNA, 201 bp, Homo sapiens
atgttggggcttcgagaaagattgctctctgcttttggccagaatccctggggtcatttaggtggtgatgttgccagttcttctcccctctggccaacacytctcaatccattatttgggataccaattataaacttgggacaagagcctaatctcccagcaaggaaaacctgggctgtcagtctactttaccaatccctg

SEQ ID NO: 6757 - DNA, 201 bp, Homo sapiens
agatgttggggcttcgagaaagattgctctctgcttttggccagaatccctggggtcatttaggtggtgatgttgccagttcttctcccctctggccaacmcctctcaatccattatttgggataccaattataaacttgggacaagagcctaatctcccagcaaggaaaacctgggctgtcagtctactttaccaatccc

SEQ ID NO: 6758 - DNA, 201 bp, Homo sapiens
agcaacagcagatgttggggcttcgagaaagattgctctctgcttttggccagaatccctggggtcatttaggtggtgatgttgccagttcttctcccctytggccaacacctctcaatccattatttgggataccaattataaacttgggacaagagcctaatctcccagcaaggaaaacctgggctgtcagtctacttt

SEQ ID NO: 6759 - DNA, 201 bp, Homo sapiens
ctttctgagcaacagcagatgttggggcttcgagaaagattgctctctgcttttggccagaatccctggggtcatttaggtggtgatgttgccagttcttytcccctctggccaacacctctcaatccattatttgggataccaattataaacttgggacaagagcctaatctcccagcaaggaaaacctgggctgtcagt

SEQ ID NO: 6760 - DNA, 201 bp, Homo sapiens
aagctttctgagcaacagcagatgttggggcttcgagaaagattgctctctgcttttggccagaatccctggggtcatttaggtggtgatgttgccagttyttctcccctctggccaacacctctcaatccattatttgggataccaattataaacttgggacaagagcctaatctcccagcaaggaaaacctgggctgtc

SEQ ID NO: 6761 - DNA, 201 bp, Homo sapiens
tcagagctatctcttgtcccaaaggatgaaaacctccgagcgccgtggaagagaacagtctgattaagttggctcaaactgccaggaagctttctgagcamcagcagatgttggggcttcgagaaagattgctctctgcttttggccagaatccctggggtcatttaggtggtgatgttgccagttcttctcccctctggc

SEQ ID NO: 6762 - DNA, 201 bp, Homo sapiens
tttcagcagagaaacaacatgatcgggtttgcattttgaaagatcccactggcttcagtagagaggatagattttgagcaagaagcaaagatgcttgtgcraaggagagtaattcgaagacctttggtagtcctggcaagagatgttgagtgttggatcacagagctggtgatggaaatggggagatgtatttcgactgat

SEQ ID NO: 6763 - DNA, 201 bp, Homo sapiens
gaggtcagccatgaagtgcttggaaggccacagagacaaattttattcctatcaccatagcaacgggaagccatgaaaccgttttcagcagagaaacaacrtgatcgggtttgcattttgaaagatcccactggcttcagtagagaggatagattttgagcaagaagcaaagatgcttgtgcaaaggagagtaattcgaag

SEQ ID NO: 6764 - DNA, 201 bp, Homo sapiens
aaaccacaatgcaataccactttattcctgcaagaatggccataatcaaaaaattaaaaaaatagacattggcatggatgtggtgaaaaggaaacacttcygcactgctggtgggaatgtaaactagtacaaccactatggaaaacagtgtggagatagcttaaataactaaaaggagaactaccatttggcacagcaatc

SEQ ID NO: 6765 - DNA, 201 bp, Homo sapiens
tcagcctcctgagtagctgggagtacaggcacccaccacaatgcctggctgatttttgtatttttagtagagacagggtttcaccacgttggccaggctgrtctcaaactccttacctccagtgatctgcccgcctcaacctcccaaagtgctgggattataggcatgagccactgtgcctggcccagaaagcatttttta

SEQ ID NO: 6766 - DNA, 201 bp, Homo sapiens
tttaaaaagtgctggactgaggaaaggtgagagttacaggctcagttctgccactcgcctgctgtgtgactttgagctggtcattccctatctcttaatawcagcttcttcatctatagaatgtgggtatacatgaggggatttttttagaactctagttctcagttctgactgcatattattctcaccaagaaaacagtt

SEQ ID NO: 6767 - DNA, 201 bp, Homo sapiens
ttggctcactgcagcctctgcctcctgggttcaagcaattctcctgcctcagcctcccaagtagctgggattacaggcacccaccaccatgcctggctaaytttttgtatttttagtagaggtggggtttcgccatgttggccaggctggcctcaaactcctggctcaagtgatccacccgcctcagcctcccaaagtgct

SEQ ID NO: 6768 - DNA, 201 bp, Homo sapiens
ggaggctgaggtaggtgatcacttgagccaggagtttgagatcaacctgggcaacatggaaaccccatctctaccaaatacgtatgtatgtgtgtgtatayacacacacacacacacacacacacacacacacaaacacacaaaattagctgggtgtggtagtgtatacctgtagtcccagctactcgtgaggctgaggtg

SEQ ID NO: 6769 - DNA, 201 bp, Homo sapiens
tggatcacatctataactttggaggctgaggtaggtgatcacttgagccaggagtttgagatcaacctgggcaacatggaaaccccatctctaccaaataygtatgtatgtgtgtgtatacacacacacacacacacacacacacacacacacaaacacacaaaattagctgggtgtggtagtgtatacctgtagtcccag

SEQ ID NO: 6770 - DNA, 201 bp, Homo sapiens
cacagaaactgaaacccttgtacattgctgatggcaatgtgatatggtgcaactacctgtgaaaacagtttggcaattttttaaaaacttaaaacgtaaasttactatatggcccagcaattccacttataggtatcaacccaagagaaattaagatatacatccacacagactggcatatagatattcacaggagtatta

SEQ ID NO: 6771 - DNA, 201 bp, Homo sapiens
agtctcccagattgaaaaattcatcctaaagtcgatttcctaagcttcggcctggaaatactgccaacatagactctgtgtcatgtcaactgtcactgagyacaaacaggtaaaaatgccacagtgccactttccatcctggacaaacagcccaggacatacagggaggcagggattggcacacatggaaggagagtgctg

SEQ ID NO: 6772 - DNA, 201 bp, Homo sapiens
acagttaaattatatcatctatataagagacttaatgcatatctggcattttcttttttatttatttttgggcagggttggggaacagggtcttactctgygacccaggctggagtgcagtagcatgatctcagctcattgcagcctccatctgggctcaagtgatcctcccacctcagctttccaagtagctgggactat

SEQ ID NO: 6773 - DNA, 201 bp, Homo sapiens
cttataaggggttgcagcctgtaagctgaccatctcgcaggctggggagtgtagcatccagcagaaaccagaggcaggcacttcaaaggaggcaaggtgasacaggaatttatgctaacagaatggctaagtatacatactcaagttataggaggagctatgaatattcacaaaagaagggcacgcaaatgcacagtaaat

SEQ ID NO: 6774 - DNA, 201 bp, Homo sapiens
actgactgcctgccacatcaccgtctctgcattgcaattgcaaacattgttgtgcattctgaatccccagtgtctttctgtttttcaccagccatgatcaygacagtgacaacaataacaatacagccttatgctcatagctccattcattcaaacagccatgcaacaacacctgagatttgttgtgcatctgtgaggact

SEQ ID NO: 6775 - DNA, 201 bp, Homo sapiens
cctctaaaagctggaaagcccagtaaatggattctcccctgcagcctccagaaagaacacagcactgcaccttgattttagcccagtgagatgtgggtgamcagtaggattataaattgatgtgttttaagccactgtgtgtaatttgttatagcagcaaagggaaaaaatactaataggatgtgtaacaggcatctcaag

SEQ ID NO: 6776 - DNA, 201 bp, Homo sapiens
ttcagaagaaaggcacagaggaatgcaatgttgctggcactggagatggaggaagcgaccacaagccaaagggtacaggcagcctctaaaagctggaaagsccagtaaatggattctcccctgcagcctccagaaagaacacagcactgcaccttgattttagcccagtgagatgtgggtgaccagtaggattataaattg

SEQ ID NO: 6777 - DNA, 201 bp, Homo sapiens
atttatcctggatgacctgcgtggggccaatatcatcaccagggtcacaagtgcagaacctttcctggctttgggtagaaagagatgtgacttcagaagawaggcacagaggaatgcaatgttgctggcactggagatggaggaagcgaccacaagccaaagggtacaggcagcctctaaaagctggaaagcccagtaaat

SEQ ID NO: 6778 - DNA, 201 bp, Homo sapiens
ctaattcctggaacctgtgagcatgttaccttacacagcaaaggggacttggcaaatgtgattcagttaaagatcttcagaggggaatttatcctggatgwcctgcgtggggccaatatcatcaccagggtcacaagtgcagaacctttcctggctttgggtagaaagagatgtgacttcagaagaaaggcacagaggaat

SEQ ID NO: 6779 - DNA, 201 bp, Homo sapiens
cgactgaacaaatgcagaaagtaaatatggaagagtcgagagcactgtgaacattccatctgcagctacctacacttctgaaaagccagactcaaacatcmaagtctctccttgcatctccaccaggatatgtgtgtagtaggcagagcactggtccccaacaaggtccacaccctaattcctggaacctgtgagcatgtt

SEQ ID NO: 6780 - DNA, 201 bp, Homo sapiens
gttctacctcaagcagctcatagtctggaggagaaagagctatgacgactgaacaaatgcagaaagtaaatatggaagagtcgagagcactgtgaacattmcatctgcagctacctacacttctgaaaagccagactcaaacatcaaagtctctccttgcatctccaccaggatatgtgtgtagtaggcagagcactggtc

SEQ ID NO: 6781 - DNA, 201 bp, Homo sapiens
tctaagagatgagtttggtttaaatttgaactcaaactgtattcttgtcacagacaatccagagcactctctggggtgtggctctgagacacacaaggagsaaaagacccaagttctacctcaagcagctcatagtctggaggagaaagagctatgacgactgaacaaatgcagaaagtaaatatggaagagtcgagagca

SEQ ID NO: 6782 - DNA, 201 bp, Homo sapiens
cacgcactaggatctgtatgatgctcctcatctaagagatgagtttggtttaaatttgaactcaaactgtattcttgtcacagacaatccagagcactctytggggtgtggctctgagacacacaaggaggaaaagacccaagttctacctcaagcagctcatagtctggaggagaaagagctatgacgactgaacaaatg

SEQ ID NO: 6783 - DNA, 201 bp, Homo sapiens
acacatgtccgtggccctcccacgcactaggatctgtatgatgctcctcatctaagagatgagtttggtttaaatttgaactcaaactgtattcttgtcayagacaatccagagcactctctggggtgtggctctgagacacacaaggaggaaaagacccaagttctacctcaagcagctcatagtctggaggagaaagag

SEQ ID NO: 6784 - DNA, 201 bp, Homo sapiens
ggggacctaaaagctaaaacaagagctcagcagggttagggtctgccatgaactcttaccaggcaaggcagggtggagacacatgtccgtggccctcccamgcactaggatctgtatgatgctcctcatctaagagatgagtttggtttaaatttgaactcaaactgtattcttgtcacagacaatccagagcactctctg

SEQ ID NO: 6785 - DNA, 201 bp, Homo sapiens
ccacaaaacccctagccacaatgccaagtttgtatccagagtggcgacggtggggacctaaaagctaaaacaagagctcagcagggttagggtctgccatraactcttaccaggcaaggcagggtggagacacatgtccgtggccctcccacgcactaggatctgtatgatgctcctcatctaagagatgagtttggttta

SEQ ID NO: 6786 - DNA, 201 bp, Homo sapiens
tgcatccatcccacaaaacccctagccacaatgccaagtttgtatccagagtggcgacggtggggacctaaaagctaaaacaagagctcagcagggttagkgtctgccatgaactcttaccaggcaaggcagggtggagacacatgtccgtggccctcccacgcactaggatctgtatgatgctcctcatctaagagatga

SEQ ID NO: 6787 - DNA, 201 bp, Homo sapiens
tttaccctctttcctgcattaggtacagctaagctttgcaaattaactcacaacaggatccagtgggccttgacccaaaaaccatccacaggagaatgttsacgaggcaacaactgctgcatccatcccacaaaacccctagccacaatgccaagtttgtatccagagtggcgacggtggggacctaaaagctaaaacaag

SEQ ID NO: 6788 - DNA, 201 bp, Homo sapiens
gatagcacttcacactcaccaggatggctaaattcagaagaatggaaataacaaatgttgaccaggatgtggagaaataagaaaccctgtacactgattgygagaatgtaaaatggtacagctgctatggaaaacagtacgacagttcttcaaaaagctacacatagaactcctatatgatccagcaattccatttctagg

SEQ ID NO: 6789 - DNA, 201 bp, Homo sapiens
aatggatcatagacaaaatattagacatccttcaccctttgtcaaaattaaaaacttttattcatcaaagggcactattaagaagtgaaaatacgaccagmctggccaacatggtgaaaccgcatctctactaaaaatccagaaaaaaaaaaaaaattagccgggcaacagtagcacgtgcctgtaatcccagctactcag

SEQ ID NO: 6790 - DNA, 201 bp, Homo sapiens
ttttcattatggtggagaagcagaaggaaaaatgtgctcagaggcagaggcaagatgaggaaactcagtgacaagaccccctttttttttttttttttttytgagacagagtctcttttcgttgcccaggcccaggctggagtacagtggcccaagctcggcttactgcaacctcctcctccctagttcaagagattcccc

SEQ ID NO: 6791 - DNA, 201 bp, Homo sapiens
tcagctttggctgcaatttggaagtacccaaggagctttaaaaactactgaagctggggtcccatgccctgagtttctgttttgatttgtctgcactgtgycctaggatggagggaagttgtaaagttctcctaggtgattatagtatgcagtcaagtttgagaaccactggacttagcctctcttgggatctcagaataa

SEQ ID NO: 6792 - DNA, 201 bp, Homo sapiens
cctggctgctgcttctatcaccagtatggtcccaagcaccagccctgcctgccactatcacttcttgaaaggcaacccaagaggagaagtggacgggagcygacaccaggcaggggttaaattgtttatatgcatcatcttgtttaatttttaagacaaccctataggtacagtacttttgtttatctccatttcacagag

SEQ ID NO: 6793 - DNA, 201 bp, Homo sapiens
aggaaagaaaacagggtatgttcaaaactgacagagagcacaggtgacaactgacagagcacaggtgcgtggtggggagcaggtggcaagaggagagggayaagacaggtgggtaaggaccccgcagttcatgagaaggcacctaggttctagccaccaagatgtcatgagaagcccttaaaggctattcagaagagaagt

SEQ ID NO: 6794 - DNA, 201 bp, Homo sapiens
atgggaggctgagattacccacaggctaagccagtggttctatactggggacacattcccacccccaccccaagggacattggcaatgtctggatgcatgmgggttgtcataaattgggcagggggtgctactagcatggcatgggtagaggctacatgtcctgcaatgcgtattatatccaccccctccaccccacagca

SEQ ID NO: 6795 - DNA, 201 bp, Homo sapiens
acaaaaaacaaaaaacaaagaaacaaaaaaaccgctagattacaaagaaaacaaattatatcaaaatacagtcataatgatgttttaaaacaaacttgtgwtatgtttatgtcggtattaacatgctaaatcacaagatctgtgctgtgtctactaactacaatgatttcaaaataatttggcaaaagtaaataattctga

SEQ ID NO: 6796 - DNA, 201 bp, Homo sapiens
cctggtgaaaagagctagacactgtctcaaaaaaaaccaaaaaacaaaaaaaccaaaaaacaaaaaaacaaaaaacaaaaaacaaagaaacaaaaaaaccrctagattacaaagaaaacaaattatatcaaaatacagtcataatgatgttttaaaacaaacttgtgttatgtttatgtcggtattaacatgctaaatcac

SEQ ID NO: 6797 - DNA, 201 bp, Homo sapiens
agcctggtgaaaagagctagacactgtctcaaaaaaaaccaaaaaacaaaaaaaccaaaaaacaaaaaaacaaaaaacaaaaaacaaagaaacaaaaaaamcgctagattacaaagaaaacaaattatatcaaaatacagtcataatgatgttttaaaacaaacttgtgttatgtttatgtcggtattaacatgctaaatc

SEQ ID NO: 6798 - DNA, 201 bp, Homo sapiens
tgatgtacctacaagccaaagaacgccaagggttgatggcaaccaccagaagttagaagatgcaggggagggtcttcccttagcatccttggaaagagaayagtaatgccagaaccttgattttgaacatctagcctctagaactgtgatataataaattcctgtggttttgagccacgaagtttgcaggactttgttgag

SEQ ID NO: 6799 - DNA, 201 bp, Homo sapiens
tgagggtggcaggcttcagcagcatctttatatttttaaaatctgaaataaatgtgacaaaaatattaacatttgttaaatctgaattgtcagtacatggktgtttgttattttattctctgtacttatcagcatgtctgaaatattccaccattgataaatcctggttttgaaagagaaaaagaaaagatttaaacacaa

SEQ ID NO: 6800 - DNA, 201 bp, Homo sapiens
cagctttaggttagtggtttcctctgaggaaggagataagggaatgaaatgagggtggcaggcttcagcagcatctttatatttttaaaatctgaaataartgtgacaaaaatattaacatttgttaaatctgaattgtcagtacatggttgtttgttattttattctctgtacttatcagcatgtctgaaatattccacc

SEQ ID NO: 6801 - DNA, 201 bp, Homo sapiens
actccagcccaggcaacagagcgagactctatctcaaaaaaaaaaaaaaaaaaaaaaaaaaaaaaaaaaaaaagaaaaaagaaagaaagaaagaaaaaagraaaaaaaaacagtagttggaaaaatatagtactgtttataaaaagcataaaacatactaataccattataccctaggtttgcatgtacatatagaaaaac

SEQ ID NO: 6802 - DNA, 201 bp, Homo sapiens
cactccagcccaggcaacagagcgagactctatctcaaaaaaaaaaaaaaaaaaaaaaaaaaaaaaaaaaaaaagaaaaaagaaagaaagaaagaaaaaaraaaaaaaaaacagtagttggaaaaatatagtactgtttataaaaagcataaaacatactaataccattataccctaggtttgcatgtacatatagaaaaa

SEQ ID NO: 6803 - DNA, 201 bp, Homo sapiens
gccattgcactccagcccaggcaacagagcgagactctatctcaaaaaaaaaaaaaaaaaaaaaaaaaaaaaaaaaaaaaagaaaaaagaaagaaagaaaraaaaaagaaaaaaaaaacagtagttggaaaaatatagtactgtttataaaaagcataaaacatactaataccattataccctaggtttgcatgtacatat

SEQ ID NO: 6804 - DNA, 201 bp, Homo sapiens
tgcagtgagctgagatcacgccattgcactccagcccaggcaacagagcgagactctatctcaaaaaaaaaaaaaaaaaaaaaaaaaaaaaaaaaaaaaaraaaaaagaaagaaagaaagaaaaaagaaaaaaaaaacagtagttggaaaaatatagtactgtttataaaaagcataaaacatactaataccattataccc

SEQ ID NO: 6805 - DNA, 201 bp, Homo sapiens
gtgggcggatcatgaggtcaggagatcaagaccatcctggctaatatggtaaaaccccatctctactaagaacacaaaaaattagccggacatggtggcaygcgtctgtagtcccaactactcaggaagctggaggcaggagaatcgcttgaacccaggaggcggaggttgcagtgagctgagatcacgccattgcactcc

SEQ ID NO: 6806 - DNA, 201 bp, Homo sapiens
taaaatataaatagttaaaataaatccactaaagctacatttataaacacagataaatctcaataacataatactgagtaaaaaagagtaatttgggccasgcgcagtggcttacgcctgtaagcctaccattttgggaggccgaggtgggcggatcatgaggtcaggagatcaagaccatcctggctaatatggtaaaac

SEQ ID NO: 6807 - DNA, 201 bp, Homo sapiens
taaagacctcccggaaaatgtaggtcctgtgctggatataaagaaaagatctgttgaggcaggaagcttcaatcactagagcaaattccacccaaactggsagcttctcctaaatggagatcctgagccctatccttagaatacagagagtgaggccaggcatggtggcttacacctgtaatcccagcactttggaaggcc

SEQ ID NO: 6808 - DNA, 201 bp, Homo sapiens
tgccccaggggacatgaatgatgcttctagccagggagaggggtgggctaagatattccgccttcaggttgctgggagggtaagtgtgaccagggctggckggcggtaaagacctcccggaaaatgtaggtcctgtgctggatataaagaaaagatctgttgaggcaggaagcttcaatcactagagcaaattccacccaa

SEQ ID NO: 6809 - DNA, 201 bp, Homo sapiens
ctcaagtaatttatatccttctataaatgatcatttattttataacataaaacaaccacaaccattatttggtagcagatagatctaggtcccactctccrctagcttgtggatgttactgtctcgatctcagtttcttcatccagaaaatcggggtgataaagtctacctctctagatcattttcagaattcagtaaaat

SEQ ID NO: 6810 - DNA, 201 bp, Homo sapiens
agatgccagtagtactcaccttcactcatgacaaccaaagctgtctccacacattgccaaacagagaacatttgtccctgaaggataaaattacttcacaktgaaaaccattggtgtacaccctggtgacatacagataaaaagatttgtttcctgccctcaagtaatttatatccttctataaatgatcatttattttat

SEQ ID NO: 6811 - DNA, 201 bp, Homo sapiens
cttccatcaccagggtgcagacatgattcaaggatttctggtaagatctggccaggaaaatgtatcccacgagctcaaaactgccaagcactattgttaakaacacagatggcctccttcaggaaagtattattttctttccctaaatagaagcaaggtaaatatgttcttccttcttatgtttaccaagggtctctggct

SEQ ID NO: 6812 - DNA, 201 bp, Homo sapiens
cggctcactgcaacctctgcctcccaggtcccggttcaagcaattctcccgcctccgtctcgccaccatgcccagctaatttttgtatttttagtaaatayggggtttcacaatgttggccaggctggtcttgaagtcctgacctcgtgatccacccacctcggcctcccaaagtgctgggattacgggtgtgagccacca

SEQ ID NO: 6813 - DNA, 201 bp, Homo sapiens
tatgtgtgtatatatacacacatatatatgtatatatatacacacacacatatatatatacacatacgtgtgtgtgtgtgtgtgtatatatatatatatakagagagagagagagagagagagagagagacagagacagagacagagacagagagtgcctcactctgtagcccaggcaggaatacggtggcgcaatctcgg

SEQ ID NO: 6814 - DNA, 201 bp, Homo sapiens
cccactgcttgatcaatggaagggggctgcaatatacatatacatacacacacatatatatatacacacatatatatacacgtataaatatgtgtgtatawatacacacatatatatgtatatatatacacacacacatatatatatacacatacgtgtgtgtgtgtgtgtgtatatatatatatatatagagagagagag

SEQ ID NO: 6815 - DNA, 201 bp, Homo sapiens
cagcttagtgctgaagggttttcaaattgtttcaagcatcttaacctgcccccatcagccaagctacctccttcttaaggtcaaactcctgtgccaaataytccttttgttcagcccctgagcctagatattacagcatttgatgcttaatatacacttgcccactgcttgatcaatggaagggggctgcaatatacatat

SEQ ID NO: 6816 - DNA, 201 bp, Homo sapiens
gcagctgtgggggaggctggcaggtcagagctgtgccgatgagccgtcgtatctatgctctgcgaaagcggccccagccaggaacactcccctctgccgcrggctggaagaggtggctttctctgtgcttatcctaagcccttccttctctgcctccacctgacatcaaagccccctggcaaagtaacccaggttaaggca

SEQ ID NO: 6817 - DNA, 201 bp, Homo sapiens
ggaggctggaggcagctgtgggggaggctggcaggtcagagctgtgccgatgagccgtcgtatctatgctctgcgaaagcggccccagccaggaacactcscctctgccgcaggctggaagaggtggctttctctgtgcttatcctaagcccttccttctctgcctccacctgacatcaaagccccctggcaaagtaaccc

SEQ ID NO: 6818 - DNA, 201 bp, Homo sapiens
acgcagctgcgctccgacactgcatctgcctctgttcctgaataagccgctctggaggctggaggcagctgtgggggaggctggcaggtcagagctgtgcygatgagccgtcgtatctatgctctgcgaaagcggccccagccaggaacactcccctctgccgcaggctggaagaggtggctttctctgtgcttatcctaa

SEQ ID NO: 6819 - DNA, 201 bp, Homo sapiens
tacatggatttggatgtaaaccaaactgattatcatgttttcccttctatggagagaacaggagaaaactgggacagggaaacagatagaatcagaacttytacattatcattaatgttttattgctttcaaaatgttgaaacaaacattaacctttggcaggtttagctttgttccctatgatgaatatcgggttgagta

SEQ ID NO: 6820 - DNA, 201 bp, Homo sapiens
tgctgctttgcatgcctggtaacttttgatgggatggaagaaattataaattttaacttttttcgtgctgatatttttgtattactataaatatcactgarctctgttctagagtgactaagttacttggaaacagtttgatcttttcaaattttgcttttgatatttgttaggcagagtgagagcaattcatagtctaca

SEQ ID NO: 6821 - DNA, 201 bp, Homo sapiens
aaccaaaaactatagaatgagatgatatggatcaattgacattcaattcaaggtgcgatttttatttcagaatttctggatattcacatactggaatataraattcataaaagcagggattttgcctggtttttccttctgctgctttttctcccttgaagaacctagaatactacctggtataaagtagatgctcaatgc

SEQ ID NO: 6822 - DNA, 201 bp, Homo sapiens
gccccaaagaagccatatagcttttccaattgtaaaagaaggcccatggggtgctgcagaagatgaaaaggacattctcagcattttctgaaaaaaatgcytgtttgtgtatgacaaccacgcagcagccaccagcagcaccgaaggttgccagaagatggaattatatcatagttgtgtcctgtgattgccctagaacca

SEQ ID NO: 6823 - DNA, 201 bp, Homo sapiens
cagaatgaatgactgtactagaaaacgcttggaggctatacagtcctatatacatataagggactatgggactatatatatatatatatatatatgtataygtatgtatttatctaggacttatattctgtgtgtgtgtgtgtgtgtgtgtgtgtgtatgagataaaagtatatatacccaagatatttatattatattga

SEQ ID NO: 6824 - DNA, 201 bp, Homo sapiens
atcacgaacacactgatttgctattctttaggggagcctggagttcttggggtgagcctgggctgtgatggaaggcataacaagaaagctgaaactgttaygagccaaacttcctaatctcttgcacatgtcaatcgcactacagtgcagatgcattcttaactgtttttattttgtctgtgtcaggtttacatgcacacc

SEQ ID NO: 6825 - DNA, 201 bp, Homo sapiens
tcccgctttccctctccctctctagcctgatccctctcccgctctccctccggtcgagtctccctcctccctggcccaaggagccctgatctccctctggkacgtacctgtagcccgagaaggtcgaggatgcagtggggcgcgctgcgcgcacgagcatctcggccgcctcagcagccaccgggtttagcgggttcccgc

SEQ ID NO: 6826 - DNA, 201 bp, Homo sapiens
taaggcatcatcctcatactgctcatggtgggaggaaaaaaaaaaaaaaaaagactgttccgagtctccccctccctggctgttttgctaagccccaggcstacaggaggctggatggcccaggggaagaggctgccttgcctaccctgggaaagtggatggagggtagcttcttcctctgccaagaaaatcaggcgtcct

SEQ ID NO: 6827 - DNA, 201 bp, Homo sapiens
ctcctacagcaagtctgaaggctgagagcaaagcaatggagctaaggcatcatcctcatactgctcatggtgggaggaaaaaaaaaaaaaaaaagactgtyccgagtctccccctccctggctgttttgctaagccccaggcctacaggaggctggatggcccaggggaagaggctgccttgcctaccctgggaaagtgga

SEQ ID NO: 6828 - DNA, 201 bp, Homo sapiens
gcactcccaaggaataagtaaatccctacttaaattgcctgggaggcctccctcaattacacaaatctaagacatgacagggtacagcagagattctcctmcagcaagtctgaaggctgagagcaaagcaatggagctaaggcatcatcctcatactgctcatggtgggaggaaaaaaaaaaaaaaaaagactgttccgag

SEQ ID NO: 6829 - DNA, 201 bp, Homo sapiens
gatccagggctggggctactgaggcatctacgggtacagaattcaaggaagaactcattctcagggccatgcaagtgcaggattcagctacccctggcttkgactggtggtagaaatgggtaggttgatgatatattttggaggtaaaatcaaatttgttctaaaaatttctgaagttcagaagcaaataataactttaga

SEQ ID NO: 6830 - DNA, 201 bp, Homo sapiens
acaaaggataatcactattctatctggtttatttggggtatctcttatcacttcctagaaaggttttttgttttttgtttttatttttgttattttttttragacggagtctcactctgtagcccaggctgtagtgcattggcacaatcttggctcactgcaacctccgcctcccaggttcaaatgattctcctgcctcag

SEQ ID NO: 6831 - DNA, 201 bp, Homo sapiens
cattcaattcaaggtgcgatttttatttcagaatttctggatattcacatactggaatatagaattcataaaagcagggattttgcctggtttttccttcygctgctttttctcccttgaagaacctagaatactacctggtataaagtagatgctcaatgcaaatttgtggaatgaacaaaagtctcaactctctgtctt

SEQ ID NO: 6832 - DNA, 201 bp, Homo sapiens
aatccagaataagcatgaatcaaagaggacaggcctgggcaggttcagtgtgaggcacccatggccatgtcaaggagagaagcccaccaagcacctagggraacaggtcaggaacccagggcaagaggttgaggctacaactgtagattgtggaggcatctgcaaagctccaactactaaggactatatctagagaagagg

SEQ ID NO: 6833 - DNA, 201 bp, Homo sapiens
ttgcgcccatgggaacttgcacctgttcttcctatatctgttttcaggggagatgtttccagccacaagtatctctactaaccacttagttctgcaccatygtgaggaaagctgtaagttcagtagaaggagcaaggtgtcaaggtcactcttttcctaatgctgacaacattaaaagacagagtaatagagtttcaggag

SEQ ID NO: 6834 - DNA, 201 bp, Homo sapiens
atgtaaggggccttagaaaggaggatttcatcttcattctgtatcatgttatatttgagatattgttggccaacacaacacaattctgtttctatatctgyatctgttattataaaaacccaaacataaacttggttgaacttaaggggctgcttcttggaggagaaaactagaatgcatataggtctgcaaaaaaagttt

SEQ ID NO: 6835 - DNA, 201 bp, Homo sapiens
gcaaaagactgagtacatgaaaatacagagggttcgttcatatggcaatgactatggtacacaattaggaagtttaggcaaacttctatgatcattgctayatagtcaacacttattagtgtaatgctgcaacccagacttcactgtctttaaattatccttagttcagacctttcctactgggatttgagaacagacata

SEQ ID NO: 6836 - DNA, 201 bp, Homo sapiens
acagaacagaaaatctttgtggtgctgcaatctcaacacttgctgagcttagcaagtcaggatgtttcctgaactaaagtctcaataggaggatgcacccrgtttacctcttttcttcctcaatgtgtgtttctgaatagctactcaaaccctgcaacccttgttatatttcatttcactggagaatgagagagcaggtgt

SEQ ID NO: 6837 - DNA, 201 bp, Homo sapiens
ttcttcctcaatgtgtgtttctgaatagctactcaaaccctgcaacccttgttatatttcatttcactggagaatgagagagcaggtgtttttactcctgycttactgatgtgggaagtacagccctataagggaagattagtgatatatctgagtagaaagaaccagtgggaaattaaaaaaacagaaagaaagaaagaa

SEQ ID NO: 6838 - DNA, 201 bp, Homo sapiens
gatgtactctcttctcacaccactctctttctgttcatcacaaggtttattacaacatggggtcacccatttcttcctggtcgaattgttttctaaccacrtaagttccatgatggaaaggtcctagtcttttgccctccctgttcatccatgtatcccctgtgcccagcaatgtgcctaacatgcaaactgtgcttaatg

SEQ ID NO: 6839 - DNA, 201 bp, Homo sapiens
tcattctgtattaaaacaatttatttataacaattttacttataacaatgtctgtgttatttcactgtaaaggaattcagcaaaaatcattaaaacattcmtgaccccaaaacatggtctgtttcacacaattatgaatcatgatgaattatgaatcatgaatcatgggatgtacacttgcccttccttggtgggccccac

SEQ ID NO: 6840 - DNA, 201 bp, Homo sapiens
tctgtattaaaacaatttatttataacaattttacttataacaatgtctgtgttatttcactgtaaaggaattcagcaaaaatcattaaaacattcctgaycccaaaacatggtctgtttcacacaattatgaatcatgatgaattatgaatcatgaatcatgggatgtacacttgcccttccttggtgggccccacctct

SEQ ID NO: 6841 - DNA, 200 bp, Homo sapiens
cccctcttggggattctagtctaagcgaagatgaataggcaagcaaacaatgccaaagcaagctgttaacactcttacgaattagtatacaggtctgcagaatgaagtggaaaagggcagacccactttgagctacccagatatagaatcaatggaaagggtgtccttagcaaagaggacaaatgtttgaaggggcagga

SEQ ID NO: 6842 - DNA, 201 bp, Homo sapiens
gcagtggtgtaatctcagctcactgcaaccttcacctcccaggttcaagcaattatcctgcttcagcctcactagtagctgggattacaggtacctgccaycactcccggctaattcttatatttttagtagagacagggttgcaccatgttggccaggctggtttgaactcctgacatcaaatgatccacctgccttggc

SEQ ID NO: 6843 - DNA, 201 bp, Homo sapiens
gaactgaatgtcacagcaactttttttttttttggaaacagggtctcactctgccacccaggatggagtgcagtggtgtaatctcagctcactgcaacctycacctcccaggttcaagcaattatcctgcttcagcctcactagtagctgggattacaggtacctgccaccactcccggctaattcttatatttttagtag

SEQ ID NO: 6844 - DNA, 201 bp, Homo sapiens
atgaactgaatgtcacagcaactttttttttttttggaaacagggtctcactctgccacccaggatggagtgcagtggtgtaatctcagctcactgcaacsttcacctcccaggttcaagcaattatcctgcttcagcctcactagtagctgggattacaggtacctgccaccactcccggctaattcttatatttttagt

SEQ ID NO: 6845 - DNA, 201 bp, Homo sapiens
tgggaaaactgaaaaatttagtaaattatcaagaaatttggaaatatccagtttgttatctgtttggaaatgctggatcagggaacaaatgttttggtttygataaagacacttgctcctggggagagccattcacaaggttgcgtaacatgaactgaatgtcacagcaactttttttttttttggaaacagggtctcact

SEQ ID NO: 6846 - DNA, 201 bp, Homo sapiens
taattatagcagttatcatgacaagaactaacacttattgagtaattactatttgctaagcactatcctaaaggcttcatactaattgttgaattaatctycatgacattttctgaattagttgatatttgtacacccattaaacaggtaaaaattaccaactcttaaatttttaagagtttataacatacacaactttag

SEQ ID NO: 6847 - DNA, 201 bp, Homo sapiens
aaagaaaaaccccaagaccacagaatgttagcactggaaggtttgttcacaatcattagctgtactcttctcctatttttcagatgagtaaactgaagttkaaaaggggaagtggctttcccaaggacacactgtgagtacatgacagcaaaagcagaaagtgtccttaattatagcagttatcatgacaagaactaacac

SEQ ID NO: 6848 - DNA, 201 bp, Homo sapiens
gtaaacttcacagttctggaaagcttcttcagaatatcaatgcagaaccccttgcagcatttcttcacattcatcccctcattggttgaattgctgtaaaraaaaaccccaagaccacagaatgttagcactggaaggtttgttcacaatcattagctgtactcttctcctatttttcagatgagtaaactgaagttgaaa

SEQ ID NO: 6849 - DNA, 201 bp, Homo sapiens
tctctagacatatttattattcactatttcccccttagactttaattctcttactgtttcacaaatgccaccataacccatttagtgtttctcaattttcrgttaattttccatctactttgccatttctgaagttcccagggacgtttcctggatcacagtgtcccttaaatgcctccttgaactgcttgggtgtcacag

SEQ ID NO: 6850 - DNA, 201 bp, Homo sapiens
taattatttgagatgttctctagacatatttattattcactatttcccccttagactttaattctcttactgtttcacaaatgccaccataacccatttaktgtttctcaattttcggttaattttccatctactttgccatttctgaagttcccagggacgtttcctggatcacagtgtcccttaaatgcctccttgaac

SEQ ID NO: 6851 - DNA, 201 bp, Homo sapiens
ctccagatttctattttatctctttcgtcttatagtcataagtctcctttaacttccaaaatctaattatttgagatgttctctagacatatttattattyactatttcccccttagactttaattctcttactgtttcacaaatgccaccataacccatttagtgtttctcaattttcggttaattttccatctactttg

SEQ ID NO: 6852 - DNA, 201 bp, Homo sapiens
cttgagcatccacagattttggtgtctgtaggagaccctcaaaccaatcctccacaatactgagggacaactgtatatataatatattgcctttccaaatkaaagtgtttaaaaaatatagactgagagggatttggggccactgtttatccatgccataaattttgcacaagcctatgtgacatcaatgtttgacttacc

SEQ ID NO: 6853 - DNA, 201 bp, Homo sapiens
ctgtatatataatatattgcctttccaaatgaaagtgtttaaaaaatatagactgagagggatttggggccactgtttatccatgccataaattttgcacragcctatgtgacatcaatgtttgacttaccaacaagccattcattatatcttatttccactttgatggttctcttgacatttgactttctctggtttgag

SEQ ID NO: 6854 - DNA, 201 bp, Homo sapiens
tctcaaactccccacctctgttcctctaactgcagagtcagaggaagcatgacattttttctgcccttttgtgctttacctaaaaactttgcattttcttycagaacctacccacatttaataatttttagaaatagttttagtcacttaccataagaggaaaaaatggacattttcccacaaaacaatcaggtaaaactg

SEQ ID NO: 6855 - DNA, 201 bp, Homo sapiens
aagtcatcaatacaagcgggatatggtctccccaaaccaagagaacaggagcacacagcacaagtgggcgtggaccaagggcatgtgaactgtggatgggwtgtagacttgagcaagttcgtttctagcttctaaattccaccccagcaagtaccccagacctggctttaggaaccacgatatggcagcatgaagtgggga

SEQ ID NO: 6856 - DNA, 201 bp, Homo sapiens
agaagcctggagaagcctggggaagccagaaggccctgaacccctgacaaaaagcctaaggatcctcacccagcaatgctgaccacgaccattaaaacatraagcccacccccaaagaggaaaatccttgccctttaatgaagctgccaaaaacctccaaatttaacagtttgcactgtgtctttctgcagacacagaaaa

SEQ ID NO: 6857 - DNA, 201 bp, Homo sapiens
tacaaattttcaaacataagaaaaccatgtaaaaaaaaaaaatcaatgggggagggggtgtttaaatgcatttgagaccagccatatgacagcgatttggmagcccttataacccttagttttaataacataagaattccctatgaaattctaaataaggctgggcatggtggttcatgcttgtaattccagcgcttaagg

SEQ ID NO: 6858 - DNA, 201 bp, Homo sapiens
attttcaaacataagaaaaccatgtaaaaaaaaaaaatcaatgggggagggggtgtttaaatgcatttgagaccagccatatgacagcgatttggaagccyttataacccttagttttaataacataagaattccctatgaaattctaaataaggctgggcatggtggttcatgcttgtaattccagcgcttaaggaggct

SEQ ID NO: 6859 - DNA, 201 bp, Homo sapiens
ttccttcctaacttcagctcattgtggcatcttttcagcccctgtatccacgatgctaactgaaaaatcctattctatttctaattcaaaagcccacattyaagctcatcctttcaaacccagccacagacgtcaaatttcagactgaggactggatatactttcatcggtccaacactcttggtcaaagcagcaatccac

SEQ ID NO: 6860 - DNA, 201 bp, Homo sapiens
ttcaaacccagccacagacgtcaaatttcagactgaggactggatatactttcatcggtccaacactcttggtcaaagcagcaatccacagcaagaagggyggggcaaccacaaagattggcatctctgctacactgtatcacacacactcctacccctgactccgagtgacatcaaccacagacagctacattgagctac

SEQ ID NO: 6861 - DNA, 201 bp, Homo sapiens
acagcaagaagggcggggcaaccacaaagattggcatctctgctacactgtatcacacacactcctacccctgactccgagtgacatcaaccacagacagytacattgagctacaggaaggattaaaccacttccaagacccaggaggtcccctaatcattttgccccatgtcttggctcacacccctggaaatactgggg

SEQ ID NO: 6862 - DNA, 201 bp, Homo sapiens
cagacagctacattgagctacaggaaggattaaaccacttccaagacccaggaggtcccctaatcattttgccccatgtcttggctcacacccctggaaayactgggggaaagtcacctaccttgtttggggacacctttttagaggataactcttggtcctcaagcttagaagctgttatgaggaagatgttggggcttt

SEQ ID NO: 6863 - DNA, 201 bp, Homo sapiens
caatagtttctctcccccactgggtgattattcatgcactgcttctccacattagggcaaagtgagctcacatctctcttacctgctctctgggcctcccrgcctggactcgcacaagggcaccatcccactacccctcatacttccaatcagtgcagaccagagccaccccaaccccactatcatcactcacatgagcag

SEQ ID NO: 6864 - DNA, 201 bp, Homo sapiens
caccccatccaacaatcagcacacagctcaaacaagatggggtcagatctccacttcatacacactggatttccacacatgcatgggaaagaaaagaaggrctattgccccacagattcactgcatctagtattgctaaggggctgcagcctcttgccaaccacagacccatctcagtggacaatgcaaagggtagcatta

SEQ ID NO: 6865 - DNA, 201 bp, Homo sapiens
gacagtgccttccccaatccccttatttggatatcccatggctatgcaacagctgtgccccaactagtaccccatggtggcttccaacagcaaaactaatytggttgtgtcatgctgagatatccatcttctaatacaaatgtaacagattagcatacaaagaatggactgctgttgaccacagggagtagtaagactaac

SEQ ID NO: 6866 - DNA, 201 bp, Homo sapiens
gatataccagctgcatggtatttgtgctgaaaacttggcaatagctatctttggtgtatagctcagaggtatccaccttcaggaagtcttccctgaaggcmcaggaatgtaaatatgacgccatggtttcctctaccataacatcctggattttttttttttttttgtatagaatttgtcacagtggaacgtaattgtcac

SEQ ID NO: 6867 - DNA, 201 bp, Homo sapiens
aatatgacgccatggtttcctctaccataacatcctggattttttttttttttttgtatagaatttgtcacagtggaacgtaattgtcactgggaggtgastttattcagggcagggatcttgttttattctccttgtacccccagtctgtggcacaggtcttggtacatgtggttcatgacattgcaccaactgtggata

SEQ ID NO: 6868 - DNA, 201 bp, Homo sapiens
ttttttttttgtatagaatttgtcacagtggaacgtaattgtcactgggaggtgagtttattcagggcagggatcttgttttattctccttgtacccccartctgtggcacaggtcttggtacatgtggttcatgacattgcaccaactgtggataacacaaggctcctgtctccttgattagtttgtgatccacagatct

SEQ ID NO: 6869 - DNA, 201 bp, Homo sapiens
ttatttataactgctgatgcccttgcagctcttgtctgacccatgtccagtttatgtctgcctgatcatcgctctggcactggaagcccaaccttgtagtmtccccgagggaaaacccagtctgcggtagttcctaggtcttcagatgaaaggtgcaaattcaatacaccaccatatagaaaataagctcaaagatttatt

SEQ ID NO: 6870 - DNA, 201 bp, Homo sapiens
gaaagcatggagcctggtctcccaggttggggagatgcctctgagttcttatctctggccaggggcttcagccatttgggtgtgatgcttctcttgtaacyccaaggtaacctatgctgtgttgctcagttctacatgccaagaaatagctcctcttttcagcaagtaaaattatctcactgcttttcagtttctttttta

SEQ ID NO: 6871 - DNA, 201 bp, Homo sapiens
ggagaaaatggtgtctgcactaaacatatacagacttttttttcttgtcattgtttcctaaaccatacggtgtaacaactatttagatcgcatttatattscattaggtattataagtaaactagagatgatttaaagtataagatgtgcatagattatattcaaatgctacaccattttatatcaggaacttgagcatcc

SEQ ID NO: 6872 - DNA, 201 bp, Homo sapiens
aattaggcattcttgttcttctcagtatcttttgttctggcccccagatatgagaagggtttgacctttatggtctttcttctgcttcttcaaaccccacratcatttttttgaaaatcacaaaatgcatgagatagatgggacttatgggatcccctgttcacctttacttcaaagccagaaatgccattctttaagtcc

SEQ ID NO: 6873 - DNA, 201 bp, Homo sapiens
cagtcttcaggttctcactcaagtgttaccttttagggaccaagcagaatcgaggtactcaataaagagttgctggttgctggatgaataaatggctgagkcttctgtgaaccctggcccattctattctttgtctaaatcttgccacacgtgttttctttatgaatcattctgtcctttattcttaaagatactagttat

SEQ ID NO: 6874 - DNA, 201 bp, Homo sapiens
tatgtctcgtatttctccttgaccattctcttatctacccaacacacctaagaatatatatgtatgtatatatatacacatacataagaatatataccacrtacataacacgtgtgtatatgtatgtctacatatgtgtatatatacacgtgtgatataaatttatatatgtgaattactagaaacgtttcgattttagga

SEQ ID NO: 6875 - DNA, 201 bp, Homo sapiens
tttctccttgaccattctcttatctacccaacacacctaagaatatatatgtatgtatatatatacacatacataagaatatataccacatacataacacrtgtgtatatgtatgtctacatatgtgtatatatacacgtgtgatataaatttatatatgtgaattactagaaacgtttcgattttaggattagatatttt

SEQ ID NO: 6876 - DNA, 201 bp, Homo sapiens
cagaactccatttctcaatagtcaactaactaacctctcaaagacatggactacctacatctgaatcactagaagcactaataaaaatgtaccttcttggscgggtgcggtggctcaggcctgtagtcccagcaatttgggaggccaaggcaggtggatcacctgatgtcgggaatttgagtccagcctgaccaacatgga

SEQ ID NO: 6877 - DNA, 201 bp, Homo sapiens
gaaaaagaaagaaaacaacccattttgtgctctggttaataaatggagggagagaaagccagctaggcatcaaccactgtctccaaccattatcatctgcrtttgtgcgcatggtctgtccaaaacaacagtatatgttgattaaaagaccacaatggaaacaaacaaaaatcccaaacccatggctaaactgtaaagtca

SEQ ID NO: 6878 - DNA, 201 bp, Homo sapiens
acatcttcagctatggagtctgtgttacactccacaatgccaacagacagagaggaatgctaactgtaacttgaatgatttgagttctcattgcttttctsccatcttttctttctctttcatcaatgttatacaattagttttttcataaagctcctactagcaagctactcctccccacactcagaaaacctcctacct

SEQ ID NO: 6879 - DNA, 201 bp, Homo sapiens
atgactctgaattcagaaaatccacagctctcattcaggtattcttatgtctcctctccagcgtcatccctggtctctatcttctctcaattagtctattygttcatgccttcatttcttcccgattccaacttagacctctttatccataacattaacagatttcttgtcatacccacaattttcctgcccccactttgt

SEQ ID NO: 6880 - DNA, 201 bp, Homo sapiens
tctctttatcacagcaacagatttcctgccacgcccacaattttcctgctcccatcttgtcctcctgtcacacccacctggcaccaccttccacccagctytgagtcaatccaccacttcctcacctgtcaaccaccaagcctcattcacaaattacagcaaatatgtgaaagaaccagaaacagttttctggctcctgga

SEQ ID NO: 6881 - DNA, 201 bp, Homo sapiens
agcgtaaatgttgatcaaactcgctctctaaccccaaacagctcagctcctaaccggtgccatgctcagtgaaacaggggaggaagtcgccagcccacttytcctgaccatgatgctgttctctctttgtctacgtagactagtcacttcatctcttggcattgattttgtattttgggcttctgatcagacacatctgtg

SEQ ID NO: 6882 - DNA, 201 bp, Homo sapiens
attacttttgccccaacctaatagctgcacaaaactttctacttttaaaggggtcatgtgattgggtgaggctcgccccaataatctccttgttgagtaaytcaaagtcaactgagaagtcctttctgccatgtggcctaataaaaccaaggagtgacagctcatcatgtcacatactcccaggggagaggcttagaaaag

SEQ ID NO: 6883 - DNA, 201 bp, Homo sapiens
cattgatcaaaaatcatttgaatgtgcctatgtggatctattttcattatttcatcattaaataagatataagcttatttaatatatatattttatgcacygtagtctaacttagaataagacagaaaaacttaaaaattgtcaaataaagcatctcatgatatgcgtatgtgcatataatatatataaatcgatatatat

SEQ ID NO: 6884 - DNA, 201 bp, Homo sapiens
ttatttaatatatatattttatgcaccgtagtctaacttagaataagacagaaaaacttaaaaattgtcaaataaagcatctcatgatatgcgtatgtgcrtataatatatataaatcgatatatatattataggtttttcatagataccctttatcagattgaggaatttaccatctttatcataactggatattgaatt

SEQ ID NO: 6885 - DNA, 201 bp, Homo sapiens
aaaattgtcaaataaagcatctcatgatatgcgtatgtgcatataatatatataaatcgatatatatattataggtttttcatagataccctttatcagaytgaggaatttaccatctttatcataactggatattgaattttgtcaaatgctttttccgcatctattgaaatgaccatatttccccctttactctgttaa

SEQ ID NO: 6886 - DNA, 201 bp, Homo sapiens
aagcatgggaaaaacccgcccctatgattcaattacctcccaccaggtccttcccacaacatgtggtaattcaagatgagatatgggtggggacaatgccmaaccatatcagggagcttccctagcacaacagaaagaatgaaagccagccctaggttgagctgtccagtagatctttctagcacaatggcaatatatctg

SEQ ID NO: 6887 - DNA, 201 bp, Homo sapiens
tgccacttgtaactatgttggtggcacttaggcccttccaatataaatgttctggggcctccactagatgaggagcaaaatatccaaggcctcttcccaartggatatatagacaataaataaatcatacaagtaaatatatatttatcaattttgttgaattctatgaaggaaaaaaatacagctctacaaagaaaataa

SEQ ID NO: 6888 - DNA, 201 bp, Homo sapiens
ctgctgaggcttgagaaccactgcctagaaattaggtgctattatcatcactttgcaataaacacctgaggcccagaaaagtaaaatgatgtgcaagtcawacagaaagtggacgagacaagctttgaacccagacaagtctaactccagagttgaggcccttaatcacagttctacactgctcattatctgaggaataaa

SEQ ID NO: 6889 - DNA, 201 bp, Homo sapiens
aacagaagagaagaaggtggggtttctgtgctagcaccagaagacacaaactggaggcagcaatcccactgcagttgatgtgacagaagcccctggagaasagttcaccaaaacgtgaaaggggagtccagcagctgcgtgctaagggggtgtggctctcagctcaattctagcctgaccttcttatagatggctgagaga

SEQ ID NO: 6890 - DNA, 201 bp, Homo sapiens
gtgctagcaccagaagacacaaactggaggcagcaatcccactgcagttgatgtgacagaagcccctggagaagagttcaccaaaacgtgaaaggggagtmcagcagctgcgtgctaagggggtgtggctctcagctcaattctagcctgaccttcttatagatggctgagagaaccctagaggctatttcacgctgtcaa

SEQ ID NO: 6891 - DNA, 201 bp, Homo sapiens
atggccataatgtagatatgttgaccaaagggtaccaactctccattataaggtgaatgaataagttctgaggatggtgactacagttagtaatatcataytatacacttgaaatttgtgaagcgattagatcttaattatactcacaccacatacacagacacccaaaatggtaaccaacagtcgtgaaagatgtgttaa

SEQ ID NO: 6892 - DNA, 201 bp, Homo sapiens
cctacaaacagaaataatgtgagaggtcacaagtccactcatttgcactggacttccaaagagttttgtcatgcagtgtctcagttaatcccccaatagcycagggaggtggacatgggcaccattttacatacagagaaaacatcccaaaacattgcagtgatgacacatatttattaagcataaaccttaggccaggta

SEQ ID NO: 6893 - DNA, 201 bp, Homo sapiens
caggaacaactgcacttccagtcccctctctttctcaatcacagaaacgatcaagttctctcctattccacctgcctgttctcaagtggaccctcccgtgragatggctctatttcaaatcaaaaccccatcgcaccaccacccaagggcttccttttgcctttccctaatccactttttgcctagtgcttattatcagct

SEQ ID NO: 6894 - DNA, 201 bp, Homo sapiens
tcttcctttaaagacctgtgggttggatgtgctatcatcacttcacagttaaggagactgagccccgtgggccagttttgcagagctggtgtttgaacttkggcagctacaaagcctgtgctccttcccatgctcaccctaagtccttttacatatcatgcactgaacttccaacaggaacggtcaagtccccaagaccta

SEQ ID NO: 6895 - DNA, 201 bp, Homo sapiens
tgaatcttctgacatgactgttcaagaaaaacaaaccaaagaaaagaaaacccaaatggccaataaatgtgaaaatatgttcaacttcttaataagataawtgcaaattgaagaccatggttagattccgttttacatctatcatataagcaaaaatgaacaggactaatacaaagatttaaagagatataagaaggttgc

SEQ ID NO: 6896 - DNA, 201 bp, Homo sapiens
agttaacagcatttctgaatgcagagaaaaccaggcaacaaatacttaatgagcatttcctaaatgcagtgtcatactaataacagagaagataaatacaygtaccagaatttctactctgaagaaattaataatataattgattcacccatacatatatccaagcaaccaaccattcatccctccacccatttacccttt

SEQ ID NO: 6897 - DNA, 201 bp, Homo sapiens
gggcctccactagatgaggagcaaaatatccaaggcctcttcccaaatggatatatagacaataaataaatcatacaagtaaatatatatttatcaatttygttgaattctatgaaggaaaaaaatacagctctacaaagaaaataacaagggtgcaggggacagggcactaattatgattagggagtaacagaaagcctc

SEQ ID NO: 6898 - DNA, 201 bp, Homo sapiens
ggtgggaacaacccaaatgtccattgacagaagaacaggtaaacaaaatgtaaatacatacaatgaaatattagccagcgttcaaaaagaaaggacattckgatacatgctacaccagcacactccctagctcacgatattttaagtggatgaataaatgaatgagcaaaaaaagagcaccctacctctaactggatcccc

SEQ ID NO: 6899 - DNA, 201 bp, Homo sapiens
aaatgtaaatacatacaatgaaatattagccagcgttcaaaaagaaaggacattcggatacatgctacaccagcacactccctagctcacgatattttaaktggatgaataaatgaatgagcaaaaaaagagcaccctacctctaactggatcccccagctgtgaactctctcacattttttctctagcaaattccctctt

SEQ ID NO: 6900 - DNA, 201 bp, Homo sapiens
agtgacctgatccaatttaccctggctgcaaaggaaaggatgaagtaggggaggagtagaggtagaagcagggagaccagtggaggctgcttcatctacarctccagatggtgatgatggtggtagcactggagatgaggaaggatctgagatatacatttgaaggagaataattatacattgcactagactctggtgggg

SEQ ID NO: 6901 - DNA, 201 bp, Homo sapiens
cacagccaagccctttcctgtattgtctgtggctgcctttgtgctatagcagcagaatgtgtggcctcttggtttgccaagcctaaaatattgactatctrggcttttaaataaaacacttgccaattgctgctttacaatactttctggtagcttatcaaaataatcttgggatcttttaaatatgcagcaccttaagcc

SEQ ID NO: 6902 - DNA, 201 bp, Homo sapiens
cagttcactgctgtaaataagattcactggagacctgaaacaggagggcccaaaataattttggttctgattccgacaacaaagaaagagttgactctccrccttctctaactgatcatagtgattaatctctcaccagccagtttattacatagtcctgctcaatctaaagctggcatgcaagacaccattttcaaaaat

SEQ ID NO: 6903 - DNA, 201 bp, Homo sapiens
ggaggatcgcttgagcccaggaatccaaggctgcagtgagccatgactgtgtcactgcactccagcctgggcaacagagcaatactcttggagcaagggasggaggggggagggagggaggactgaccggagtttgagtcctgggtttatcatttgctaattgagtgattttaggaagttatttaagccttgaagtctcca

SEQ ID NO: 6904 - DNA, 201 bp, Homo sapiens
cgcacgctaggtgctctgtatacagcgtaccacccactccaaagctgagagtggaaggcagagctcaagcaatcattaaccacagcacacgttcaggcagytttgccactaaattttaaccagtacatatataaaagtgtcccactctcctcctcatatcccatatgcacacgtgcacacccatgtgtgcatgtactcaca

SEQ ID NO: 6905 - DNA, 201 bp, Homo sapiens
cactaaattttaaccagtacatatataaaagtgtcccactctcctcctcatatcccatatgcacacgtgcacacccatgtgtgcatgtactcacatgtgcrcacacacacatacacacacacttcaattcggtcggcttttccttggggagtagactttggtgagtaaatacctctcttagctcaatctcagctccaagca

SEQ ID NO: 6906 - DNA, 201 bp, Homo sapiens
tgctggctgtgccatatattcactggatgattttggacacattcttcacctttctgagccttttcttccatgcaaaatgaggcagttggatgttatacttstaaacatgacaatgctacagcataacgaaagcaccaactgataaagaaaaagcaatgggttgtcagttcccaatgcaagttagagttgtgtgtgatttgg

SEQ ID NO: 6907 - DNA, 201 bp, Homo sapiens
ggaaaattcctccagaaggatttttatcacatttccctttgaagaggagcaaggaatcaacaattggcatcccttggaagatgaaagcaagttcctctgtmttcggaacggatgttcctctggaatcagagtaatctcttaatggaccctgatgacataacgtggcacgggcttctcgtctgaaatggcaggttactcagc

SEQ ID NO: 6908 - DNA, 201 bp, Homo sapiens
aaattcctccagaaggatttttatcacatttccctttgaagaggagcaaggaatcaacaattggcatcccttggaagatgaaagcaagttcctctgtattyggaacggatgttcctctggaatcagagtaatctcttaatggaccctgatgacataacgtggcacgggcttctcgtctgaaatggcaggttactcagcaag

SEQ ID NO: 6909 - DNA, 201 bp, Homo sapiens
ttctaagacattaaaaagtagtgcccacatttccgactcccacaacgaaacctgtgaagaaatcctgacgttgatttcaggagcatgtgggatcttgcctmtcttacaatgcgggtccctcactctggttatgccaagcacagcttaaactgacccctctggttgtgagaaagtaagccaagaggagactaagattctaac

SEQ ID NO: 6910 - DNA, 201 bp, Homo sapiens
atgttcattttatatggtcccgcatttagaatagaatgaaattttaatttattattttggtttttacctgcctttatcattaggaagtgatgtttattagwcagtgaattaagaggaaaatatcaaggagacatctgcactcccatatttgttgcagcactactcacaatagccaagatttggaatcaacctaaatgtcaa

SEQ ID NO: 6911 - DNA, 201 bp, Homo sapiens
aatgtttattttgtcagtattttatctttcaagatctagatatcaccttttccttcttccataaatactacaacctcacataggtattttctgtcctccarttgtgtagagtgctagtaattcaataacttagcatcaaaatcaccctaatgagcttttcagtgtgcatatacccgagtttccttccagcaccactgaatc

SEQ ID NO: 6912 - DNA, 201 bp, Homo sapiens
atgtctggggagtgtgtctctcctgaacactgaaggaaagagatccataggggtgtgtgtgtgtgtgcgtgtgtgtgtgtgtgtgtgtgtgtgacacagaragaggtcttacaaacacacatttttaaatttttaatacataaaaacagtggacaaattataccactcaattttctacaatttgaacacatccatacaacc

SEQ ID NO: 6913 - DNA, 201 bp, Homo sapiens
ctacagcacctagcacatagactaatcactcatcaaaaattctcaatgatggagagatgaataggggtggggatttcaaaccaggactcacagttcttaamaaagaaaacagaataaaaataaaatgttcatttttctggtctgattcctctaacaccaggtgtttttttaaatcataaaattatctctcacatattaagt

SEQ ID NO: 6914 - DNA, 201 bp, Homo sapiens
ctgccctacataccctctgctgaaactatcttatggctggtgccccatcgtgaacacaacatgggaacctgccaacattccacaagtgcttccatgcatgytcttgtatctttagaaggttctcagaagccctccaataaaatctcccatctcatcgttcttaactatgattcatgctaatcaatgagccagtcaccatgg

SEQ ID NO: 6915 - DNA, 201 bp, Homo sapiens
tttcctactggaaaccataaggccttttattcttgtcgaaattcatcagtactttgtaaaatggaataaacttttaagcattaactagcagaaaaatctgscatattgctgctgagtgagtgtgtagcaactgacaattatggacagtagaactcaaactagctcttgatgcatgggaagcgaatacgaggcaatcagttt

SEQ ID NO: 6916 - DNA, 201 bp, Homo sapiens
tatttcaggtaatggatcatgcagtcacacgtccgcattgcctcacctgctctattttactgtgtctctcctgggaagaaatcttggaaaagggtaagaargttgtttactgtcctggttccctgtgtgtgctgcctctcactattacccatgaaagggaatcaaaagggggctgggaaagtttcacggagagggttgaga

SEQ ID NO: 6917 - DNA, 201 bp, Homo sapiens
tgcattataaattagatgcccatgaattttattgaaaagacaaaagtaaaacgaaaatttatttttataaaagctctgtgtttctctgaatttacaaagtkttgaggctagaatatatggggcactggtaagtatgtaggttacaagcatgaatcaaataaaataatcatttgaaaaaattgcatctagcaacatgcatca

SEQ ID NO: 6918 - DNA, 201 bp, Homo sapiens
acttatattctgggccaatgtacccttaaaagttgatttctctcctgctttctctcagacaactgctgtttatatttgtaagcttgtgcaattccacaaaytaacaaacatgagtataacattttttattactcacattaactgctatttttcaatccaaaggaaaatgaaggagaaatttcagagcgatggtcacaaaac

SEQ ID NO: 6919 - DNA, 201 bp, Homo sapiens
catctgaatactgccatttcaacagacagtatcactggagcttttaaatctttaagagaagtcaaatatccagaatttcatgtaacatctcctgatttgtmaatgttggagactaagtcaaagcaccatgtgggctgaataaaactcattcatcctgtggcctgtcactttgcaaattccattataaattctattaagtac

SEQ ID NO: 6920 - DNA, 201 bp, Homo sapiens
attctattaagtacttttcactttttaaacctaagacaaaaaggggaagttttcatccagtgaaatgacatgatcacatttgtgttgaatttatttctaakgcaaccacatatacacagtgacacacacatttacacaaacctctgagtgtatgaataaactacctttgaaaccataagttcttaagggatagctttttac

SEQ ID NO: 6921 - DNA, 201 bp, Homo sapiens
tgccaatctggtctttcctgcagtaaatgaaaactagctctgttcctgcatagaacagaagagtccaggcagctaagtcacatgaccggagacaaaccagrcagaaagaagtcacgtgggaccacaatgaacaagaggcagagacaggccggatgatggccaaatgcacaatgaaactggaactgaggttcctaaagatgc

SEQ ID NO: 6922 - DNA, 201 bp, Homo sapiens
atcagtaattacagatgtatgttaaactaagtttttaatgctaagattatcttcccaggtgtttacattagaaagaattctagatttggagataagtggasacaagttcacccctgaatatttagtaaggtgctaaggtacctgtgggattgcctgagttgtgactcttaagacattgcaagtaaaaagttacaactgaca

SEQ ID NO: 6923 - DNA, 201 bp, Homo sapiens
tttctgacctgcagaactgtaggataataaatttgtattattttaagccagtaagtttgcggtaatttatttcagcaataggcaactaatacaccatgtawcaactgcaaacaattgttgcagttctagaaagctggcccaatttaccagttcttgggtgggaggcggtagaggagcagaaaagataacttttgagtactg

SEQ ID NO: 6924 - DNA, 201 bp, Homo sapiens
tccccgtctagattgataagctctgtgagagcagagtgcaagcctgtatagcctagcccagctaataaatgggtaggtggtgagttgtgagtgaatgtgtrggggagtctgacttgtcaatattctgctttattatcagaacaaatgaaaactccagtttttggtcattttcatatggctggataccttccccttctcaac

SEQ ID NO: 6925 - DNA, 201 bp, Homo sapiens
tatcaacaagtaatgggttattaataggaacatgacatttatatttcagaaaaaaaaatttagcatctacaggaggatgagtgaatagaaaagcaggaggrcattagaaggttgttataatcatttaaataagaaataactggacaggtgtggtggctcatgcctgtaatcccagcactttgggaggccaaggtgggcaga

SEQ ID NO: 6926 - DNA, 201 bp, Homo sapiens
cctgggggaaggagaagccaggccacgtagtcatgtccccatggagaatgcagctgctcctctgtgctctgccctcggttgctactgccctgcgaggcaamctcgaggctgggaatctcctcctttctctgtctgcagcagctgcagtgaaacaaagggcacagcccccttcaggccaagagaggtgagaagctgctgggg

SEQ ID NO: 6927 - DNA, 201 bp, Homo sapiens
actaggtgtcaggcaccatcttagcacaaataagatacacaaggcctgtgcctttgggagcttaatttctagtagggaatggaggagaggggcatatggayaataacaaccaaaaaaaatggtaatgtcacagtatgataaaggctgtgaaagaaataaagtgcaagctagagaataataggagagaactgactgggtagt

SEQ ID NO: 6928 - DNA, 201 bp, Homo sapiens
ctgattaccttatctttaagccaccaaaaggcacctttttatgattaggcttcctttgcaagcaatgtgactctgccaggccctgggcttttgcagaaagmgaaggtggaagggagatggttattagccactgtctctgcaaacgacaagccatctgcaccccgttacctaagcatagacctctgtgggtgccaaacttca

SEQ ID NO: 6929 - DNA, 201 bp, Homo sapiens
ttgcagatccttgtattgcagccagatgacaatgcctgggaccctcttaccatccaaacacccacctcaaggaggcccagccctgtcatatgactgtcccyattatacttgaacagcctttgaagggctttcaaagtgtttcccagccacatctccaccctccaagctcaggtagcccattccttcattcccgtctcgaat

SEQ ID NO: 6930 - DNA, 201 bp, Homo sapiens
ccctattatacttgaacagcctttgaagggctttcaaagtgtttcccagccacatctccaccctccaagctcaggtagcccattccttcattcccgtctcraatgttctgccccagtgaatatcttcgcctccctgttagactctgagatcttgtactgcagaatccactgttgctcatacaattctgagttgtacctgag

SEQ ID NO: 6931 - DNA, 201 bp, Homo sapiens
ctgctccttacatatgcccccagaaagttgttccaagtgaaggcagcttaattaaaaaccacattcaatcaaactgtcactttgtttatgaaaaagtgtckagtggctggaaatggcaagaacaagcactgaagattaatgctctaaattttttctgattaaaagtatgattgaggcattaagaaagctagctccatgaac

SEQ ID NO: 6932 - DNA, 201 bp, Homo sapiens
tctgattaaaagtatgattgaggcattaagaaagctagctccatgaacccagggcaggccttaagcccaacattttgccatcttcaaatacaactggggayagttgtaaaaacaaatagaacttctctctgcctagaggtttcctttcatgaagataaagtttctagctggaactggctgtttttgcagggaagcacacat

SEQ ID NO: 6933 - DNA, 201 bp, Homo sapiens
ccaaatctgatgctcactggaccagggtcaggctatggaactgattaaaataagtaggaacctccaaggccctatgtccctactctccattttcagattgrtcagctgagacctatgtactggaaaaataagctcaagggctccaagtagaaatagttgtagtcctggagtcagccttgggtttagctccacttccaaaat

SEQ ID NO: 6934 - DNA, 201 bp, Homo sapiens
aaatctgatgctcactggaccagggtcaggctatggaactgattaaaataagtaggaacctccaaggccctatgtccctactctccattttcagattgatmagctgagacctatgtactggaaaaataagctcaagggctccaagtagaaatagttgtagtcctggagtcagccttgggtttagctccacttccaaaatgt

SEQ ID NO: 6935 - DNA, 201 bp, Homo sapiens
ctgcctacgatggaattatgagagagctttggaaaatggctgttccaaaagtgatagtcttaacacaaagatcaggaagaatatttgatttggattaccasccacagcaggcagaattctaagatgttcccaaagtgatagtcttaatccacaggaagaatatttggtttggattaccagccacagtaggcaaaattctaa

SEQ ID NO: 6936 - DNA, 201 bp, Homo sapiens
cacataagatgtttgtggcaacaactaacagctgtctggccagacttaactgcaagtgagcaaatcccgccttcttcactagctcagaagctgctgtaaarttacagaggagccccaggagaagctgcaccataccagggggtggagcagctccaaaaaaaaaaaaaaaaaaaaaggaaacagagaaaaaaatatctggct

SEQ ID NO: 6937 - DNA, 201 bp, Homo sapiens
tttcttaacagtacacaggaccatgtaccaggaccaggcaagcaaagcgtaggcatatgctacccctaggctaatccacagacctcggggaagagcaagcsgcagtgctaggctgccaagctctaaaaatacccagctcattcccaccatgacactcatggtaagctcttagtgggcaggaatcctgccaaacaaatgcct

SEQ ID NO: 6938 - DNA, 201 bp, Homo sapiens
ggaccatgtaccaggaccaggcaagcaaagcgtaggcatatgctacccctaggctaatccacagacctcggggaagagcaagcggcagtgctaggctgccragctctaaaaatacccagctcattcccaccatgacactcatggtaagctcttagtgggcaggaatcctgccaaacaaatgcctacctagctggatgatcc

SEQ ID NO: 6939 - DNA, 201 bp, Homo sapiens
gtgctcggtaaaatgttagttgtactttgtcaactactgtagtaatcaatagggacaaaacggtgagtgaaaactaatacagttcctgcccctacgaagcygatgatccccgaggagaaatatacattaatcacataccctggaggttaaagatatattcagtactccttgattttggtgatggtatcacagatgtatgca

SEQ ID NO: 6940 - DNA, 201 bp, Homo sapiens
acactgttagacatataaaacccttgataataataatcaaataatcagataataataacagaggtctaaacgggaaactataagatttcaacagcaagctrtcttgataaggttccatcatctctcaaaaatttataactaacaacaagacaattacttcccaaatccccttgaaattaattccatcctcctccaggagct

SEQ ID NO: 6941 - DNA, 201 bp, Homo sapiens
aactaacaacaagacaattacttcccaaatccccttgaaattaattccatcctcctccaggagctatgatgggtgggaaataaaaccgatgagggggaggytcaagtagtagtgatcatatcagagcatatcaaaaccttggtgaatttttactctttagtttgacatggaaattttccctaatcccaagacatagatgat

SEQ ID NO: 6942 - DNA, 201 bp, Homo sapiens
ttctttgccgagattaaagcagtgccactctgggtctggagccgaactggtagctggggtctagaagaattcagagttcatcccgagtcttctctagagayggaagccggagaagcctggagaagcctggggaagccagaaggccctgaacccctgacaaaaagcctaaggatcctcacccagcaatgctgaccacgacca

SEQ ID NO: 6943 - DNA, 201 bp, Homo sapiens
cctgtgtccatgccatttcagcactagataacaagatatatccatgtaggaagatggatgaggaaagcagggtggatctgtctcccccaaaggaaaccacraggcataaacagcagcagtccccagaggacaatgtacacacaacctctttcctccaactctggtgttgaaactgccctgagctgactttaaatccactgc

SEQ ID NO: 6944 - DNA, 201 bp, Homo sapiens
gagtcctgcagcctttgaataaatacctgccaggccaagctagcaaatagcacagtttcatgtctggaatttgcagaccagggctgaaggaagttagacaygcttctgtgaagaaaactgatattctgctggggtttgcaagatccctaaaggtcccgtcctccccctgggaatcccagcagtttagaagattcctgaaag

SEQ ID NO: 6945 - DNA, 201 bp, Homo sapiens
gccaagctagcaaatagcacagtttcatgtctggaatttgcagaccagggctgaaggaagttagacacgcttctgtgaagaaaactgatattctgctgggrtttgcaagatccctaaaggtcccgtcctccccctgggaatcccagcagtttagaagattcctgaaagggaaaggagcagctcacctgagacaagcaaggg

SEQ ID NO: 6946 - DNA, 201 bp, Homo sapiens
cagagtctgttggtggtggggaagggagagcatcaggataaatagctaatgcatatggggcttaatacctaggtgataggttgagaggtgcagcaatccaytatggcaaatgtctacctaggtaacaaacctatgttctgtacatgtatcccagaacttaaaattaaatagaaatttttaaaaaggaaatagaaccatgga

SEQ ID NO: 6947 - DNA, 201 bp, Homo sapiens
acaggtgaattcaggacccaaaatctgtcatctggatttcgtgttcctccttcttgctgttctgctgccacacagttggctctagttgttggctccaattsttggctccaagtggaagcaagatggtagcagtgattttattccctacatcttttcaggttcacttttaatagaaaataccaagtcttttcccccaggagc

SEQ ID NO: 6948 - DNA, 201 bp, Homo sapiens
tatactccataatgagactgctgggttgattgataattctgttttaagttcttttaggaatcatcacactgctttccacaatggctgaacaaatttacatkcaactgggggagatttttaccaccaggaaatgtttgtctatggctggagacatttgttgtcacaactatggactgctacctgcatttagtgggtagagtc

SEQ ID NO: 6949 - DNA, 201 bp, Homo sapiens
tagcaaagcatacaggcaatcgtgtagagaaacctgttctccccaggaaaggagggtgagcaaatgctaaaagttttgatactttaatatagcactggccktggctaattttacttaatatgaaagatttcaaataatggaaacactgacaggcaaaaacattaaaagtttgcataaaatctcaaaaaaccctgcaaacaa

SEQ ID NO: 6950 - DNA, 201 bp, Homo sapiens
cggggaggtaggggcacggctgcaaagtgatgaacattgcagcaggttcggctattcagaatgagctattttctcccaaatcctgtaattgcctggagcaygtgatctttttgaaggtcattagaggcatgcggctgtcagatgtctcccagaaagtttcactttgattagttagttcctgatgcttatttcctaaaaggc

SEQ ID NO: 6951 - DNA, 201 bp, Homo sapiens
aggtcattagaggcatgcggctgtcagatgtctcccagaaagtttcactttgattagttagttcctgatgcttatttcctaaaaggctctttttgtccccmaccccccaaaaaaatggggagcattaaaattttaaaaaaggaattagatgaatatcctgctaaatgtaacttggcaagatgaaaggaagcagcaaagaaa

SEQ ID NO: 6952 - DNA, 201 bp, Homo sapiens
agtcctttttgtcctctcacatttgcagatgtgtaaattccaggcagatctaatgaaggagttaccttttcaatccctagattgtgtttgccaaaacttcmcttgcaatagggacactccagcaaccctggctcggggctccctgcgtacttagatgtaatactatgtcaacaacatcctgcaggctgaagcagcctcttt

SEQ ID NO: 6953 - DNA, 201 bp, Homo sapiens
gggcagttcttctcaaactttaacatgcacgtgaatcgccgagggatcttgttaagaggcagattctagctcggtcagtctggatgggacctgagattctrcattcaggctcccagaggatgtcaaagctgctggtgcatggaccacactttgaatgatgagatctgtttagctggttggtaggtacctggtggctgagct

SEQ ID NO: 6954 - DNA, 201 bp, Homo sapiens
ttctcaaactttaacatgcacgtgaatcgccgagggatcttgttaagaggcagattctagctcggtcagtctggatgggacctgagattctacattcaggytcccagaggatgtcaaagctgctggtgcatggaccacactttgaatgatgagatctgtttagctggttggtaggtacctggtggctgagctttcaaactc

SEQ ID NO: 6955 - DNA, 201 bp, Homo sapiens
gggaagagcattccaggcatagggaaccatgaggacaaagcccctagggttggaaagaacaaggaggaaaatgacagcaaacaaagccccaaaaaagcacstagtgcccaaatcatgcagggtctcttcataggccatggtgaggatgttggattttattccaaaggctacaagatgccatgaaagggttttaaatctgtc

SEQ ID NO: 6956 - DNA, 201 bp, Homo sapiens
ggaaagaacaaggaggaaaatgacagcaaacaaagccccaaaaaagcacctagtgcccaaatcatgcagggtctcttcataggccatggtgaggatgttgkattttattccaaaggctacaagatgccatgaaagggttttaaatctgtcttacaaaaccataaatttcacactgcagcaatcaagtcccacaatgtcctg

SEQ ID NO: 6957 - DNA, 201 bp, Homo sapiens
gaccttctgagtcacactctgaagtcctgacctcaccataaacaaagagccttttctgggggagttggagctgccctaagccagtgaaagccaatgctcayacgcttgccctatccaactgctttcattagctccattctttttagtctaaaagccttcctgacagcaacaggggccaagaatttctctcatgaaccccat

SEQ ID NO: 6958 - DNA, 201 bp, Homo sapiens
gctcatacgcttgccctatccaactgctttcattagctccattctttttagtctaaaagccttcctgacagcaacaggggccaagaatttctctcatgaamcccattttcttgatttcaaaatccacttgccttgggagaaacgcttgaacctgggaggtagagattgcagtgagcagagatcgtgccactgcactccagc

SEQ ID NO: 6959 - DNA, 201 bp, Homo sapiens
aagaatttctctcatgaaccccattttcttgatttcaaaatccacttgccttgggagaaacgcttgaacctgggaggtagagattgcagtgagcagagatygtgccactgcactccagcctggcaacagagattcagtcttgaaaaaaaaaaaaatccacctgccttggtacaagatgggaaagtctttgggtgtttattg

SEQ ID NO: 6960 - DNA, 201 bp, Homo sapiens
tctcatgaaccccattttcttgatttcaaaatccacttgccttgggagaaacgcttgaacctgggaggtagagattgcagtgagcagagatcgtgccactscactccagcctggcaacagagattcagtcttgaaaaaaaaaaaaatccacctgccttggtacaagatgggaaagtctttgggtgtttattggctgtatgt

SEQ ID NO: 6961 - DNA, 201 bp, Homo sapiens
acaagaaagtaagaaggagagataggtatggggacatgctaaagacaatgagactcagaaaagccaagagactcattcaaggttacatggctgggaaatgrtagaggcagacttggaacgctggtccctgggactccacggcagggttcaaatggtaaagcaagctgaatttccaggccaggttcagggaaacattgaggg

SEQ ID NO: 6962 - DNA, 201 bp, Homo sapiens
tagaggagaatccatttcttaccttttccagtttgtagagtctgcccacattccttagctcatggccacatcactctaactctgtttccatggtcacatcyccttctctgactcttccatgcccgcctcttataagtacagtcacaattatattgggcccaccagataattttggatgaggctctcatctcaagacggatc

SEQ ID NO: 6963 - DNA, 201 bp, Homo sapiens
cttttgccataaatcataacatttatacaggagtcagagtttagaaggtgaacatctttgagaggtcgtagttctgcctgccaggccaccatcttgctccsaaagattcactccatctccccaaaactaactcacgatagtgtcaaagtccaaaattttcatcaaaatctcatcagaccaggcacagtgactcatgcctgt

SEQ ID NO: 6964 - DNA, 201 bp, Homo sapiens
aatccctgtaatcctaacactatgggaggccaaggtggttggaatgcttgagcccagacattggagaccaacctggacaacgtggtgaaaccccacctctraaaaagaaaaaaaaaatacaaaaacagattagctgggtatggtggtgcatgcctgtagtccaacctactcaggaggctgaggtgggagaatcacttgaga

SEQ ID NO: 6965 - DNA, 201 bp, Homo sapiens
gcattcgtatttccactcacagtctgttgaaggatgtctagtctttttctctgatgtgtctccaaattattctagcctctgcccaacacacaattccaagrccactgccactttttaaggtatttgttacaacagagccctattcttggcaccaaaatctgtattattgagggttcaattaaaggaacagatgagcgggag

SEQ ID NO: 6966 - DNA, 201 bp, Homo sapiens
gatgaatttatctgtcagtggaaatgtcttgaaagaataagttcactccaccttcacaaggatggtaatgatgatgatgtttatagcagctaccatttatsggggaactgaccttgggcctcacgactgtgctaagcacttaacatacaatgtttcgttttatcattattatgacctgaggccctgaaaaagaatttgagc

SEQ ID NO: 6967 - DNA, 201 bp, Homo sapiens
ctccaccttcacaaggatggtaatgatgatgatgtttatagcagctaccatttatcggggaactgaccttgggcctcacgactgtgctaagcacttaacakacaatgtttcgttttatcattattatgacctgaggccctgaaaaagaatttgagctcccagtggtttgagaaatgatcccaggaaacactggtaagagga

SEQ ID NO: 6968 - DNA, 201 bp, Homo sapiens
gtatgccttcctgccccagccctggcctacatttccttaattcaactcacgtgccatttttcttcttttcaataaaaattcactgtgcacctattctgtgygagacactatagtttcctcctctgtaaaatgggggtaattgtagggttaagagcattaaatgagagagtgtgacatgcttagcacaaagtaagggctgaa

SEQ ID NO: 6969 - DNA, 201 bp, Homo sapiens
ggctctgtagataatgcttcatgaaaagtgggctgtttccatcaagcctaaatcatataagtgtgtgagatggttaacactgaagactcagaagtcagagmgggctgagtttgaaaccacattcgatcactattcaactgtgagactgtattggttcattttcacaatgtaaagaactatctgagactgggtaatttataa

SEQ ID NO: 6970 - DNA, 201 bp, Homo sapiens
ccctgacacgtggggattacaatttgagatgagatttgggtggggacgcagagccaaaccatatcagagacactgtgcactctgtttccttctatgagccycagttttcccatctgtcaagcaggggtaagaatagtgccagcatcccagacttactgtgaggattaaatgagatatttaaagtacctggcatagtttctt

SEQ ID NO: 6971 - DNA, 201 bp, Homo sapiens
actgtttttcatatcagctgcattattttacattagcaccaacagtgtacaagggttccaatgtccccacatccttgccaacacttgttatctttggtcawttttataatagccatcctaacaggtgtgagataatttcacagtcactcgttgtggttttgtgttgcatctccctgatgattaatgatgttgagaaccttt

SEQ ID NO: 6972 - DNA, 201 bp, Homo sapiens
aactcaaccctggagacctgccttgcttttccctcaggccacccaggtaccatgtgactttcttatgagatgatcaaaacagtactttgtaaaggaacacwtctattcaccaactcactcagcaaaatacttatggcaccccctgtgtatgccaggcatagtattaaagaccagggagaacaagaagagtaaatctagtcc

SEQ ID NO: 6973 - DNA, 201 bp, Homo sapiens
tcgagaccaggcttgggcaacatggtgaaacaccgtctctactaaaaatacaaaaaaaaaaaaaaaaaaaaaaaatagccaggcatgcaggcatggtggtrcacacctgtggccccagctactcaggagcctgaggtgggaggatctcttgagcctggtagggcagagcttgcagtgagctgagattgcaccgctgctctc

SEQ ID NO: 6974 - DNA, 201 bp, Homo sapiens
aggccctgtctcaaaaaaaaaaaaaaagaagaagaagaagaagtgtatacagggtccaaccatagcaaaatcatgaggaggatcaccccaaaatacaagcrtagcttctaccttaaaaacagaaatgaaaacccttatgtgacctcgtgtccctctgtagataattctccatttctctctgttcccttttatagcaaaaat

SEQ ID NO: 6975 - DNA, 201 bp, Homo sapiens
gtagataattctccatttctctctgttcccttttatagcaaaaatgatctagagagttggctataaccaccctgcctacttctgtgctattctttcctctrcgaactctggtcaggtgtggccacgacggtgctactgaaaggtatcctgcaacctctgtgttgtcaaatccacaggacaattctcattccttgtcctacc

SEQ ID NO: 6976 - DNA, 201 bp, Homo sapiens
acatttgcatgcctctgtcaaaatatcccatatacctaacaaatatatacacctactatgtatgcacaataattaacaattttaaaaatttaagaaagaamtctaggactttgcccagtggggcaacctgggtgaagcatatactgaaattctctgtactaattttgcaacttttctacaactctaaaattatcctcaaat

SEQ ID NO: 6977 - DNA, 201 bp, Homo sapiens
cttttctacaactctaaaattatcctcaaattttaaagttgattaaataaaagccctaagaatcattctttctctctcattcttttctttctgttactcckcacatcaaatccatcagcaagtacagagcagtccactttccaagcacatccccaaactggtcagtttcaccacctccaccagtacctcctcacccaagta

SEQ ID NO: 6978 - DNA, 201 bp, Homo sapiens
ccctccagtggttttccatcacagttgaaataaaacccaaactgctcttttaaaaagtttaattgtgtttaattgaacaaagaatgattcaagaattgtasagatctcgaaccagaacaggtgtgaagaggctccatttctaccacaaagaaaatttatggacagagaaggaaagtggcagacagaaaatggaagcgaggt

SEQ ID NO: 6979 - DNA, 201 bp, Homo sapiens
cccatagaatgtacaacaccaagggtgaattttaatgtatactatggactttaggcgataattttgtgtccatgtaggcctatcagttgtaacaattaatrttgttacaagttggtactattctggtgggggatgtggatcacagggatggctattcatgtgtagggcagggggtatttgggatatctctgtacattctgt

SEQ ID NO: 6980 - DNA, 201 bp, Homo sapiens
ttaatgtatactatggactttaggcgataattttgtgtccatgtaggcctatcagttgtaacaattaatattgttacaagttggtactattctggtggggkatgtggatcacagggatggctattcatgtgtagggcagggggtatttgggatatctctgtacattctgttcaattttgctgtgaacctaagactgctctt

SEQ ID NO: 6981 - DNA, 201 bp, Homo sapiens
ctgcatagctttccctccctctgccaaccagtccacaagtactggatatattggccatccatcacttgccaggcagtatctaggtgctggggggactctaygaaggggatatgctcctgcccaggtggagtttagcagggaatctggacagtgatgaagtcatttcaaatatgataaacccatcaggtatacacaaggaga

SEQ ID NO: 6982 - DNA, 201 bp, Homo sapiens
gatgaagtcatttcaaatatgataaacccatcaggtatacacaaggagaaaagctaattttcatttttataggtattttataaacatttttctaaacactstactatagttagggtgattttacatatttctgccttgtttcttgtgctagaacataagatcctggccttgagtcagaggacaagtcaaaataaattttgt

SEQ ID NO: 6983 - DNA, 201 bp, Homo sapiens
gtggcaatcaaatgtgagctgaagcccttaagagccagcgtatgactcaccacatccccctccccacctacaccacaacaaccagccatgctccatctggkcccacaagtgaggcgatatggcgcagaagtcgtagccaaccctcggtgggcacgttgcatgaacgagaaataagcctttattgttataagccattaagat

SEQ ID NO: 6984 - DNA, 201 bp, Homo sapiens
atctgtatgatggttcaagttaaatagtggacatcccttctacagtccctgccaattctcctggcagataatgtgactgcaataccatccatgattataaygtttggtataacgatttaatgtattatcttttccactgaaagagctctgtattagtctgttctcacactgataataaagacatatcggagactggtaact

SEQ ID NO: 6985 - DNA, 201 bp, Homo sapiens
tagtggacatcccttctacagtccctgccaattctcctggcagataatgtgactgcaataccatccatgattataacgtttggtataacgatttaatgtaytatcttttccactgaaagagctctgtattagtctgttctcacactgataataaagacatatcggagactggtaacttataagggaaagaggtttaatgga

SEQ ID NO: 6986 - DNA, 201 bp, Homo sapiens
gaagctacaattcaaggtgagatttaggtggggacacagccaaaccatatcaagttcaaaggctcaaaggacttcaaaagaaggggcaagaataaataatygcacagaaatccattttaagtggtaggagggaccctggacgatgaaaagggtgatctagcccagggtccaggaaaactgtcaggcttcctgcccatctgc

SEQ ID NO: 6987 - DNA, 201 bp, Homo sapiens
cacttaaaacttaaaggacttaaaggcaaagcgggactaacaatgacatgtttcacacttgtatttcttcttacagttttcagggttttcatacaccttayttcattcgatcctaataagaaccctgagaggtagatttcaactgtgctttccaaaagtaaagatggaggtgggaggaagaactcagcgatggagctagaa

SEQ ID NO: 6988 - DNA, 201 bp, Homo sapiens
tttaatattactactgtaatctttatttttggtttttttactagtggcaagattttgtttgtttatttgattgttagtttgctgttatcttctgcttatcrtaagtgaaactggttttcattattggcagtgatataccattctcttttaaactatatttatttttatttatttatttatttattttttgagacaggatct

SEQ ID NO: 6989 - DNA, 201 bp, Homo sapiens
cttcactttcctcctctctacaatgagggtggtggtcctcggatccctgcctgcaacactctgcctgcacatcagggagctcaatatacatccgtccttcrtgttccttccaagcaaggaaggcttggacaacaggaataccattgacagagagaagaaatccagaataagcatgaatcaaagaggacaggcctgggcagg

SEQ ID NO: 6990 - DNA, 201 bp, Homo sapiens
ggatgcttggagggctctcgcctgtacagaggtgtaggtcccccaagcatgcaaaaggcagatcatcatcaatgaggctggagtgactcctgacttccaasaagcagcggagtctgtcaaggagtggaccttagcccaatcccattttacagatgaggaaaggtaaggtccagaagggagagaggaaggaagaagatacac

SEQ ID NO: 6991 - DNA, 201 bp, Homo sapiens
aggtgtcagtgatttttggaaatcacaacttacattttagagtgagtttatttttgttttggcaaaagagtcactgttagggaccaatggaaacaattaasctttttcaagtcagggattgtagttttcaagtcagggattgtagtttaagagaagatcctttccatatgccgacttcagcaaaaaaaaatcacaaacaga

SEQ ID NO: 6992 - DNA, 201 bp, Homo sapiens
ggagaagtggataaacaacagaatagtatctagagtattttctgccataagcagatgttccaaatgcaggagaatacaactgactaaaaagaataatttgycaactgaaaaaccagagaggagtctggctggctctttagaatacaaacatattactacagtaagatgtgcaaaacaagctgaatatactttattaagtaa

SEQ ID NO: 6993 - DNA, 201 bp, Homo sapiens
tgagcaccatgatctcaaatactcacagaaaccatatcattaacataaatgtatgaatcaccctagatatgggataacagagtggggacagctgtagtgawtttgaaaatgcatgctgtctaaagacattaaaattcaagcatttaaaaatgctgtactggtgaaacaaaatgcatctatgagccagattcagcgtgcagt

SEQ ID NO: 6994 - DNA, 201 bp, Homo sapiens
agctttgaacaatgcacaaattactgcaactcccagatcctttatttcctcatctgaaaatagagattctttaaacaaataccgttggagctgccaggttycccaggctatcactgagttattaatccttggcagagataaaatgagaaactatatatgtccacactctaaatccctaagcctcgtgcaaacatatggtcc

SEQ ID NO: 6995 - DNA, 201 bp, Homo sapiens
actatatatgtccacactctaaatccctaagcctcgtgcaaacatatggtccagttggtggagtcatttagtgcaaaggtcaatgagatagtcttctcctrcgatcactttcatgctggccacatttagcttccgtttgccaggataaagctctcagcaagtcctacaaaggcaaaggaagcttctgattgtctcagttaa

SEQ ID NO: 6996 - DNA, 201 bp, Homo sapiens
acaccctcacagatacagggcataagaaatcataaagttgccttgaaaataagttcacaaacaaaaattaaagaacatatgtgaacatccaactaactgaytctacaaatgaaggacttcacaactgaagaaggaaagatgctagagcaatcagagaagaactttataatacatattttttaatctttgaagggacagggg

SEQ ID NO: 6997 - DNA, 201 bp, Homo sapiens
tcctaagtgctctacaatgaaaaggcattatttttatatgtctgcggaggagagaagcatttgtcatgtcaaatacacatatacagataaacagttttttwaaaaatctgccctcaaacgacttacactctggcagaagacatgaggcttgcataggaataacatagaaaacgaaacccaagtgataactggcatggatgg

SEQ ID NO: 6998 - DNA, 201 bp, Homo sapiens
aaaagaggccgtgatctttgtcagtgtgatcttgtgaaccagagctgataaatggggcaattaaatctctttcctgaagcagactcattcttgctgggaasacacaagctaaatgctctcttgggaacagatggagcctgggaagttttggggttgcagtcaaaccacactgcctttgtctccccaccggagaggactggt

SEQ ID NO: 6999 - DNA, 201 bp, Homo sapiens
tagtagctttaatatcctcacaggaaccccaaggggtgggtattatcattagctccattttgctgttggaaacaaagaatgacagatttccagaattagcsggagtctcacaaatgttacccctggccaaactcaacagcgtaaatgttgatcaaactcgctctctaaccccaaacagctcagctcctaaccggtgccatg

SEQ ID NO: 7000 - DNA, 201 bp, Homo sapiens
agtagctttaatatcctcacaggaaccccaaggggtgggtattatcattagctccattttgctgttggaaacaaagaatgacagatttccagaattagcgrgagtctcacaaatgttacccctggccaaactcaacagcgtaaatgttgatcaaactcgctctctaaccccaaacagctcagctcctaaccggtgccatgc

SEQ ID NO: 7001 - DNA, 201 bp, Homo sapiens
aaacaaagaatgacagatttccagaattagcgggagtctcacaaatgttacccctggccaaactcaacagcgtaaatgttgatcaaactcgctctctaacyccaaacagctcagctcctaaccggtgccatgctcagtgaaacaggggaggaagtcgccagcccacttctcctgaccatgatgctgttctctctttgtcta

SEQ ID NO: 7002 - DNA, 201 bp, Homo sapiens
acaaatgttacccctggccaaactcaacagcgtaaatgttgatcaaactcgctctctaaccccaaacagctcagctcctaaccggtgccatgctcagtgaracaggggaggaagtcgccagcccacttctcctgaccatgatgctgttctctctttgtctacgtagactagtcacttcatctcttggcattgattttgtat

SEQ ID NO: 7003 - DNA, 201 bp, Homo sapiens
aggcatctataatcccagctactcatgtggctgagacaggagaaccacttgaatccaggaggtggaggttgtggtgagtggagatcgcaccattgcactcyagcctgggcaacaagagcaaaactccgtctcaaaaaaaaaaaaaaaaaaaaaaaaaaaaaagtcaagacagaaaaataataactccaacacagagatact

SEQ ID NO: 7004 - DNA, 201 bp, Homo sapiens
aaaaaaaaaaaaaaaaaaaaaaaaaaaaaagtcaagacagaaaaataataactccaacacagagatactctaaaatgggctcagaaaccacaacataaagraacagaaagaagaaaaggatttttataaggagaaaagtattgtttattctttcaacacaaattctattgtggtcaattaaaaaaataatgttagttgtct

SEQ ID NO: 7005 - DNA, 201 bp, Homo sapiens
ccctacctccctcgctcagcagctcccggtcgcacaactcccagcagccggcgctggggaggtggtagggggtgcgggtggaggtgcccagttagcttctygtgggtggccaacctggggctcccattctcctgtgcaccctggagtggagctcccgctatcagccacaggggctgaggatccgcactgggggcgtcgtgg

SEQ ID NO: 7006 - DNA, 201 bp, Homo sapiens
aatgccatgtggggacgtgggtccagtgttgacagttcttccatgttttcaggaagaaactgaaaattggaattttaagtgaaataaccttagttttacayagaaaatatctaaacaaaaaatttttaaaacagcatgcagacctggcacatcgggggcgtgactttgccccattaaatgaagcataaattctctattttg

SEQ ID NO: 7007 - DNA, 201 bp, Homo sapiens
ttgccagtgttcctatttggctcatataggacactttaatttgtgattctttggttattagatcactagctttttaagcacaggctttgggctctgtttgycttcttgggaaatactgtcagaaatcagtgggttcataaccttttgaagaagtcactcttattttggttgagtgggcagtgttcttagctacccaaaaca

SEQ ID NO: 7008 - DNA, 201 bp, Homo sapiens
ttcctgggatcgctgggaccggtgcctgcgggtttctggggacacagaagatacatcttcctcctccctctcctgtgtttacacaatctgctttgaaaggytatgattcttctgtgggcgactggcctacagcatctgcctgctttgcttgatttggttcatttcacccaggctggcatcttcgagtctggggtccttttg

SEQ ID NO: 7009 - DNA, 201 bp, Homo sapiens
taagatgcccttcaagactctactcctcaaggtcatgaaatagtcttttaaatttgttaaaaataatgctgagtgtattttattttcaactcaataacgcygtcacacatattaaacaataatggcattttcccatttatttccttctgcatatatatgtgtgcattgatgtgcatgtgtatgtatgtatctgtatttata

SEQ ID NO: 7010 - DNA, 201 bp, Homo sapiens
acattccccaggtaaaaaccatgtaatagcgtccattagaatttattaaaaaatccaaactatttaccttgatgaggtcctgtgtgatctagccttgtctrttctccagtctcatccattaccacgttcccctaactcgttaaatgctattccaaatggtttccattcaacttttcaaatttgccaagctctttcttaccc

SEQ ID NO: 7011 - DNA, 201 bp, Homo sapiens
cacaggaaggggaacatcacactctggggactgttgtggggtggggggatgggggagggatagcattaggagatatagctaatgctagatgacgagttaayggatgcagcacaccagcatggcacatgtatacatatgtaactaacctgcacattgtgcacatgtaccctaaaacttaaagtataataataataaaattaa

SEQ ID NO: 7012 - DNA, 201 bp, Homo sapiens
gactggcctacagcatctgcctgctttgcttgatttggttcatttcacccaggctggcatcttcgagtctggggtccttttggctttacccgcacataatmtcttgggtggatcaaaacctcttcaactctctcttgagtttccaagcaggctcccctgtggggcttttctaagagtgtttagcattggcattgctgcaga

SEQ ID NO: 7013 - DNA, 201 bp, Homo sapiens
tccttttggctttacccgcacataatctcttgggtggatcaaaacctcttcaactctctcttgagtttccaagcaggctcccctgtggggcttttctaagwgtgtttagcattggcattgctgcagagcacagtctcactgtgtggttttatgaaggatttgttttttaaaatttattttctatttttgtgtctttagagg

SEQ ID NO: 7014 - DNA, 201 bp, Homo sapiens
tcaaaacctcttcaactctctcttgagtttccaagcaggctcccctgtggggcttttctaagagtgtttagcattggcattgctgcagagcacagtctcaytgtgtggttttatgaaggatttgttttttaaaatttattttctatttttgtgtctttagaggcagggtcttgctctgttgcccaggctggagtgcagtgg

SEQ ID NO: 7015 - DNA, 201 bp, Homo sapiens
gtgtctttagaggcagggtcttgctctgttgcccaggctggagtgcagtggcatgatcatagctcactgcagcgttgaactcaggctcaggcaatttttcytgcctcagcctccagagtagctggcactacaggcacacaccaccatgcatggctaattaaatctttttttttcttttttttttaagaacgagggtctttg

SEQ ID NO: 7016 - DNA, 201 bp, Homo sapiens
cctccatctcctgagctcaagcaatcctcctgcctcagcctccctagtagttggtactacaggtgtgtgccaccatgcctggctcatttttgtgttttttwgtagagatggggtttcaccattttgcccaggctggtctcaaactcctgggctcaagagatccacttgccttggtctcccaaaatgctgagattaaaggca

SEQ ID NO: 7017 - DNA, 201 bp, Homo sapiens
ttctgagaagacatttaggctgagaagctaattaagaaataacagagaaaactaatgaaacccaaagctgattctctttaaaaaaaaaaaaaaaaaaaaamaaaattgataaacctaggtagactgatcaagaagaaaagagactatcagaaataaagtctggtgcattactacagactttaagatattaaaaggattaaa

SEQ ID NO: 7018 - DNA, 201 bp, Homo sapiens
gccactgtactccagcctgggtgacagtgtgagattctgtcttgaaataaataaataaataataaaataaacaaagctactataaccctaaaatggtaacyagaattattctcaaagcattttttttcaggtagaataagtagttcagcctagagcaatccaatttattactcaaggctcaactccaatacctctagcttt

SEQ ID NO: 7019 - DNA, 201 bp, Homo sapiens
agaagtcacgtgggaccacaatgaacaagaggcagagacaggccggatgatggccaaatgcacaatgaaactggaactgaggttcctaaagatgctggcayagcgttgcacagtcacttgtcttgggccagaccaaagcacagtcccctctactctacgagtgaggagcaaggcccaaagaaacaagcacgactgtgaatt

SEQ ID NO: 7020 - DNA, 201 bp, Homo sapiens
aagcccctggagaagagttcaccaaaacgtgaaaggggagtccagcagctgcgtgctaagggggtgtggctctcagctcaattctagcctgaccttcttayagatggctgagagaaccctagaggctatttcacgctgtcaacactaatgatacttctgctgagagaggggtgaacctctggtccacctattgctgatgct

SEQ ID NO: 7021 - DNA, 201 bp, Homo sapiens
tccctatatcggctggcagagacaggcaggctaggggatgcaaaatctcatgggtagagatgcagccttgcttcagagaaatcttactgcaaaccctggakgccagactttagacaggattgcaatgaccttatgtatccgaggcagtggaagtttcctctaaagaaaaaatgggaggcaagtggcttgaggaagtcaggc

SEQ ID NO: 7022 - DNA, 201 bp, Homo sapiens
tgaacaaataactaaagagctgtgaccttcaaacaagctacttcaagcttgttgagccttgggtaacgatggctatgccagagagacatgggagacttcartgacataaaatggatgatattttataaacaacaattggcgcacactgtacaaattaagtgattttttttaaatgtgggtctacccacctctaagcctttc

SEQ ID NO: 7023 - DNA, 201 bp, Homo sapiens
ggttttgcaaactggctatgaattgttcagcggttggattagccagttctgcagactgcctcacacgcagaccatctggaccgcttatagagaagacatgwtccaagtaccctctttcctttgtctgcttttctcatgggtactttgccctctaagaagcctactttcctcttttcctctcctcctctccctatttctctt

SEQ ID NO: 7024 - DNA, 201 bp, Homo sapiens
cttcttccctctcagcctgacaaagcaaagtgggctagtcccatcttccttacctccaaaaccagtacagcattaagaaattcctaatctaccgtgatgtstgagggtcaaaaaagtgggcctagaggtgaaaaatggatcatagacaaaatattagacatccttcaccctttgtcaaaattaaaaacttttattcatcaa

SEQ ID NO: 7025 - DNA, 201 bp, Homo sapiens
agttcattccgagacccatctgcaagagtgaaaaatgcgcccattgtgctacctgtaaaaagcatggcaaaatgtgaatgttccttaggatcggacatagrgctaaccagaccattctcccagcccagcacctgggacatcaggaagcaaagtgggttgaggatcccatccccataggccttcctctgagtcactggtgca

SEQ ID NO: 7026 - DNA, 201 bp, Homo sapiens
tgaggctctaccctctgagtaaccagtcctttctcatgaagggtaatatgtgtttccagcctaagagttttaaccgtcatttcctgcctgtagaatttggrgagtatatcataggtgataattgaacaatgagaacacttggacagaaggcggggaatatcacacaccggggcctgtcagggggtagggggctgggggagg

SEQ ID NO: 7027 - DNA, 201 bp, Homo sapiens
gaccagggagaacaagaagagtaaatctagtcccacactctaggagcttaacgagcagcaattttgccctccccccagcaaataattgtctggcccataaygtcacgttcaaagactgagaaaccctgctaaaagaagacacagattttaaagaaatgataatgtgaaagaattaattgtagaagtgtactgtaatcccag

SEQ ID NO: 7028 - DNA, 201 bp, Homo sapiens
acaaaccagagattcagttcctgtttctcttctgcacagccctctttctctctctttccccactcactctgcctacagtagcattttccatctgaggctakgagaaagaagataaacaccgctgcaaacccaccagaccacagctcttcagggcccaaacgattgtcagcaacccctgagggctacttggagtgtgagtca

SEQ ID NO: 7029 - DNA, 201 bp, Homo sapiens
gtcttctcattttctactctttctttcttttagaaaacaactgtttacgttcacttaaaagtagctgttcaactgttatcaagggaagagcccttgattcmtaccacaataacaggcaaaaggacgtctggaacattttgatctgtggcttcccctgcttctccccactcctaccccagatttcagcagccgtacctacag

SEQ ID NO: 7030 - DNA, 201 bp, Homo sapiens
tcttttagaaaacaactgtttacgttcacttaaaagtagctgttcaactgttatcaagggaagagcccttgattcctaccacaataacaggcaaaaggacrtctggaacattttgatctgtggcttcccctgcttctccccactcctaccccagatttcagcagccgtacctacaggaaacagtcagatcaaggctgcagg

SEQ ID NO: 7031 - DNA, 201 bp, Homo sapiens
aagaaacatcatctcgattcttttcaggatgtaaataaaaagatttccttctgccctttgcccaaacaatacctctttttagaggaaatcaacatggtaamgcagacttcaatttcaaaaaaaaaaaaaaaaaaaaagagcaaatgcacatttctcattaccaattacagcctgttccaatcattttcaaattaatcattt

SEQ ID NO: 7032 - DNA, 201 bp, Homo sapiens
tgggaaggttatgaggactttttaatatcacaaaggagttcttgtgttttaaacacatacagatttaagaaaaaaaaggatagcaataacttcagatcccrtgctgttttgagagccactggctaaactgggtttccagtactacagcagctaacaaccctgccctaatgaccaacgaggggaagtaaatctgggtgttta

SEQ ID NO: 7033 - DNA, 201 bp, Homo sapiens
gtgccttgtaccaacacaccggagccgaggagaagcacggatggctctgagacatcttcaatttcatctgcagcatggctaattctcagtttaataaaacyagcctgctctgtggatgcacaggctaaacattgcctgaactatcacttagcaaacatttcttacctctcccactccttctttctttgcctctctctccct

SEQ ID NO: 7034 - DNA, 201 bp, Homo sapiens
atttgtcaagtaactggaatagtgcctggaccagagaaagcattcaaaaataaagctatgattaccgtctgttattatcattatgagtgaaaaaggaaccygaacctcatttttctatgaaacattgaattctggaactagaaagtaataacaacaatgactaacactttttgggaacctagttgggtccagcactatgcc

SEQ ID NO: 7035 - DNA, 201 bp, Homo sapiens
gccagggtaagtgtccaaatttacccaagagtcaaaccagctagaaacattattcttttttccagactcacacttcacttcactgttaattaaaatttccmgttgaaaatcgttttccctaaattaggcatgctgctgcctaatatgcagtcataactggatttgggagaagtggccatccattttccaaatgagatcctc

SEQ ID NO: 7036 - DNA, 201 bp, Homo sapiens
gtgacagggatggagcaagaggaaggaaacgtgggagcaggtgagataacacagggctttgtgtgccatggtaagtaaagtgacccttactcaagcctcartcggaagccatcagagagaggtgaggcactctcatgcctttgtggaaatgactccatctttaaccccaacccctcatcagctctcttgacaagattcttt

SEQ ID NO: 7037 - DNA, 201 bp, Homo sapiens
aaaaaactctctgctccttttgtgtgccttgaagacatttcaggtgagtcagaagcgctgatgctgagactgatttggctgtatggaaaagaggagctgtsagataattttgtctctgggtagggcttaaagatgactttttttcaggtcatagatgaggtacccacagcctacagtgctccttcaccccaatttcttctc

SEQ ID NO: 7038 - DNA, 201 bp, Homo sapiens
aaaaaaatcaactgatgccctaatttcatagggaaggtttccctttaacaggaggttaatttttatgtcatttaagtaaatgaagatatgaaaaaatgatstactcagatgtcacctgccaatataagcagagtgggcaataaataaagtggcagaagcaaattcacattaatggaagttatgaagtgctgggcaggaagc

SEQ ID NO: 7039 - DNA, 201 bp, Homo sapiens
atcttctgggcttattctcaagaggcaggaaattcttggggaaaacttagagttaatccagtcaactttatgaacgatttagtttttttagggatgcacaytgatcagaaatgacagctatttaggaatcagatgtaggcagttcagaaggatcggtccaagacttctaggaattcctgattcatgaatactatgactggg

SEQ ID NO: 7040 - DNA, 201 bp, Homo sapiens
gcagatgagctggaaacagagagcctggagagaatggaagggctgaggagtttgcacaactgatgccatcctttacaatagtctttccagcatgcttcagkcaaaggagaacgtattgcaaggatgggctgtgggtggtttttaccttccaaaatgtaactcagatttacctgattatctgtattttcgttgttcttgaca

SEQ ID NO: 7041 - DNA, 201 bp, Homo sapiens
gaaactgtctcagattccaccctgttggaaatcttcttagaggttaaattaccctttaaatgaaggcttgcaatctcccattaaacacaacatcattattwatggcattgtttagtatctggttgattgaagatggtttatgtggtaatcaccactcttcaatggtgaggaagaagttgaaagatttcaataaaactaggt

SEQ ID NO: 7042 - DNA, 201 bp, Homo sapiens
atttagaaggtagtgcccactgaggaaagcccactcaaaatggcataacgtgtatgacataaaccctggctagagtgggatccttttaatgagttatagcyaacgaatgcctcccaattttatttcctatctactgattgtccctttatcaactacaatgcactaagatcaatgcattttattttagcacacttgatttcc

SEQ ID NO: 7043 - DNA, 201 bp, Homo sapiens
tcattttctttgcatagactgaagttgaaacccatgacaattttagcatttgacaagcattttttaaattaattgtcagaaaagttccttcaaatctgctytcccaacaaattgaacatcagtggttttcacctaacaactattgacttcaggttatgacaagattaaaatatttcattttgttttatccatcagttgaag

SEQ ID NO: 7044 - DNA, 201 bp, Homo sapiens
gcttctgatgtgagttaatggagtttgtggaggagagaaaataggaaataatgaacagcaataaaatcagattttgaatgttttggctcttccagatgacwaagccagtgaatggaaaaatgtagcttagctggttcattatgactttcaaaatctgtagataatgaccgtaaataagggggtgcacagtcaatcaaatag

SEQ ID NO: 7045 - DNA, 201 bp, Homo sapiens
cattatgactttcaaaatctgtagataatgaccgtaaataagggggtgcacagtcaatcaaatagggatgtaatttagtgactaggaaaaatattaagccyactgggtaaaaacagctttgaaaatagtttcctctggttacaatttattttacttttaaaaatgcagcaggaaaagtgtggggaaagagaggttttgcta

SEQ ID NO: 7046 - DNA, 201 bp, Homo sapiens
caactgatcagccttcctcaaagacgttccctataggaaatgcaattgatctaatcttctttaatgttgggattagtggatcctagcaattctctattgcyctcacgagtcagactttcatttcatccagacacagtaaactcctcatatccccaagcggaagaaggaaagctgcaagctactatctcctcacagaaacca

SEQ ID NO: 7047 - DNA, 201 bp, Homo sapiens
atccttaatttgatttaaatatctaaacatcatttgcttcacaatattatacctcaataatctacaataatctatgtgtttatgtatatgttttacttatsagactatgatttcccagtctaccaggaattttatatgcgtaatgattggtttctatgtccacagcttctaactcagggcatgccacatggagggacttaa

SEQ ID NO: 7048 - DNA, 201 bp, Homo sapiens
tgcttttaggaaactaattgctcttcagctcctagaaagattttttttaaagggcagtgattacttatcaaaatgttcagccaatatgttcttagagcagrgataatttcatctccagaaattgtatgtctcaagttaatatacacctcttatgtccggataaattcagagggatgttgccaaggctgcaaaaggctggaa

SEQ ID NO: 7049 - DNA, 201 bp, Homo sapiens
agtgcctgcttcctctgaatgcactgttttaaatgcaacgattggaggtggtgggattatgaagctttggcatgaataagaacctttcctggaagctgatwaagaatgcagactcctgtatctctggagtgttggaatcagtagatctgggataaggtgtgggatcctgacttttcaaccagcgtcctagagtcattctgc

SEQ ID NO: 7050 - DNA, 201 bp, Homo sapiens
ctccacagtctccagttatcacctctcttgacagcccctgatctgctgcctttcccccattcttctctactgcctccgagaaacctcaaactcagtaggcwtagagaagaactcagcctcttatcttccaccgtaaaaaatagtttctctcccatctgccatataggagttcttgaaatcccaaccatggaaatatccatt

SEQ ID NO: 7051 - DNA, 201 bp, Homo sapiens
tctctactgcctccgagaaacctcaaactcagtaggcttagagaagaactcagcctcttatcttccaccgtaaaaaatagtttctctcccatctgccatayaggagttcttgaaatcccaaccatggaaatatccattaattcatctctcttctgccacccccatatatattaaatcaatcaccaagccttgatagttcta

SEQ ID NO: 7052 - DNA, 201 bp, Homo sapiens
tgagaacagacatacagcgcaccacacaattaccacagttcacccagagaaagcattccaattgcaccttacagatttagtctgccttgttgcaagaaagrcgtgctcttggctgtgagatgggatctagagcagctcaacaggaaatgcgtgggagaaagaagcactgtgagcccctttattgcccatgctttcttccct

SEQ ID NO: 7053 - DNA, 201 bp, Homo sapiens
gcagaccagagaggctgaagcagagaaagacaggaaaatgtgagatcaggtgaggctgagaagatgaataggaacagaaagtgcaggattttagagaccaygttaaatgtctgtcttaaaaccgtgggaaggtgcaggcatggtggctcacacctgtaatcccagcactttgggaggctgaggtaggggaatcacctgaag

SEQ ID NO: 7054 - DNA, 201 bp, Homo sapiens
ggacacactgaagggtttggatttgttcagaaggtcatggtgagccaggaaagattttaagtagaggagtgatatactcagatttgcagccaataggggcrgaagtgaaaatgcttctctgcacttgaggggacttgaacatttttgttcacggcttaaaaaccattcattatctagacaattgaaacttttttttctctc

SEQ ID NO: 7055 - DNA, 201 bp, Homo sapiens
gtgctccacctcacacctcttattgagactctaaagaagatatttgcatggactgtttagtggagaactggagtcaaattcctcattattagcaggacttyaaagtaactaattgagcctaagttaagctgtttttattttttaagctgacattttggttccatttcccagggttatttttagccccgtcacattgtctgg

SEQ ID NO: 7056 - DNA, 201 bp, Homo sapiens
caatggcctttacctcagctagcgaaaataagttaccagtcactctgtacctgctgccctaagttgataattagggtggccaactcactgaggtgtttctyattgagtacaatgagatcttaagccaggtttcaattatccaacactttggggtgaatgtagttcaggttgagtctacctagcgccccaaatgtgggaaaa

SEQ ID NO: 7057 - DNA, 201 bp, Homo sapiens
gaaataccattttacaccacattgatcagttcccattaacacctgctgggcacttgtattaaacagtaaaatcttgtcattgttttgcttatctctacaawattgatcataaagctttagtggtcagataaaatgtcagaaattctgactgcttctaagcctcaaattacagcttcaatatctccatcaggagcaataagt

SEQ ID NO: 7058 - DNA, 201 bp, Homo sapiens
ttaacacctgctgggcacttgtattaaacagtaaaatcttgtcattgttttgcttatctctacaaaattgatcataaagctttagtggtcagataaaatgycagaaattctgactgcttctaagcctcaaattacagcttcaatatctccatcaggagcaataagtacacagaagcatgctggcaaatagagaaggggaag

SEQ ID NO: 7059 - DNA, 201 bp, Homo sapiens
aacaccctactacaaatgcaatgctttttaaagccatgcttccccttgccatttagtatactcatttccagagtccctctgtccttgtgtgaacagccaamcataatgggctgcataagcttctttaactatgacttaaaatatctcattcctccagatttctattttatctctttcgtcttatagtcataagtctccttt

SEQ ID NO: 7060 - DNA, 201 bp, Homo sapiens
taaatgcctccttgaactgcttgggtgtcacagtttcttcgtttgtcatttaatttacatgtttttgaaaacacagtcagttttctttaacctcttttcarttctcaagatactttcattttcacagagtgttttttttttgttttttttttttctcttacaagcattctcctggtgtttgcaaatcccttcaactttgat

SEQ ID NO: 7061 - DNA, 201 bp, Homo sapiens
tttgtggctttcaacctcaggtaagtatcctcagttctcagagtatttgtttccttttctgtaaaagtgaggtcataacagccatgtcactgggtaattayagggatcacactaaatgacgtctaatgagatacacaacgtgataaaggccagcagagtgcttggcacattatgggtgtctgctaaactatggtaggggta

SEQ ID NO: 7062 - DNA, 201 bp, Homo sapiens
caaaaactatagaatgagatgatatggatcaattgacattcaattcaaggtgcgatttttatttcagaatttctggatattcacatactggaatatagaaytcataaaagcagggattttgcctggtttttccttctgctgctttttctcccttgaagaacctagaatactacctggtataaagtagatgctcaatgcaaa

SEQ ID NO: 7063 - DNA, 201 bp, Homo sapiens
ctggttaatcttccattactccatttctacttgcttttttcagggcaaacaccaagttgatttatcagaaagaatacaaatttctcatgcttttcagaacygggcagataatatcaatgagtaaaacgagccaggtgcaagatgataacagtggtgaaaatcttagctaaaggcattcaaattcatttaaatgtaaatgaa

SEQ ID NO: 7064 - DNA, 201 bp, Homo sapiens
ccatggcggatcaattagattctgtctcctaggaatttgaaagttgataggtaagacacacagaccaggaattgttggctctaaaccaatgtaatagtgaytctccttcgtcgaggaatgttgcctcaccttatgacctttccaagattagttgctcaacttatactttgatttttaaaaggtctagtaaagccccaaaca

SEQ ID NO: 7065 - DNA, 201 bp, Homo sapiens
aatgtctttcactttgttcctacctgcactataacatctgtactgctattcagattcctacatttcatcctccatactcatatcaagcccacttgccagaygaaatgttcccacacctcagttctgatcatgtgccacccttctcaaaaccctgaaatggatccccactgtccaaaaataaaatccatgctccttggcaac

SEQ ID NO: 7066 - DNA, 201 bp, Homo sapiens
tcataagacacatagtagatatgggtgctctatttcattcaaaaatatacatatagagtcttcactctttttctccagacaggatcttgaatttgcagaawgagattctattccagggacctttatgtaaagatttatagacatttgctacaacgcattgtgcaaccttgtattttaggtcaaataagtaattgaaacaag

SEQ ID NO: 7067 - DNA, 201 bp, Homo sapiens
ttttgtgaaatctgatgatagtgtttaaacattgggactttacttttggaaacaggaaaaacactctaagtttaaaaaaaaaaaacatgcacacaacacasgtcaatttgcagcctctgaaagtcgtaacgtggggtttggaaccaaaggaaactggatttaacttctggctccattttacattacctgtgtggctctttt

SEQ ID NO: 7068 - DNA, 201 bp, Homo sapiens
aaatgattgacttgcattgcagggctggcatacggttcttttgacttccagccataaaagggagggctgtgttccaggagagatgccacaaacagagatgrtgctgaagagaggctgttgacttagtgctcaggctgaacacccagcaagctcagcccactctcatgggtccatcaggcctagatcaagctgtgcctctag

SEQ ID NO: 7069 - DNA, 201 bp, Homo sapiens
tacccaaccatccaatacccaacctatatctcaatgtatcctttattgataaagaggagaatatagaagacctataaacctcagcagttgtccacagaacktcattaatgccaaaatagggcaacaagataaaaaaaaccaccaacagaagacaacacagaagtagagtctaaaggcaattatattcgccaacctcacaca

SEQ ID NO: 7070 - DNA, 201 bp, Homo sapiens
tttaccacccagagccaagtttcccactatcaagtccacaatgccagaggaaagaacacataaatgcatggagaaatgtatttcttgattctcgttgcagstgatttaggacagcccaatatactgtacattaattaggaccacacaatgatcattgctcttgaactcagccctgctttctagatcattagcagggctggc

SEQ ID NO: 7071 - DNA, 201 bp, Homo sapiens
cttgcttctgcttttctgtatttttcaaattttccataattagcctgtttcttttataaatgaaaaattaactggaaaacgaggcagcctaggtaggtagrgagagcatatgctgtgaagtcaaccagactatcttttattaattgtatcacttgttcctaacgtgtaatttttcttttttatacactttatttttattta

SEQ ID NO: 7072 - DNA, 201 bp, Homo sapiens
atccaaatggagtttcataccatggagcttacatgaatttacagtacaagtgtggccctggaaccagtgacccaatcctgcatctaccacttgataaataygggaccttgcacaattactcagccttgaattcttcttcctgaaaatgtgaccactgttagtgcttaattgaggttcttgtgacaatttaatgggatcagc

SEQ ID NO: 7073 - DNA, 201 bp, Homo sapiens
gctagagcagggtctttgtccatcagtcttcaccacagctctgcttattacctcccccataacactgtccaaaatctgtaattagttttttcacctgtgtrttgatgtctccctatactagaatctggacatgaaaagactgtatcctcattctctagtacaatgccaggcatttaagcatttaatattcacagaatgaat

SEQ ID NO: 7074 - DNA, 201 bp, Homo sapiens
aaacccagaaatcaaggctggctcttgggcgagtatgttctcatcaaagatcccagcaatagagcctggtggtttcctacagggaacagacttccatctayagctgaaagacgtcagaaggttgttgctgctgatctcattcgggttcgctgtgaacaccgagagggtaactgaccccatttcaatcctgtttcatgtctt

SEQ ID NO: 7075 - DNA, 201 bp, Homo sapiens
gcaactgttcccacatgtctccccacttggaattgaccacatctgttccttaacttgtgagcacagcacggatcaaaggactctgctgcagtagtcttgtyttagtaaattaagtacctatcagtgccctgaagggttgctattctaagataccacacacgtgaatgcacacacatgctccagaacaaagaaacatcgtta

SEQ ID NO: 7076 - DNA, 201 bp, Homo sapiens
ctggcaccaggccctccctggtgacattgggaaagtaggtcagtttcagagctggctgggggatgaatggtcagccaggagcaagtggtgggaattaaagrtgctgagtgagaggttgacttaagcatgggatctaggagacagggagtgttattagtctgtttttcacactgctgataaagacatacctgaactgggaag

SEQ ID NO: 7077 - DNA, 201 bp, Homo sapiens
tctctccagacccaatgctccaccacccatcacctccctcatccgtcgagacccaaagcttcatcacttccttatctctccaaagccaaaacttgacttgycatactttctcaatgtactgattaaataaaactgccggtaggattaactctgcaaggatgcacccaacccagatatattcaccatagccatagattacac

SEQ ID NO: 7078 - DNA, 201 bp, Homo sapiens
ggaagaaaaagagggaggaagaaagagcatggaaaggaggaaggatggagagacacagacagggagtgaaaaaaagagacaaggagttaatgctttctggrgttgacgagaagaatccatgaaagaattttttagcagcggtgtgacatgagcaagtttttatcttcgggaaggaccacttgagcttgagtatgaggaagg

SEQ ID NO: 7079 - DNA, 201 bp, Homo sapiens
attacccaaatgatgtcatcgcatcataattagcaatagggccagaattaccaaccacagcaaagcacgtcaaaatggggctatctcaactcttccttaaytgggaaatttaacaaccgaaagatgcccctcgatgactctgaagggcttggtttctcgcatttcctggacctctttgaacctcacctgagaactcttcta

SEQ ID NO: 7080 - DNA, 201 bp, Homo sapiens
atctcagctccaagcaaattgaaaatctctactaattcacaaaaaaataaaaataaaaaaataaaactttttaattaggtcaaccctgcagcttaacaacraagatgaagaaaaagatcttgggcaagaacaagacagctgtggtttgagaagaaggcactagacttggagttagaacttggatgctggctgtgccatata

SEQ ID NO: 7081 - DNA, 201 bp, Homo sapiens
gaaaaagtgcttatggagaagttgtcataacatgatgaactgaaattatgacgttaggtgaataataaaagtgaaaacaaaatgtatatacaagccaatcrtaaaaatatttgtaaaataataagattgaaaaacttcaccaaagagttacagttgtggtgaaattacaagtgatctttgtcgattttattttatagtgta

SEQ ID NO: 7082 - DNA, 201 bp, Homo sapiens
ttatttttccattatttttccaagatgttcagaagtcaattgcataaaaaaccacctttcacaatgtagatgatcaataaatataaaagggagttctgcasgttattatttcaatacgaggtgggagtttagtgcagcaggctgcagctgtgtgtgcaataaatatagaattagaattttccacattgagtttctgaaaaa

SEQ ID NO: 7083 - DNA, 201 bp, Homo sapiens
gggatttctagttagaggctttataaaggtagaatcatgcagacacatatacctggaaatattcggaacattctattagcagaaatgcaatgtaggaagcktattggttctagaagaatgtgtcattgtcagtaattggaattactgacagatccagttgaagtaaggggaaaaccacaaagagtctgtactcttaaaact

SEQ ID NO: 7084 - DNA, 201 bp, Homo sapiens
tgagacctaggggtggaagcttgggggtcaagtctgctttgagaggcaagatctcaggctgtgtgcagaacacttttgcacctcgtgtctcagtgatgggmggtcagggtgagcttccccaccaaaccccaacaggtgtttattataccctgtggggaggcagggagaggagagggaaatgtctcttctgaagaggcctag

SEQ ID NO: 7085 - DNA, 201 bp, Homo sapiens
caacccaaccttgcaagcccaattttccacctcattcctgagggacagacagtcactgttagctcaatcatatcctgatatagccttcctattccatgaaycctcacagtcttctgttagagacctaattgccgaagcttattcctcatatcaagatgaaactttactccttatagtttcactcttggccaggtgccgtgg

SEQ ID NO: 7086 - DNA, 201 bp, Homo sapiens
aataaaaataaaaaaagttaaaaaaatgtgtgtgtgtgtgttcattttaactgataaccaaattgactactattcttaccagcaggggcactatcatgttsccaatgtagaagtaaatataacacacgtgtgttctggatgactttaccaaatcaacatcattttaacaggaggcagaggccttgtcaatctaggaaggtt

SEQ ID NO: 7087 - DNA, 201 bp, Homo sapiens
aaagtctctgccaggtgttaggtgctggttcctatcattggttccatcaccccttaaagcggcttgcaacatccttgtaaagttctgttgttcggactcakgatcaagacacaaaacaattctcaggggcttgaatcagcccctcctagctgctactgggtgaacactgtgatttgtgacaggtaatttaaatgcaacaag

SEQ ID NO: 7088 - DNA, 201 bp, Homo sapiens
ggagatggaacaaaaatgccccccaaagctgcctcaatatcattaaaagttgggcagtgaggaagccaggaaatagaacacaaagcatgttgggctgagcyatagaataagagacttttgggatagtgaacaaactctacctcccctattttaagcagaaatcacaaccgattttgattccacttaataatttcctcgaca

SEQ ID NO: 7089 - DNA, 201 bp, Homo sapiens
ctcagcctcccaaagtgctgggattacaggtgtgagccccgcagccagtgtaattaatatgactcttgagactctttttatttcattgcatttttggtttyaaaaactgggtcttttgttgcagtttccaatagtctggattttgctgatgacatgcccatgatgtcatctaacaggcttatgccccctcccatatttgct

SEQ ID NO: 7090 - DNA, 201 bp, Homo sapiens
gaatgatcacacaactttaaaggaaaagacaattacccaacctcctttggaaacagaaatcaacagcattgttccttctggctgggtaccgagataagaawggaaatctgtagaaaatcctacaaccaaggaaaagaaatatgctactaccaagaaaaagtgcttatggagaagttgtcataacatgatgaactgaaatta

SEQ ID NO: 7091 - DNA, 201 bp, Homo sapiens
ctgtggaatacattcccctagggagagctgaccacagatggaatggctattcaggaaggcaatgagaaattcatctctggaggctgaatgaccggtttcayggattaggtgggtaagagaaggaagtcagtgtagtcatctataggtaccttcctcacagtaagcctggaactccatgagagaagttggaaactgagatgc

SEQ ID NO: 7092 - DNA, 201 bp, Homo sapiens
atggaaggcaggaaaccaagaacacagtgggagtataccaagtagagctgagttcttggacaaggctgaaattgtgcacactcccacttctggttgccttrgcaatgagactcccactttatacgaatgacatgagaatgagtaaaaccttatgcaaatgaagcacacagtaattagaggcagagccacatggagtctaga

SEQ ID NO: 7093 - DNA, 201 bp, Homo sapiens
ggaagctaaaattgtatttctaagcagaaatttgtggacccattttaatgacaagataaaacacatttctagttagcagcattccttgtacataaacaatytatctacccaaggctagaaaacggtatgccctcaagtagattaaatcaaccctgccgggtacccccaatgcctctttactactcatttgtttggcaaatg

SEQ ID NO: 7094 - DNA, 201 bp, Homo sapiens
aaaatactactatcatgaggccagggagaaatctgaactcgggaaagtggtgtgggggccagaatttgagaagagaagaagcctacgctggaatcgcactkagttcacgtcacttcccagatctggcttccaatggcctcttctcaccctctaaataaaatacgtaaatcctcaatgtggcctttacaatctgcctctttt

SEQ ID NO: 7095 - DNA, 201 bp, Homo sapiens
ccacctacctccaggctgctttaatctgagaaggaaataaacttctcttttgttttagcatttccaggcttatttattggcaaacacaattcctaaccaayatatgcacctgcccgaatactaaaatccaatgaatagagattcctgagattcctttacatactcatttccactcattcactctgatttaaatacagtcaa

SEQ ID NO: 7096 - DNA, 201 bp, Homo sapiens
taaaatacccacgaaaaattcacactccatctctgaatgaggaggctaggtttttccaacggtggagccacaaaagtctgttttgacaagttatctccccrtaaacatactggtttatctcatgctgaacaattagatgtgctatttaggcaaaataaaaaatatattgcacattttctagacagcctgttagcatccatg

SEQ ID NO: 7097 - DNA, 201 bp, Homo sapiens
ctcttgcagcctgcaggtcccaaaggaaattgtgtcattttatcttgcctagctccaaaaggagcagcctctgtcagaagatctcaatcatcataggcacrtcccaggtgtgtgtcctgcttctcatcaggcctccccatcttactagaccactaggttcagccctgacttgtaggaggggctgggcctccatagcttcta

SEQ ID NO: 7098 - DNA, 201 bp, Homo sapiens
cctaaatttaaacttcatatcacttcgccctctgatttaagcagggcattaggttcatctctaactctccctttctgtcaactgaagaacatggatctgcwccattcactgcacagtcaagctggggggcactgcagagaacaaggaaagaagaccaccaccagcagacatgggccatggcagctcttaacaatggcccca

SEQ ID NO: 7099 - DNA, 201 bp, Homo sapiens
tgcagtaaaggactaaaccagagatgatgctgcacccaccaaccaagtgcttcctctgccctgcgtgctcctcctctctcctccctcgtccaaggcattcygaaaagcacccttgtcttttgggcagagttccctttccaccctcgagctgtccccactgccttagcctggactaatctctccagggaacctctcctacat

SEQ ID NO: 7100 - DNA, 201 bp, Homo sapiens
gcttctaaaaacatacagttaatctacagcatctctcctacatttgctgcgtagcattggcaccttcactcaagtgacagtattatagtcaggtggcatcratcagctttaatcagccttatatttaagagctagagtctctgggtgttttagggaatacccgggcaacaaagtgaaaaaaaaaaacaaaaaaccttttgc

SEQ ID NO: 7101 - DNA, 201 bp, Homo sapiens
gtagggaagagattgtctgggaaactctgcccaagacatcaccagagagcccacgtagtgtggtttctctccttgtatcaatgagaatgaaacccaaagaraactgatgcatcacccagtgagtgaatataggagctacagtgaaacccatgtctcctgtcctcctactccaggtttctaaacaggaagcatcagaacctg

SEQ ID NO: 7102 - DNA, 201 bp, Homo sapiens
tccatcatgagtcaggacaggcggctcatgtggggaaaaggatgcattctttgtttttgctcctggctcagatttcggacacatcattgtaatcctctggycttctgttgcaccatcatgtcttcttacttgcaaagagtagtctgatattctacaggaattgcagatggaaagtttatttttgaacattctgtagtgagg

SEQ ID NO: 7103 - DNA, 201 bp, Homo sapiens
tccataactttttacacaaataataggttatgctttttgttctataactgtctgtttttacccaaaaacatgtcttggagacctctccataccagtatgargctctactttattctactagatgaatctttcccatggtgctcatgtgtcatgggttagccatggcactgcgattgatatttagtccatatctgttgttat

SEQ ID NO: 7104 - DNA, 201 bp, Homo sapiens
ttgctcaaatgagaaagaaaaaaaaaaaatcaacctgccaatctggtctttcctgcagtaaatgaaaactagctctgttcctgcatagaacagaagagtcmaggcagctaagtcacatgaccggagacaaaccagacagaaagaagtcacgtgggaccacaatgaacaagaggcagagacaggccggatgatggccaaatg

SEQ ID NO: 7105 - DNA, 201 bp, Homo sapiens
acctaaactcacattttgccacatctccacccatcctgcaccctccttctgaaatatcctccctcttccttgtcctgtttagtcactacagaactccattyctcaatagtcaactaactaacctctcaaagacatggactacctacatctgaatcactagaagcactaataaaaatgtaccttcttggccgggtgcggtgg

SEQ ID NO: 7106 - DNA, 201 bp, Homo sapiens
gaccacagaacaatggacttttcagaagagtccatggaatagaatctaacctttacaataaataacaacactcacatttaggtactgtctatttcccatcsaaaaggctttccatcagattttctctcttaggtcctattattattcccatgttagatatgaggctatgaggtatgagaaactctctctccaaagcctaaa

SEQ ID NO: 7107 - DNA, 201 bp, Homo sapiens
gcctatgcctacactatttcttctgcctggaattcttctccttattatctccccctactgaaatcctacccactcttttcaggcctagctcaaatgccaawactcccatggaacctaattctccatctggaattcatttttgcattttctttgcctttagaacacactttcccctcacttgtttattcatgagcccacatg

SEQ ID NO: 7108 - DNA, 201 bp, Homo sapiens
tggagtgaacatagcaataggagacagaggaaatggcgacaaagatggagcagctgcagatgtgctgggccccacagactatgggaataggttttagttgygccttaagtgcagtgggtagccatggaagcagtgtatgcaggggaataacagatctacattatattgttttaaaagatttctttggacactgaatagaga

SEQ ID NO: 7109 - DNA, 201 bp, Homo sapiens
cgcaccttccgcgctcagctcggcggccccggccgcggtggacaggctgtcggccgggccccggtgcgcaggcggcggcggttgtttctccttggctgccrcctcacgctgctcgtgctccacggcagcgctgctcgacacggatgccggccgcttgtgggcgcccagatcggtgggctgcgcggagcccaggctggcggc

SEQ ID NO: 7110 - DNA, 201 bp, Homo sapiens
ttaatgctaaaagttaaagaaaaaaaggtactgtaaatctgacaaatgacagaattcaggtgatatttccatagcgtgattttaaaatataataatgttgrtatctgagattacactcacttcagttgacatgagtttcatcatatatagaaaaagtatcaccttcaacttaaaaaaagtaaaggttaaaaggtggcacac

SEQ ID NO: 7111 - DNA, 201 bp, Homo sapiens
gcggggcactggttgccagagaggagtccgggaggctggcagggtgcactggctccagtcctcctgtgttgcctgctccctggccccccacctctctgggrcccagccttctttggttcatagaggacggagagggcggactgttgctattcctcctggtagtggagtgaacctggttggcatcttttgaggcatgactgc

SEQ ID NO: 7112 - DNA, 201 bp, Homo sapiens
catgcaacttaaaaccttcaggcgtacgggattctgaggcagcagactgatttaaaatggagccactgaaaatgacacgcttgtaactgcctgtttgtacrcatgcacaaaagtaccctcgtttgcactcaacatgtgactgctaatgtcccccaataggttaaaaggtgactggtgccctcatgctcccatccaagaatg

SEQ ID NO: 7113 - DNA, 201 bp, Homo sapiens
agaccataagagctgaattctttacaaatgtctttatgggcatgtaaaattgactctgcatttctgcatgtgtgcattcacataagagagaccagtctgcmctgagtcatatatactccaacttgaaaaagtaagtgtaacaactggttaatcatgcaagtctgtttgtaatataacaatgactggtaaaacatgaattct

SEQ ID NO: 7114 - DNA, 201 bp, Homo sapiens
gatttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaaga

SEQ ID NO: 7115 - DNA, 201 bp, Homo sapiens
atttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaagaa

SEQ ID NO: 7116 - DNA, 201 bp, Homo sapiens
tttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaagaag

SEQ ID NO: 7117 - DNA, 201 bp, Homo sapiens
ttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaagaagg

SEQ ID NO: 7118 - DNA, 201 bp, Homo sapiens
cccttttctcccctagaccccctcacttcacagccgcccctacctgctttagacccgttggccccgttggcctcgaaacccaacaacctgcctgcagtcarggccggctccttcttaaacttgctctcgaagggccccgagtggccgtgctggtgcagcgccagcagcgtgtcgcgcacggtcttgggcctgttgacccag

SEQ ID NO: 7119 - DNA, 201 bp, Homo sapiens
agccgcccctacctgctttagacccgttggccccgttggcctcgaaacccaacaacctgcctgcagtcagggccggctccttcttaaacttgctctcgaarggccccgagtggccgtgctggtgcagcgccagcagcgtgtcgcgcacggtcttgggcctgttgacccagtcctgctctccagacccgcggctcttgcccg

SEQ ID NO: 7120 - DNA, 201 bp, Homo sapiens
ggcgcgcgcggggccgcctcggggccgccgtggccaagctgctgctgctgctgcaaaaggatgtccttggcggagagcggcggcggcttggcggcggccgrggccgcggcgccgggtggggagcgaccctccgggaagcagccgtgcgcccgcttgagctgccgcgccgtctcgatgacgaactcgacgcggtcggcgccc

SEQ ID NO: 7121 - DNA, 201 bp, Homo sapiens
tggaaacacaaagaaataaaaggaaaaaggtaacataagtggcggtgcactgaaagagatcattctcttcctaacccgaaacaaaagtcgttacagaattyctcctctctaaaagcacagacagaaaatactcatatacgagtttcaggtgcacatgcaacttaaaaccttcaggcgtacgggattctgaggcagcagact

SEQ ID NO: 7122 - DNA, 201 bp, Homo sapiens
gtgaggcagtgggtggtggcggagacacaaaagaggatgtaggagtcatggggatcttgagcccctctgtggatgtggacagccacggctgggcctctccrttgatcttagggggcccgacttcaccttctggttctggagagggcttccttttccttgctgttcttgcaactggaaacacaaagaaataaaaggaaaaag

SEQ ID NO: 7123 - DNA, 201 bp, Homo sapiens
gggccgcttcaggcggtgtggtccggttggaatgaggtgaggcagtgggtggtggcggagacacaaaagaggatgtaggagtcatggggatcttgagcccytctgtggatgtggacagccacggctgggcctctccgttgatcttagggggcccgacttcaccttctggttctggagagggcttccttttccttgctgttc

SEQ ID NO: 7124 - DNA, 201 bp, Homo sapiens
ttatccaaaacggcaggatggttctgtattaatctttttggaaagcatgtctgtattaagattgcaaaacatacagatagctaccacaaattaggtcaaaygactgatcaagttgtaacatctgtgaggtcaaattcctataataaagtgcctagatacacatttatacaacagaccataagagctgaattctttacaaat

SEQ ID NO: 7125 - DNA, 201 bp, Homo sapiens
gcagcgtgtcgcgcacggtcttgggcctgttgacccagtcctgctctccagacccgcggctcttgcccgcaccttccgcgctcagctcggcggccccggcmgcggtggacaggctgtcggccgggccccggtgcgcaggcggcggcggttgtttctccttggctgccgcctcacgctgctcgtgctccacggcagcgctgc

SEQ ID NO: 7126 - DNA, 201 bp, Homo sapiens
gcacagacagaaaatactcatatacgagtttcaggtgcacatgcaacttaaaaccttcaggcgtacgggattctgaggcagcagactgatttaaaatggasccactgaaaatgacacgcttgtaactgcctgtttgtacacatgcacaaaagtaccctcgtttgcactcaacatgtgactgctaatgtcccccaataggtt

SEQ ID NO: 7127 - DNA, 201 bp, Homo sapiens
aatctgatactgcccatgtacagtaagtagctttgtgacatttttatccagctgtggagaatctctgcactgtcatcaggtacaacaaaagatcaaacccmtgtcccgatgttaactttttaacttaaaagaatgccagaaaacccagatcaacactttccagctacgagccgtccacaaaggccacccaaaggccagtca

SEQ ID NO: 7128 - DNA, 201 bp, Homo sapiens
tctttatgggcatgtaaaattgactctgcatttctgcatgtgtgcattcacataagagagaccagtctgcactgagtcatatatactccaacttgaaaaastaagtgtaacaactggttaatcatgcaagtctgtttgtaatataacaatgactggtaaaacatgaattctcgcacagtagtaataggtgcactcattaaa

SEQ ID NO: 7129 - DNA, 201 bp, Homo sapiens
agcaagcattttcttcagcttccagtggcttttctcaaaattaacttctttacatgcccaactactcttgacagttacttttgcttcagtctgggcaattkgttgaaaataagaacagagagaacattacttcacatgacaattcctttgggaacgcatacttcaaattttatcagcatagccctttcacacaaggatgtt

SEQ ID NO: 7130 - DNA, 201 bp, Homo sapiens
tacctaaatactttctgcacgaattttttcctttagccacctgtcaaagagatgtttagggatgacaatccttgaaacagaactactagatgaaattgctyattgagttgctgttcattcactgatcactctcatccttcacagttttttgaagaggcgcagtctactgaagcatacctgaaggggctccaggactccatc

SEQ ID NO: 7131 - DNA, 201 bp, Homo sapiens
gtcttgagcctgttgccttgaagagctggggtctcggggaatgattggtctattaataatttaatcagccacttgcaattcagccttctttgaaatggtcrtgaaaaatccttccttcctgaaaacttctccgtgtggaggccattatccttagcaaacttatgcgggaacagaaaaccaaataccacatgttctcactta

SEQ ID NO: 7132 - DNA, 201 bp, Homo sapiens
ccttgcttgaagagcaaatgaaactctgtcatctcgttctttaagatacagaccatctgcaacattttccgccaacaccaccgttgttttaaggtttctgytaggtgtcttccagaaaagtgcctcatttgaaatgtacattgaatgagcttcattgtagagaaaaataggtattctaggaacatcttgaaaggagaatgg

SEQ ID NO: 7133 - DNA, 201 bp, Homo sapiens
cgatcataactgagcttctggactgtttaggcgttggcttaaggaagccattgcaccagtgaaggagggagggaatgaaagtctgaaccagggtgagggcrgtggatggaaaagtaggtattgccaaggtggagtgacagcttcagctaagaattggatgcgagagacaagggagagtctgagaaaacaggcccagagctc

SEQ ID NO: 7134 - DNA, 201 bp, Homo sapiens
actatcccacaaacacaatctgccaaacacacagtgtgaaaatcgagaaaaccgcctggaaaagaagcagaacttttattagagtactgtttctgtagctsctgggcgaagacaaaatgcaggatcaaaggaggctgtctttctaaaatctatagagacaaaaaatccaccatgtttgctcactgctggagtgggaatggg

SEQ ID NO: 7135 - DNA, 201 bp, Homo sapiens
taggattccccattgaaacatttaattttgggcaggctccatgttttttccttgtgtagtatcatcccgtgctctgtttttccaacttaaagcctacttayaaacttgtcaagtctcacatctctctgggaaggggaaagagacccaagtgaaaaattacctgactttgaggaaggatgttttttcttctcattaatgttg

SEQ ID NO: 7136 - DNA, 201 bp, Homo sapiens
atgaactttttttcctttatctttctgaatatttttatttttttaagacaaggtcttgttctttcgcccaggttggagtgcagtggtgcaatctcggctcrctgcagcctctgcctcccaggttcaaccatctcatctcagcctcccatctcagcctcccgagtagctgggacttacaggcgtgtgccttcatgcccagct

SEQ ID NO: 7137 - DNA, 201 bp, Homo sapiens
tctggacgactgggagactcgggtcccgaaggtggaaaggtttttttgccccaggtcccgaaagaacttcccggccgcgctgggagcaggaccgggtgtcytgacgcgtgcggggacaggttggcccctgtcctgcgaacagggactcggtcgtacctttctcccctcccgcgagcccgggcgggtggtcagagggggcgt

SEQ ID NO: 7138 - DNA, 201 bp, Homo sapiens
tatatcatttgctaagatcatatgagcagctggtgcaagaattatgatgagaatccagatttcttgaatttttgcctagtcactctttgcatgtatgtctrtgtgtgtaaagagaaatgagaatgcacattggtctgggaggggaaaagtactgcttctttcttggaatgtgaggtgtttttcttttgacataatctctga

SEQ ID NO: 7139 - DNA, 201 bp, Homo sapiens
tacagatgaggtagctcagactcaaagataatatatcatttgctaagatcatatgagcagctggtgcaagaattatgatgagaatccagatttcttgaatwtttgcctagtcactctttgcatgtatgtctgtgtgtgtaaagagaaatgagaatgcacattggtctgggaggggaaaagtactgcttctttcttggaatg

SEQ ID NO: 7140 - DNA, 201 bp, Homo sapiens
gaatttgctttatttctctgtgttaaagataacatcttggactaggtatatttgaattttttatattcagtgattgttccctttattcctcatttatgatrcttaaattgagattatatgtaaacttattttaatgtaaacttgaaataaagggaatataatttatgaaatcataagcttttgattttgaaagaaattacc

SEQ ID NO: 7141 - DNA, 201 bp, Homo sapiens
catgtgtttttatgattgaataatattccattgtttggcagtgccacattttgttgatcttttcatcagttgatacctgagttgtttccagtttttggctrtgataaaaagtgctgctatgaacattcatgtataagtttttatgtgggaatatgatcagttttcttgggtatatatcaagtgaatttctgggtgattcta

SEQ ID NO: 7142 - DNA, 201 bp, Homo sapiens
cctagcaggagagggagatcctttaggagtgacagggatggaagtgaggagaggggcacagaaagtaccttttggggtcccccgagccctttttctctttktagttggagcagctttgctgggctctgctttacatttagggcttctgaataatatttcgttgaagaaaaatattctgtaggcaaaaaaaaaaaaaaaaaa

SEQ ID NO: 7143 - DNA, 201 bp, Homo sapiens
aatatcaatattcactcattgtaggaagaacattcgtttaacaggttgtccatggcagattcctttaaaccatttagtatcgaaatcttcaaccacacacwgaatagggagagtagtgtagtaagctgctgtgtgctcatgaccaagctttgggtcattggcatctaatgcacctgccatcctgccttagacctctgtcaa

SEQ ID NO: 7144 - DNA, 201 bp, Homo sapiens
tgaagaaaaggaggcttagaagggccactcttttctatacaatccacaaggggatttatatctacctgctttttgttgtcttctagcgcgagaaatctgckatctaccagttggaggaggagtatgaaaacctgctggtaagctgatttatttctcaagtgcatcgactttctgttgtttccaattcaattcagttcaaga

SEQ ID NO: 7145 - DNA, 201 bp, Homo sapiens
agttcccagggaggtctgggctcctcacccacattcatctagtcctggcttgttggggagccttgcctgcagggaggaaccccaaatgggtggccaaaaamgaaatgctttcccatggtgagacagtgcagccaggtgcttcgggagaattcccacattactgtgatcttatcccatctatgcataatgcaaccattgttt

SEQ ID NO: 7146 - DNA, 201 bp, Homo sapiens
cttgcttgtatctcagcagtatgagaaacggacctcatttcctgtataattcggagtggaagacagagactggttgcattggtggtgggtgggggcagtcytggtttcgagagctggatggctctggcaccacctcccctgggcctgcctggaggagcctgtgtcttcttctgggagtagttcccagggaggtctgggctc

SEQ ID NO: 7147 - DNA, 201 bp, Homo sapiens
ttttatttttttttaacagcggggttttatgctgtgttgcccaggctagtcttgaactcctgagctcaagcaatccttttgccttggcctcccaaagtgckgggattacaggcgtgccccaccctcatcttatagctcagtttgtgattgtttttacagtggcacacattattaaatcatttaggaaactctgactttcca

SEQ ID NO: 7148 - DNA, 201 bp, Homo sapiens
atagttttagatttgcagaaaagttacaaaatagtacaaagtttgtgtataccctcacccagtttcccatgcctccatcattttatttttttttaacagckgggttttatgctgtgttgcccaggctagtcttgaactcctgagctcaagcaatccttttgccttggcctcccaaagtgcggggattacaggcgtgcccca

SEQ ID NO: 7149 - DNA, 201 bp, Homo sapiens
gtggattccctataccttagttggcctgagtctccctctatcttgttttgatggaccgagccattcacaaggtatatacctagttccttttctcgcctcgktctgtttccaaagggaattcttggccacacctaagactgaagttggattcttacagatgaaagatagaagtagaccttgttttaaggatcagacgcggtc

SEQ ID NO: 7150 - DNA, 201 bp, Homo sapiens
acctggcaaggtggattccctataccttagttggcctgagtctccctctatcttgttttgatggaccgagccattcacaaggtatatacctagttcctttkctcgcctcggtctgtttccaaagggaattcttggccacacctaagactgaagttggattcttacagatgaaagatagaagtagaccttgttttaaggatc

SEQ ID NO: 7151 - DNA, 201 bp, Homo sapiens
ctaagacaagcaaactgacctggcaaggtggattccctataccttagttggcctgagtctccctctatcttgttttgatggaccgagccattcacaaggtrtatacctagttccttttctcgcctcggtctgtttccaaagggaattcttggccacacctaagactgaagttggattcttacagatgaaagatagaagtag

SEQ ID NO: 7152 - DNA, 201 bp, Homo sapiens
aatccagtgctacacatacagctggtgtatgtctgacatcagactgacccgatgggtcgaaatcatttccgctgaacttcctccctgattaagtacagcgrgttctgtgtggattcttcattgggctaagacaagcaaactgacctggcaaggtggattccctataccttagttggcctgagtctccctctatcttgtttt

SEQ ID NO: 7153 - DNA, 201 bp, Homo sapiens
gcttgttaatttaattcctaacatgatttgaaaatctttcaacccctaacacccatatgtagcagtattaaaaatttctttgagggtagggatttaaaaamatgtgtatacgcttgtaagtacatcattttaaaattatttctttatccattatagaattttgcattttcccaaactgcactatatgaattaaatttaatt

SEQ ID NO: 7154 - DNA, 201 bp, Homo sapiens
gagcttttgaaatcagggtaatgagatgagccataataccctcagatgggtcttttgtttgcctttgtttttcttccactttactaagccaaacaaacatkcattaagtaccttctgtgtgccgaaccttatttatgttgttaggttaagtgtttgtaggagtccaagatgactaagacatgggactttgctctccaggag

SEQ ID NO: 7155 - DNA, 201 bp, Homo sapiens
aggaagaattccctgtggcgtcaaagcttcctctccgggacccactgcgggacccggagcgagatccggagcgagatcccgagcgggagccggagcgggascccggagccgaagacatgttgtaagggctgggtaagcccttggacgacacggaggcggcttccagaaggcgcagcccagtgatatcttctaccatggagc

SEQ ID NO: 7156 - DNA, 201 bp, Homo sapiens
atatatcatttgctaagatcatatgagcagctggtgcaagaattatgatgagaatccagatttcttgaatttttgcctagtcactctttgcatgtatgtcygtgtgtgtaaagagaaatgagaatgcacattggtctgggaggggaaaagtactgcttctttcttggaatgtgaggtgtttttcttttgacataatctctg

SEQ ID NO: 7157 - DNA, 201 bp, Homo sapiens
aacatggatttggacacatcctggtgaaactgtatttcctctaaaggtttagtgtaatactgcttgtttgtaagtctggggttacttccatgctccaataygctgctttaaatgaacttaagtaatagtcataatattgcaacaactttgccaaacaaaagtcacttgatttaatgtttggttaaggaatttgctttattt

SEQ ID NO: 7158 - DNA, 201 bp, Homo sapiens
atttctctaagacctagggaatcctaaatgatgtctttaaactttaagacaattttctaacacgtgagtctttaagtgaccctgatctgggctttcctttrtggagacggtgctgccaggccagcaagggtttgctttccaaccgcctaggaaaaagtccccatgggtgaaatatctcatagagctagtaattctttcttt

SEQ ID NO: 7159 - DNA, 201 bp, Homo sapiens
aataggtattctaggaacatcttgaaaggagaatgggtttgttttgcgataaagacaatgtatttaaattttccatcactttcttcacaccatgatttttwaaaaaaacattattgtcttttacaggaattacagaaaatatatatatatatttttacagacagggtctcactctgtcaccgaggcaagagtgcagtgctg

SEQ ID NO: 7160 - DNA, 201 bp, Homo sapiens
actacagtaggctgtgctgtggcataatatatcttggtaaatttaaaagccagactttggttataccttgcttgaagagcaaatgaaactctgtcatctckttctttaagatacagaccatctgcaacattttccgccaacaccaccgttgttttaaggtttctgctaggtgtcttccagaaaagtgcctcatttgaaatg

SEQ ID NO: 7161 - DNA, 201 bp, Homo sapiens
caacttcttgtagcacatccgtgaggacttttcacagacattaaataatcacttggtctgctttaaatctctctgaaaccaaactacagtaggctgtgctrtggcataatatatcttggtaaatttaaaagccagactttggttataccttgcttgaagagcaaatgaaactctgtcatctcgttctttaagatacagacc

SEQ ID NO: 7162 - DNA, 201 bp, Homo sapiens
aaaatgtgccaagcaatagaaggaatgaaaacttgggttttcattacatttgttttaaaattttgccagccatttaaatctgaaatttaaattttctcccscagtcctccaggatttgagatgcacatcctttaaatgtgtgggttacacacagtttaaatccaagtcagaatagaatgcgaaggactctttagtagctct

SEQ ID NO: 7163 - DNA, 201 bp, Homo sapiens
agcccccgcgggcgagcgcacctggggccctgcctctgagccttttgtttcctcctttttaaaaacaccggatgaaagaccccagtgtgccttggatcgcmgagcgccggccgcatgtctgctttgatccagaatgtgtgggcaggggagtgggggggtgggagaggacgacgctgggggcccgccctggcctaggcgccc

SEQ ID NO: 7164 - DNA, 201 bp, Homo sapiens
aatttcagaaccataacaacagcagcagcctccgcaagtaagagctatcactaagtgaggtctccgcctctgcagtgcccctctgagcctcacctcagccycaggaggggggtgttctacctgtcacagaggcagaagctccaggcactgccagtggatgtcactttaagttgctcaaggtcacaggctgtataactggaa

SEQ ID NO: 7165 - DNA, 201 bp, Homo sapiens
aaccctttcatagtcgatcctcaggcgtgtcagttcttgctcctgaaccttcagtttgtttattgtctccgtcgcactactgtttgctttctgcaggtcayactggaccctttgtaatctcgcgttttcatcttccaggcatttccggtcatttgtttctttgtcgatcagttgttttaacctttctatctccttgttttt

SEQ ID NO: 7166 - DNA, 201 bp, Homo sapiens
aaatgtttagaaatcccacttcttaaatggggaagtggaatcagtagccctattagagattatgttaacacttgaagaggagttaaaccagaggctgaggktgtgcaaacactcatttgcagtttgtgaataagtctctttaggggtggcagtttgtttctgcggtaagcagaacatctttttgaataggggaaatgcaac

SEQ ID NO: 7167 - DNA, 201 bp, Homo sapiens
cctgtctggtggccgagtggtgctcggggctccgcagtctctaccggctcacccccaatccccagtaaccccgagaccacgactgcaacgactcctggacycctcggccacccaaggacgtttgtatcaaggctgcgcgtcccggcggcgcggggtcctgtcccgaggaggcgcttcggcttcccctgtccgggaaacgaa

SEQ ID NO: 7168 - DNA, 201 bp, Homo sapiens
acaatagaccaaaaaacagacaaaataaatttttatctgctttgacgttgttccctttcattactagctgtgagaggcaaatcttcacagactaattatgycactggcaattttatgtgcttcttttgctctttccagcttatgcacagtaagggcactgctccaggctattctccaaacagaagacatgttaaaggttta

SEQ ID NO: 7169 - DNA, 201 bp, Homo sapiens; identical to SEQ ID NO: 550

SEQ ID NO: 7170 - DNA, 201 bp, Homo sapiens; identical to SEQ ID NO: 571

SEQ ID NO: 7171 - DNA, 201 bp, Homo sapiens
ttccttctcctaacccttaatttaaaaataacttatttaacttctacagacaatatttgtgtgtggctgggttggtgtgtgtgtgtgtgtgtgtgtgtgtrtatatctatatattatatatataattatataattacataatatatatttatctataatatatattttatataatatatatcttcatatatttgtattgct

SEQ ID NO: 7172 - DNA, 201 bp, Homo sapiens
atataatttatgaaatcataagcttttgattttgaaagaaattacctcattttacagatgaggtagctcagactcaaagataatatatcatttgctaagakcatatgagcagctggtgcaagaattatgatgagaatccagatttcttgaatttttgcctagtcactctttgcatgtatgtctgtgtgtgtaaagagaaat

SEQ ID NO: 7173 - DNA, 201 bp, Homo sapiens
aaacaaactaaaagctgtttgattgcttactgcaggttcgctctgggatttgctgtggctcctttcctcttatcgcttgttcccctgcatgctttacctcrttcccaggagactgagctgcagggcccagctgataagggaactgttgccccagcagccagtcaggaggcaggcactcctgagccaggtttttgttttgtt

SEQ ID NO: 7174 - DNA, 201 bp, Homo sapiens
ccttggcctcccaaagtattgggtttacaggtgtgagccaccacgcccagccagttttatgtcgttttctaacagaagcaattgataagcgatgctttccrggttaggcacgcagccctcatggttgcaaacaaactaaaagctgtttgattgcttactgcaggttcgctctgggatttgctgtggctcctttcctcttat

SEQ ID NO: 7175 - DNA, 201 bp, Homo sapiens
tcctttgaaggcagcacaaatgttcccaaggaaaggtttgcttacttggtattttgcaactttattatgtatctctaatacaaagtgaccatttcattatrggtgttaactgtacctccctttagaggacagaaagccctttggcatggcatttgactttttttttttttttttttttttttgagacagggtctcgctctg

SEQ ID NO: 7176 - DNA, 201 bp, Homo sapiens
tcgcagagcgccggccgcatgtctgctttgatccagaatgtgtgggcaggggagtgggggggtgggagaggacgacgctgggggcccgccctggcctaggygccccgggaagaccccccggtgagagggtcagcttctccggatcccagcggaaacagaccgagggcgtcatttgggtgggtggggaagagatcctgtccc

SEQ ID NO: 7177 - DNA, 201 bp, Homo sapiens
taccggctcacccccaatccccagtaaccccgagaccacgactgcaacgactcctggactcctcggccacccaaggacgtttgtatcaaggctgcgcgtcycggcggcgcggggtcctgtcccgaggaggcgcttcggcttcccctgtccgggaaacgaaacttccccgccggggcggctgccgggcccgggtctcgaagt

SEQ ID NO: 7178 - DNA, 201 bp, Homo sapiens
ccttttggttgttcacaagataatgtcacttgaagggaaccactgaagaaaacagaggttttgttttttgtgtaagttaggcgtaacagatgctcttttcrtggactgcctgtatgcagctttgttagaaatggaaggagaatgcatcacgatagccaaccctgtgcaggccaggtgccatccagggtcttagagaaacgg

SEQ ID NO: 7179 - DNA, 201 bp, Homo sapiens
tttcagaaactggaaaatatcaatggtgttacagatggctacttaaataggtaaactcagctaacactaatctcatattttccttttctcaagcttctttytctgggtcttcatttgctttagatgcttgccttacagtttctctgttactagagatttacttacatccttctgtggtttggagagcatgttaattccgct

SEQ ID NO: 7180 - DNA, 201 bp, Homo sapiens
gacaagcggaaaatacagtctcagttcaccgatgcccagaagcattaccagaccctggtcattcagctccctggctatccccagcaccagacaggtcggcytgggacatctttctctttgtatcaaccatccataccattttaaaaagaaaggagtttgcataaaactggtttcagaaccatttctctgaatgctatatag

SEQ ID NO: 7181 - DNA, 201 bp, Homo sapiens; identical to SEQ ID NO: 558

SEQ ID NO: 7182 - DNA, 201 bp, Homo sapiens
tgaactacttacaagatctggagactattacaggttcttaagtgagatgctgaagagtttggaagatctgaaggtaatttatactgtcttttcttgtagcrtcaaaaaagaaaatagaatagaaccttattattacttccacattataacatggatttggacacatcctggtgaaactgtatttcctctaaaggtttagtg

SEQ ID NO: 7183 - DNA, 201 bp, Homo sapiens
acattgaactacttacaagatctggagactattacaggttcttaagtgagatgctgaagagtttggaagatctgaaggtaatttatactgtcttttcttgkagcatcaaaaaagaaaatagaatagaaccttattattacttccacattataacatggatttggacacatcctggtgaaactgtatttcctctaaaggttt

SEQ ID NO: 7184 - DNA, 201 bp, Homo sapiens
ccaacagttcaaccttcttgctgtgtagcagtgcttttgtgtctcgtcaagcaagtcagctcagccctccttagaggttctggtctgtccaatagagaacrggagggattagcatatggctgattatgagagaaagaagcaatactaattcaggtggcctgacaagcaagccagaagtgcctgtggaaaagtcatgcactc

SEQ ID NO: 7185 - DNA, 201 bp, Homo sapiens
aagcactgggattacaggtgtgaaccactgtgtccggccaatatttttgtagagtaagcttttttctcctctcctacctttccttcagcccgacttgccastgaaatcttcatgctctgtgtctgacaccatgaggtcttcctgcagagggacttgtggtgttggggactgtcattagggaccgctgtgggatgaagcagg

SEQ ID NO: 7186 - DNA, 201 bp, Homo sapiens
ttctggattggatcctggacctgggaggggaaaacttgctgtgaatgacattattgggctaattggtgaaatctgaacaagttctataaattagaaaatcrtttgtgtcaattgtaaattttctgcttctcatcattgtattgtggttatatataagtgaatgtttttattcttaggaatgatatgctaagatatttgggg

SEQ ID NO: 7187 - DNA, 201 bp, Homo sapiens
ttatatataagtgaatgtttttattcttaggaatgatatgctaagatatttgggggttaaaaagccatgttctcaaatgattcagaaaaaaataatatgtrtacatagataaatatatgctgaaatatttgggggtagaagggcatggttattctcaagtggttcagaaaaaataatatatacacacagataaatacacac

SEQ ID NO: 7188 - DNA, 201 bp, Homo sapiens
tttgcaaaagcatggatgaatgtgggggacattatgctaagtgaaatacaccagacacaaatactgcttgatttcacttatgtgtaaattctaagaaaaargttgaatgcagggaaacagagagtaggatggtgattaccggggtggggagggaggaggaaatgggaagatgtaaaggatacaaacttgcatttgtgtggg

SEQ ID NO: 7189 - DNA, 201 bp, Homo sapiens
atggatgaatgtgggggacattatgctaagtgaaatacaccagacacaaatactgcttgatttcacttatgtgtaaattctaagaaaaaagttgaatgcakggaaacagagagtaggatggtgattaccggggtggggagggaggaggaaatgggaagatgtaaaggatacaaacttgcatttgtgtgggatgaataaatc

SEQ ID NO: 7190 - DNA, 201 bp, Homo sapiens
tcacttctgcctgtctcctttcagctgaaaacaatgcggcaggaagattacatgaagacgatagccgaccttgagttacattaccaagagttcatcagaartagccaaggctcagagatgtttggagatgatgacaagcggaaaatacagtctcagttcaccgatgcccagaagcattaccagaccctggtcattcagctc

SEQ ID NO: 7191 - DNA, 201 bp, Homo sapiens
cctgtgatgagtgttgctttgagtcccatctagtgggtggcattttttggccaactcttcttgattgcattgtggggcagtcataaatcccaaatcacttytgcctgtctcctttcagctgaaaacaatgcggcaggaagattacatgaagacgatagccgaccttgagttacattaccaagagttcatcagaaatagcca

SEQ ID NO: 7192 - DNA, 201 bp, Homo sapiens
aaagccaaaccctggggttgcttgccttacagaaaatcgtgcataagggggatgagtgtatcctgaaggacaacaacgagcgcagcaagtggtacgtgacrggcccgggaggcgttgacatgcttgttccctctgtggggctgatcatccctcctccgaacccactggccgtggacctctcttgcaagtaagtcatccaag

SEQ ID NO: 7193 - DNA, 201 bp, Homo sapiens
aggctaagacagctgacattttcttgtttcaggcctatatggacactctgcagacgcagtggagttggattcttcagatcaccaagtgcattgatgttcayctgaaagaaaatgctgcctactttcaggtttttatatttagtgataattttgttgttatttaggtcttaatacctaatcttttgagtgtgttttataaag

SEQ ID NO: 7194 - DNA, 201 bp, Homo sapiens
tttcagccttaaaaatgctgtgattcttgaggaaaacagcgtgattctttggcattgttcatttccaaaatgcagttttgtatttcacttttaaaaagtamtgtgggggtgatggaagtttaatgatgacttgctgcaaaggatttcttatttcttcattcacagatacgcatgagtcaactggaagttaaagaaaaagag

SEQ ID NO: 7195 - DNA, 201 bp, Homo sapiens
gctgcagaacatcattcaggccacgtccagggagatcatgtggatcaatgactgcgaggaggaggagctgctgtacgactggagcgacaagaacaccaacwtcgctcagaaacaggaggccttctccgtaagttcaccccacgcggctgtagatgcttgtcttgagcctgttgccttgaagagctggggtctcggggaatg

SEQ ID NO: 7196 - DNA, 201 bp, Homo sapiens
ttgtggagacggtgctgccaggccagcaagggtttgctttccaaccgcctaggaaaaagtccccatgggtgaaatatctcatagagctagtaattctttcyttctatggagggatctgaggccagtatctgaagaaaaggaggcttagaagggccactcttttctatacaatccacaaggggatttatatctacctgcttt

SEQ ID NO: 7197 - DNA, 201 bp, Homo sapiens; identical to SEQ ID NO: 573

SEQ ID NO: 7198 - DNA, 201 bp, Homo sapiens; identical to SEQ ID NO: 553

SEQ ID NO: 7199 - DNA, 201 bp, Homo sapiens; identical to SEQ ID NO: 560

SEQ ID NO: 7200 - DNA, 201 bp, Homo sapiens; identical to SEQ ID NO: 569

SEQ ID NO: 7201 - DNA, 201 bp, Homo sapiens; identical to SEQ ID NO: 552

SEQ ID NO: 7202 - DNA, 201 bp, Homo sapiens
aagatcattttcactggcgaaacttacagtttttgtcatgtttacagtggaagctcttgcttccattaatgcccatgaaggttttcttcctggtagtatgygttttccttcatgtgagtgttttctttcaggaattgaagtatggagatggaatacaactgactcggagtcgagaattggatgagtgttttgcccaggcca

SEQ ID NO: 7203 - DNA, 201 bp, Homo sapiens
gggcctattcactgacctctttcacgtagtgtttagagacacgctttttcagaacagactacagagagatgtgtgtcttcttaacctatttgtaatgttgktttaacaatgagaaccagctttcagacagttccccgtccccctcccaacaaatgtttacactacagattgccacctttttggaaataaagcaatttatga

SEQ ID NO: 7204 - DNA, 201 bp, Homo sapiens
ctgacctctttcacgtagtgtttagagacacgctttttcagaacagactacagagagatgtgtgtcttcttaacctatttgtaatgttggtttaacaatgrgaaccagctttcagacagttccccgtccccctcccaacaaatgtttacactacagattgccacctttttggaaataaagcaatttatgatttacgtgact

SEQ ID NO: 7205 - DNA, 201 bp, Homo sapiens; identical to SEQ ID NO: 551

SEQ ID NO: 7206 - DNA, 201 bp, Homo sapiens; identical to SEQ ID NO: 568

SEQ ID NO: 7207 - DNA, 201 bp, Homo sapiens
cgcggatcaacactctgggccgcatgatccgcgccgagtctggcccggacctgcgctacgaggtgaccagcggcggcgggggcaccagcaggatgtactaytctcggcgcggcgtgatcaccgaccagaactcggacggctactggtgggtacctgcccggagagcgcgggctgcggggctcgcgggacagggagggaccg

SEQ ID NO: 7208 - DNA, 201 bp, Homo sapiens; identical to SEQ ID NO: 575

SEQ ID NO: 7209 - DNA, 201 bp, Homo sapiens
gctctctgctaagtgaatgatgattaagaatttcataagtatttttctgacccgaaggttttctaaataaaggtttttgtggttttcttttctttctttctttttttttttttagcatgaaaactagtataaaaactattggttgactttaaactcatttatttcaaaaactgctactttatggctgaattattaatagat

SEQ ID NO: 7210 - DNA, 201 bp, Homo sapiens
actgcagtcttgaccactcaggcttaagtgactctcccacctcagcctctcgagtagcttgggaccacaggcgtgcgccaccatacacaactaattaaaattttttttttttttttgtagagacaaggtctcgctatcttgcccaggctggtcttgaactcctgggctcaagtgatcctcccaccttggccttccaaagtg

SEQ ID NO: 7211 - DNA, 201 bp, Homo sapiens
ctgcagtcttgaccactcaggcttaagtgactctcccacctcagcctctcgagtagcttgggaccacaggcgtgcgccaccatacacaactaattaaaattttttttttttttttgtagagacaaggtctcgctatcttgcccaggctggtcttgaactcctgggctcaagtgatcctcccaccttggccttccaaagtgc

SEQ ID NO: 7212 - DNA, 201 bp, Homo sapiens
gaaaactccttgcagaaggctgtaacttttgaagttctgaacttttgaaggatggctaacacagcatttcagctgatgtatatagagagtgtttaatgaatttttttttttttgagacggagttttgctcttgttgcccaggctggagggcaatggcgcgatctcggctcactgcaacctccacctcccaggttcaagcga

SEQ ID NO: 7213 - DNA, 201 bp, Homo sapiens
gcctcccaggttcaaccatctcatctcagcctcccatctcagcctcccgagtagctgggacttacaggcgtgtgccttcatgcccagctgttttgtttttktttttttttctgtagagatggggtttcgccatgttgcccaggctgatcttaaactcctgggttcaagcaatccggcggcctctgcctcccaaagtgctgg

SEQ ID NO: 7214 - DNA, 201 bp, Homo sapiens
ggctgggagtggtgcctcccatctgtaatcccagcactttgggaggccaaggcgggtggatcccttgaggtcaggagtttgagaccaggctggccaaaatktggtgaaaccctgtctctactaaaaatacaaaaattagctttgcgtggtggcagtgtgcctgtaatcccagctacttgggaggctgaggcagaagaatca

SEQ ID NO: 7215 - DNA, 201 bp, Homo sapiens
tctctactaaaaatacaaaaattagctttgcgtggtggcagtgtgcctgtaatcccagctacttgggaggctgaggcagaagaatcacttgaacccaggakgtggaggttgcaatgagctgagattgtgccactgcactccagcctgggcgacagagtgagactccttctcaaaaaaaaaaaacaggcatgtttcctgaag

SEQ ID NO: 7216 - DNA, 201 bp, Homo sapiens
tgaggcagaagaatcacttgaacccaggatgtggaggttgcaatgagctgagattgtgccactgcactccagcctgggcgacagagtgagactccttctcaaaaaaaaaaaacaggcatgtttcctgaagcaagctctcctggctctcgtgctgaagaatccagtgctacacatacagctggtgtatgtctgacatcagac

SEQ ID NO: 7217 - DNA, 201 bp, Homo sapiens
aagatgctgtgcaaaacatgtaagttttttagtggatatcaggaacatatgagacagggcgcggtggctcacgcctgtaatcctaacactttgggaggccraggtgggcagatcatttgaggtcaggagtttgagaccagcctgaccaacatggtgaaaccccatctctattaaaaatacaaaaaaaaaaaaatagctggg

SEQ ID NO: 7218 - DNA, 201 bp, Homo sapiens
tcaggaacatatgagacagggcgcggtggctcacgcctgtaatcctaacactttgggaggccgaggtgggcagatcatttgaggtcaggagtttgagaccrgcctgaccaacatggtgaaaccccatctctattaaaaatacaaaaaaaaaaaaatagctgggcgtggtggtgcatgcctgtagtcccagctactccagag

SEQ ID NO: 7219 - DNA, 201 bp, Homo sapiens
gggagaattcccacattactgtgatcttatcccatctatgcataatgcaaccattgtttgtcaaacatttttttttaaacagtgaaattctttctttaaaacacacacacacacacacacacacacacacacacacacacacacacacacacacacacacccagttggttagacaggcatcagataaaagcaggctcaggc

SEQ ID NO: 7220 - DNA, 201 bp, Homo sapiens
ggagaattcccacattactgtgatcttatcccatctatgcataatgcaaccattgtttgtcaaacatttttttttaaacagtgaaattctttctttaaaacacacacacacacacacacacacacacacacacacacacacacacacacacacacacacccagttggttagacaggcatcagataaaagcaggctcaggct

SEQ ID NO: 7221 - DNA, 201 bp, Homo sapiens
gagaattcccacattactgtgatcttatcccatctatgcataatgcaaccattgtttgtcaaacatttttttttaaacagtgaaattctttctttaaaacacacacacacacacacacacacacacacacacacacacacacacacacacacacacacccagttggttagacaggcatcagataaaagcaggctcaggctg

SEQ ID NO: 7222 - DNA, 201 bp, Homo sapiens
agaattcccacattactgtgatcttatcccatctatgcataatgcaaccattgtttgtcaaacatttttttttaaacagtgaaattctttctttaaaacacacacacacacacacacacacacacacacacacacacacacacacacacacacacacccagttggttagacaggcatcagataaaagcaggctcaggctgg

SEQ ID NO: 7223 - DNA, 201 bp, Homo sapiens
aaattttctgcttctcatcattgtattgtggttatatataagtgaatgtttttattcttaggaatgatatgctaagatatttgggggttaaaaagccatgwtctcaaatgattcagaaaaaaataatatgtatacatagataaatatatgctgaaatatttgggggtagaagggcatggttattctcaagtggttcagaaa

SEQ ID NO: 7224 - DNA, 201 bp, Homo sapiens
aaccagatgaatttacgggctctgtttagataacattttaatattctaatttcttaatttagatattgtgtgggttctagttctgaatttcttcatccagktaaaaaaagaatgtcacgttagtccatgttcagagatatttggggctcagcaaactagcttggctccagttctagttgtttcgagtgtctgatttgaaac

SEQ ID NO: 7225 - DNA, 201 bp, Homo sapiens
atttcttcatccagttaaaaaaagaatgtcacgttagtccatgttcagagatatttggggctcagcaaactagcttggctccagttctagttgtttcgagygtctgatttgaaacatactccttgaaatgttcctcgcagtggcccgattcctttacacaaaacaaaatagcagacaccagtgacttaatagtgaacatac

SEQ ID NO: 7226 - DNA, 201 bp, Homo sapiens
tcaaaaaaataaaaataaaaataaaaaaagaactaaaacattatgttctcataaggtataggaaaaactctgtgcataagaggccccatctgtaccactgtaccataatggtacagtgtccttgtcacaatgagattcccattatatgagacttgtgtgtaaatatgaaagatcagcatttaacatactgaagcaagggga

SEQ ID NO: 7227 - DNA, 201 bp, Homo sapiens
caaaaaaataaaaataaaaataaaaaaagaactaaaacattatgttctcataaggtataggaaaaactctgtgcataagaggccccatctgtaccactgtaccataatggtacagtgtccttgtcacaatgagattcccattatatgagacttgtgtgtaaatatgaaagatcagcatttaacatactgaagcaaggggaa

SEQ ID NO: 7228 - DNA, 201 bp, Homo sapiens
aaaaaaataaaaataaaaataaaaaaagaactaaaacattatgttctcataaggtataggaaaaactctgtgcataagaggccccatctgtaccactgtaccataatggtacagtgtccttgtcacaatgagattcccattatatgagacttgtgtgtaaatatgaaagatcagcatttaacatactgaagcaaggggaag

SEQ ID NO: 7229 - DNA, 201 bp, Homo sapiens
ttgtatttatgttgggtgtagcttaagaatgtagtaaatgctcaatgtctttaaattttggaaaagtattaccacatgaattcagttttatgtcattttcttttttttttttttgagagggagtctcactctgttgcccaggcaggagtgcagtggcatgatctcgtctcactgcaacctctatctcccgggttcaagcaa

SEQ ID NO: 7230 - DNA, 201 bp, Homo sapiens
tgtatttatgttgggtgtagcttaagaatgtagtaaatgctcaatgtctttaaattttggaaaagtattaccacatgaattcagttttatgtcattttcttttttttttttttgagagggagtctcactctgttgcccaggcaggagtgcagtggcatgatctcgtctcactgcaacctctatctcccgggttcaagcaat

SEQ ID NO: 7231 - DNA, 201 bp, Homo sapiens
ttaagaatgattaaatgagtattttataacatatcatacatatatatgcacacatatgttctgtgcacatgcttgcttgcctgtgcacaggtagatttggttttttttttttttcagaagacatgatcttggttttcaggttcccatttctaaatttccttctctgcccatcttgagctggggtcaagcaagttgagggaa

SEQ ID NO: 7232 - DNA, 201 bp, Homo sapiens
gggttgagaattacagcataaaatcataactgatcttaagtgcttagtttcccgcaggtctctacacttgtaaatcactaaactttttttttttttttttwcctgagaccatagcttctcatcctcatttcttcttctggctttttggggcttacttttgtccacctgagcccctgaccaactttctccttcatttctcta

SEQ ID NO: 7233 - DNA, 201 bp, Homo sapiens
gtaaatgaatgagtgtgcctgtattccaataaaactttatttacaaatagaagtgggccacatgtggcccttgagctatagtttggtgaccgctgccctakactgccatctttgggccacgctcaaggctgacattagctggtaccactggtatggccatactgcttgttaaaaaacacagaaagttccatatcagttggt

SEQ ID NO: 7234 - DNA, 201 bp, Homo sapiens
ctctgcctcctgggttcaagtgattctcccgcctcagcttcctgagtagctgggattacaggcatgcaccaccatgcccggctaattttatatttttagtrgagacagggtttctccgtgttggtcaggctggttttgaactcccgatctcaggggatctgcccggctcggcctcccaaagtgccaggattatgggtgtga

SEQ ID NO: 7235 - DNA, 201 bp, Homo sapiens
tccagtgtgagtcattgatgtatgatacattttcagaaatgatcaggaatctgttatttagagtctttgtagaaattgggcttaaatttctgggtttgatragacttctaaaaagtggaaaatacagaaatttctaaaagacagcctcttctcaaagatgtcagagactatcgtacctgtcagatggtttaggggaaacag

SEQ ID NO: 7236 - DNA, 201 bp, Homo sapiens
ttgaccgggtctcgggagctggactctagatgcccacgtgagccgtgcgcgttttgcagcccgccccacctccccgccccctgctagttgttcccacgtcsggcttttgggaaagaggccctgagcgccgggacgttatttaccaggcgttgtggccctaggcctgggaggagcaacctgaatgcgctccagggagttttg

SEQ ID NO: 7237 - DNA, 201 bp, Homo sapiens
actgcaacctctatctcccgggttcaagcaattctcctgcttcagcctgccgagtatctgggactacaggcgtgtgccaccatggcaagctgattttttgyatttttagtagagacgggggttttgccatattggtcaggctgatctcgaactcctgaccttgtgatccgcccgccttggcctcccaaagtattgggttta

SEQ ID NO: 7238 - DNA, 201 bp, Homo sapiens
cacacacacacgtcatttgtagtgactatggatacgttttacatgtagctctgaaaattttgcatggcctcatgttctcagtttatttttgcttatatgcrtcaacgtgcaataaataaaaacaggttagggaaatagtgtcatatttgctaacatttctgtttagagaaaagaggttcatttgactaaagccaagtaaaa

SEQ ID NO: 7239 - DNA, 201 bp, Homo sapiens
gtgcgcgttttgcagcccgccccacctccccgccccctgctagttgttcccacgtcgggcttttgggaaagaggccctgagcgccgggacgttatttaccrggcgttgtggccctaggcctgggaggagcaacctgaatgcgctccagggagttttgttttgcaagcagttttgaaggcagggactactcgagttgcaacc

SEQ ID NO: 7240 - DNA, 201 bp, Homo sapiens
catgatctcgtctcactgcaacctctatctcccgggttcaagcaattctcctgcttcagcctgccgagtatctgggactacaggcgtgtgccaccatggcmagctgattttttgcatttttagtagagacgggggttttgccatattggtcaggctgatctcgaactcctgaccttgtgatccgcccgccttggcctccca

SEQ ID NO: 7241 - DNA, 201 bp, Homo sapiens
acttctttttacagtgaccacaactgaaatcactcatcatggaacctgccaagatgtcaaccataataaagtaattgaaaccaacagagaaaatgacaagyaagaaacatggatgctgatggagctgcagaagattcgcaggcagatagagcactgcgagggcaggatgactctcaaaaacctccctctagcagaccaggg

SEQ ID NO: 7242 - DNA, 201 bp, Homo sapiens
ttgaacctcctgtgcagaaagcgtcctttgagaggatggatcacctgcgacagctgcagaacatcattcaggccacgtccagggagatcatgtggatcaakgactgcgaggaggaggagctgctgtacgactggagcgacaagaacaccaacatcgctcagaaacaggaggccttctccgtaagttcaccccacgcggctg

SEQ ID NO: 7243 - DNA, 201 bp, Homo sapiens; identical to SEQ ID NO: 576

SEQ ID NO: 7244 - DNA, 201 bp, Homo sapiens
tggatcacctgcgacagctgcagaacatcattcaggccacgtccagggagatcatgtggatcaatgactgcgaggaggaggagctgctgtacgactggagsgacaagaacaccaacatcgctcagaaacaggaggccttctccgtaagttcaccccacgcggctgtagatgcttgtcttgagcctgttgccttgaagagct

SEQ ID NO: 7245 - DNA, 201 bp, Homo sapiens
ctattctccaaacagaagacatgttaaaggtttatgaagccaggctcactgaggaggaaactgtctgcctggacctggataaagtggaagcttaccgctgwggactgaaggtaacttgaaagcttataacagtggcccaacttacaggaactaattcagatctgagctcccaattataaagcctcactgggttttcatgag

SEQ ID NO: 7246 - DNA, 201 bp, Homo sapiens
atgcttttgctagcttggatttcttatcttttaaatagacaataatcagtactattaatcgaatatttcactcccttggcttcttataccttttgtagggragtaaaactttaataaattaagtggttaatgaactgcatcaaggtacatgttttattaggattccccattgaaacatttaattttgggcaggctccatgt

SEQ ID NO: 7247 - DNA, 201 bp, Homo sapiens
ctcggtctgtttccaaagggaattcttggccacacctaagactgaagttggattcttacagatgaaagatagaagtagaccttgttttaaggatcagacgyggtcttgaaaagttgtgtatatgatgaaatttcgttaatcagatcacacttcccaatagacaaataatgatatcaaagattctttatttcattgttccaa

SEQ ID NO: 7248 - DNA, 201 bp, Homo sapiens
tatgatgagaatccagatttcttgaatttttgcctagtcactctttgcatgtatgtctgtgtgtgtaaagagaaatgagaatgcacattggtctgggaggrgaaaagtactgcttctttcttggaatgtgaggtgtttttcttttgacataatctctgatttcattccacagctgaaaaataccaagatcgaagttttgga

SEQ ID NO: 7249 - DNA, 201 bp, Homo sapiens
ggctgaggcaggagaatcacttgaacccaggaagtggaggttgcagtgagccgagatcatgccactgcactccagcctgggtgacagagcaagactccatytcggaaaaaaaaaaaaaaaaagaacatatggaaatggaaatcctttagaaaagcacgaagaatttatttggtattattagcagcatataaagttacctgt

SEQ ID NO: 7250 - DNA, 201 bp, Homo sapiens
ctcttttttttcttatcaccccgcctccattttgctgcaggacatccttaaagttatggactggggcaaagacaaaacacaaaaacgaaatttctgccggrcgcggtggctcacgcctgtaatccagcactttgggaggccgaggtgggcggatcacaaggtcaggagttccagcccagcctagccaatatggtgaaaccc

SEQ ID NO: 7251 - DNA, 201 bp, Homo sapiens
cctcatggttgcaaacaaactaaaagctgtttgattgcttactgcaggttcgctctgggatttgctgtggctcctttcctcttatcgcttgttcccctgcrtgctttacctcattcccaggagactgagctgcagggcccagctgataagggaactgttgccccagcagccagtcaggaggcaggcactcctgagccaggt

SEQ ID NO: 7252 - DNA, 201 bp, Homo sapiens; identical to SEQ ID NO: 570

SEQ ID NO: 7253 - DNA, 201 bp, Homo sapiens
ggtgtagcaggtatgataacctgaaacaaaactccccacattttttcaaagcataattattgttaagagtaagacaggtctgcaacttacagttccttctrtagaaaaaaatagtaagtatgaagccatttattgaagtggcaacatatacagaatttttcccacaaatttgtaaaataacaagctcacagtgtatccagg

SEQ ID NO: 7254 - DNA, 201 bp, Homo sapiens
gacagtgataaaaatgcaaccatcttggaactaaggagccagctgcagatcagcaacaaccggaccctggaactgcaggggctgattaatgatttacagakagagagggaaaatttgagacaggaaattgagaaattccaaaagcaggctttagaggtattcacaaatacttgatcacagcttcactgtttctcaaattat

SEQ ID NO: 7255 - DNA, 201 bp, Homo sapiens
catatgagcagctggtgcaagaattatgatgagaatccagatttcttgaatttttgcctagtcactctttgcatgtatgtctgtgtgtgtaaagagaaatragaatgcacattggtctgggaggggaaaagtactgcttctttcttggaatgtgaggtgtttttcttttgacataatctctgatttcattccacagctgaa

SEQ ID NO: 7256 - DNA, 201 bp, Homo sapiens
tcccattacagggtaccactttaagaggtttaatagcaggttatgtgccctccagtgtgagtcattgatgtatgatacattttcagaaatgatcaggaatstgttatttagagtctttgtagaaattgggcttaaatttctgggtttgatgagacttctaaaaagtggaaaatacagaaatttctaaaagacagcctcttc

SEQ ID NO: 7257 - DNA, 201 bp, Homo sapiens
tcagtccccttctggggtgattctgcaagaggtatatatgtcatcacatatctcttaaaacctgcccctccttctgcttcttcccttttccctgtctcctrcctcttcccttttccctgtctcctgcctgtcttccttaccattgctgatttcatcccattacagggtaccactttaagaggtttaatagcaggttatgtg

SEQ ID NO: 7258 - DNA, 201 bp, Homo sapiens
actttgcgccaattcaattaaggtatgttggtttcataaagaatgttggtatttcaccaagattattattaactgcatgacttgctgatttgttgtaaagmgtatacacttcctgaggatagcaattacggtctgtatatattcttttctgaacaaaccataaaaattaaaaatctattagcttgaattcattccacattg

SEQ ID NO: 7259 - DNA, 201 bp, Homo sapiens
taacattggtaaatatttcactttttgtatagaacttgcacagtgaaatatctggcaaacgagacaaatcagaggaagtacaaaaaattgctgaactttgygccaattcaattaaggtatgttggtttcataaagaatgttggtatttcaccaagattattattaactgcatgacttgctgatttgttgtaaagagtatac

SEQ ID NO: 7260 - DNA, 201 bp, Homo sapiens
cctcttacagatagtaagttaaagggcttgcttctcttctctgaatggaaaaaatgctcatctcctaagctgtaactataaaaatatgagacaagtacatrtagtaataaactgaaaaaagggtacaaataacagtggtaaaagagtgaaatcacatttatttaaaaatatttgtatgcattaacattggtaaatatttca

SEQ ID NO: 7261 - DNA, 201 bp, Homo sapiens
ccagaacttgagaattcttcagcgaatacaaaatgttggtctgaatcacaatagaccaaaaaacagacaaaataaatttttatctgctttgacgttgttcyctttcattactagctgtgagaggcaaatcttcacagactaattatgtcactggcaattttatgtgcttcttttgctctttccagcttatgcacagtaagg

SEQ ID NO: 7262 - DNA, 201 bp, Homo sapiens
caaaacatcattagtagacacatgactatacacacacacagtggggtactatttacctttaaaaaagaaagagatcctggggccaggtgcggtggctcacrcctgtaatcccagcactttgggaggccgaggcgggtggatcacaaggtcaggagttcaagaccagcatgaccaacatggtgaaaccccatctctactaaa

SEQ ID NO: 7263 - DNA, 201 bp, Homo sapiens
aagaaacatggatgctgatggagctgcagaagattcgcaggcagatagagcactgcgagggcaggatgactctcaaaaacctccctctagcagaccagggrtcttctcaccacatcacagtgaaaattaacgagcttaaggtaggtatctgctagtattttgcctggttaccctgtatatttttatttacctgtaaatgaa

SEQ ID NO: 7264 - DNA, 201 bp, Homo sapiens
cagtgttcttcgtgcactaaattttcagaattgattctgaaattcaaaggaagaaggtatacttttaggtagtatggatgttttttgaggcctagcacctwgatacctaggtattctctgatttttgtggccctaacttctttttacagtgaccacaactgaaatcactcatcatggaacctgccaagatgtcaaccataa

SEQ ID NO: 7265 - DNA, 201 bp, Homo sapiens
gaccctggtcattcagctccctggctatccccagcaccagacaggtcggcttgggacatctttctctttgtatcaaccatccataccattttaaaaagaarggagtttgcataaaactggtttcagaaccatttctctgaatgctatatagccagtgttcttcgtgcactaaattttcagaattgattctgaaattcaaag

SEQ ID NO: 7266 - DNA, 201 bp, Homo sapiens
agataattcagaatgtacttttggggagtaaatgaatccaaatccatgaactgttttcaaagttatacctctacctgttactttatcagtgactgttgtargtttttgtgcagtggtgtgagcgtgtccaggtttcccatttgggatgaagtgtgaaagcctggctctagcatgttttccctttgtgcctcttaggattga

SEQ ID NO: 7267 - DNA, 201 bp, Homo sapiens
taccttttaggctcacatgtattatttaaagcatcggtattgttgggttgtatgatgatcagcttcatttgaggggaaaaacgtaaaagctttaataattygcatgtgttcatctctgtttccatcattgagaaaaaaaataaaaacacatacttatgaataaagccaaaccctggggttgcttgccttacagaaaatcgt

SEQ ID NO: 7268 - DNA, 201 bp, Homo sapiens
tgcagttggctctgattagtattattgtacaatgcacgcccagagccaagcaagcattttcttcagcttccagtggcttttctcaaaattaacttctttayatgcccaactactcttgacagttacttttgcttcagtctgggcaattggttgaaaataagaacagagagaacattacttcacatgacaattcctttggga

SEQ ID NO: 7269 - DNA, 201 bp, Homo sapiens
aagaactggtacgttcagataacccaggatgtgtgtggcactgcaggagggtgggtggaagcctgggattagaaaacctcaggatggatgtagctcttctytcctcctgtgtcatcttgagtaagcctccgccacatcctctcctgtagcaaacatccttttcagccttaaaaatgctgtgattcttgaggaaaacagcgt

SEQ ID NO: 7270 - DNA, 201 bp, Homo sapiens
gaggtggaaggagggagaggatcaggcaagataactaatgggtactaggcttaatcgtgggtgatgaaataacctgtacaacaaatccctgtgatacaagwttacctgtgtaacaaacctgcacatgtatccctgaacttaaaataaaagttaaaaagaaaaagaggggcaataccttgtttaatatcccagaagaccgta

SEQ ID NO: 7271 - DNA, 201 bp, Homo sapiens
taattattgatgggtacaaaaatacagttagatagaaggagtaagttctaatatttgatagtacaatagggatattatagttaatgataatttattgtatrtttcaaaatagcttgaagaaaatatttgtaatgttcccaacacacagaaaagataaatgttcgaggtgatggatatcccacttatcctgatttgatcatt

SEQ ID NO: 7272 - DNA, 201 bp, Homo sapiens
tgctgttctgttttcaagttgtgtcacataaatggcacttgttaagtacttgcagttgaagcaagaaaacgttgccacttgtgaattgtggtcttttttaygaagtgtaagcaaaaataaaagttatttttctcaagatagaggtctaccagatcgtcatcacaattttatgacactcagtcatatcagttacttgattca

SEQ ID NO: 7273 - DNA, 201 bp, Homo sapiens
aagtgcatcgactttctgttgtttccaattcaattcagttcaagaaatatcaagcacatcctggcggggaggcacctgttcatcgatgctaatgttgttgstgctgctgagtttcctttagaagtgaattttaaaagttgttttcttttctttttttcttttaagtagagacagggtttcaccatgttcaccatgttaacc

SEQ ID NO: 7274 - DNA, 201 bp, Homo sapiens
ccatttcattataggtgttaactgtacctccctttagaggacagaaagccctttggcatggcatttgactttttttttttttttttttttttttgagacarggtctcgctctgtcacccaggctggagtgcagtggcacaaatgtggctcgccgcagcctcaacctcctgggctcaagcaatcctcccacttcagcctatc

SEQ ID NO: 7275 - DNA, 201 bp, Homo sapiens
ttaaaaaacagagcaaacccaccaatgttttaagccaatgtttggttgccttacctcctttatcctggatgtaattcgtttctaactgtggtataactaaycagtctagttcttgggtaaaaagaagttggcaagttttatattttgtggtcaaatgaatttgatctcataaattcacttttaaaaatgtgtatgtacact

SEQ ID NO: 7276 - DNA, 201 bp, Homo sapiens
atgcgccaccacgccaggctaattttgtatttttagtagagacggggtttctccatgttggtcaggctggtctggaactcccgacctcaggtgatcctccygcctcagcctcctgaagtgttgggattacaggcgtgagccaccgtacccggctagtgaatcttagaggtaaagtatcatccttaaatgaagtattaaaaa

SEQ ID NO: 7277 - DNA, 201 bp, Homo sapiens
taccctcagatgggtcttttgtttgcctttgtttttcttccactttactaagccaaacaaacatgcattaagtaccttctgtgtgccgaaccttatttatrttgttaggttaagtgtttgtaggagtccaagatgactaagacatgggactttgctctccaggagcaggtagccaggtgtgtttaaactaatgcaagagag

SEQ ID NO: 7278 - DNA, 201 bp, Homo sapiens
acaaaaaatccaccatgtttgctcactgctggagtgggaatggggaggggagagctgtgctctctggttgagcttttgaaatcagggtaatgagatgagcmataataccctcagatgggtcttttgtttgcctttgtttttcttccactttactaagccaaacaaacatgcattaagtaccttctgtgtgccgaaccttat

SEQ ID NO: 7279 - DNA, 201 bp, Homo sapiens
tatggtgaaaccccgtctctactaaaaatacaaaaattagctgggcgtggtggcgggctcctgtagtcgcaactgctcaggaggctgaggcagaagaatcrcttgaacccgggaggcagaggttgcagcgagctgagatcatgccactgcactccagcctgggcaacagagcgagactccgtgaaaaaaaaaaagaaagaa

SEQ ID NO: 7280 - DNA, 201 bp, Homo sapiens
ggccttgttgctgcagctgggagcagtgcctcaccccttgattttctccatctccctcccgctgggctggtcccagtggccctgccgcttgaaaacgttcrgatgtggttctgattttgaagtcacggccccacagatcctaagactcagacatgagctgctcatttgaggtgacatcttgtaaaatactagtgcagtcca

SEQ ID NO: 7281 - DNA, 201 bp, Homo sapiens
acagatgggaagctgaggttaaaatatttaaatggcttgcctaaggtcacacagctagttaagttgttaagctagatttgaatccagtataccacaatgaygcaagagaagattaaacctgcagtgtgagaattcaccttttctacttgtaaacccttttctatctgagttattacttatttttaatctgttgaattcctc

SEQ ID NO: 7282 - DNA, 201 bp, Homo sapiens
aggggagatcaaggtggaaatctatagccttgaaaggagtgtaggcccttccaaggaagataagtacacgaagactagcacgcaaaagcggaatgcacagkaggggtgtacgtgacttcagagacttcacaaggaggtgagagaacatctgtcgtgggggcactgggaagactttataaaggaagtggtgtcgaactagac

SEQ ID NO: 7283 - DNA, 201 bp, Homo sapiens
tacattttaaagttagtcttaaattaggttttaagagaagcttatttcttactatgagacaaacaggtcaatttgcctgaattttagagcggggggacccmtaaggatcacttagcctaggcagaaaccccacacgcacacttcagagacaggaagctgaggacgtgccgaagatcctagaatccacttagggctgggttg

SEQ ID NO: 7284 - DNA, 201 bp, Homo sapiens
tcaagctcagggcttgagtcgggaggcggtcattctttccggggatcctggcaatggaggttcctctcgagcctgacccagcctgcagtggtgctactgastacaaaatagcccacaaatgctgacttctgcgttttcaaataatagcgaccgcctgaaggcagggcatgtcgcagtttttctggtggcattctggttttg

SEQ ID NO: 7285 - DNA, 201 bp, Homo sapiens
gtatcatcccgtgctctgtttttccaacttaaagcctacttacaaacttgtcaagtctcacatctctctgggaaggggaaagagacccaagtgaaaaattrcctgactttgaggaaggatgttttttcttctcattaatgttgctctgcccggcagcagggcgtcaagctcagggcttgagtcgggaggcggtcattcttt

SEQ ID NO: 7286 - DNA, 201 bp, Homo sapiens
accttttgtaggggagtaaaactttaataaattaagtggttaatgaactgcatcaaggtacatgttttattaggattccccattgaaacatttaattttgrgcaggctccatgttttttccttgtgtagtatcatcccgtgctctgtttttccaacttaaagcctacttacaaacttgtcaagtctcacatctctctggga

SEQ ID NO: 7287 - DNA, 201 bp, Homo sapiens
cgaaggactctttagtagctctttttggcgttttcatgaaccaagtatttattttgattattatttataactatgcttttgctagcttggatttcttatcytttaaatagacaataatcagtactattaatcgaatatttcactcccttggcttcttataccttttgtaggggagtaaaactttaataaattaagtggtta

SEQ ID NO: 7288 - DNA, 201 bp, Homo sapiens
gtcagaatagaatgcgaaggactctttagtagctctttttggcgttttcatgaaccaagtatttattttgattattatttataactatgcttttgctagcytggatttcttatcttttaaatagacaataatcagtactattaatcgaatatttcactcccttggcttcttataccttttgtaggggagtaaaactttaat

SEQ ID NO: 7289 - DNA, 201 bp, Homo sapiens
tttgtttcctgaacaaaatgtgtctggggatttccagggaaaatgtgccaagcaatagaaggaatgaaaacttgggttttcattacatttgttttaaaatkttgccagccatttaaatctgaaatttaaattttctcccgcagtcctccaggatttgagatgcacatcctttaaatgtgtgggttacacacagtttaaatc

SEQ ID NO: 7290 - DNA, 201 bp, Homo sapiens
tctcgggagctggactctagatgcccacgtgagccgtgcgcgttttgcagcccgccccacctccccgccccctgctagttgttcccacgtcgggcttttgsgaaagaggccctgagcgccgggacgttatttaccaggcgttgtggccctaggcctgggaggagcaacctgaatgcgctccagggagttttgttttgcaag

SEQ ID NO: 7291 - DNA, 201 bp, Homo sapiens
gataaatacacacacatctatggagaggggagaagggggataaaagaaacacaacaaaatgttaacaattgggattccgggtaaagggtctcacaggagtsgttttgtcccgtttttgcaacttttgcaagtttgaaattatttcagaattgaaataggttatttgatgtctggtttctctgtgtttgcctccttagtcaa

SEQ ID NO: 7292 - DNA, 201 bp, Homo sapiens
ggttagacaggcatcagataaaagcaggctcaggctggccctggctgaaggtaggaagagccaacttcttgtagcacatccgtgaggacttttcacagacrttaaataatcacttggtctgctttaaatctctctgaaaccaaactacagtaggctgtgctgtggcataatatatcttggtaaatttaaaagccagacttt

SEQ ID NO: 7293 - DNA, 201 bp, Homo sapiens
ctggaggagcctgtgtcttcttctgggagtagttcccagggaggtctgggctcctcacccacattcatctagtcctggcttgttggggagccttgcctgcmgggaggaaccccaaatgggtggccaaaaaagaaatgctttcccatggtgagacagtgcagccaggtgcttcgggagaattcccacattactgtgatctta

SEQ ID NO: 7294 - DNA, 201 bp, Homo sapiens
gccttggcttcccaaagcactgggattacaggtgtgaaccactgtgtccggccaatatttttgtagagtaagcttttttctcctctcctacctttccttcwgcccgacttgccagtgaaatcttcatgctctgtgtctgacaccatgaggtcttcctgcagagggacttgtggtgttggggactgtcattagggaccgctg

SEQ ID NO: 7295 - DNA, 201 bp, Homo sapiens
tttcagagaaaatgactatattgagataacaattctatctgagaaacagaaaaatggggaaaaataggcaatggaaaattgaggagaaatggtaacatttstgagaaccttgcgatgtttcttaagataactgagacatcctaggatctcatcgaatccagattagaaatcatggagttcgtggtatttgctgtgtgaagt

SEQ ID NO: 7296 - DNA, 201 bp, Homo sapiens
gagtattttataacatatcatacatatatatgcacacatatgttctgtgcacatgcttgcttgcctgtgcacaggtagatttggttttttttttttttcaraagacatgatcttggttttcaggttcccatttctaaatttccttctctgcccatcttgagctggggtcaagcaagttgagggaagtatttggcaaccctg

SEQ ID NO: 7297 - DNA, 201 bp, Homo sapiens
cctaggaaaaagtccccatgggtgaaatatctcatagagctagtaattctttctttctatggagggatctgaggccagtatctgaagaaaaggaggcttaraagggccactcttttctatacaatccacaaggggatttatatctacctgctttttgttgtcttctagcgcgagaaatctgcgatctaccagttggaggag

SEQ ID NO: 7298 - DNA, 201 bp, Homo sapiens
tttcataaagaatgttggtatttcaccaagattattattaactgcatgacttgctgatttgttgtaaagagtatacacttcctgaggatagcaattacggkctgtatatattcttttctgaacaaaccataaaaattaaaaatctattagcttgaattcattccacattggcagtatccatttgaatggctggtttctatt

SEQ ID NO: 7299 - DNA, 201 bp, Homo sapiens; identical to SEQ ID NO: 578

SEQ ID NO: 7300 - DNA, 201 bp, Homo sapiens
gttcttgggtaaaaagaagttggcaagttttatattttgtggtcaaatgaatttgatctcataaattcacttttaaaaatgtgtatgtacacttcggtgcrttcattcacaattgtgtttgtcctccctgtctctgttttttaatacattttaattctagaatagttttagatttgcagaaaagttacaaaatagtacaaa

SEQ ID NO: 7301 - DNA, 201 bp, Homo sapiens
agtttaatgatgacttgctgcaaaggatttcttatttcttcattcacagatacgcatgagtcaactggaagttaaagaaaaagagctcaataagctgaaayaagaaagtgaccaacttgtcctcaatcagcatccagcttcagacaaaattgaggtaggcttcatgaggtttatatttttgttagaaaaaaaaaaactttt

SEQ ID NO: 7302 - DNA, 201 bp, Homo sapiens; identical to SEQ ID NO: 580

SEQ ID NO: 7303 - DNA, 201 bp, Homo sapiens; identical to SEQ ID NO: 579

SEQ ID NO: 7304 - DNA, 201 bp, Homo sapiens
gttttcttgggtatatatcaagtgaatttctgggtgattctatgttacatattttaggaactaataagataatgattttattgtatctatttccccccagrttatgggacctggagaaacaaatcaagcaattgaggaattatcgtgataactatcaggctttctgcaagtggctctatgatgctaaacgccgccaggatt

SEQ ID NO: 7305 - DNA, 201 bp, Homo sapiens
tcttgtatttttaaaaataatatttttggcaacacatgtaaagctaatgccttaggacagctagttttggagtcctatttttaaagaaaaatgtttttttraaggtagtaaaataaaaccttgaaatcttggtaatattgttcacatattcatgtggtccgtctttggattagaatccagaacttgttttctttttaacca

SEQ ID NO: 7306 - DNA, 201 bp, Homo sapiens
catcttctgtgccactgaaatgggatttaaaaatcgaacttcatggcttgttaatttaattcctaacatgatttgaaaatctttcaacccctaacacccayatgtagcagtattaaaaatttctttgagggtagggatttaaaaaaatgtgtatacgcttgtaagtacatcattttaaaattatttctttatccattatag

SEQ ID NO: 7307 - DNA, 100 bp, Homo sapiens
ataaagtggaaattcatataaatgaagtcaaggtatagcaaccactcccwactgactactagtgcccaatagaactactgctaaatgagtaggaataaga

SEQ ID NO: 7308 - DNA, 201 bp, Homo sapiens
cctgctggtaagctgatttatttctcaagtgcatcgactttctgttgtttccaattcaattcagttcaagaaatatcaagcacatcctggcggggaggcasctgttcatcgatgctaatgttgttgctgctgctgagtttcctttagaagtgaattttaaaagttgttttcttttctttttttcttttaagtagagacagg

SEQ ID NO: 7309 - DNA, 201 bp, Homo sapiens
taaataatgtcactcgtggtgacacagtgattttcctattgggctggggtgtgacttatggcactttgaatttttggggagaaggtaggaaaagcttgatwtctctaacagtccattttcccccttatagtccaaaactaattattgatgggtacaaaaatacagttagatagaaggagtaagttctaatatttgatagta

SEQ ID NO: 7310 - DNA, 201 bp, Homo sapiens; identical to SEQ ID NO: 591

SEQ ID NO: 7311 - DNA, 201 bp, Homo sapiens; identical to SEQ ID NO: 590

SEQ ID NO: 7312 - DNA, 201 bp, Homo sapiens; identical to SEQ ID NO: 589

SEQ ID NO: 7313 - DNA, 201 bp, Homo sapiens; identical to SEQ ID NO: 622

SEQ ID NO: 7314 - DNA, 201 bp, Homo sapiens
tgcctttccacttttgtgttctgctgcctacctctttttaaaagcctacttggtaaactcctcctcatcctttaagacccatctcagccatttcctgaagmctttttctcacttgttcaagcagagctgatcatcttttccattttgttgccaccctacctagcttatagttgttcttgagcttaatagttattattatcg

SEQ ID NO: 7315 - DNA, 201 bp, Homo sapiens
attccttccttcctctttctcttattctttctttctttttcctgctaattcctcaaataagggtatgtagggtcagagagaacatctaaattttgacagtsaattttgcctttgttagtaaaattttgatagcttgagagatgtgaattaataccgaattagtaaatgtaaatcatttgaggtctatttctgtagtccagc

SEQ ID NO: 7316 - DNA, 201 bp, Homo sapiens
ctaccattggtttgatatagaatattacactttagactggtgtgtctgtgtacgtatactggagaccagtggtaacacaaactgattaacattcttttctrtgttttaggaatgaagaaaggcgatcagcttcagtagattcacggcagtctggtggaagctatttggatgctgagtgttcacgacatagaagggatagga

SEQ ID NO: 7317 - DNA, 201 bp, Homo sapiens
gttatagcaacttcaaatttaatattgctgtaaaacttttatctactattcatattccagtttgaccattgccttttctgtgttctctaaactgcacaagwcccacagtcaattatgtcatagcacttagtaaatatttgattgttagcactgatttttctagcgttacagtcttaattttttgagcagttttcttacctg

SEQ ID NO: 7318 - DNA, 201 bp, Homo sapiens
cacccagcttcaaaaattgaaataaaagattggcaagggcttcatagagaaaagcatttgagggaaagggagaagcaaggaggaataaaggaatgtctgctattgactcttgcctatgtggtggagcctgagctaggtggattctgtgcaaatagcaggcttcaaggcgcttacatagagctgctgacagggaggcttgta

SEQ ID NO: 7319 - DNA, 201 bp, Homo sapiens
aaacaagttaaaatataggattgtgatgtatttatttgataattcatagaatttaaaagctttgaaggatataatacttttattttattctttcattagayaatagtcgaaaaagtccaaaatcctaccttgaaatcctggcagaagtacgagattataaaagaagacgccagtcctatagagccaagaatgttcacataa

SEQ ID NO: 7320 - DNA, 201 bp, Homo sapiens
ttgggggttcctgaacaaattctgcatggatactgagggatatttactcagtacctgaggttttactctgacttttacattaaatgtaccttctttctgtraaaatattacaactgtgctgttactttaatctatgtacctaagcactcttatgttcaactaatggctggagagaagaaatgatataaaacttagcccgtg

SEQ ID NO: 7321 - DNA, 201 bp, Homo sapiens
ggctggtcccaaactcctggcctcaagtgatcctcctgtcttggcctcccaaagtgctgggattacaacgtgagccactgtacccggcctgtattaggtawtgaaagtaatttagagatgacttcaagtgtactggagggtgtgtgtaggttatatacaaatactacaccattttatatcagagacttgagcatccatgga

SEQ ID NO: 7322 - DNA, 201 bp, Homo sapiens
tttgtgatctaactcaagctgatcgtcttgccctctatgatttcgtagttgaggagacaaagaaaaagcgctctgattctcaaattattgaaaatgacagygatctctttgtagacttggctgccaaaatcaatcaaggtttgagatgcacatcatggctttacatttcttcattatcattttattctatgagtgttatta

SEQ ID NO: 7323 - DNA, 201 bp, Homo sapiens; identical to SEQ ID NO: 601

SEQ ID NO: 7324 - DNA, 201 bp, Homo sapiens; identical to SEQ ID NO: 600

SEQ ID NO: 7325 - DNA, 201 bp, Homo sapiens
gctactttgaaacaagttaaaatataggattgtgatgtatttatttgataattcatagaatttaaaagctttgaaggatataatacttttattttattctytcattagacaatagtcgaaaaagtccaaaatcctaccttgaaatcctggcagaagtacgagattataaaagaagacgccagtcctatagagccaagaatg

SEQ ID NO: 7326 - DNA, 201 bp, Homo sapiens; identical to SEQ ID NO: 594

SEQ ID NO: 7327 - DNA, 201 bp, Homo sapiens
cagctttagagctgggttaaagagtttctccctgggaacctcagcagagagtaggttagaagttttaagcataagcttttaggaaattgaaagaaaacttmatccatcaaaaacatagacataggccagacacggtggctcatgcctgtcatcccagcactttgggaggccgaggcaggtggatcatctgaggtcagaagt

SEQ ID NO: 7328 - DNA, 201 bp, Homo sapiens
gtccgtgtgcagagccgcgatgggcgcctgggacccgaggggcgccgggggccctggagcaaccctgacgtccctgggttccgggctggggcgcgcgaggractcccgaaggctccacatcgacctccagtgcggcgctcctcccgcgcaacttcgagtttaaagaaaaccgggggccgggcgcggtggcgcacgcctgta

SEQ ID NO: 7329 - DNA, 201 bp, Homo sapiens
ggaagaagggagatccgcactggcagccgcggagggaagggcgaggagtcctcgtccgtgtgcagagccgcgatgggcgcctgggacccgaggggcgccgsgggccctggagcaaccctgacgtccctgggttccgggctggggcgcgcgaggaactcccgaaggctccacatcgacctccagtgcggcgctcctcccgcg

SEQ ID NO: 7330 - DNA, 201 bp, Homo sapiens
cgtggagagcggctgccggacgttggaggaggtgaccgcgtccctgggctgggacctagatagtctggatcccggggaagaggaggcggcggaggtgaggrgcgcggccgcggggccctttcggggactatcggcccggggtcttctctggaagaagggagatccgcactggcagccgcggagggaagggcgaggagtcct

SEQ ID NO: 7331 - DNA, 201 bp, Homo sapiens
tccagtttgaccattgccttttctgtgttctctaaactgcacaagtcccacagtcaattatgtcatagcacttagtaaatatttgattgttagcactgatytttctagcgttacagtcttaattttttgagcagttttcttacctgaagttcggtgcttacctctcccaaggtgattcgagatgtgataaatgtgcacatg

SEQ ID NO: 7332 - DNA, 201 bp, Homo sapiens; identical to SEQ ID NO: 602

SEQ ID NO: 7333 - DNA, 201 bp, Homo sapiens
acaaagaaaaagcgctctgattctcaaattattgaaaatgacagcgatctctttgtagacttggctgccaaaatcaatcaaggtttgagatgcacatcatrgctttacatttcttcattatcattttattctatgagtgttattaagatgatttaattcttgggccactttgagttagagtaaaatggttttgtatcattt

SEQ ID NO: 7334 - DNA, 201 bp, Homo sapiens
gaatgtagaattaattaatgtacaaggcaactaattcacataatctgaagtttagagaccaggcttgtattaataggcagtgaaaaccttacaaagctttstatagtagagcagacaccttctttctcagttacaacaaaaatttgagcatgtgacacagattgaaggatgagactgaagatggacatgtgttccagggat

SEQ ID NO: 7335 - DNA, 201 bp, Homo sapiens
aatggtaaacatttaatggtaattatttatttaaatattatgtacctattttctttgtttctgtttgatttttataggatgaagttgtgatatgtccataygattccaatcatcacatgcctaaatcatctttggcaaagcacatggcatcttgtagattgaggaaaatgggctataccaaagaagaagaggtaccatata

SEQ ID NO: 7336 - DNA, 201 bp, Homo sapiens
catgggggttgagagaggcctgtagaagaggatgcactatacagtactggtacataattaaatggtaaacatttaatggtaattatttatttaaatattawgtacctattttctttgtttctgtttgatttttataggatgaagttgtgatatgtccatacgattccaatcatcacatgcctaaatcatctttggcaaagc

SEQ ID NO: 7337 - DNA, 201 bp, Homo sapiens
tagttaagaggaactattatattattttgatagttaagaggaactttaattttgaattcttacactatcttaaattaagatttaattgttaaccgtaaccttttttttttttttttttgaggcggaatcttgctctctcgcccaggctggagtttagtggcacaatctctactcactgcaagctctgccacctgggttcac

SEQ ID NO: 7338 - DNA, 201 bp, Homo sapiens
agttaagaggaactattatattattttgatagttaagaggaactttaattttgaattcttacactatcttaaattaagatttaattgttaaccgtaaccttttttttttttttttttgaggcggaatcttgctctctcgcccaggctggagtttagtggcacaatctctactcactgcaagctctgccacctgggttcacg

SEQ ID NO: 7339 - DNA, 201 bp, Homo sapiens
gagataaattgcaaaactaaaaatagtaccaagaactcccatattgtctttacccagatcacccattgttagcattttgccacatagcttctcattggcaytctctctctctctctctgcacatttttcactctctcgatctcgatctgtacatatttttttcccctgaattctttaagggttaaattacatacctcataa

SEQ ID NO: 7340 - DNA, 201 bp, Homo sapiens
tggctcatgcctgtaatcccagcactttgggaggccaaggcgggtggatcacctgaggtcaggagttcgagaccagcctggtcaacatggtgaaaccctgwctctactaaaaatacaaaaaatagccaggtgtggtggttcgcgcctgaaatccagctgcttgggaggctgaggcaggaatcgcttgaatccgggaggcga

SEQ ID NO: 7341 - DNA, 201 bp, Homo sapiens
aaaaaatagccaggtgtggtggttcgcgcctgaaatccagctgcttgggaggctgaggcaggaatcgcttgaatccgggaggcgaaggttgcagtgagccragatcgtgccatttgcgctccagcctgggcaacaagagtgaaactccatctcaaaaaaacagaaacaaacaaataaaaaaactaagagacgaaactgaaa

SEQ ID NO: 7342 - DNA, 201 bp, Homo sapiens
tctgtgtacgtatactggagaccagtggtaacacaaactgattaacattcttttctatgttttaggaatgaagaaaggcgatcagcttcagtagattcacrgcagtctggtggaagctatttggatgctgagtgttcacgacatagaagggataggagtagaagcccacataaaagaaaaagaaacaaagataaggataaa

SEQ ID NO: 7343 - DNA, 201 bp, Homo sapiens; identical to SEQ ID NO: 599

SEQ ID NO: 7344 - DNA, 201 bp, Homo sapiens
agcggcggcggctgcaggaggagctgaacgagttcgtggagagcggctgccggacgttggaggaggtgaccgcgtccctgggctgggacctagatagtctrgatcccggggaagaggaggcggcggaggtgaggagcgcggccgcggggccctttcggggactatcggcccggggtcttctctggaagaagggagatccgc

SEQ ID NO: 7345 - DNA, 201 bp, Homo sapiens
aagttctagagatggatagaggttgcacaacgtgaatgcacttcatgtctctgaacagtacactgaaaaaatggttagaatgttaaattttatgttatatrtattttgccacaaaaaacctgcaaaaacaggcagccaaagggtcttagagttattataattacagcacattcatatgtacctttaaatcatttaaaaaca

SEQ ID NO: 7346 - DNA, 201 bp, Homo sapiens
atacctcttttatttcagggatggggaaagacaccatagtcataaaagaagaaagcaaaaaatataaatgaagtacttgtacctatattaattatgcttaygccatgataaccaatatacagatatattaattggaattcctttgcataggagaatgtttttatgatctgtttagtgcttattattttttttatgatctgt

SEQ ID NO: 7347 - DNA, 201 bp, Homo sapiens
ctgaggtaagttttacataatctttgttgataagaatttcccttaggtaattttctaaatctgttctatgaatttccacaattctttggaaattttctgaragtgtcttcagggtggccacacctgatttgtatctgttccatcacttctagatccaccctttagcaagcaaaggctttcatagtataagaaccttatata

SEQ ID NO: 7348 - DNA, 201 bp, Homo sapiens
gtgtgactcatgtcactccgctaggttggaccttggcatatcttaggttttccatgggagaatatagtggaggaggagaagtggtggataaggattttccrggtggaagaactagcattctgaaaagcagatagaagtataggagtttttcagagactcattagtaacccagggtggctagagcttagggcttctctgttg

SEQ ID NO: 7349 - DNA, 201 bp, Homo sapiens
ccaggctgtagtcatggttggttttctccctcattgaaattgaggatctttaccaaatactgttctaagccagtatctggacttgatttctcagagttgckctatggcttcagaagaaagaccatcttatccttagttgtctatattacatgggttctctacaacagccagaagcacatttcttgtattttttgttttgag

SEQ ID NO: 7350 - DNA, 201 bp, Homo sapiens
ttgattggatgtgggtgatgagggagaagtagtttcttgcttgagcaagggggacctttcactgaaatagaaaagtacaaaaggaatagatttgagggttrggagatgatgaatataattaatttatttttgtttgtgttgaacttttagtgtctttaatatacggtactggagagaaacaaggtttaaagatctaaattt

SEQ ID NO: 7351 - DNA, 201 bp, Homo sapiens
gataccctgagttggggaagtggcagtggggatggaggatgttgagggattttcagaaatatttaggagttaaattggcaggactaggtgattgattggaygtgggtgatgagggagaagtagtttcttgcttgagcaagggggacctttcactgaaatagaaaagtacaaaaggaatagatttgagggttgggagatgat

SEQ ID NO: 7352 - DNA, 201 bp, Homo sapiens
ggtggtggacaaagtggtggtcagcaaaggcttcctggacaaagtgaattctaagctgataaataaaagtgagttgaattggctagggggttggcgggtgyggggaagaagcatcaacagcatgtgtagaagttcagagacagggagtgaccagatcgggaagcctcaagtagttaaggatagctagagcatagagtgtag

SEQ ID NO: 7353 - DNA, 201 bp, Homo sapiens
aggtcgaggctgcagtgagccgagatcgctccactgcattccagcctgggcgacagagcaagaccctgtctcaaaaaacaaacaaacaaaatccaggaagrtgtgttgagtgaggagggaatggcagatttggtatttatttagaaaataagtgaacgtgtctcagagcgctgcagagggattggcggtttgcattgtcat

SEQ ID NO: 7354 - DNA, 201 bp, Homo sapiens
aagggagatccgcactggcagccgcggagggaagggcgaggagtcctcgtccgtgtgcagagccgcgatgggcgcctgggacccgaggggcgccgggggcyctggagcaaccctgacgtccctgggttccgggctggggcgcgcgaggaactcccgaaggctccacatcgacctccagtgcggcgctcctcccgcgcaact

SEQ ID NO: 7355 - DNA, 201 bp, Homo sapiens
cggcggctgcaggaggagctgaacgagttcgtggagagcggctgccggacgttggaggaggtgaccgcgtccctgggctgggacctagatagtctggatcycggggaagaggaggcggcggaggtgaggagcgcggccgcggggccctttcggggactatcggcccggggtcttctctggaagaagggagatccgcactgg

SEQ ID NO: 7356 - DNA, 201 bp, Homo sapiens
cttagtaatcctttttgattcatatgctgttttataataactatagtgcttcttctacttaagtaatttttgacatctctaatcaatccctgttgacttamatacattagaagtcctcaaaatctaaacattaaatagtttttatttaaagaagataaactggatataagtaagaaatacttctcaacaggctaatctttg

SEQ ID NO: 7357 - DNA, 201 bp, Homo sapiens
ccgcggagggaagggcgaggagtcctcgtccgtgtgcagagccgcgatgggcgcctgggacccgaggggcgccgggggccctggagcaaccctgacgtccytgggttccgggctggggcgcgcgaggaactcccgaaggctccacatcgacctccagtgcggcgctcctcccgcgcaacttcgagtttaaagaaaaccggg

SEQ ID NO: 7358 - DNA, 201 bp, Homo sapiens
ttgcactccagcctgggcaacagagcgagactccatctcaaaaaaaaaaacacacatagacaaacgagttaataaaagtttaaatttctaatgaatgtagrtatgacatctagccaaaacctgaacagcttctcttgtaaggatttctgcattgtcttctttgaaccttctgtaggtagctttctctggacaacttacctt

SEQ ID NO: 7359 - DNA, 201 bp, Homo sapiens
tacaaaaattagccgggtgtggtggtgtgagcctgtggccccagctatttgggaggctggggtggaaggatagcttgagcccaggaggtcgaggctgcagkgagccgagatcgctccactgcattccagcctgggcgacagagcaagaccctgtctcaaaaaacaaacaaacaaaatccaggaaggtgtgttgagtgagga

SEQ ID NO: 7360 - DNA, 201 bp, Homo sapiens
gggtattttcggtggaatgagaggaagggaagtgctccaatgtggggtaattcattatctttactattacttctgggtttaccatgctgtgataatttctsctgggtttaagttacatgactgattcctcagaggcatttaaaatatatttgatttctgtatataccattcattgtttattgtattaaaagcacagaggaa

SEQ ID NO: 7361 - DNA, 201 bp, Homo sapiens
tgctgcgtgcctaattataggcatgaactgcttgaagtctgattacttactgggctgtagataaatctgaaaggattctgtgttcagatttcatagacagrgatgtggatgtttcttaagattctggaaggtttgtccacgtgcccaaagggcttggatcagaaaccagttaataatttaattgtggtcactgatgattca

SEQ ID NO: 7362 - DNA, 201 bp, Homo sapiens
gaatcttgctctctcgcccaggctggagtttagtggcacaatctctactcactgcaagctctgccacctgggttcacgccattcttctgcctcaggtcccragtagctgggactacaggcacctgccaccacgcctggctaattttcttgtatttttttagtagagacggggtttcactgtgttagccacgatggtctcga

SEQ ID NO: 7363 - DNA, 201 bp, Homo sapiens
aatcttgctctctcgcccaggctggagtttagtggcacaatctctactcactgcaagctctgccacctgggttcacgccattcttctgcctcaggtcccgrgtagctgggactacaggcacctgccaccacgcctggctaattttcttgtatttttttagtagagacggggtttcactgtgttagccacgatggtctcgat

SEQ ID NO: 7364 - DNA, 201 bp, Homo sapiens
ctgggattacaggcgggagccaccgcgcctggccaacggtaactttatatgatcttcaaccttctttaaaaattttttttggccacgtgtggtggctcccwcttgtaatcccagcactttgggaggcccaggtgggcagatcacctgaggccaggagttcaagaccagcctggccaacatggtgaaaccctgtctctacta

SEQ ID NO: 7365 - DNA, 201 bp, Homo sapiens
tctaaatttactgcatatgattccattcccttgtatactgctagagtgaatagtcacctcatagaactcttccgtggcggtctggcatggtggctcatgcytataatccctacactgtgggaggctgaggcaggtgatcacttgagctcaggagctcaaggccagcccgggcaacctggcaaaacctcgtctctacaaaga

SEQ ID NO: 7366 - DNA, 201 bp, Homo sapiens
tctataaacatgttcataggtcttccccctcgccccgcccgtcttctaagggcattttctgtttctttttagtgagttcatgaatgtttaacggttctggygcaaagctttcttgcattctgagcataaaaataataaaacccacttatatttgcttgagtgtgtttacaagtcaatttccttttatgtagcttgcttttt

SEQ ID NO: 7367 - DNA, 201 bp, Homo sapiens; identical to SEQ ID NO: 593

SEQ ID NO: 7368 - DNA, 201 bp, Homo sapiens; identical to SEQ ID NO: 592

SEQ ID NO: 7369 - DNA, 201 bp, Homo sapiens
ccatcatttataaccatttttttatacctcttttatttcagggatggggaaagacaccatagtcataaaagaagaaagcaaaaaatataaatgaagtactygtacctatattaattatgcttacgccatgataaccaatatacagatatattaattggaattcctttgcataggagaatgtttttatgatctgtttagtgc

SEQ ID NO: 7370 - DNA, 201 bp, Homo sapiens
gggtttaccatgctgtgataatttctcctgggtttaagttacatgactgattcctcagaggcatttaaaatatatttgatttctgtatataccattcattrtttattgtattaaaagcacagaggaaattaaaaaatctttaatattcatttagaggggtatttgaagctgggaattccactgagtggggcttaccagacc

SEQ ID NO: 7371 - DNA, 201 bp, Homo sapiens
aaattattatttagtaaatacagatggtcccaacttaatgatgatttaatttaggattttttcaattttatggtgttgtgaaaacaatacacaatcacaargttttagactttaagtactagtgattcttttatcagacgctgggctgcattttcaacttaacggtattttcagtttatgatgggtttatcgggatgtaac

SEQ ID NO: 7372 - DNA, 201 bp, Homo sapiens
ttcttcctctctgcagatttttgagattgatccctgtgtgtcagttgtgcattttttttgttgctgagtagtatgttctatcttatgtcagatcattcacrtgagactttggcatgaaatgttaagcatccgacatctaaatagcaatattttgaatactggaaactcaggttaaagattttgtttccaagtagaaatgaa

SEQ ID NO: 7373 - DNA, 201 bp, Homo sapiens
caagtagagacctgggtccctgtcatactaccttggtgattctcatagtccctaagatacttggctcatcagttatttcttctctcgtctcataacccttrtaatcaagcttaaatgttgctgctagcattctttacggttttatagttgatattttattgtggaaatattcaaacatatactaaagtggatagcatcgtc

SEQ ID NO: 7374 - DNA, 201 bp, Homo sapiens
tcccctcaaatgcagctgatctaagctgaaatgttattggacaactacccagtttaatgaattttccagtgtcataatagccctgtaggcgctcagcaggrtgggatatctatgcttaaacagagatttatttggattcttaatctaatggaggttcaaatatgtggaatttctggtcatttgtaaaaagaggattatgag

SEQ ID NO: 7375 - DNA, 201 bp, Homo sapiens
aatcaacaccaattttagtgagtccatcatttccttctactgttcacaactacatgttttccatagatattgccttgctcaggtattgaagaaggaaatcyaattcgttttatagcaaaataaatgaaagtcataatctggagtttctattaaaatattccaaaatgtatttatcttcttttactcctaccttcacatatg

SEQ ID NO: 7376 - DNA, 201 bp, Homo sapiens
tctcatgtacatccaacttctcttgctctcccataaaagcctgcttgcccgttttcctgtccccttcctcttcattgtcgtcctcctcctctttctccccrggctgtttctgtacgtcttcacttgtgttctctgtatcccaagccagccgccttctaacgggtatggtgggagctgacacacccaatttctccgtggtat

SEQ ID NO: 7377 - DNA, 201 bp, Homo sapiens
ctagatgagatgcttttttccccaaaacatgtttaccttagtaaaatcattctttgaagtttctaaacaatcctgagaggtcattcttttcctctgttctrgggctggaggcttcatcttagatggagacactaaaacagcaccacctggaaaaataaagatgacagtttcaattacactaaattaacatgtagaaaaagc

SEQ ID NO: 7378 - DNA, 201 bp, Homo sapiens
atgtaaaaagaattctttaaaagttaaatttgtataagcctatgttaacaatttccaagtaaactgttctattggaaattaaatatttcaaagtagaaaaygttaggaaaaacttcactcaaaaaattttaacacagtaagcaataaagaaaaattatgccaatgtttccttagataaaggcaactcagctaggtttatgt

SEQ ID NO: 7379 - DNA, 201 bp, Homo sapiens
tgagtgtataactatacccaagtaagtggaagtttaagccagcagaagagtgaaaccaagaaacaaccaacttgttcccctgatggctctgggtttgggcrtactgagtaccactgaaagttggagtgaagggaagactgaaccaggaagctgcctaaatatgtttttacaaaaatagttaatatgccaggtcctccttta

SEQ ID NO: 7380 - DNA, 201 bp, Homo sapiens
acagcttaacaaaaacgacataaacttttgggagttttataaccctgcccaggtgtgagaagccagaatacctcccctgggcaacacagggcaagctcaawtaccactgctactactgcagctggtgctcttttgcaagcagcacctcctgattagaggccaactgacacagtccattatatcatctctaggtagaataac

SEQ ID NO: 7381 - DNA, 201 bp, Homo sapiens
gatgattaagctactcaaggagctaccagagaaaggtgaaaaccaacataaagaaattaaaaaaaaattcaggatatgaatgaaaaatttcccagagagayagatatcataaagaaaatgcaatcagaacatctggaaataaaaaacacacttagagaaatacaaaacgtagtggaaagtttcaaaaatagactagaacaa

SEQ ID NO: 7382 - DNA, 201 bp, Homo sapiens
aaggtgaaaaccaacataaagaaattaaaaaaaaattcaggatatgaatgaaaaatttcccagagagatagatatcataaagaaaatgcaatcagaacatytggaaataaaaaacacacttagagaaatacaaaacgtagtggaaagtttcaaaaatagactagaacaagtagaagatagctgcatgccaggtccaagagg

SEQ ID NO: 7383 - DNA, 201 bp, Homo sapiens
gtggctcatgcctgtaatcctagcactttgggaggccgagacgggaggatcactttaggccaggagtttgaccagcctggtcaacacggcgagaccccatmtctatttatttaaaaaaaaaattaaattaaattaaaaacaaaacaaggcaaaccagtaaaatcaagtacagttccaaactttcctgattatttcttgtaa

SEQ ID NO: 7384 - DNA, 201 bp, Homo sapiens
tttgaccagcctggtcaacacggcgagaccccatatctatttatttaaaaaaaaaattaaattaaattaaaaacaaaacaaggcaaaccagtaaaatcaartacagttccaaactttcctgattatttcttgtaattgttgccttcacttattatctttgattctatcaatgtaacattcaaaacattgctttctaaactt

SEQ ID NO: 7385 - DNA, 201 bp, Homo sapiens
tcttgagataacgaaagaaatcccaatgttgccatgttttccagcctcatgttgtaccaggctccctgccacacactgtattggtctttgtttcctcaaastctacattgtttctctccacaagatcttggcatatgctaggctccttctccccatccttttttcctggttaatgcttcctcttctcctttatcttagctc

SEQ ID NO: 7386 - DNA, 201 bp, Homo sapiens
cagcctggatttctaaggaggagtaaaacagtccattaagatctgattctcatgagtcctctgaccatattcctaatgtcacatttcctttaataaaccartgtatacataagcaacaggaaatagttttgatattctgtcactccaataacattcattcaatctgttacgtgctatgagctggactctgttctaagcact

SEQ ID NO: 7387 - DNA, 201 bp, Homo sapiens
cttagcactaatcagtatctaaaatactatgtattttacctggttattttgtttattgtctccctcctccactagaatgtaagttcaatgatggctatgayttttgtctgtttgttctctgctatatccccagcacttaaaacaatgcctggaacatagctggaatacaactgtcacacagcagatgctcaatgaaagtat

SEQ ID NO: 7388 - DNA, 201 bp, Homo sapiens
tagtgacaaaatacatatcaaccatgtaaataacgcttctctatactgagtaatttaaaactctcacccttctttcatcttatctgccttagatttctcaygtacatccaacttctcttgctctcccataaaagcctgcttgcccgttttcctgtccccttcctcttcattgtcgtcctcctcctctttctccccgggctg

SEQ ID NO: 7389 - DNA, 201 bp, Homo sapiens
tcagatggtcccgagaaaaatgcgtcccctgaactcgcttcctataaaactcagccttttctcggagttctttaacctattcaggagagttcagacatcayatactattgtaaatgcttctttacaaacagcaccaagtagcatatcaaagacattgcacaaatacagccagggaccaaagacaaaggaaggcaaaattag

SEQ ID NO: 7390 - DNA, 201 bp, Homo sapiens
aggcaaaaaaaagtcaagatatgatttgaaagatgctaattaatacaataacaaaaaggttccattctctatcctttgagtataagaagctagtactaaartagcaattctcaactctagaattacccttcccttcaaacctatcttcagatccccagagtttctcccaagtcagagtaccccaaaactgtagctcacacc

SEQ ID NO: 7391 - DNA, 201 bp, Homo sapiens
ataccccaattacctgtaatttataatcatgttagcctgattctgcaaattaaatggctgtaatatcacacagaagcagttgtttgtatattctgaggtamatcatgtgaattatactggctataatttggcatgctaaagctttggtttaaaatacatgtgatggccgggtgtggtggctcacgcctgtaatcccagcac

SEQ ID NO: 7392 - DNA, 201 bp, Homo sapiens
cacatatattattaacatccaaaggtcaactttatgtactcattactatgttttgaataacagttttgtaatcaaaatatagcttataatcaaaataaacrttggcatattttcatatgacatagacattagctttaaggcaactctgttgtcagttctacaggtttttttcttcctccctgacatgattttttttcttcc

SEQ ID NO: 7393 - DNA, 201 bp, Homo sapiens
ttaccactgattacaaggaaagcaaatggaaaagatggggaactcagtcaagttatattactgctttgtaatgctggatagtacatcttcatacagatcasatctaaacagtttatcttttttagtacagtataacctcaaggactttactgccaaaaactgttctgactcctttacatattaatataagacatcctttca

SEQ ID NO: 7394 - DNA, 201 bp, Homo sapiens
ctgttaagaacataaatgagagtttaaagcctaagaactccctaaaggatgaaggtagtaaaacaacagactatctattagtaatggtatctcaatactamaattgtgcaggagtataatgaaatctaataccacatcattacagcttttgaattttacaaatatagttatactgacaatgcctattactatttgtctgat

SEQ ID NO: 7395 - DNA, 201 bp, Homo sapiens
caggctacttaagtacttaatttctttcaactcttaattctatgtaaatctacattactagataagataatggtactcagaaatgtattacatccattaarctacctgattggctgcaaaagctggagcagtttctttagaagtcttccaaacaaactgcctttgatattcagaatttctcaaggcattatatgaaggaac

SEQ ID NO: 7396 - DNA, 201 bp, Homo sapiens
attttccacatctgaagccccttcagctctggagtctgcagagtgagatctggttcttttgggaaccctggaagcttctagtgagtgaactctttcttgartaacatccttttgttctgcttcttgtgattttggtgtttccggggcttctggttctggtgatgcaaccacattgctctctgagatagctccattccactc

SEQ ID NO: 7397 - DNA, 201 bp, Homo sapiens
agcaaatgtccaaaaacttaaccttctatgaaggtaagagcagctctgcagaatgacagccactgagagactgccctagtttagggccattctttaagacrgttgcagggtgcagaaggaagattaagaccagaatggaaagggaaggtggaaagaaaattgggcatgaggtaaaacccagggctccttagcctctgttgt

SEQ ID NO: 7398 - DNA, 201 bp, Homo sapiens
cccagtctctgaagtttgccgctgggtcagatcatgatgcttcagaggaactctaaaagagacactcactcttgcccactcttccctttgttctctagacsaaattctgaaaatacctcgtcgtcttactaactttccaggcttggtaccctacccataagtcttttcctggcttcaaacatctaacatttatgtgactta

SEQ ID NO: 7399 - DNA, 201 bp, Homo sapiens
cttcttttaatctataactaaggtctgagtcctgaagaccttcttctggagcatcagtaaatttacttaatctaaatgggtctaggtgctgggctgattayccttatcttgtctcctgctgaatcatggaggtttgaggagttccttcagaccgccaataaatttgtggaggcctggggagtttcttcagacccccagtaa

SEQ ID NO: 7400 - DNA, 201 bp, Homo sapiens
cccaggttagaatggctattagcctgctcaacttacctaattgatctgatctaagtccagcccatgggtactttcgccccacggaggaattacaagactckgacaaataagactttttccacaggaagttcctctggtattcactcagcccctgtaatgcaaagtacacttttgagtacagtccaattaatgaatgatgtt

SEQ ID NO: 7401 - DNA, 201 bp, Homo sapiens
tatatcattctatgatctacataagcttcaacaaactttttttgccatccacaaagaatatctcacccagcaagatctaatgctctgatgttgctactaayggttccttctgagcttgtggttgaggagacatcccaacagcagttgctatcagataaaatctgattcagatggtcccgagaaaaatgcgtcccctgaact

SEQ ID NO: 7402 - DNA, 201 bp, Homo sapiens
tcaaactttttaaaaattgtggtaaaaaatgcataacatgaaatctatcctcttaacaaaatgttaaatctacagtgcaaaattgttaactacatgcgcawtgtggtacagcaaactttcttcaacttataaatagtatcttttttcaagtgtcaaactatttaaaattcctttctatcaaaggactattaggcatcccag

SEQ ID NO: 7403 - DNA, 201 bp, Homo sapiens
catgtggtggagaaggcaactgtccagggggatttgttgggtattttggaatttttgaaactggaagagttgcctcagcaaatttgtggatattgtcttcmgaatcttcccgcaaaggcagaggatcaactgtttttataccagcagctggagaagtcagtagggatacagcacgactttctttctaaatgacaaaaaaaa

SEQ ID NO: 7404 - DNA, 201 bp, Homo sapiens
cactcaaagacattaaaaatttctattcaaactttttaaaaattgtggtaaaaaatgcataacatgaaatctatcctcttaacaaaatgttaaatctacastgcaaaattgttaactacatgcgcattgtggtacagcaaactttcttcaacttataaatagtatcttttttcaagtgtcaaactatttaaaattcctttc

SEQ ID NO: 7405 - DNA, 201 bp, Homo sapiens
aaaccaaaataattaccattgtgctgaaactctggatctctaagagagccctgaattcgtcgagagggatgccagtaggatggaacatgtggtggagaagrcaactgtccagggggatttgttgggtattttggaatttttgaaactggaagagttgcctcagcaaatttgtggatattgtcttcagaatcttcccgcaaa

SEQ ID NO: 7406 - DNA, 201 bp, Homo sapiens
tctcagcttgggagtaggaagccggcctcctttttctgaggatacagaagaatctgacctataaattgaaacaatctatgaatctatacagcatttcctcragaaaatatgataaaaaatactttgccatcattgtgcaataataaagtataaaacttgtaagaggccaggcgcggtggctcacgcccgtaatcccagcac

SEQ ID NO: 7407 - DNA, 201 bp, Homo sapiens
ttgaaatttcttttgtattcagtttcatggatgactgagttacctttgaatggtggaacaaactggcttttattgtggaaaaccttaaaacaaaaattatyttagtttagttttgttgattaaatatgcggaactttggtcttcaattacttaacaaaacataaagttgaattacaggacaaaaaaatagcaaagttatat

SEQ ID NO: 7408 - DNA, 201 bp, Homo sapiens
aatttccaagtaaactgttctattggaaattaaatatttcaaagtagaaaacgttaggaaaaacttcactcaaaaaattttaacacagtaagcaataaagwaaaattatgccaatgtttccttagataaaggcaactcagctaggtttatgttttaccccagaaattctccttccttttcttagctcgtgccagagtttga

SEQ ID NO: 7409 - DNA, 201 bp, Homo sapiens
aactttatgtactcattactatgttttgaataacagttttgtaatcaaaatatagcttataatcaaaataaacgttggcatattttcatatgacatagacrttagctttaaggcaactctgttgtcagttctacaggtttttttcttcctccctgacatgattttttttcttcctgccttaatagaaaattcttcacattt

SEQ ID NO: 7410 - DNA, 201 bp, Homo sapiens
aatagcaaagttatatatgattttaatttcatttcacatatattattaacatccaaaggtcaactttatgtactcattactatgttttgaataacagtttkgtaatcaaaatatagcttataatcaaaataaacgttggcatattttcatatgacatagacattagctttaaggcaactctgttgtcagttctacaggttt

SEQ ID NO: 7411 - DNA, 201 bp, Homo sapiens
tggaaaaccttaaaacaaaaattattttagtttagttttgttgattaaatatgcggaactttggtcttcaattacttaacaaaacataaagttgaattacrggacaaaaaaatagcaaagttatatatgattttaatttcatttcacatatattattaacatccaaaggtcaactttatgtactcattactatgttttgaa

SEQ ID NO: 7412 - DNA, 201 bp, Homo sapiens
ctcaatgaacatttgatgaacaaatgaattaatgaactagtgaaaaccaaaaactcccaggtggtagtaagtaaacgaaaacgtggagaatctaaaataayggggattttgttttgtaaggttaaaagttgatgaataccttcctttcaggagacactgtttcaagatttctgttttctctcaaatcatttcttaattttg

SEQ ID NO: 7413 - DNA, 201 bp, Homo sapiens
tctgtcctcatctgcaatgaaaaaatcccgagattatattcattgccaaaaatatctattaaataaacattgtgttttatataacagaaaattaaaagcaycaaactgtgttatcaatgtcaagttagtcaggaaaaaaagtaatctactgaaatgtaagatactaacactctcatgatacctcacagtagttttccaggt

SEQ ID NO: 7414 - DNA, 201 bp, Homo sapiens
tataaaactcagccttttctcggagttctttaacctattcaggagagttcagacatcatatactattgtaaatgcttctttacaaacagcaccaagtagcrtatcaaagacattgcacaaatacagccagggaccaaagacaaaggaaggcaaaattagccacatacagtcatcagactgtgcatttaagcaaaaactaaa

SEQ ID NO: 7415 - DNA, 201 bp, Homo sapiens
agaccatcctggccaacatggtgaaaccccatctctactaaaaatacaaaaattagccgggtgtggtagcggatgcctgtaatcccagctatttgggaggytgaggcaggagaatcgcttgaacccgggaggcagaggctgcagtgagccgagatcatgccactgcactccagcctggcgacagagcgagactccgtctca

SEQ ID NO: 7416 - DNA, 201 bp, Homo sapiens
tgcccctccacagcttaacaaaaacgacataaacttttgggagttttataaccctgcccaggtgtgagaagccagaatacctcccctgggcaacacagggmaagctcaattaccactgctactactgcagctggtgctcttttgcaagcagcacctcctgattagaggccaactgacacagtccattatatcatctctagg

SEQ ID NO: 7417 - DNA, 201 bp, Homo sapiens
tgtcttcagaatcttcccgcaaaggcagaggatcaactgtttttataccagcagctggagaagtcagtagggatacagcacgactttctttctaaatgacaaaaaaaaaaaaaaaaaaaagatgcctatgtgtagatatgtaaataaataagccaaacatttaaatgcaaaaaacataaccaaaaagcagaaggagaaata

SEQ ID NO: 7418 - DNA, 201 bp, Homo sapiens
cttgaggccaggagttcaagaccagcctggccaacatggcaaaaccacatctctactaaaaatacaaaaattagtcagatgtggccacaggtggctatagyctcagctatttgggaggctgaggcatgagaactgcttgagcctggaaggcagaggttgcagtgagccaagatcgcaccactatactccagcctgggcaac

SEQ ID NO: 7419 - DNA, 201 bp, Homo sapiens
tgaggcgggagaatggcgtgaacccagaaggcggagcttgcagtgagccgatatcgtgccactgcactccagcctgggtgacagagcgaaactccgtctcaaaaaaaaaaaaaaaaaacttgtaagagaaggccattttgtttctgaaaaaaataaccaccaaatccacatgcagttaaaagcgactgaaatttccaataa

SEQ ID NO: 7420 - DNA, 201 bp, Homo sapiens
caacttctcctctacactccaaacctatatagtcagttccctattcaacatgtctacttgtatgtctaataagcttctcaaatttagagtgtccagaacgraattcttgatcttctccaactcagttaaatggcgactccatccttattgctaaggccaaaaatcttgagtcacccttgatttttctctttctcccacccc

SEQ ID NO: 7421 - DNA, 201 bp, Homo sapiens
gaacgtaaatggcctaaatgctccatttaaaagatatggaatggcagaatggattaaaaaccacaaaccaaatatctaatgcacaaagattcatataagcycaaggtaaaggggtaggaaaagatattccatgcaaatggaaaccaaaagcaagcaggagtcttatatcaggcaaaacagactttaaagcaacaactattt

SEQ ID NO: 7422 - DNA, 201 bp, Homo sapiens
gttcaaaagggggaccaatcagtcctgcactgtgttgggtagattgacggggcagtgggggtggaagggacagcagaggcagctgcatctatccatgcatkatgaatgaaaggatggatgaataccctccatgtacacagtcatccagttttatttgacgtcaattttatttagaaaggagggggagagtatacttcataa

SEQ ID NO: 7423 - DNA, 201 bp, Homo sapiens
tgtttccaaggagtaagcttccttttaggctggtgtaagtcttttaattccatctctgcttccaattttaaacgatcgtctattttattactctgaaatgraaatcatttaagctttttatgcttaagatgttacacattaaagtgaaaacatgcatgttataaagttagacttgaatatttaatgacatttctattttta

SEQ ID NO: 7424 - DNA, 201 bp, Homo sapiens
ctgcttctatgaacaccccttctcctgcctgccagactcacacatcaccttccttgttccctttcacccccagctttttcaacaagctacagattcttctmcaacactctgaaatgcctcttcagggtcccagtcagtggtggacatgaaccagagaagagcagtggaacagaatggagaaagaaatgtggaaagcattga

SEQ ID NO: 7425 - DNA, 201 bp, Homo sapiens
tggccatgtcaccccgggtccttatccttttaaaaggcttccctagaccacaggtcttctcactgggtggatatctgtctggaggcacacaaagatgtttyaggagggtaaacagaagtgggcagcttaagggaatcattttccagatcctcaactccacatgtgctctcttgcctgatgctgatatatctgcctgagagc

SEQ ID NO: 7426 - DNA, 201 bp, Homo sapiens
cacatcacatgtgggacactaagcactgatctgtgtactcaaaccaggcccttaataggcaacatctcatttaaaccctcccagtaatcctatgcaacagwcttcctaaaatctcacttggtgaaactagctcaatttgcccaacatcacacagctattataattcaaatttaggctaattcattcattcaaaaaatagtt

SEQ ID NO: 7427 - DNA, 201 bp, Homo sapiens
gagtacagtccaattaatgaatgatgttttaaagcagacatcggtgaaaaataatttctgaacctcccaaaagagacttaagactgaaaattaaacacagwcgagctccttaataagagctaatattcacccagccctgtgctaagcagttcacacgtgttatatcctttaatccacaacaccacttgaggcagatgctac

SEQ ID NO: 7428 - DNA, 201 bp, Homo sapiens
atcaccctccgggaaactctggcccaggactctgccttccctgggacacagggaggaggcatgtgtgataacaagaacatgacctctgaaattacatgctytgcacaaaacagacttgatttcaaatcatggttctgccacttactagctgtaaagctggggcagcgacctcatctccctaagcttccatttctcaagacc

SEQ ID NO: 7429 - DNA, 201 bp, Homo sapiens
atttttagaagctttagatactaaagaaaataaaaaccataagaaatcaacaaagaagttttgaaatttttagtatatttggttagttatttttgaagttwagctgaggatatagtttcattttctaacaataaagattttagatctttggctaaggaagaaaatttttaagttaacaaatacatatctaaataatgttac

SEQ ID NO: 7430 - DNA, 201 bp, Homo sapiens
actccccagatgcaggcttgcatgagaggcagagtcacaattcctatctacttggatagcattctcacccttcaccctgataagacctcactgcatttaastgagagctcccccagccaccttcatcaaggctgggacctgtgcccaccagtgggtattgcattcacccacctaccttagccacagtaagttcctacccag

SEQ ID NO: 7431 - DNA, 201 bp, Homo sapiens
gagtcacaattcctatctacttggatagcattctcacccttcaccctgataagacctcactgcatttaactgagagctcccccagccaccttcatcaaggmtgggacctgtgcccaccagtgggtattgcattcacccacctaccttagccacagtaagttcctacccagggatacctcccctaatggcctgaagcctgaa

SEQ ID NO: 7432 - DNA, 201 bp, Homo sapiens
attgtcttcagaatcttcccgcaaaggcagaggatcaactgtttttataccagcagctggagaagtcagtagggatacagcacgactttctttctaaatgmcaaaaaaaaaaaaaaaaaaaagatgcctatgtgtagatatgtaaataaataagccaaacatttaaatgcaaaaaacataaccaaaaagcagaaggagaaa

SEQ ID NO: 7433 - DNA, 201 bp, Homo sapiens
tgatattccagaggtttcccagtgacatcagaataacatccaagagaataaaccccacttgattataatgaattatctttttgatgtgctgctggattcartctgatagtattttgttgaggatttttgtgtctaccttcatcaggaatattggtctacagttttctttttttgttgttgtgtccttgccagattttggta

SEQ ID NO: 7434 - DNA, 201 bp, Homo sapiens
aagcccaaaccccagcattacacaatataccaatgtaacaaacttggacataaacgctctgaatctaaaataaaattcaggctgggcacagtggctcaagyctgtaatcatcctaccactttgggaggccaagaagggaggactgcttgaacccaggagtttgagaacagcctggcaacacagcgagatccccaactctac

SEQ ID NO: 7435 - DNA, 201 bp, Homo sapiens
actggtcttctgccaactttgtgaccaccaacttaaaatggccccttaacattggcctaaaatatcccacattcccctggcccactcactctcccactctstgagaagactactctatgccttcactttcctcaaatctccaacatcttccccagccttattctcagtaaggatctttcttcacatgtcaccaagaagcaa

SEQ ID NO: 7436 - DNA, 201 bp, Homo sapiens
aaaaaaaacttgtaagagaaggccattttgtttctgaaaaaaataaccaccaaatccacatgcagttaaaagcgactgaaatttccaataatgaatagaaytaagcacaagatcaaaaataaaacagaacactgaaaaaataatataagctatatcaactatatcaatagaagaaaaacaacccacaaagaaaaaagtgac

SEQ ID NO: 7437 - DNA, 201 bp, Homo sapiens
tatgtattaatagcttgcagtctctacttttttattgttgttgactttctttttaccttctaaaggtctttttacatctaccatgtaatcatccctactcygctattaactgccaacaaaaaatattataaaaatctagccttccagatttacattatgtgttatttatacataaataaagcaatctacattgctttattt

SEQ ID NO: 7438 - DNA, 201 bp, Homo sapiens
tgtatattctgaggtaaatcatgtgaattatactggctataatttggcatgctaaagctttggtttaaaatacatgtgatggccgggtgtggtggctcacrcctgtaatcccagcacttcaggaggccaaggtaggcggatcacctgaggctagtagttcgagaccagcctggccaacacagtgaaacccgcatctctact

SEQ ID NO: 7439 - DNA, 201 bp, Homo sapiens
aatttataggatcactggtgtttttctatcttaatgtaagatgactagatgttattgtcttgctgaatctaattatcctgtcagttcttacggctatacamaatatacaagtgaatgttgacgtacaggagaaaatgaatgtgagggtgtgtgaaagtgtgtgtatttataaagaaaaacacgaagaccagaagaaaaaac

SEQ ID NO: 7440 - DNA, 201 bp, Homo sapiens
atacaagtgaatgttgacgtacaggagaaaatgaatgtgagggtgtgtgaaagtgtgtgtatttataaagaaaaacacgaagaccagaagaaaaaacagaytaagccattacaggtctctggggatattccaagtggaggtatttcctgtctatgcctagaagtactgttaagaacataaatgagagtttaaagcctaaga

SEQ ID NO: 7441 - DNA, 201 bp, Homo sapiens
agaaaataattctaatttggccggttagtttgccaatgaatactgactttgccaattgtatgataaacattttccaaaaattgaatgggctaaattggcarctccagagtttttacaaaatatatgtaaaatatataagcactatgcaatataccagaaattctatcattcaaaactattcataaaaatttattataaaaa

SEQ ID NO: 7442 - DNA, 201 bp, Homo sapiens
ctgtgaagttgcagggtgctagtccctgacagctaccagctacctggaacttttaacatacgctaagaatgcacaacgatgaaaaacgtgtatttctttayacgctgtctttactaagaacccatttctcaagcctttaaaagccacatacactaaagttttaaaggtaatgggggttaaatgctaagctaaatgggccac

SEQ ID NO: 7443 - DNA, 201 bp, Homo sapiens
tcagattataggattttaaaagtacagcttttcaacataaaatatttaattttgcttttaaaagcattaaaaatttgaccataacaaaaaattaaaaatcrgggggtcacaaaatgttccagttatcctaacaaaagtcactagaattgcaacgtgatagacctggcaggccaggcagtacatgctgcctcgtttctaatt

SEQ ID NO: 7444 - DNA, 201 bp, Homo sapiens
actggggtttagacctgtctacaactattcttctctgtctacacccacccccttgatgatttcctccagtctcaatactttaaaaacctgacccacctaasctataaagagcctcaaatctgtacctatagcccaacttctcctctacactccaaacctatatagtcagttccctattcaacatgtctacttgtatgtcta

SEQ ID NO: 7445 - DNA, 201 bp, Homo sapiens
aaaaactggggtttagacctgtctacaactattcttctctgtctacacccacccccttgatgatttcctccagtctcaatactttaaaaacctgacccacytaagctataaagagcctcaaatctgtacctatagcccaacttctcctctacactccaaacctatatagtcagttccctattcaacatgtctacttgtatg

SEQ ID NO: 7446 - DNA, 201 bp, Homo sapiens
actgaatatatcgctagtgatttctcttataaaagtaacgtttctacacaacgctttcactgacatgtaaaagccctatttgatgatgatagggctttgayttgaatcagctctattttaaaggtcaaatactctataaaaaactgaataattacaattttcaggttgtaagtaatgttttaggtacacttaatctccaaa

SEQ ID NO: 7447 - DNA, 201 bp, Homo sapiens
agctgccacaatttataggatcactggtgtttttctatcttaatgtaagatgactagatgttattgtcttgctgaatctaattatcctgtcagttcttacrgctatacaaaatatacaagtgaatgttgacgtacaggagaaaatgaatgtgagggtgtgtgaaagtgtgtgtatttataaagaaaaacacgaagaccaga

SEQ ID NO: 7448 - DNA, 201 bp, Homo sapiens
caaataatgaaacagcaatgtaaaagcaattgtagaaacatagctccttaacaaggtacgattttgaatgcaaagatgaaagtgttacatctctagggaaytggccaaagcaaaagacagcacctatatggcataagaaaccatataatcccaacagagtcctactctaatgaaccatacctgaaaaaagttcctaaagga

SEQ ID NO: 7449 - DNA, 201 bp, Homo sapiens
aggaacctcataatcagatgcctatagtaaatgacttccaagagatataagtaaaacatggctcatattaaatgtctataacctggtcaactaaaactgtwatcatcaatgatcactgacttcttagctaaaaattcttattcttttccaacttcaatttactttttgaattatttttctcaaagaaattaaggcaaacta

SEQ ID NO: 7450 - DNA, 201 bp, Homo sapiens
tactacaaaatagcgagtagtcagaatagaactaattcacaataactaaagtcaacagcctgttatcaactattcttatagacattagacaagaaaacaayaatggaaaattctgaaacacaaaatgtaatattacagaaatgacaatgaaaccaatgaagaattctatgcttttgaaaagaaatgcagtgaatatgccta

SEQ ID NO: 7451 - DNA, 201 bp, Homo sapiens
ttaggtacacttaatctccaaaaaaacctgtaggcaagcaaaagaagtactgatcctatttactaggttaataaagggtatttatcactttgttacttcayagattcttaaaatgttatataaatttcaaaggtattttaaaaattgaataataattaagcccaaagctgccacaatttataggatcactggtgtttttct

SEQ ID NO: 7452 - DNA, 201 bp, Homo sapiens
gttaagaaaaatacacatacctctgaccagtatataatcctctacactggcaaacaaagcctccgttgtcgacaacacacgtgcccccatagaggcatggsttggaggaacacggattgacgcttatctcacagtgggtccctatgtacaaggcactgcatttgcagtaataacctaaatcggcaaaaaggaacaaaaaag

SEQ ID NO: 7453 - DNA, 201 bp, Homo sapiens
tgaaatgtactaacaaaatgtcacacttcagtggaaaaagacagaatgaaaccctggttatagtaaaaaaaaaaaaatcagggtgctagataatggcactracaccaccaaaattcagttgaaacaaatgcacaaaatatcttggaaatctagttaaaactatgaaaaatcaaatctgtacataaaatttacaaaaaaaag

SEQ ID NO: 7454 - DNA, 201 bp, Homo sapiens
acacaggggttgggcttctaagctacagaatgacagcaacacaagtctacattgttttaggccacaaagtttgtggtaatctgtaatggccctggaaaacygggaatacgacgcaggaacagactctcagcagactttcagtttacaactgataattacattatggtaatgagtaaaataaaaacactcctgtatatatgt

SEQ ID NO: 7455 - DNA, 201 bp, Homo sapiens
aggagaaggggtgtagcgaaaagggaagaaaaaggaggatgatgaaggaaacatggtaagaaagggagtgtgaggaggaagagggaggaggggaagcagamacgaggaggagtgggggacaggaggaagagcagagaggaggaggagtgtaggagaagaagaggactggaggagaaaaggaagagacgaggccaggcgcgg

SEQ ID NO: 7456 - DNA, 201 bp, Homo sapiens
tctctccttaacctctgcctcataaaaacaatcctcccttttttaataagattatttaagtcatagtcaagattctctatgttctacctagacaaaaaaaagaagccaatccttttcctaagataacatggtacggtgaggtcttcagaatttctctccactcatcacaccacaagccacactatgctttctataacttgc

SEQ ID NO: 7457 - DNA, 201 bp, Homo sapiens
caagcaactgttaacagtggtaacttctggagaaccggtagagaaacaggtagctgagggaatgattactgtggcatttttctctactgtggtttttttttagcatgagtatgtgttgtctttatcatccactcacccctttcattaattatttaattccttttacataggtttaatgagcatctactatgtatcaggtgc

SEQ ID NO: 7458 - DNA, 201 bp, Homo sapiens
aggggggtagatacaatgtacccacggatatactttaaaatggacagaaaagtctaggcagacaagcaactgttaacagtggtaacttctggagaaccggyagagaaacaggtagctgagggaatgattactgtggcatttttctctactgtggtttttttttagcatgagtatgtgttgtctttatcatccactcacccc

SEQ ID NO: 7459 - DNA, 201 bp, Homo sapiens
ggtttgggatgtttttcatgttttccaatataagtatcaacattcttgtaacatgtctagaattattaagcttaacaaaaacttccttttcatttttgaaygacaaggtcctctctttcatatttaaacgactcaaaaatcttcatgagtatcaaatgaaaggctactaactgtaacaactaagttatatttttatattta

SEQ ID NO: 7460 - DNA, 201 bp, Homo sapiens
tataaagaactacaggttcttatttcacttggaaacagccttgaatgacggtttctcctaaatcatttcaggcacatgtacaaatatatagaaaagtgacctgtccattgttaaggtttatctagctcatttataatttttatacaggttttatttctctattacattaagcaccatataatgtatgtagaaatacttgca

SEQ ID NO: 7461 - DNA, 201 bp, Homo sapiens
ttaaataattaccatgtattttctaaagcaactaacattcctctcacaagtgaatgactggatgttaatcactaacttgggggataagagggaaaaaacaaccccaaactccctttaccccaccagtattaacgcagcacagtgaaacactttcagacacgtaatacaaacagggtaacaattgttttaatttaacaaatt

SEQ ID NO: 7462 - DNA, 201 bp, Homo sapiens
ctttaaataattaccatgtattttctaaagcaactaacattcctctcacaagtgaatgactggatgttaatcactaacttgggggataagagggaaaaaamaaccccaaactccctttaccccaccagtattaacgcagcacagtgaaacactttcagacacgtaatacaaacagggtaacaattgttttaatttaacaaa

SEQ ID NO: 7463 - DNA, 201 bp, Homo sapiens
tgacaatattaaactacattctcttgttgtttaatcgtctcatctagactgaatctcctctccaattataactatatccaatcccagatgaaggtctcackgcacagttataggagtgcttccgtgctggaccctgggaaggggatgctttagaagggccaggacagtatctgcgaggggctgaaggtactcttgcagatt

SEQ ID NO: 7464 - DNA, 201 bp, Homo sapiens
acatactcgatggaatactgggcagtcacaaaaaggaattacatgtgccctgtaatttcttcagtgattggaacagtaaaagtaccttttgtttaaaaaaatatttaggctgggctgggcacggtggctcacgcctgtaatcccagcactatgggaggccgaggcgggtggatcacgaggtcaggagatcgagaccatcct

SEQ ID NO: 7465 - DNA, 201 bp, Homo sapiens
tccctgtggtcatggactgtatgtataagctgcccccctgcccatccattcccaagtagcattttcctttactccagcctccacttttatcaaatttttaraaacttctttttctattaaattttatttcaattacaaagcagttcttaaattttaattcaaatctttaaactttaaaaattgcaaactgaagacgaacta

SEQ ID NO: 7466 - DNA, 201 bp, Homo sapiens
tgaagtgtaaatcagctgtaaaagttttgtggcagatcaacagaaacgttttaaggaaaaaccctctttaggaaagaaatctcattaagaaaaaaaaaaaactagcctcagcatggtggtgtgccctgtagtaccagttactcaggaggctgaggcaggagaatcgcttgaacccaggaggcggaggttgcagtgagttga

SEQ ID NO: 7467 - DNA, 201 bp, Homo sapiens
atgaagtctccataaaaggcccaagaaagcagagttcagagtttctcaccgctgaacacgtggaggctacgggaaggtgaacaagaactcatccaggtgcygggagggtggtacaccctgactctaccgggacagaaatgcctgtgcgtgggacccttgcagactttgcccctgtgtatctcttcatctggctgtttattt

SEQ ID NO: 7468 - DNA, 201 bp, Homo sapiens
acatgttgacatggctgtccgtgcgtcaatcatgcctaggcaatgaagtctccataaaaggcccaagaaagcagagttcagagtttctcaccgctgaacaygtggaggctacgggaaggtgaacaagaactcatccaggtgccgggagggtggtacaccctgactctaccgggacagaaatgcctgtgcgtgggacccttg

SEQ ID NO: 7469 - DNA, 201 bp, Homo sapiens
agcaaatgtgtttatccaaaggcacaagtttatcagtctactagattcttgattgtctgacattcattaacagagcaaccgtaacacccgcaagaggaagyggctgtggcacctgtcccctgaacgacgctgggcgctcctgcactctacacacacaagcccgctgtggcacttgtcccctgaacaaccctgggcgctcct

SEQ ID NO: 7470 - DNA, 201 bp, Homo sapiens
ggaattctattcatagactggcgaggctggaaagcagctcagaactcatttagttcaaactttcagagttccaaagaaaacactaataaaatggatcaaaygactagtctaaagtcacatggggagtcatacagggaccccataccctagtcttcagacgtctcttctgctttcaattctaccttactagctgtttcttgt

SEQ ID NO: 7471 - DNA, 201 bp, Homo sapiens
agcagctcctaatggggaaagcactgtggctgtgaaaccaccttttccagagggtattcccagttcccaatgcacacacacacacacacacacacacacahatacactgcacaactataaaaactaagtatttactgacaacgttaagaaaatttgaccaaggataaaatgaaattaagcaggcagcattataaacagcaa

SEQ ID NO: 7472 - DNA, 201 bp, Homo sapiens
tctgcttaatcagtaagtgatcataaaacacatgtgaattacaccacagcgccaaatgatggtcccattgaaagaattaagaaattgaaattcataacacrcaaatgtaagggaagagctgcttaccttttcacaaactggactgttgtcatttgcatccagaactttcacttcaactatcgcttttgatgagaaggtgcc

SEQ ID NO: 7473 - DNA, 201 bp, Homo sapiens
aaacacatgtgaaacaaggaggagccgtggagcagccaccagctccacatccctgaaagagcctggcctgacatttaacctacaaaatgctattatatgtyattaagctgatttcatattcaaatccttatgagaaaacgtaagtactaatcaaaaatgtaagtagtgctccgtatttacctaaaaactgcagagaataaa

SEQ ID NO: 7474 - DNA, 201 bp, Homo sapiens
aatttgaatggagcaactttctacactgttttaagacttaggactattttaggccacaggttagcaagatgatgaagcattcacgcagcaggagtcagcagttcctatgccttttgagcttgttggcggtctttccctaactgtgattcaaagtactccaactgttatagacaactagcatgataacgaagtcaacttaat

SEQ ID NO: 7475 - DNA, 201 bp, Homo sapiens
gaaacgaggaggagtgggggacaggaggaagagcagagaggaggaggagtgtaggagaagaagaggactggaggagaaaaggaagagacgaggccaggcgyggtggctcacgcctgtcatcccagcactttgggaggctgaggcgggcggatcacctgaggtcaggagttcgagaccagcctggccaacgtggtgaaaccc

SEQ ID NO: 7476 - DNA, 201 bp, Homo sapiens
aaatgtactaacaaaatgtcacacttcagtggaaaaagacagaatgaaaccctggttatagtaaaaaaaaaaaaatcagggtgctagataatggcactgacaccaccaaaattcagttgaaacaaatgcacaaaatatcttggaaatctagttaaaactatgaaaaatcaaatctgtacataaaatttacaaaaaaaagag

SEQ ID NO: 7477 - DNA, 201 bp, Homo sapiens
acagctagaaatgaatgactacactgaaatgtactaacaaaatgtcacacttcagtggaaaaagacagaatgaaaccctggttatagtaaaaaaaaaaaaatcagggtgctagataatggcactgacaccaccaaaattcagttgaaacaaatgcacaaaatatcttggaaatctagttaaaactatgaaaaatcaaatct

SEQ ID NO: 7478 - DNA, 201 bp, Homo sapiens
tccttcacaggcctacctctctgaggtagttcctgctcagcttcccttcctggacataagtctgcacagatgagtgaatggatggatgaatggatggatgsatagatgggtggatgggtaactggatagataggtggatggataaatgggtgaatgaataactgtatagatgggtgaatgaatgggtaagtggatacatgg

SEQ ID NO: 7479 - DNA, 201 bp, Homo sapiens
atctttaaggagtgctcatgctgcagctctcgatccagagggcgtgcgatgttaacaacacccgtcacgctgtcaattgaaaatgtgtctgtgtctgtaasaattgagtacgtcacgtgtccgttgggccccaggtctttatctgtggcttcaacctggatgatttcactatgtacctccttgtcttcactcacttccaca

SEQ ID NO: 7480 - DNA, 201 bp, Homo sapiens
tacatacttaaaaacaaaatttccatatatcatgttaaaaatgttaaacttcatcagtaaaatatgctaaattgtcattttaaagtatgtgttaaataaayagtacaccttttaataccagtaatcaccattttattttggctgttttcctctacagatttttataggagtggacctaaacatttaaatttaagaccaact

SEQ ID NO: 7481 - DNA, 201 bp, Homo sapiens
ctgcattggggccctcatccttgtcggtggctatgacgtgatagagcggctcccgtctggcatttctttctcggtctggcttttcccgctcagggagtctrattttgtagaacttttgcagaaactgaggtttgttgtcattttcatcaaggattttcacaatgactcttgcaatggttgatttggggggactaccattgt

SEQ ID NO: 7482 - DNA, 201 bp, Homo sapiens
aaacaaaacaacacacacgacgtcttaagagaaacctaaaaccacggagctaggtgagcattacgtggcaacacgctggcgagtgggatgggtgaccatgygcacactatgaaaaaaaaaacagcgatggaagatagtcactggaaataaaaaagtaaaaaaaaacaaaaacaaaacaaggcttttattttagatctcata

SEQ ID NO: 7483 - DNA, 201 bp, Homo sapiens
atatttccaggttctcagctaaagaggaaaaataatctaaacacaaatcattccctttgtcccacaccttaacaggtcaacctgggctactgttctcttayagtccgactgcctttctctgccagcgattaggatagcatctacagcctatgacaatggcccaaaaataagttacagaagtataaaggaagcaatgaaatt

SEQ ID NO: 7484 - DNA, 201 bp, Homo sapiens
tcctgagtcagcatcagatgccctgatctgaattactctacttccccctggcaggttttcaacaatgaatgcctcatatggactagattcaaagaccgggytgttgtcatttgcatctttcacttggatactaacatctacagaagccaccatctcatggtcatcttgagtgcacctggccagtatggaaaactgatacca

SEQ ID NO: 7485 - DNA, 201 bp, Homo sapiens
ttggtatgaattttttttacctgttatgaaatatgtaacttgtctgttgatctcttcagaatcagcatccgtggtacttaagatggcaatcaccccacctdgggggtcatcctcactcacagtccctttatagatctcggccgtgaatcgtggtggactatcgttgacatcggtgacggtaacatccacaatggctgtgga

SEQ ID NO: 7486 - DNA, 201 bp, Homo sapiens
tgccatcagttgccgtgatagtaagaaggtaattgtcccttttttccctgtctagaggtttcttcacatataccttccattcattctgtatagtttcaacrgcaaactgtcctaaaggatcccctcctattaaatcaatggaggaagataataatcaaatttgttgaaaggataaaaataagtaacagaaaaaataaactg

SEQ ID NO: 7487 - DNA, 201 bp, Homo sapiens
ccagggaccacccctgctcgagccacatgccctcatctaaccttggagggagcagcccttcctacgtctacttttagttcccactgaatggtgagccgcgmagatgcaggaagcacgctgtccacctctgagcttctccagcgtgcagaagagcagatgcccccaaaacagtgtctcacggcacgtcggcactttgtttcc

SEQ ID NO: 7488 - DNA, 201 bp, Homo sapiens
ccccagggaccacccctgctcgagccacatgccctcatctaaccttggagggagcagcccttcctacgtctacttttagttcccactgaatggtgagccgygcagatgcaggaagcacgctgtccacctctgagcttctccagcgtgcagaagagcagatgcccccaaaacagtgtctcacggcacgtcggcactttgttt

SEQ ID NO: 7489 - DNA, 201 bp, Homo sapiens
taagtgacaaaatgaggacggcctccttgctaacctggtttggacgtgtaactaatatgagcacagtataaatgagagtgtttctgtggggatggcctggmccactctacgcacacagaatgcaaatatacctccctgagagaacagcagaaaaccaaagctttggaaatcccacttaatgacagtattatttttgctctg

SEQ ID NO: 7490 - DNA, 201 bp, Homo sapiens
tgagataacacagtaacacaacaagcaagcaaagcgcagtgttgcagcacactgctgcctcaccattgtcatcgcacgattcggactggaaggagctcagrgactgcacttcagacaggctttcccgggcactgtatggctgggaaggcttttcctctagaggcttcttggaaagacagggatcaagatccaccacttttg

SEQ ID NO: 7491 - DNA, 201 bp, Homo sapiens
ggaggaaagtgactgcggaatgaggaaccagaaatttggccagaaaactcaaatattactttcttttccttgtttctgacaatcacagcctgaaaacacaraatttccttaggaataatgaaaacaaaacaaacaggctctaataaaatataaactgatcagattacataggtgataatccaaatacatctacagctacat

SEQ ID NO: 7492 - DNA, 201 bp, Homo sapiens
aggagtgccacggtctcagtaaaatggaaaaacctgtgggcagccagggcagaagctggagggcgaccagagcagtcagaggctgcagccacaacacaggyggagcgcgtgtgggctggggcacaacgggggtggggggcagattgtgaatctatttcaaggttgcctgatgcactggagtggggagagggagggaaagga

SEQ ID NO: 7493 - DNA, 201 bp, Homo sapiens
tctgctaactccatttatatgttgttatctttgactggggctgcaataatctggtaactctagcaagacatactttaaatattgccttcacatgatcaacmaccggttccaatttaaccctgagaatggtctttactgacaatgacagtgtggaactacaatctggctttttcagaaaacttcaccatgtacatgatttaa

SEQ ID NO: 7494 - DNA, 201 bp, Homo sapiens
atccacattccaggacaaactttgcccaaggagaagctcaatggactgttgacctcttgtgaatggagatcatctcatctaatgtatttttctccacaaayagaagtaatttaaatgacatcttggcagagtagccaataatcaacaatggccacttcttccactcccaagttggtaagtaagactttattttatacgttg

SEQ ID NO: 7495 - DNA, 201 bp, Homo sapiens
gccacttcttccactcccaagttggtaagtaagactttattttatacgttgaattgggctccctgtataattagattcggtcaacccttcactaaatgacrgaccaggaaagtgaatgttccatgtacagcaagaaaacggaaatcttcagggagaaaagtccatcttccctcctcctcttaaaatgttctcttcacctgt

SEQ ID NO: 7496 - DNA, 201 bp, Homo sapiens
cttccactcccaagttggtaagtaagactttattttatacgttgaattgggctccctgtataattagattcggtcaacccttcactaaatgacagaccagraaagtgaatgttccatgtacagcaagaaaacggaaatcttcagggagaaaagtccatcttccctcctcctcttaaaatgttctcttcacctgttctctct

SEQ ID NO: 7497 - DNA, 201 bp, Homo sapiens
tcggtcaacccttcactaaatgacagaccaggaaagtgaatgttccatgtacagcaagaaaacggaaatcttcagggagaaaagtccatcttccctcctcytcttaaaatgttctcttcacctgttctctcttcttacacctcagaagagatgccacccaccctagctgcaaataaagatactctgataccacaaaatcct

SEQ ID NO: 7498 - DNA, 201 bp, Homo sapiens
tttgttcatgcagagtattcctacagtcttttggtattcctgctttctgcccccaatcccagtcaacctattcaaacttctttgtgatattattctttagyttgaaaatattcagtatttccccttagcctgctaagtatatgattcttaaccttgcattaaagacctttgataatctaacctctaactaatttcctaatt

SEQ ID NO: 7499 - DNA, 201 bp, Homo sapiens
acaatcctcccttttttaataagattatttaagtcatagtcaagattctctatgttctacctagacaaaaaaaagaagccaatccttttcctaagataacmtggtacggtgaggtcttcagaatttctctccactcatcacaccacaagccacactatgctttctataacttgctttgcacacatcatttcctctgcttga

SEQ ID NO: 7500 - DNA, 201 bp, Homo sapiens
ctcatcagaatatatttttgaaatgaaaagttcccctcaggtatgagaaaatggcaacttcctgatcttaactgatgtatatcactcatttcaaaaactcytctccagtgtctaaggataaataagcacttgcaaactgaacaattaagtgagaccaaaagatagagtttggcttcaacttctacataatttggtcaaaag

SEQ ID NO: 7501 - DNA, 201 bp, Homo sapiens
agcacttgcaaactgaacaattaagtgagaccaaaagatagagtttggcttcaacttctacataatttggtcaaaagaacaattatctagcgcaaatcccrctcataaagattaaacagcacatccagccttacggctccctgctattaaatcaggtcctttaggctacaaattatgccactgagacagaatctaatgcaa

SEQ ID NO: 7502 - DNA, 201 bp, Homo sapiens
cggctccctgctattaaatcaggtcctttaggctacaaattatgccactgagacagaatctaatgcaataataatgtactaatttgatttggctgattgaytctacgtaaaatcagccaaacttgggtggaaagcaagcgggtaaagtgttaaaacataatctctaagatcctatccacctctaacattcaaagaaacgac

SEQ ID NO: 7503 - DNA, 201 bp, Homo sapiens
gctctcgtggagctcacccgccgtctcagcgcgcccccgagcagggaccgggcctgccggggccctcgccgggctcgcgcgtccgcatggtacctgccgcrcgagccgctcccgcgccctctccccgcgcccggccgcccagctcggcgccggcgcctcacgctccccgagcgcaggagatccctccgccccggccccgcc

SEQ ID NO: 7504 - DNA, 201 bp, Homo sapiens
gatgctggatgttcctatttcatgaattcatgactgtgtacttttataatgcctatcgtgattgctgagataagcttctgcttcgatgcattttaattatyacctctttgtaagataaaaaatcactgaatacaacttacggagaactataaagtaaatttcaactgccaaagggagaggagggcacaccgaagaatctta

SEQ ID NO: 7505 - DNA, 201 bp, Homo sapiens
caactatgaaccaaggggtgtgctgtaacaagaggaagcaaaacttactactgtcattctttattcatctccacatctgtcttcttacaataaacatactytgcaatatttttagactccaataaagaagaaaatggtaagaaacaatgaaaccgatttttaaaaataaaagtatacccaaccattcaactctcacctggg

SEQ ID NO: 7506 - DNA, 201 bp, Homo sapiens
gcgctctcgtggagctcacccgccgtctcagcgcgcccccgagcagggaccgggcctgccggggccctcgccgggctcgcgcgtccgcatggtacctgccrcacgagccgctcccgcgccctctccccgcgcccggccgcccagctcggcgccggcgcctcacgctccccgagcgcaggagatccctccgccccggccccg

SEQ ID NO: 7507 - DNA, 201 bp, Homo sapiens
gcctgacagaagaacaatgatttcatgaccacattcaacataaacaataagcaccctgattctcaaacgttatccggcattgcctaatggggccagcaggycacaaacacttcagccgtttacaaaatagaaataaagttactaaagaaaaaatacaaaataaggtttatagtcacaacatatgaaaaattacagtactac

SEQ ID NO: 7508 - DNA, 201 bp, Homo sapiens
caaagttgcgttttacaggcacatcttgatctcgtacctaaaaagaattgacacattatcaatcccattggtgctttccttataactaattaaaaatcacrctcgaacacacaaaggcctcaggaccaaatggtgggaggagagcgggtagagcgcctaccatgaccgtgagggtgtgctggtgaacagcttcatgatcca

SEQ ID NO: 7509 - DNA, 201 bp, Homo sapiens
acttcagcatttttccctttgtccttgtccagagccgtcacctgcaacacaactgagccaacggctgccgattcataaacccgccctttgtaggaggaagyggtgaaccacggggcgtggtcattcgtgtcgctgacattgaccacaatccttgcaaagttgcgttttacaggcacatcttgatctcgtacctaaaaagaa

SEQ ID NO: 7510 - DNA, 201 bp, Homo sapiens
cgtatcaaagaaaaggacaaatttctttatagcacttcactaattcacactgaaacccagctctgtcaatgactatgacagaatcaacaatgagctccttsaaacacagcgggataaaaatggaaggtatggcaaaaaacaaagacagcaattctatgaaagtttgtttttgtatgaaatgtaagctgttcaaatagaaga

SEQ ID NO: 7511 - DNA, 201 bp, Homo sapiens
ttgatcacacgaaattaaatattaacttattcgaggttaatatcagaaaaactcattttttgaatgaatgataattatatctaatactcccaaaaggactyacaacttgaaaatagaaaacttagctaaataaaatgtgaaattatcataaaatgaatctttattgccattcagaagcattacaatgatttgttattgctt

SEQ ID NO: 7512 - DNA, 201 bp, Homo sapiens
tacttgtttcttcatagtccagacttagtactgtatgaatagcaccagtgctagaatcaatagcaaaatatgtgtgtacagatggttcaacaatgtgatayacaagcaaagcatttgagtctttatcagcatcagctgctcgaatcaccagtgggacattcctgtctgttaggaccacgctgttaattgaggctgattcac

SEQ ID NO: 7513 - DNA, 201 bp, Homo sapiens
gcatctgccagtcaatatgacgctatgaaaaggtatgaacctaaattttgaaagaaaccatttacctttctcccctaaaacccgaatcacactgacaaacrgcgccatccaaactgtcaaagcatgttccgccattcttacagggttcatctttgcagtatggactaagctgacacctgaagagtaaggagaaacagacat

SEQ ID NO: 7514 - DNA, 201 bp, Homo sapiens
ttcatgcaagtatgtatggtattgtttaaaagtggtccaagaaaaatgaaaatatggtgaggctttaagggtagatagtgcgtctacattgtgagataacmcagtaacacaacaagcaagcaaagcgcagtgttgcagcacactgctgcctcaccattgtcatcgcacgattcggactggaaggagctcagagactgcact

SEQ ID NO: 7515 - DNA, 201 bp, Homo sapiens
atattaactgttgtgaaaaaaagccaatataagattagtcgatcagatccttcaatgaatatgttcttctctattactgacaagttcaaacacctattcawtaagaacagtttggctattttccccagcagacattcatgcaagtatgtatggtattgtttaaaagtggtccaagaaaaatgaaaatatggtgaggcttta

SEQ ID NO: 7516 - DNA, 201 bp, Homo sapiens
aatgaaaattcaaaactttgctctatcataaagaaaatgaattcaagcgaactttacaccctatgaactaaaaactcagatgtaatacatgaagcagctcytaatggggaaagcactgtggctgtgaaaccaccttttccagagggtattcccagttcccaatgcacacacacacacacacacacacacacacatacactg

SEQ ID NO: 7517 - DNA, 201 bp, Homo sapiens
aggacactccagatcaccctccccctcaatttcacactcggattatactcagctgtctaaatccctcaggattagcttgtcaggacctcccacaaaagaawgaaagtcaagtgagatagcttctttttcagggcagttccctataaagctctgtcttctagaatgagttgtgggagaagccagaaagctggctagatccca

SEQ ID NO: 7518 - DNA, 201 bp, Homo sapiens
gtaagatgggagcagccttccttagggccccaagtttgctctcagtggaagtagacagacatgagctgcctcccgcaccttagcgctgactcatttccaaygcctcaggacactccagatcaccctccccctcaatttcacactcggattatactcagctgtctaaatccctcaggattagcttgtcaggacctcccacaa

SEQ ID NO: 7519 - DNA, 201 bp, Homo sapiens
tcaggcaaaagacagaatgcacgttcattttcacaaggccgacagagctccaatgaggagtgtcctcctgagagtcctgacgggcaggtcccagtgagctrccactatctgttgcatcctgcctgtgagcgatgccctaatctcctacaaacgagtgcatgcaagtaatacacatttcccaacagcaagaattaccaataa

SEQ ID NO: 7520 - DNA, 201 bp, Homo sapiens
tctgctctatctgaaaggaagagaagaaaggtggagacgggagtgtggtggtgaggaggagggaaaggagaaggggtgtagcgaaaagggaagaaaaaggmggatgatgaaggaaacatggtaagaaagggagtgtgaggaggaagagggaggaggggaagcagaaacgaggaggagtgggggacaggaggaagagcagag

SEQ ID NO: 7521 - DNA, 201 bp, Homo sapiens
agggttgttttttttaaacaagtggtataaacgccttctaaattttaaatccttttttcaattaggtgatattcttgctgttttttaaaaaatctcacctygaattttacgcactaaattgctggtaagatttctaagagatgtcaacttcggagcatcagaatacatttgaaaagggcaaaatgtaatttcaaattttgt

SEQ ID NO: 7522 - DNA, 201 bp, Homo sapiens
tctaaattatgctaagttataaatttatggtcaccaattcaagaaaatatgctatttaaataaaatggataaaaagcagaaagcttgagttatattttaayttctgagggttgttttttttaaacaagtggtataaacgccttctaaattttaaatccttttttcaattaggtgatattcttgctgttttttaaaaaatct

SEQ ID NO: 7523 - DNA, 201 bp, Homo sapiens
atacttctagttccaactataataaataaggaatactcaacctgtggtatgactgaagaagttattctctgctatcaaatgctacaaatatacattctatmgtccaattttctctaaaaaaattttgaaaggtttgtaaacctatcataaagcatttgcttccattatgttgcaatgaggctaaaagctctctctgtcctc

SEQ ID NO: 7524 - DNA, 201 bp, Homo sapiens
ctgtggcctgcactcttgtcagcagcgttcccggctctgtgttttcaaacacggtgatggcataaggatcggcagagaattcgggggcgttatcgttcacrtcttctagcgtgagcacaatactggcttggcagaatcttcctcctccatctgtggccctgacgagaagatgataaacagcttgctcctcacgatcaaggg

SEQ ID NO: 7525 - DNA, 201 bp, Homo sapiens
ctctatctgaaaggaagagaagaaaggtggagacgggagtgtggtggtgaggaggagggaaaggagaaggggtgtagcgaaaagggaagaaaaaggaggakgatgaaggaaacatggtaagaaagggagtgtgaggaggaagagggaggaggggaagcagaaacgaggaggagtgggggacaggaggaagagcagagagga

SEQ ID NO: 7526 - DNA, 201 bp, Homo sapiens
tccatctgagggtcgagactgtaggttagagtatcatacacgtcctggtctgtggcatggatcttcccaatgacgccacctgagtattcttctccagaagmggtgatgaaaatctccaggggcaaaatcgcaggcggatagatgctctcctcaattaccctaatgtcaatgtatgtcaaagatgacaactgaggctttcca

SEQ ID NO: 7527 - DNA, 201 bp, Homo sapiens
gaaccccacacatctggtgtcagaagcatgttctgagagtctaattcaggaaactgagtttgttttctatccataagcaggaagtatctcacatcttattwaaaaaactgtctgctttttccaaaacctaaatacaaattcaacatgggaaaaaaaaaaacatagcatagtacttacaacactgttgccattcctaaagct

SEQ ID NO: 7528 - DNA, 201 bp, Homo sapiens
ttgggggaaccccacacatctggtgtcagaagcatgttctgagagtctaattcaggaaactgagtttgttttctatccataagcaggaagtatctcacatyttatttaaaaaactgtctgctttttccaaaacctaaatacaaattcaacatgggaaaaaaaaaaacatagcatagtacttacaacactgttgccattcct

SEQ ID NO: 7529 - DNA, 201 bp, Homo sapiens
aactaaaaactcagatgtaatacatgaagcagctcctaatggggaaagcactgtggctgtgaaaccaccttttccagagggtattcccagttcccaatgcrcacacacacacacacacacacacacacatacactgcacaactataaaaactaagtatttactgacaacgttaagaaaatttgaccaaggataaaatgaaa

SEQ ID NO: 7530 - DNA, 201 bp, Homo sapiens
aaagaaacagctgcacccctgcgcgccttcctgaccacgcaggctctcttctcgcattagtttaagtggaaagtgaacctcacccaaatgttaagctaccraaaacttaatacctttaggccatggaagagatacgtgaagattctgctttacacatttaaagagtcttcttaaaaacaacacactctacatacttaaaaa

SEQ ID NO: 7531 - DNA, 201 bp, Homo sapiens
agaccaaaaacatcctgctatgccaggactgcttcctggtggtcccccttgttatcccgactctggatctcttggcctctgggtcccggaaccgtccaggmccgcagctccagctgttttttttgctgcccttgctgcctcaagccccaccccagcaggccccagctctggggtctagtcctcaacccaattccatgaggg

SEQ ID NO: 7532 - DNA, 201 bp, Homo sapiens
gcaaggttacacagcgaggtcaggtactgcacagcagcagcctgttgatctggaaatgtgataaaagttaacagaaagcaaacaaacggttttgagcatcrttaactacgaaaatagtctctttttccccttcccttgaaagtatgctgtaagggtttcacaggtgctgatgacatcaatttcacacaatcaccaaattgg

SEQ ID NO: 7533 - DNA, 201 bp, Homo sapiens
cacatttgtattctgtgtatggaatgcctgacagaagaacaatgatttcatgaccacattcaacataaacaataagcaccctgattctcaaacgttatccrgcattgcctaatggggccagcaggtcacaaacacttcagccgtttacaaaatagaaataaagttactaaagaaaaaatacaaaataaggtttatagtcac

SEQ ID NO: 7534 - DNA, 201 bp, Homo sapiens
agttttcggttcgatgaaaaatttgccatgctcattcccgtcttcgatgctgtaggagatttctgcattggggccctcatccttgtcggtggctatgacgygatagagcggctcccgtctggcatttctttctcggtctggcttttcccgctcagggagtctgattttgtagaacttttgcagaaactgaggtttgttgtc

SEQ ID NO: 7535 - DNA, 201 bp, Homo sapiens
ttatctttgtcagtgactgcatttgccccttctgtcaatccttgtagtgacagaatgaaaattcaaaactttgctctatcataaagaaaatgaattcaagsgaactttacaccctatgaactaaaaactcagatgtaatacatgaagcagctcctaatggggaaagcactgtggctgtgaaaccaccttttccagagggta

SEQ ID NO: 7536 - DNA, 201 bp, Homo sapiens
cttctgcagagcacttaatcactcaccaacagcactgcgcaaatacttatgagcaaatacaactccccacttcacgatttacttagagcacacaagaaggytaaggaaagctgtacctgtgtccatactaccaattccacataaaaaggctgggcatggtggctcacacctgtaatcccagcactttgggaggctgaggca

SEQ ID NO: 7537 - DNA, 201 bp, Homo sapiens
aagtatgtccacttctttcattttcgacatctgtgctcatctgcaatattttttgccaaatcccagaaagatatatacttaaaggaaactgtacagaactkcagaactagacagaaacctttaagattatcaagttgagctgcctgaaccaaagagaagttaaaattttccaaggccactagtaagtcattaacaaagcca

SEQ ID NO: 7538 - DNA, 201 bp, Homo sapiens
aatgtagaagagatctaacagtctactaaccaacttgcaaaatcgtatctgagatctcaaccttgatactgatactctaattgctctatttaaagaataaytttgttattaacaaccaagagaagtgaaatacaaacatcctttctaagcactcttgcttagagcaacgggagggattcaatttttacttcagaaatataa

SEQ ID NO: 7539 - DNA, 201 bp, Homo sapiens
aaatggttgaaaaaaacttttgtgatacatgaaaagggcagaaaattcaaattttattgaatttatttcgtttatttacaaagttttactggaacacagcrgtgctcactcatttccgtatcatctacagcagcttctgggctacagtgacacggctgagtggtgtgacagagactgtatggcccacaaacccaaaagccc

SEQ ID NO: 7540 - DNA, 201 bp, Homo sapiens
tggtcgtggtggtgcaggtctgtgatcccagctattcaggagaccgaggaaggaagaacttgggcagaggagtttgaggctgcagtgagccaagatggcaycactgcactccagcctggacgacagagtgatacactgtctcgaaaaacaaaaaaaaaaacaaaaaaaacttcactctacaggatggaggaaggaaaacct

SEQ ID NO: 7541 - DNA, 201 bp, Homo sapiens
gtcgtggtggtgcaggtctgtgatcccagctattcaggagaccgaggaaggaagaacttgggcagaggagtttgaggctgcagtgagccaagatggcatcwctgcactccagcctggacgacagagtgatacactgtctcgaaaaacaaaaaaaaaaacaaaaaaaacttcactctacaggatggaggaaggaaaacctaa

SEQ ID NO: 7542 - DNA, 201 bp, Homo sapiens
gaaagaaaatgcaaacactagttgcctctaagtagattttattattcaggtatggtgaggcaacagatcaggtacgaccgccagtacctgaaagtacctgmaaaggcagtttggtacttccccaagaggaggccataccaccgccactgaaggtggcaaaggccgaaggccgtgctgggccatacgggaccatgccagggt

SEQ ID NO: 7543 - DNA, 201 bp, Homo sapiens
acgctcaggactggctggtttaagtaatttcaaaggctctggggcatagctgtccccagttgtctagcactggctctgatatgacttgggcgtgacacagrtggtggtgtggagtgggactctggactggtcagcttgcatatgaaaagcacggtcctgcaccagtcatctgctatcccgagtcctggaaggggcagtcct

SEQ ID NO: 7544 - DNA, 201 bp, Homo sapiens
tgggagggggaatacagagaagtgtgaggagacctttgggaatgatgggtgtggtcactgcctgatagtggtgatgttttctcaggtgtaaaagctatgtsaaagcttatcaaattgtagactttaaatatgtgcaatttgctgtaagtgaattacacctcaaaaaagctttttaaaaataaagatcaatacttggtttgt

SEQ ID NO: 7545 - DNA, 201 bp, Homo sapiens
ataagaatgtctgaaatgcagacagacagttcttggcaccataattaagcacaaaaaccttgaagagaaaaaacattcaaaaaagttcactcaaacttgtkgtttagaacacaaaattcataagctcactcactaaacccactcctagaaagctttcttgttgtgacttttaaaatattttgttacactatgacaaaaggg

SEQ ID NO: 7546 - DNA, 201 bp, Homo sapiens
tatttcttgcttgctcatctatctcttcacagaggacttactctaatctaaaagagagacagaagacacaagaaaattgaaaacactgcttagtctaattmatcaaacaaattactataggggtagttctggtcttgaattgccacctgagatatgacatatacgtgtgttgtggggaggggtacatatttgtttctgtcc

SEQ ID NO: 7547 - DNA, 201 bp, Homo sapiens
gtgcaatctcgccctttgtctaccaaaaacatatcactgcactttttctcatggattgatcactcgggactaaagatactttcagtgttcttctacaccayggtacaggctggactctggaaatgctgaagctctagaatcactgaagtttcccgttaaacgcaaactactgtgagaaaaataaccaattaccaattttac

SEQ ID NO: 7548 - DNA, 201 bp, Homo sapiens
atgtgcaaagaaagaccaggggtagagctagccttcgccatctcaaaatcaagcattagactgggaacgccttcaaaaccctccagtgcaactcccttgtycttaaagaacgttgaaatgatttgtccaactccaagaagctaaacaggtgtagttcagaatccagagtgaaggacttccttaatcaggggttcatcacga

SEQ ID NO: 7549 - DNA, 201 bp, Homo sapiens
gaggagggagggctgcagcccaggccttccgcaggattccctccagccagatgccgggagcaacagagccgtgagaggggtgacagggaaactctgtcgcyactcccgtcaggaggttgccgtgcacacgcagtgagagcggtcgtgatgctgctgcgtgatgctatgacgcagatttggagcacaggagacaggttgaga

SEQ ID NO: 7550 - DNA, 201 bp, Homo sapiens
atgtaccaatactgattctttaattgtaacatcttacatactcatgtaagatgtcaacaacgtgagaagctggggcagggagcagggagttatgtgagcaytctactttctgctccatttttctgcaaatgttttatttttttaaaaagttgtctatgagagctcataatatgtagattgtttccttccttcaattaaaaa

SEQ ID NO: 7551 - DNA, 201 bp, Homo sapiens
ctgctaaaccatgttgtcccgctttgttgaggaatgattccaagttctgacttccctgtcagaatcactgatattgtcaatgacggcttttgtggataagstctactgttaaagaggatcacccttgggtatcaaaacttatcatctggacacctgttaattggataaaactacatccacaagacagccttcagaagcatt

SEQ ID NO: 7552 - DNA, 201 bp, Homo sapiens
tacttctaatacccaatttgttgccaaaaccaatacctgtaagaactcagaagcttaagttaggtcaagctaacctaatcaggaagtgattcacggacacygataacctaggagaaacttcagatatgtccttttatgctaacgcttcatattaaatcaaacagccctatctaataatctaaatgcactgcaagatttgat

SEQ ID NO: 7553 - DNA, 201 bp, Homo sapiens
accaagatttcttagtggtaactgtggggcagacaaatgaagtatttaatatgcactattttatgcaaacaggaaacaaatctcataaagtactttgaaasagaattaaaacaggaggaaaacggattactgctaattcatcactttagagactatgaagacaaatcttgctggagacattaaaagactatataagaatag

SEQ ID NO: 7554 - DNA, 201 bp, Homo sapiens
tattcaaactaaccactagaaaaaacaaattcaaaaacacacaagtgttcattataacacactagttgtaattaagtagcagggtggttactaaaatataygtatcggagaagataaaaatataaataaatagctaggcgcagtggctcatgctggtaatcccagcactttgtaaggccaatctagtaggatccttgagcc

SEQ ID NO: 7555 - DNA, 201 bp, Homo sapiens
ctgcactccagcctgggtgacagagtgagactctgtctcaaaaaaaaaaaaaaaaaaaaaaaaaaatgggggttgggggaaccccacacatctggtgtcaraagcatgttctgagagtctaattcaggaaactgagtttgttttctatccataagcaggaagtatctcacatcttatttaaaaaactgtctgctttttcca

SEQ ID NO: 7556 - DNA, 201 bp, Homo sapiens
caacactgttgccattcctaaagctcaaatatttccagctcatgacagtatcagatatatgggttcaaaaggaaaagcatgttatcaagtctacagtttaraagatgatttttgaaaaatgactttgtgctaaactcttggattgagattgccttttcattcagcaatttatgaaagaggtggtgaagcaatcgtatattt

SEQ ID NO: 7557 - DNA, 201 bp, Homo sapiens
cactgttgccattcctaaagctcaaatatttccagctcatgacagtatcagatatatgggttcaaaaggaaaagcatgttatcaagtctacagtttagaaratgatttttgaaaaatgactttgtgctaaactcttggattgagattgccttttcattcagcaatttatgaaagaggtggtgaagcaatcgtatatttttt

SEQ ID NO: 7558 - DNA, 201 bp, Homo sapiens
agtatcagatatatgggttcaaaaggaaaagcatgttatcaagtctacagtttagaagatgatttttgaaaaatgactttgtgctaaactcttggattgarattgccttttcattcagcaatttatgaaagaggtggtgaagcaatcgtatattttttcccacttattttactacattggttggtttgctgtagcaggcta

SEQ ID NO: 7559 - DNA, 201 bp, Homo sapiens
gacctaggcacacatctcaatcactggtcaagagtatcaccgaattatttcggaattggagagggaaacaagagtgaatgtaggttttattctcagtctgytacttcaaagtattggccttataatcaaccatccttacagcatgcctgttaactgtcccaactcagcattttaataaatgtgtgactttggcaatttatt

SEQ ID NO: 7560 - DNA, 201 bp, Homo sapiens
tgggagactaaggcgggtggatcacctgaggtcaggagttcgagaccagcctggtcaacatggggaaaccccatctctactaaaaatacaaaaattagccrggtgtgctggcatgtgcctgtaatcccagctactcgggaggctgaggcaggaggattccttgaactcgggaggtggaggttgcagtgagctaagatcaca

SEQ ID NO: 7561 - DNA, 201 bp, Homo sapiens
gatcacaccaccgcactccagcctgagtgaaagagcgagactctgtctcaaaaaaaaaaagaaagttgtaaatgtttctaacatgatgcgtatgcatgaaracagactttttgaactaaaaacatgcttctgaaagaaaacaacttttaatgatttgtttttaaagtagttaaaacagcaatcttatttcaagggtttaca

SEQ ID NO: 7562 - DNA, 201 bp, Homo sapiens
cactccatctaaggaggccatgcacaccctgcaaaaatccttaacacatgccctgttttcctccacagcaccgctcagctgaaactgtgcgttcttttctyctcatctccgtgttgactcgtgtctcctctctccagaagaatagctccaagaagggcacagcaccatccaccttgcaaactgtggagtcctgggctccaa

SEQ ID NO: 7563 - DNA, 201 bp, Homo sapiens
taaggaggccatgcacaccctgcaaaaatccttaacacatgccctgttttcctccacagcaccgctcagctgaaactgtgcgttcttttcttctcatctcygtgttgactcgtgtctcctctctccagaagaatagctccaagaagggcacagcaccatccaccttgcaaactgtggagtcctgggctccaagaagggcac

SEQ ID NO: 7564 - DNA, 201 bp, Homo sapiens
caaactgtggagtcctgggcacctagagcaggttctggcattctagaggcggtcaataaacgtcaactaccagatgaatgaatgcatggaagggcattcasccaagccttctttcaccctctcaaatcttgcctctgtgaaattttccgaaagttttgctttcaaaggccactcgtgatttctccaaagcctttttccttc

SEQ ID NO: 7565 - DNA, 201 bp, Homo sapiens
tcgtaggagacgtaggaccatgaactgtgctcctccccgggatgcacctgcctccgcccgaacactgccatgcacagaaaatggaactgacgctcggcccrttttcaacagaatgaaacagctaccacatttctttaggacactttaaataattaccatgtattttctaaagcaactaacattcctctcacaagtgaatga

SEQ ID NO: 7566 - DNA, 201 bp, Homo sapiens
atctgtaagagactcgtattcccttcaactgaggtgagcattgctctctctactaaaaaagagaatactggcaggtcctgagctttgctctatctggtagkttgcatttgtagatgagtccgtctctaagcagccagcaagctgtaagcacaccggttgtgagaatctgtataaggaaatctacttccctcagttaaactc

SEQ ID NO: 7567 - DNA, 201 bp, Homo sapiens
cactaagctaatgaagaataaaatatgtgtcaatttttgaatgagtgttcttttttccaagggctcaatgaaagcatcttggcataattaaatcaatatastaatctcaacatctgggcctgctctgttgaaatgcaaccctctgcctcaatacaaatctcattttaatatttaattattgaatctattgcctaaagtcag

SEQ ID NO: 7568 - DNA, 201 bp, Homo sapiens
aatttaatttgacaagcctgatagcagcgaaaacgaaaaattcaactacttctgattttacgaagtagcatctggccaatgaaatgaagagtgaaagcatrttttacagtctgtccatccctcattagcctttatctggcatacaagagacgctttttaaacaattaattaatgtgaagaaataagcctcaatatgcactg

SEQ ID NO: 7569 - DNA, 201 bp, Homo sapiens
gagaaatgggcactcacaaactgctgatgggatgtctagttctcataaaaacaaacaaacaaaaaaaaagaacagcttttaaaaatttcattacctttcamccagcaatttcacttcctgttatttacgctaaggcaacagagatacacacaaacaaggaacttacatattcaaaaattgagtattactatacaaacagga

SEQ ID NO: 7570 - DNA, 201 bp, Homo sapiens
ataggtccttaatatgtatctgctccctgaactgattcctgttcataaggtaatcgcggaccccatgtggtcctttcacaggggcttcggcaaatcccctrcagtgagatggcccctgggcagctctgttttctgcagaccaggctgtgacctaatcaatagggttccaagcaagacaatccctacattcaacagctcgga

SEQ ID NO: 7571 - DNA, 201 bp, Homo sapiens
taggtccttaatatgtatctgctccctgaactgattcctgttcataaggtaatcgcggaccccatgtggtcctttcacaggggcttcggcaaatcccctgmagtgagatggcccctgggcagctctgttttctgcagaccaggctgtgacctaatcaatagggttccaagcaagacaatccctacattcaacagctcggaa

SEQ ID NO: 7572 - DNA, 201 bp, Homo sapiens
gctgagtaacttttattaaaaaaaaacaaaaaaccaattgatttaaaactaaaaagactgtattagtagactctccccaacatgaaatgagtaagacattytaaagaatcccattcaacaggttgagccactcggaggcctagcaatggaccgagttcaacatggtatcagatattcgaggagatatggtactgttgaact

SEQ ID NO: 7573 - DNA, 201 bp, Homo sapiens
acaagaaaagccttccaacaattaacgtcctgtccagttcagatgggcagcatttttaccgattaaatcacacttttacaactgcaaacacaaatatgacrcctgtccatctcttcaatggccaatgagacaagggaagctacaggcactcacctggattcacccacgccttcgctggcctgatcttgacttgctgactgc

SEQ ID NO: 7574 - DNA, 201 bp, Homo sapiens
cagaatgccgggcccagtgcccggctgtgacactcagtgtcgtggttattactagactggtgctcaccaccagtgtcattaccactgacagcatgaggacraagccggcctgtctgacgtaagctgtttccaccccacacctccgggtcccggcccctgcacactctgagaattacatcacagcacggtaagcgtcactgc

SEQ ID NO: 7575 - DNA, 201 bp, Homo sapiens
tgccgggcccagtgcccggctgtgacactcagtgtcgtggttattactagactggtgctcaccaccagtgtcattaccactgacagcatgaggacaaagcyggcctgtctgacgtaagctgtttccaccccacacctccgggtcccggcccctgcacactctgagaattacatcacagcacggtaagcgtcactgcgtgct

SEQ ID NO: 7576 - DNA, 201 bp, Homo sapiens
gttattactagactggtgctcaccaccagtgtcattaccactgacagcatgaggacaaagccggcctgtctgacgtaagctgtttccaccccacacctccrggtcccggcccctgcacactctgagaattacatcacagcacggtaagcgtcactgcgtgctgctccacaacgtgggacggccctgagtcacggtcccccg

SEQ ID NO: 7577 - DNA, 201 bp, Homo sapiens
gacagcatgaggacaaagccggcctgtctgacgtaagctgtttccaccccacacctccgggtcccggcccctgcacactctgagaattacatcacagcacsgtaagcgtcactgcgtgctgctccacaacgtgggacggccctgagtcacggtcccccgagttcccatccacagcctttccaggctagacttgttcagtca

SEQ ID NO: 7578 - DNA, 201 bp, Homo sapiens
tagctgtgattctcagactgtggaaagacacctttgcacctaagccatccattagcgatcgctttaatgacaatacccccgagttggggtttaaactaaasaaatccagttcatttccagcttcaatctgatactgtaccaactgaagttcatctgcatcaatagcagaaacagtggttatttgctctcccacgcctagat

SEQ ID NO: 7579 - DNA, 201 bp, Homo sapiens
gttcgtagtccaggttttctgacgtactcacggcaccagtgaaatggtcaatcgcaaacggcacatgatttaaatttgcgatactgtatgtcacgtacccrttctcaccctcatcagggtctacggcactcaggctcatgacagtagtaccaatgggcacgttctcatcaaaagcagctttgtacgctgtctgggtaaatt

SEQ ID NO: 7580 - DNA, 201 bp, Homo sapiens
agatgataaacagcttgctcctcacgatcaaggggggttgacgttttcagttcacctacaaacaaaaacaaatggactcacttgtaatttaagacgtgachtgcagttgtacatcttatttcctccccttttgtctttcaattacttagtctgagtattcacagccttcctcttgagaccagtattatcaatgacagattc

SEQ ID NO: 7581 - DNA, 201 bp, Homo sapiens
agtctgagtattcacagccttcctcttgagaccagtattatcaatgacagattcaacagctgcaagaggcagtgagctccaggtctccaaccctgccaggkgctagctctttaagtcctgcaggtctgaggccagggcctctcaccttgtgtataagattgcacaggtgaaacagctaccaaatttaccaaaatttaaaaa

SEQ ID NO: 7582 - DNA, 201 bp, Homo sapiens
aaggactcatccctattgctttctggagtattccctttgaccaggctgtaaagaacagtcccactatgttctgctcggatgagatctatctctgttccaayaggcacgtcctctgacactgtaaaggtatagaaaggttctgaaaattttggaagctgcatttccggtggaaggattttaacatagacaagaacaacagat

SEQ ID NO: 7583 - DNA, 201 bp, Homo sapiens
ttatttcatacaccactgatgattgactatgggctgtaaccatcccaacgaaactcccaatgctgacagtttcactaagttcaacagaatattcttttgaygtaaacttcggagaggcgttgtcagcaattgtgacaaagatacgcacagaagttatttcactcattggtggactgcccttatctgtagcttttaccatta

SEQ ID NO: 7584 - DNA, 201 bp, Homo sapiens
catccaaactgtcaaagcatgttccgccattcttacagggttcatctttgcagtatggactaagctgacacctgaagagtaaggagaaacagacataaacytcacgatcctattgcaaataaatacagcaaaacagaaagcaaaacagaacacattagcaaattaacgtgcagactttttacatgtaccattatatgttta

SEQ ID NO: 7585 - DNA, 201 bp, Homo sapiens
aggagtctgttcaagtcgttggctgccatcactgtctccaaaatgttggaagagaaggagcagaagcaggagcaaagccaaatgtctccccattgcttaamtgtcgggaatctgaaacagaagaaatcagaatcgttaccttggggaaataaaacaagcaaaagtgtgtacattgttttaaacttctcattaaaaaaatat

SEQ ID NO: 7586 - DNA, 201 bp, Homo sapiens
caatggaggaagataataatcaaatttgttgaaaggataaaaataagtaacagaaaaaataaactgtacaaaagatgtataatgttatagtttaaaagaaytgagtattaaaagaattaatttggcatatattagccttccaatttacaaaaacaagggcagcattaaaatgcataaacatagcattaagactactaatca

SEQ ID NO: 7587 - DNA, 201 bp, Homo sapiens
tggtatgaattttttttacctgttatgaaatatgtaacttgtctgttgatctcttcagaatcagcatccgtggtacttaagatggcaatcaccccaccttrggggtcatcctcactcacagtccctttatagatctcggccgtgaatcgtggtggactatcgttgacatcggtgacggtaacatccacaatggctgtggag

SEQ ID NO: 7588 - DNA, 201 bp, Homo sapiens
gggcagaggaaaagcaccagtggcagcaggtctgattaagcaataagctcttaggaatcctagaacagtgagaatatctcaaaaatcaaagcacggaaagraaagagataaaagcttggctttatctttaaaatgctcatcttttaatactgatagcgacttcttgaattctacgtttcccatttttctagaaagaaacct

SEQ ID NO: 7589 - DNA, 201 bp, Homo sapiens
atgaatccacaaccaaaccacaaagaaagccattcataccttcacctgcagtaagtaatgatctttctccttcctcttgatggcagatgatgtcaggaggrctccttgcgggttaacttcaaaagccttctcatcatttccagttacaatagtaaagaagaagggtggaccgttatgggaagaatcctcatctgttactac

SEQ ID NO: 7590 - DNA, 201 bp, Homo sapiens
gttgccgtcagttcttgaggcggtcagtcctgctcacaccacgcccagcagacaagagcacaaggcatttctagttattgatgtggtgatttgtaaacaaygtaaatcaacctttttcacttaccgtttctcggtcgagaagtttggtcactttgacttctcccctgacggggtcaattgtgaacgagcttccttggttgc

SEQ ID NO: 7591 - DNA, 201 bp, Homo sapiens
cagttttcactgtaatggggaaaaaatacacaccgtgatgacagactgctcaagaacggcatcttcactgatgactgtcgtgtaggtgtcttggctgaacrcaggggtattatcgttgatatctgttacattaacgttcacagtggcaacgtcgctcagtgaaggcgtgcctccatcagtggcctctactgttaggtaata

SEQ ID NO: 7592 - DNA, 201 bp, Homo sapiens
gttcctttaaagttgtaatccagcctgtttccatgttaatggcaaaggattcaatgacttccacactttgtgactgatccaggctatacataacttggccrttggttcctgagtcagcatcagatgccctgatctgaattactctacttccccctggcaggttttcaacaatgaatgcctcatatggactagattcaaaga

SEQ ID NO: 7593 - DNA, 201 bp, Homo sapiens
tgattgactatgggctgtaaccatcccaacgaaactcccaatgctgacagtttcactaagttcaacagaatattcttttgatgtaaacttcggagaggcgytgtcagcaattgtgacaaagatacgcacagaagttatttcactcattggtggactgcccttatctgtagcttttaccattaaatcatactccgcttggtt

SEQ ID NO: 7594 - DNA, 201 bp, Homo sapiens
tagcttttaccattaaatcatactccgcttggttacttcgatctaattctttggcagttttaatagagcccaagacaggatcaatcataaaagaatttccratatttcctggaaggagaggaaaaaatacatgttacagaaaaacacaaggggcagtagtagtagtagttagagaaacagaaacaaagtatccttaaaaat

SEQ ID NO: 7595 - DNA, 201 bp, Homo sapiens
tttaccattaaatcatactccgcttggttacttcgatctaattctttggcagttttaatagagcccaagacaggatcaatcataaaagaatttccaatatytcctggaaggagaggaaaaaatacatgttacagaaaaacacaaggggcagtagtagtagtagttagagaaacagaaacaaagtatccttaaaaattatat

SEQ ID NO: 7596 - DNA, 201 bp, Homo sapiens
catactccgcttggttacttcgatctaattctttggcagttttaatagagcccaagacaggatcaatcataaaagaatttccaatatttcctggaaggagrggaaaaaatacatgttacagaaaaacacaaggggcagtagtagtagtagttagagaaacagaaacaaagtatccttaaaaattatattctgaaattaagc

SEQ ID NO: 7597 - DNA, 201 bp, Homo sapiens
agagcccaagacaggatcaatcataaaagaatttccaatatttcctggaaggagaggaaaaaatacatgttacagaaaaacacaaggggcagtagtagtastagttagagaaacagaaacaaagtatccttaaaaattatattctgaaattaagcagaaactcaggggatgtcaatatttgaatggaaccttcaacttgtt

SEQ ID NO: 7598 - DNA, 201 bp, Homo sapiens
ctgaaattaagcagaaactcaggggatgtcaatatttgaatggaaccttcaacttgttttatttttatccacctaaaaccaggtatactttacagaatttygtccataaatgatgaaaaacaaaaaacagaagaaacagcactctgctcttagcgaagccaaaactccctctctcggctgcactgggaatgtgtggtggaa

SEQ ID NO: 7599 - DNA, 201 bp, Homo sapiens
tgataactccagtattgaagttaatagtgaactggctgaaagggtctccgtctgtgatgctgtagaacactttcaggccttccgggctgttagcctgcacrtggaccacagggctgtgcacctggatgctctctgcaatctctgcactgtagaaaggtttttcaaacacaggcatggctttattcatgacagtgatcggaa

SEQ ID NO: 7600 - DNA, 201 bp, Homo sapiens
tcggaacgataacttccgctgaaaaggccgggttccctccatcttttgcaaccactgtaacaagatattctttatttaaggtgtcaagctcaaattgcttyttcagtgaaatttcacccaagggtccaatttgaaagtgttcatgatgttccttgaggtagtaatgcacttccccgtttctgccactgtctctgtctacag

SEQ ID NO: 7601 - DNA, 201 bp, Homo sapiens
ccggcgcattatcattttggtcttctacaatgaccttcacgacaacgtgggccactgcagaaggcttatgttcctctgtcacttctacaaccacatcaaaygcctcctgctgctcacgatcgaagggcgtgccagtggttgacagaactcctgaagtgcggcttattttaaatctgcgatctgggttgaggatgtgataaa

SEQ ID NO: 7602 - DNA, 201 bp, Homo sapiens
ggcttattttaaatctgcgatctgggttgaggatgtgataaaacaaaggctcattgattggattcccaatagcagtaatgacagctaatgtttcggcctcrgtggaattctctttcactaccgcagagtagacatcctgggtaaactttaggtgactttctttgctttctttcacattaattttgacagaggtaaggccgg

SEQ ID NO: 7603 - DNA, 201 bp, Homo sapiens
tctctacaagtactattctcaccagtgccttttgtttgaggttcagacatatcgaggggataaaaattgggcaaatactgattcaagttgaacctctgccrgtttcttgatgaagaacccaagctacccgcggcaggcatgtctctaggagggtggatggattcaaactgattgctgaattcgggcggtaacggtggtagc

SEQ ID NO: 7604 - DNA, 201 bp, Homo sapiens
tgatttcatgaccacattcaacataaacaataagcaccctgattctcaaacgttatccggcattgcctaatggggccagcaggtcacaaacacttcagccrtttacaaaatagaaataaagttactaaagaaaaaatacaaaataaggtttatagtcacaacatatgaaaaattacagtactacaatcttaactcactgaa

SEQ ID NO: 7605 - DNA, 201 bp, Homo sapiens
ttcaagtcgttggctgccatcactgtctccaaaatgttggaagagaaggagcagaagcaggagcaaagccaaatgtctccccattgcttaactgtcgggartctgaaacagaagaaatcagaatcgttaccttggggaaataaaacaagcaaaagtgtgtacattgttttaaacttctcattaaaaaaatattttccatac

SEQ ID NO: 7606 - DNA, 201 bp, Homo sapiens
aaggctgtatctcacctgaccagactgacctaaatcaggatcgtgggcttctaaccacatgatgacggttccttctggaagatcctctcggactttcacaygataattaggtggaataaatgtaggtgggttgtcattaacatcttctagtgatactttcacaacgacagtggagaacagctgaggctcttctctggcttg

SEQ ID NO: 7607 - DNA, 201 bp, Homo sapiens
tgagcattgacagagtgagaatcgaagaaaatatcctccacctctccctggttgtgtaatttatttgcctgcaggagcttctctgccagcattttggcaayaccagtctcttcacactgcaagtttaccagcttgtgactggcagccactgttatgttgatatataatggtgtggcaaaattttctccatctgtagctgtg

SEQ ID NO: 7608 - DNA, 201 bp, Homo sapiens
ccagcttgtgactggcagccactgttatgttgatatataatggtgtggcaaaattttctccatctgtagctgtgattctcagactgtggaaagacaccttygcacctaagccatccattagcgatcgctttaatgacaatacccccgagttggggtttaaactaaacaaatccagttcatttccagcttcaatctgatact

SEQ ID NO: 7609 - DNA, 201 bp, Homo sapiens
ctgtagctgtgattctcagactgtggaaagacacctttgcacctaagccatccattagcgatcgctttaatgacaatacccccgagttggggtttaaactraacaaatccagttcatttccagcttcaatctgatactgtaccaactgaagttcatctgcatcaatagcagaaacagtggttatttgctctcccacgccta

SEQ ID NO: 7610 - DNA, 201 bp, Homo sapiens
tgactgtcccaatcaatgccaccgatggctttgactttatactccttactccctggaaaggacctcactgttctaaactgctggagaaggtcacctgccaygatgcttaaagatgctatgtcaccattggcaccctgatcgcagtcatccactgtcacaattgcatatgctgggtccctgtccagttctgatggtgacaat

SEQ ID NO: 7611 - DNA, 201 bp, Homo sapiens
gtcccaggtgcttgtctttaggttcagcctgatgcttctttttccgactaatcatcttacggcagagaacaaacaccaccaccagtaaaaatatccctgcracaaacacaacgattccaattccttccgccaacccaatgttccacggcgtggacacatactggttgggcgcagcatcctcgcagtgacgtcccctgtact

SEQ ID NO: 7612 - DNA, 201 bp, Homo sapiens
tcaaagcatgttccgccattcttacagggttcatctttgcagtatggactaagctgacacctgaagagtaaggagaaacagacataaacctcacgatcctrttgcaaataaatacagcaaaacagaaagcaaaacagaacacattagcaaattaacgtgcagactttttacatgtaccattatatgtttaagaattttata

SEQ ID NO: 7613 - DNA, 201 bp, Homo sapiens
gagaaacagacataaacctcacgatcctattgcaaataaatacagcaaaacagaaagcaaaacagaacacattagcaaattaacgtgcagactttttacaygtaccattatatgtttaagaattttatactacaattgattatgaaagttaagaaaaatacacatacctctgaccagtatataatcctctacactggcaaa

SEQ ID NO: 7614 - DNA, 201 bp, Homo sapiens
caaaacagaacacattagcaaattaacgtgcagactttttacatgtaccattatatgtttaagaattttatactacaattgattatgaaagttaagaaaawtacacatacctctgaccagtatataatcctctacactggcaaacaaagcctccgttgtcgacaacacacgtgcccccatagaggcatgggttggaggaac

SEQ ID NO: 7615 - DNA, 201 bp, Homo sapiens
ctctgaacagagacaattccagggccacttccacagtcaaacttgtactgcagccttccatgatgaatctaggataaaagcaatgactgttcacattactytcatagaaccttcaatgagagcacctgatcacaaatctacaggagagggcttagggagtgagggtagaagttaggccttacatttaagtactacagagca

SEQ ID NO: 7616 - DNA, 201 bp, Homo sapiens
caggaaaattaaactgctacataatggcactgcgttgttagctgtatgtctatataatcattgaagacacaggaggagggacaccaactatgaaccaaggkgtgtgctgtaacaagaggaagcaaaacttactactgtcattctttattcatctccacatctgtcttcttacaataaacatactttgcaatatttttagac

SEQ ID NO: 7617 - DNA, 201 bp, Homo sapiens
taaactgctacataatggcactgcgttgttagctgtatgtctatataatcattgaagacacaggaggagggacaccaactatgaaccaaggggtgtgctgyaacaagaggaagcaaaacttactactgtcattctttattcatctccacatctgtcttcttacaataaacatactttgcaatatttttagactccaataaa

SEQ ID NO: 7618 - DNA, 201 bp, Homo sapiens
accttttcatcgcagaacttccaggggcagtccagtcccgcgcagagtttctggaatacattcagtatcctaactccaatgatttcctcaatgtcagtcayggaagagttaatcttgtgcagaagttgttttgttgagatctgagcactacctggtttctctacaaaaagtaagacgtccagatgtgggtgaggttcagag

SEQ ID NO: 7619 - DNA, 201 bp, Homo sapiens
caggagggttatcattgatgtcgtctactatgatgtccacaaatacttcagcatgagcgcccgtcaaggagtcagttgcgcgtatgctcagcttatatgcygggtgggcctcaaagtccagaggagctatgacattgataactccagtattgaagttaatagtgaactggctgaaagggtctccgtctgtgatgctgtaga

SEQ ID NO: 7620 - DNA, 201 bp, Homo sapiens
caccgttagcttggccatgctgctgatgccactgctcccatacaacttcatgccacggtccgcagcgaggatttccatctcatagagcttggtctctaggwaatcaagtctaccagttaacactatcacaccactggttgggtgaatagcaaacatatctgttcgatctttaaaactgtagtaaaattccccgttggttcc

SEQ ID NO: 7621 - DNA, 201 bp, Homo sapiens
tgtctgacaaaattatctgaatcaaaagagaaaaaaataaaaaaatacctggggagcttccccttaaatgtacacacgtgcagcattttaaagatggcaamattacggagcccacctccagcaggtgacggattgcaaacgcctccattctggcaagggttgctggcgcagtcttccgtggccgtcaggaagcagcctgga

SEQ ID NO: 7622 - DNA, 201 bp, Homo sapiens
gcccccatagaggcatgggttggaggaacacggattgacgcttatctcacagtgggtccctatgtacaaggcactgcatttgcagtaataacctaaatcgkcaaaaaggaacaaaaaagtcctatcactcaatgactcagaaacctggtcttaattatattgctttttatctttattctccgaggtctgtaaaagctcgta

SEQ ID NO: 7623 - DNA, 201 bp, Homo sapiens
agtcatccactgtcacaattgcatatgctgggtccctgtccagttctgatggtgacaatgtcactgctgttatcaccggagcacattcattggcctgttcratgtgcaccgttagcttggccatgctgctgatgccactgctcccatacaacttcatgccacggtccgcagcgaggatttccatctcatagagcttggtct

SEQ ID NO: 7624 - DNA, 201 bp, Homo sapiens
tggctctaacttgaacaacagacgttccaattacagatgcctcagacagggtcaccgcataagactgctgagcaaacacaggagggttatcattgatgtcstctactatgatgtccacaaatacttcagcatgagcgcccgtcaaggagtcagttgcgcgtatgctcagcttatatgccgggtgggcctcaaagtccagag

SEQ ID NO: 7625 - DNA, 201 bp, Homo sapiens
tccccagcagacattcatgcaagtatgtatggtattgtttaaaagtggtccaagaaaaatgaaaatatggtgaggctttaagggtagatagtgcgtctacrttgtgagataacacagtaacacaacaagcaagcaaagcgcagtgttgcagcacactgctgcctcaccattgtcatcgcacgattcggactggaaggagct

SEQ ID NO: 7626 - DNA, 201 bp, Homo sapiens
gaatataaagtctgcaaagagtttaaacaaaaacgttacataaaagcattaacaggcagcacaaacatcaagggaataatggaaaagaaatcattcatctytgaccacagaaaacatgggaaatgactaaagataaaatcccaagagctttgaaaacgatttttctcataaaacataaaacacatgtgaaacaaggaggag

SEQ ID NO: 7627 - DNA, 201 bp, Homo sapiens
cgatgtcgtagcctccagggtaatagtccgtatcgatggcgtttggatctgctgagtacaggggtgtctgctcatcaatcacctcatagttggggaactcytgtatgtccggcagaggaacgcttggcatccaatctgatgtatcccagtgatacccttggtggaaaagaaaacagatgtcagtgtgttttctcctaagct

SEQ ID NO: 7628 - DNA, 201 bp, Homo sapiens
ttaaaagtggtccaagaaaaatgaaaatatggtgaggctttaagggtagatagtgcgtctacattgtgagataacacagtaacacaacaagcaagcaaagygcagtgttgcagcacactgctgcctcaccattgtcatcgcacgattcggactggaaggagctcagagactgcacttcagacaggctttcccgggcactgt

SEQ ID NO: 7629 - DNA, 201 bp, Homo sapiens
tgaacccaataacgtgtaagtaatttcagcgttagagcggatgtctgcgtctgtagcagagatctgcatgatcaattttccaggaaggacgtcttcaggartagtgtctgaatataaagtctgcaaagagtttaaacaaaaacgttacataaaagcattaacaggcagcacaaacatcaagggaataatggaaaagaaatc

SEQ ID NO: 7630 - DNA, 201 bp, Homo sapiens
ctgcggggaagtcttctgggggtggaggaaaatcactttcgatgtcgtagcctccagggtaatagtccgtatcgatggcgtttggatctgctgagtacagrggtgtctgctcatcaatcacctcatagttggggaactcttgtatgtccggcagaggaacgcttggcatccaatctgatgtatcccagtgatacccttggt

SEQ ID NO: 7631 - DNA, 201 bp, Homo sapiens
aattttgcaatcaaaatattatagttgaaagcaaattctccacctgtcgatcttattcccaattttaaatcctgacttgtgcccaaaactcatcaaaccgyatgcaggttctcctcagtgtaacccatacggacaacgaaaatgagggggaatgcttaccagtgatgtcaaaccaaaggggtatgccaggaggctccacag

SEQ ID NO: 7632 - DNA, 201 bp, Homo sapiens
tatagctgtgttttcaggtaaagaaacgctgtatgaggtgggtgagaataacggtctcaagtcatttgtatccagcacctgcaccctgacctttgttcgcrcctccacattagtatttttttcaagtgctttcactatcaatgtgtagtgatccttcacttctctattaagaatagctgtatttcctcctttggtccttat

SEQ ID NO: 7633 - DNA, 201 bp, Homo sapiens
ccttttttcaattaggtgatattcttgctgttttttaaaaaatctcaccttgaattttacgcactaaattgctggtaagatttctaagagatgtcaacttyggagcatcagaatacatttgaaaagggcaaaatgtaatttcaaattttgtgtgtgatctaaaatcacccacatatatgatactgttggaatatacaattt

SEQ ID NO: 7634 - DNA, 201 bp, Homo sapiens
gcaatggaaaggtagaggatgatcaggggaatgaaaacagaattagtttgtgcataatttttaaagatttttcttctcttctttttcttttcttttttttycccaggctgaattgcaatggcacgatctcggcttaccacaacctccgcctcccgggttgaagcgattctcctgcctcagcctcccaagtagctgggatta

SEQ ID NO: 7635 - DNA, 201 bp, Homo sapiens
ttatcttcacatacataatgaacccttggaattaagcaagaattcaggcaatgtatttaaatctgggacttacagtaaaagatgacttaaaaaacttaaaagagtgaaatatgcagattcctcatcagaatatatttttgaaatgaaaagttcccctcaggtatgagaaaatggcaacttcctgatcttaactgatgtata

SEQ ID NO: 7636 - DNA, 201 bp, Homo sapiens
tggcatgcacctgtagtcccagctactcaggaggctgaagcaggagaatcgcttgaacccgggaggcggagcttgcagtgagccgagattgcgccactgcrctccagcctgggcgacagagccagactccgtctcaaaaaaataaaataaaataaaataaaataaacttcattcaaacctttgcttctttcaaacaaacac

SEQ ID NO: 7637 - DNA, 201 bp, Homo sapiens
ggcaggcggatcacgaggtcaagagaccgagaccatcctggccaacatggtgaaaccctgtctctactaaaaatacaaaaagtagctgggtgcggtggtgkgcgcctgtagtcccagctacttgggaggcagaggcaggagaatcgcgtgaacaagggagacggaggttgcactgagctgagatcgcaccactgcactcca

SEQ ID NO: 7638 - DNA, 201 bp, Homo sapiens
gtcagaggctgcagccacaacacaggcggagcgcgtgtgggctggggcacaacgggggtggggggcagattgtgaatctatttcaaggttgcctgatgcactggagtggggagagggagggaaaggaggagagaacagtaccagagaagatgccaaagactgctcagcgtagagaacaagggggccaggaaccgagaggga

SEQ ID NO: 7639 - DNA, 201 bp, Homo sapiens
agtcagaggctgcagccacaacacaggcggagcgcgtgtgggctggggcacaacgggggtggggggcagattgtgaatctatttcaaggttgcctgatgcactggagtggggagagggagggaaaggaggagagaacagtaccagagaagatgccaaagactgctcagcgtagagaacaagggggccaggaaccgagaggg

SEQ ID NO: 7640 - DNA, 201 bp, Homo sapiens
gtctatcttcctccatttatttattcaattttttttcttttttagacagagtctcgctctctcacccaggctggagtgcagtggcgcgatcacggctcackgaagctttgagctttccgggcccccgtctcagcctcctgagtagctgggactataggtgcgtctgtagatttagactgacagaattttacatactcagga

SEQ ID NO: 7641 - DNA, 201 bp, Homo sapiens
agaccagcctggtcaacatggggaaaccccatctctactaaaaatacaaaaattagccgggtgtgctggcatgtgcctgtaatcccagctactcgggaggytgaggcaggaggattccttgaactcgggaggtggaggttgcagtgagctaagatcacaccaccgcactccagcctgagtgaaagagcgagactctgtctc

SEQ ID NO: 7642 - DNA, 201 bp, Homo sapiens
aatatattacatatattgtcattaatatcaattattgtatattattgatattatgtattatatatgttattaatatattattacttttatatacatattayatacataaatatatatacataggcctgcatataagaaattacaggggaatggcaaggctgcggagaaacaggaacgcttttacactgttgaagggaatgt

SEQ ID NO: 7643 - DNA, 201 bp, Homo sapiens
aggtgacagagtgagaccctgtctaaaacacacacacacccacacatacacacgaccctgtctaaaacacacacacacacacacacacacacacacacacmcacacaattaatttttaaaagctgtaccttatttttcaacaagggacttaatgttgtttgtactggcttggatcttaatctggaacctggctttattgat

SEQ ID NO: 7644 - DNA, 201 bp, Homo sapiens
caggtgacagagtgagaccctgtctaaaacacacacacacccacacatacacacgaccctgtctaaaacacacacacacacacacacacacacacacacacacacacaattaatttttaaaagctgtaccttatttttcaacaagggacttaatgttgtttgtactggcttggatcttaatctggaacctggctttattga

SEQ ID NO: 7645 - DNA, 201 bp, Homo sapiens
aatgggtaaagcacaccaacatggcacatgtatacatatgtaacaaacctgcacattgtgcacatgtaccctagaacttaaaggatagtaaaaaaaaaaaatgaaataaaataaaataaacctcagaaccaaataaaaatgagctaactggttcctccgtacagcagacaactgaagatgaactcaaacatgcttccctgt

SEQ ID NO: 7646 - DNA, 201 bp, Homo sapiens
tttcaccatgttagccaggatggtctcgatctcctgacctcgtgatctgcctgcctcggcctcccaaagtgctgggattacaggcgtgagccactgtgccyggttatgctaaatttttatccaaaataaaggcttattttgaataattcaaaaggaaaacaatttatcaagaaacaaaagtatgtaacagataaatgctaa

SEQ ID NO: 7647 - DNA, 201 bp, Homo sapiens
acatttaagctaatttttttttttttgagatggagtctcactctgtcgcccaggctggagtgcagtggcaccatctcggctcactgcaagctccgcccccygggttcacgccattctcctgcctcagcctctggagtagctgggactacaggcgcccgccaccacgcccagctaattttttgtacttttactagagatggg

SEQ ID NO: 7648 - DNA, 201 bp, Homo sapiens
tagctttataaaagcaaactcaaagtttaaaaagcacatttaagctaatttttttttttttgagatggagtctcactctgtcgcccaggctggagtgcagkggcaccatctcggctcactgcaagctccgccccctgggttcacgccattctcctgcctcagcctctggagtagctgggactacaggcgcccgccaccacg

SEQ ID NO: 7649 - DNA, 201 bp, Homo sapiens
cctgcagaatctgaggctgtctccaggtaaaaaaatgtcagaattgaatgagaggactcccaaggtgtccgctgcttggtgtgtaggaaatcctcccccccgccccccggccagccccccaaacacacacttggtcccagaagtcttctgtgatgatgattgttgaggtttgggaagagggtaggaaaacatctctttgag

SEQ ID NO: 7650 - DNA, 201 bp, Homo sapiens
tggggagtcatacagggaccccataccctagtcttcagacgtctcttctgctttcaattctaccttactagctgtttcttgttgaaaattgatggcattamaacataagatcgacagcaaaactcaatttacagggaattgccttcagtgatcctataaatgtcagatatagcagggtcagaagaagaggatagggtacac

SEQ ID NO: 7651 - DNA, 201 bp, Homo sapiens
ccactgcaattgagcttaggttacagagtgagactgtctcacaaaaaaaaaaaaaaaaaatatatacacacacacacacacacacacacacacacacacaygaaagatggcagctagaaaaggaaaaaaataggatttctgaataggattcaggtccaactgcaacaagagagcaagcacttgcaatctgtagtacgagtc

SEQ ID NO: 7652 - DNA, 201 bp, Homo sapiens
accactgcaattgagcttaggttacagagtgagactgtctcacaaaaaaaaaaaaaaaaaatatatacacacacacacacacacacacacacacacacacmtgaaagatggcagctagaaaaggaaaaaaataggatttctgaataggattcaggtccaactgcaacaagagagcaagcacttgcaatctgtagtacgagt

SEQ ID NO: 7653 - DNA, 201 bp, Homo sapiens
cctgggaagccgaggttgcagtgagctgagggcggaccactgcaattgagcttaggttacagagtgagactgtctcacaaaaaaaaaaaaaaaaaatatayacacacacacacacacacacacacacacacacacatgaaagatggcagctagaaaaggaaaaaaataggatttctgaataggattcaggtccaactgcaa

SEQ ID NO: 7654 - DNA, 201 bp, Homo sapiens
gacctgggaagccgaggttgcagtgagctgagggcggaccactgcaattgagcttaggttacagagtgagactgtctcacaaaaaaaaaaaaaaaaaatayatacacacacacacacacacacacacacacacacacatgaaagatggcagctagaaaaggaaaaaaataggatttctgaataggattcaggtccaactgc

SEQ ID NO: 7655 - DNA, 201 bp, Homo sapiens
ttggacctgggaagccgaggttgcagtgagctgagggcggaccactgcaattgagcttaggttacagagtgagactgtctcacaaaaaaaaaaaaaaaaaatatatacacacacacacacacacacacacacacacacacatgaaagatggcagctagaaaaggaaaaaaataggatttctgaataggattcaggtccaac

SEQ ID NO: 7656 - DNA, 201 bp, Homo sapiens
tcaattttgacagtttgttagccaaggtattatgctttaatagatacttcattacatatatatatatatatatatatatatatatatatatatatatatatgcctgtaaaaaactgagatatatccacatatgtatatgtgtatatcttcacatatgatgtgtaaatatgtgaagatatctccatttttacaggcttagag

SEQ ID NO: 7657 - DNA, 201 bp, Homo sapiens
ctcaattttgacagtttgttagccaaggtattatgctttaatagatacttcattacatatatatatatatatatatatatatatatatatatatatatatatgcctgtaaaaaactgagatatatccacatatgtatatgtgtatatcttcacatatgatgtgtaaatatgtgaagatatctccatttttacaggcttaga

SEQ ID NO: 7658 - DNA, 201 bp, Homo sapiens
gattaacatgttaagatatactatataaaaagtgagcatcttcttcctcatgctactccgcatgtgtgtaaagctctgcattttgcagggcacgatgacaacatacacagcagatcttcattccaacaacagggctgtaaggaggtgaggcagcacctcccatctctacagggagagagtcagggggccgggcatggctaa

SEQ ID NO: 7659 - DNA, 201 bp, Homo sapiens
atgcctgacagaagaacaatgatttcatgaccacattcaacataaacaataagcaccctgattctcaaacgttatccggcattgcctaatggggccagcaggtcacaaacacttcagccgtttacaaaatagaaataaagttactaaagaaaaaatacaaaataaggtttatagtcacaacatatgaaaaattacagtact

SEQ ID NO: 7660 - DNA, 201 bp, Homo sapiens
aatgcctgacagaagaacaatgatttcatgaccacattcaacataaacaataagcaccctgattctcaaacgttatccggcattgcctaatggggccagcaggtcacaaacacttcagccgtttacaaaatagaaataaagttactaaagaaaaaatacaaaataaggtttatagtcacaacatatgaaaaattacagtac

SEQ ID NO: 7661 - DNA, 201 bp, Homo sapiens
gaatgcctgacagaagaacaatgatttcatgaccacattcaacataaacaataagcaccctgattctcaaacgttatccggcattgcctaatggggccagcaggtcacaaacacttcagccgtttacaaaatagaaataaagttactaaagaaaaaatacaaaataaggtttatagtcacaacatatgaaaaattacagta

SEQ ID NO: 7662 - DNA, 201 bp, Homo sapiens
aaaaatggacataaagtcccccccagagagatgaatcgcaacagagactcttgttcttaaatacccttgtaactaaaatgtgaggaaacaataaaaaaaaatctaagatgcaaactctaatgtgaaatttaaaaaatacgttgaatagggtattacattcaatgtcttatctaaactacatgacaaataagaagaagaaat

SEQ ID NO: 7663 - DNA, 201 bp, Homo sapiens
tgaatgaatgagggaccaacatggcacctggcacataaagtgagcttcaccagcccacagaatgaatgaatgaatgaatgaatgagggaccaacatggcamctggcacataaagcgagcttcatcagcccacagaatgaatgaatgaatgaatgaatgagggaccaacatggcacctgacacataaagtgagcttcaccag

SEQ ID NO: 7664 - DNA, 201 bp, Homo sapiens
cagaatgaatgaatgaatgaatgaatgagggaccaacatggcacctggcacataaagtgagcttcaccagcccacagaatgaatgaatgaatgaatgaatragggaccaacatggcacctggcacataaagcgagcttcatcagcccacagaatgaatgaatgaatgaatgaatgagggaccaacatggcacctgacacat

SEQ ID NO: 7665 - DNA, 201 bp, Homo sapiens
tgaatgaatgagggaccaacatggcacctcgcacataaagtgagcttcatcagcccacagaatgaatgaatgaatgaatgagggaccaacatggcacctgrcacataaagtgagcttcaccagcccacagaatgaatgaatgaatgaatgaatgagggaccaacatggcacctggcacataaagtgagcttcaccagccca

SEQ ID NO: 7666 - DNA, 201 bp, Homo sapiens
agggaccaacatggcacctggcacataaagtgagcttcaccagcccacagaatgaatgaatgaatgaatgagggaccaacatggcacctcgcacataaagygagcttcatcagcccacagaatgaatgaatgaatgaatgagggaccaacatggcacctgacacataaagtgagcttcaccagcccacagaatgaatgaat

SEQ ID NO: 7667 - DNA, 201 bp, Homo sapiens
atgaatgaatgagggaccaacatggcacctggcacataaagtgagcttcaccagcccacagaatgaatgaatgaatgaatgagggaccaacatggcacctsgcacataaagtgagcttcatcagcccacagaatgaatgaatgaatgaatgagggaccaacatggcacctgacacataaagtgagcttcaccagcccacag

SEQ ID NO: 7668 - DNA, 201 bp, Homo sapiens
gagggaccaacatggcacctcgcacataaactgagcttcatcagcctacagaatgaatgaatgaatgaatgagggaccaacatggcacctggcacataaastgagcttcaccagcccacagaatgaatgcatgaatgaatgaatgagggaccaacatggcacctggcacataaagtgagcttcaccagcccacagaatgaa

SEQ ID NO: 7669 - DNA, 201 bp, Homo sapiens
agggaccaacatggcacctggcacataaagcgagcttcatcagcctacagaatgaatgaatgaatgaatgagggaccaacatggcacctcgcacataaacygagcttcatcagcctacagaatgaatgaatgaatgaatgagggaccaacatggcacctggcacataaagtgagcttcaccagcccacagaatgaatgcat

SEQ ID NO: 7670 - DNA, 201 bp, Homo sapiens
gagggaccaacatggcacctggcacataaagcgagcttcatcagcctacagaatgaatgaatgaatgaatgagggaccaacatggcacctggcacataaascgagcttcatcagcctacagaatgaatgaatgaatgaatgagggaccaacatggcacctcgcacataaactgagcttcatcagcctacagaatgaatgaa

SEQ ID NO: 7671 - DNA, 201 bp, Homo sapiens
atgaatgaatgagggaccaacatggcacctggcacataaagcgagcttcatcagcctacagaatgaatgaatgaatgaatgagggaccaacatggcacctsgcacataaagcgagcttcatcagcctacagaatgaatgaatgaatgaatgagggaccaacatggcacctcgcacataaactgagcttcatcagcctacag

SEQ ID NO: 7672 - DNA, 201 bp, Homo sapiens
ctgcaacctctgtcccccaggttcaagcaattctcctgcctcagcctcccgagtggctggggttacagacacactgtaatttttgtatttttattagagayggggtttctccatgttggccaggctggtcttgaactcctgacctcgtgatccacccgcctcggcctcccaaagtgccaggatcccaggcgtgagccaccg

SEQ ID NO: 7673 - DNA, 201 bp, Homo sapiens
aaaataaaaacgtaaaaattctattgtgtctttcggtttcattttttgtctcatctttttaaaatattttccttctcatatttttaaaatggagatttatrtccttttaacttctagataaccctttatttacatcctctcatttttaaaaatccctttttaaacaattccttttaacatctttcacatcattctagtcct

SEQ ID NO: 7674 - DNA, 201 bp, Homo sapiens
tgacatgtctccagcatataactcaatggttactgaaaatatctcttaattaactcctttttccctgaatactcctaatcagaccaaaccttttactcaawtaattgctgctaattaaacatgcagtgttacgtactgaatttgtaactagtctttttgaactttaaatgtaatctgacacaaattagaagcagataatta

SEQ ID NO: 7675 - DNA, 201 bp, Homo sapiens
agcttcaccagcccacagaatgaatgaatgaatgaatgaatgagggaccaacatggcacctggcacataaagtgagcttcaccagcccacagaatgaatgmatgaatgaatgaatgagggaccaacatggcacctggcacataaagtgagcttcaccagcccacagaatgaatgaatgaatgaatgaatgagggaccaaca

SEQ ID NO: 7676 - DNA, 201 bp, Homo sapiens
tctggggtctagtcctcaacccaattccatgagggaaatccacctgttaaaggcgagtggcaaaaatccaggtaaatgtggaaggggtgggaggggcacgrcacctctttctgaggtttcagccaattacaatgagatgagtcaacactgttatggagcttcctgctctgctcaagagaaaatactctctgacaaaaaagt

SEQ ID NO: 7677 - DNA, 201 bp, Homo sapiens
cccagctgatccctctgctcttcaatccatccctgcagtaccctagtgtctcacctcccagctgactcctgtgctcttcaacccattcctgcggtatcctrgtctctcgccgcccagctgactcctctgctcttcaatccatccccgcggtatcctagtgtctcactgcccaggtgactcctctgcttttcaatccatccc

SEQ ID NO: 7678 - DNA, 201 bp, Homo sapiens
agtaaagtttacacttcagtttctcaatcacactaagccaaatttccagggtacggcagcccccaggggccggtgacgacagcatggagcaaggcagatgsagaacgcgctccccacggcaggaagctctgctggacggcaccggtctactcaggaggcataattcacaaatcaagatcctgcaagaaaccctgcagggtg

SEQ ID NO: 7679 - DNA, 201 bp, Homo sapiens
gatggagaacgcgctccccacggcaggaagctctgctggacggcaccggtctactcaggaggcataattcacaaatcaagatcctgcaagaaaccctgcarggtgggtttacttttctgcggagaacacgtaagatatttcagactgacaaaaacaaacaaataacaacaacaaactttctttctaaattcacaacactta

SEQ ID NO: 7680 - DNA, 201 bp, Homo sapiens
gtacgagtcatcgatgaccccacactgaaagacagggtcctggctctaaaggaaggaatctctgcagccctatgttcacctcacccggcaggaaatttacytggaacacttttcaattactctactagagaataagcacaggaagggaaaaagatcaaggaaaaaaggtaaaaatctggtcacccgataccttccttttac

SEQ ID NO: 7681 - DNA, 201 bp, Homo sapiens
ccttttgcaggaaggagtcctctgggctccatccctttctcacgatgttgtattaatcatagcattattctgacaaacccttgactgcaggcacgcacttyagatacataccattttcacccgatgatgtctctgaaacactttcatatattctacttgatactaagtttaagaactgtaatcatagtatttttggtggta

SEQ ID NO: 7682 - DNA, 201 bp, Homo sapiens
ttcttgcttatatacaagtgaaagaaaatgcaaacactagttgcctctaagtagattttattattcaggtatggtgaggcaacagatcaggtacgaccgcyagtacctgaaagtacctgcaaaggcagtttggtacttccccaagaggaggccataccaccgccactgaaggtggcaaaggccgaaggccgtgctgggcca

SEQ ID NO: 7683 - DNA, 201 bp, Homo sapiens
aacagatgaggggacacccacgatcgcagcagctttctgccttgagacagtttccagacagctatgcacccctatgtgatgtccaagagaaatggaagtakgtgtccacagaaaggcttgtactcaatgttcacagcggatttacaaactgccaaaaactggcagcaatacaaatgcctattactaggtgagtggataaac

SEQ ID NO: 7684 - DNA, 201 bp, Homo sapiens
ctgccttgagacagtttccagacagctatgcacccctatgtgatgtccaagagaaatggaagtatgtgtccacagaaaggcttgtactcaatgttcacagyggatttacaaactgccaaaaactggcagcaatacaaatgcctattactaggtgagtggataaacaaattataatattaatctatctatataaaggataca

SEQ ID NO: 7685 - DNA, 201 bp, Homo sapiens
gagttcaccaagataaaattccaggaaatgcaaactattatttagtgctagaaagcacaccagcatttgactagagatggaggtgggagggttgggagggrgaatacagagaagtgtgaggagacctttgggaatgatgggtgtggtcactgcctgatagtggtgatgttttctcaggtgtaaaagctatgtgaaagctta

SEQ ID NO: 7686 - DNA, 201 bp, Homo sapiens
tgatactgacctacctgggaacagtctgctttaaaggttgtaagaagacgaggcatgtgtacttcaggccctgaggatcacaccccaactttctgctgagktgggggaagagaagcatctagaaacagatctaatgaagctatatttactatattatttaataattccatgctaaaatactgttcttcatcttcagagact

SEQ ID NO: 7687 - DNA, 201 bp, Homo sapiens
atataggctataaaagtatttgttattagaatcaggtgtcaggcactaaatggagcactttaaaaatattatctcactgaagtctcaaaataggtgagcaytaagagatcatctaatggcccaacacttcatttttccataggtaaagtttatagttggttgagagacgtgctgactttcctggaggctactcaggaagac

SEQ ID NO: 7688 - DNA, 201 bp, Homo sapiens
aatgccaggccctgtgataagtgtcttacatgcattatcttatataatctttacatccaacctgcctagatatgtgatgctattaactccatttcactaaygaaaaactcagattgagagaaatgaggcactttcccagggccacagtgaatggcagagctggagtgtgaataccacaaatctcatcttcagcgccagcaa

SEQ ID NO: 7689 - DNA, 201 bp, Homo sapiens
cagtgtgcaattctgagatggcatctgctggtccccaccgacccatcagctgtacaaccagggggtgggggacagtcatgtccatcaggaggggattgtcrgcctccccggtaatctacggatattactaaaggttaagactgaggcaacaaagcgactctattcaaatatcggagattgtgtaattcgcaattaaaatag

SEQ ID NO: 7690 - DNA, 201 bp, Homo sapiens
gcttctgcttcgatgcattttaattattacctctttgtaagataaaaaatcactgaatacaacttacggagaactataaagtaaatttcaactgccaaagrgagaggagggcacaccgaagaatcttatcttctaaccaaaatcctcagatccctcatgtccaccaatcacgtcactagatgctttatgtgcattaaatca

SEQ ID NO: 7691 - DNA, 201 bp, Homo sapiens
tctgcttcgatgcattttaattattacctctttgtaagataaaaaatcactgaatacaacttacggagaactataaagtaaatttcaactgccaaagggaraggagggcacaccgaagaatcttatcttctaaccaaaatcctcagatccctcatgtccaccaatcacgtcactagatgctttatgtgcattaaatcattg

SEQ ID NO: 7692 - DNA, 201 bp, Homo sapiens
tcacgatccaaaccattctttaagggagtcctggtttctgcagggagtgacacaccagctgtctccaagtatgaccgaagctgcctttactcattaagtcwttagcagttcttgttcctacacttcatcatgctttcaccagtccttcctaaagccacgactggcatttacagattacagattgatttcttctgtaacttt

SEQ ID NO: 7693 - DNA, 201 bp, Homo sapiens
tcccgtcaggaggttgccgtgcacacgcagtgagagcggtcgtgatgctgctgcgtgatgctatgacgcagatttggagcacaggagacaggttgagacasgcttgttacgtgtgccactcagcagtgccatcagaaatcacggctttacctgaatgaagcattacggaaggaatgaaagcctagctttccaacctcgaga

SEQ ID NO: 7694 - DNA, 201 bp, Homo sapiens
aacctgccagaagtcacacagtccattagtggggaactgggattcaaccctaaaagtcaggttccagacaatcgtgctaaatgtttggagtccctgcctgyccttcaattggagggaagattaaggggcaactgaacacaacctgcaaatttcaccagagaagttgtgacttgaatgcaatccagaaatgtagctgccaga

SEQ ID NO: 7695 - DNA, 201 bp, Homo sapiens
gcctcgattaatttaacctaatactgaagacatttgacagatgctcccttgataagcctattttgaaataatgctggcatatccctggctttaattattgwccttaaaaaagaaatacaactcaacagactaacacaatctgttcaaaagagacacgcaaaggggtaccagtgttgagaagcaaaggctaagccatcctat

SEQ ID NO: 7696 - DNA, 201 bp, Homo sapiens
acagacaaggaagtccagggaataaatgacttcacaagttactaggttgcagagcttgaatcaaagccataactggaacccaaatctcttgaaatctcagyctacgttcgagagtggcacctagtagagaggtgcacgcttgcattaacacaaatctcataagactgaaatcggcttttctgattggtgagggaaatggct

SEQ ID NO: 7697 - DNA, 201 bp, Homo sapiens
taagactgaaatcggcttttctgattggtgagggaaatggctcacattaggaaaagcaaaagtcaatgatactatctcagagttaatgatctgccaaccaraccctaagaaagcttaaaaaataatcggccttaccttaacatggtatcagtgactttgacctaggcacacatctcaatcactggtcaagagtatcaccga

SEQ ID NO: 7698 - DNA, 201 bp, Homo sapiens
atcaataccgctgaagtggcagtgaggtctgccacaaactttccctccagccccaaatgaagagctacttttataaaacgtttcaaagtttcatttcaaayatgaaaggacaataaaaaccaggaaaagtcaaattaggaatttctgggacacagaaaggaacattagtccacctttgcctccataactatctttccccac

SEQ ID NO: 7699 - DNA, 201 bp, Homo sapiens
taaataattaccatgtattttctaaagcaactaacattcctctcacaagtgaatgactggatgttaatcactaacttgggggataagagggaaaaaacaamcccaaactccctttaccccaccagtattaacgcagcacagtgaaacactttcagacacgtaatacaaacagggtaacaattgttttaatttaacaaattt

SEQ ID NO: 7700 - DNA, 201 bp, Homo sapiens
acttccagtctccctgtggctgggaaacgagcttcttttctcttaagctttcctaggaggagaacataaagagccaagaggacagcagctgctgccacttsagggaggagccagcaacacaaaagccctttcaccagcacattttttaactctctgccgggcctcccacccgtctctaatcaagttcctgctgccaggaat

SEQ ID NO: 7701 - DNA, 201 bp, Homo sapiens
tctggccaggcatttttctagacattcccttagttttaaaaatgaacaaaaagctgcagcatttcattggtgctcaagtaataattaacttgctaagtacmcatcagctaagaacactacaccaaatttattccacacacccacaagagggatgctccagattttattctgcttaaattacaggaaaacctgttgaagctt

SEQ ID NO: 7702 - DNA, 201 bp, Homo sapiens
aatcctcactgtagaccttacagatagcaatctgaggaggagaatcttaattagagctctggaaactggctctctaacgagaccgactttccaaataattkttcacatggccctctccccttccagacctcacatggaagggcagtcacgtggcatggatctgtcagaacagttcaccaacatccagaggcctctccagga

SEQ ID NO: 7703 - DNA, 201 bp, Homo sapiens
aaatggtcaatcgcaaacggcacatgatttaaatttgcgatactgtatgtcacgtacccattctcaccctcatcagggtctacggcactcaggctcatgayagtagtaccaatgggcacgttctcatcaaaagcagctttgtacgctgtctgggtaaattcagggggattgctatttgcacctaagactttcaccaagacc

SEQ ID NO: 7704 - DNA, 201 bp, Homo sapiens
cttcaagttcaaaatgggctgcctgctgtcttttaactggttctaaaatagaaatgagaccagtgttgtaatttaaactgaatttagcttttccaggtgtmcttttaaaaacatacctcaaatgggaataagcaggaatggcctttaccatgaccacaggtgtgttgggaggagcaaattcacttatttctgctctgtaaa

SEQ ID NO: 7705 - DNA, 201 bp, Homo sapiens
aataagcaggaatggcctttaccatgaccacaggtgtgttgggaggagcaaattcacttatttctgctctgtaaacatccttttcaaacttgactggcccrgctttgaactgtggagaagtcacgtgaatgactttaacagaagagaactggggcggagttcctttatctttagcctgtagtgtgagattgtagccgaaag

SEQ ID NO: 7706 - DNA, 201 bp, Homo sapiens
gacaaggtcctctctttcatatttaaacgactcaaaaatcttcatgagtatcaaatgaaaggctactaactgtaacaactaagttatatttttatatttamatcgttaaggcaaatataagcaactgttaaaaattaatgaacattgtttacatttacttacatacaatgaattaaatgatcaaaagctggcaaacataat

SEQ ID NO: 7707 - DNA, 201 bp, Homo sapiens
agctcaggagttcgagaccagcctggccaaaacatggtgaaaccccatctctactaaaaatacaaaaattagcaggatatggtggagcaagcctgtaatcwcagttactccagaggctgaggcaggagaatcacttgaacccgggaggcagagattgcagtgagccgagatcgcgccactgcactccagcctgggcaacag

SEQ ID NO: 7708 - DNA, 201 bp, Homo sapiens
ggagacaaataaaaccttgtaatacccaaggtgctactgaaatcgaacatttcagactatcacatctcttcttagagggggtgtgtgtgtgtgtgtgtgtgagagagagtgtgtgtttgtgtgcgtgctgcgtggttaagaaagttgcgaggaagatttctgacaaacccacaaaactggggtgatattaactgttgtgaa

SEQ ID NO: 7709 - DNA, 201 bp, Homo sapiens
aggagacaaataaaaccttgtaatacccaaggtgctactgaaatcgaacatttcagactatcacatctcttcttagagggggtgtgtgtgtgtgtgtgtgtgagagagagtgtgtgtttgtgtgcgtgctgcgtggttaagaaagttgcgaggaagatttctgacaaacccacaaaactggggtgatattaactgttgtga

SEQ ID NO: 7710 - DNA, 201 bp, Homo sapiens
ggccgcagtggggttgggggaggagacaaataaaaccttgtaatacccaaggtgctactgaaatcgaacatttcagactatcacatctcttcttagagggkgtgtgtgtgtgtgtgtgtgtgagagagagtgtgtgtttgtgtgcgtgctgcgtggttaagaaagttgcgaggaagatttctgacaaacccacaaaactgg

SEQ ID NO: 7711 - DNA, 201 bp, Homo sapiens
cggggtttcactgccaggacggtctcgatctcccaaccttgtgatccgcccgccttcacctcccaaagtgctgggattacaggcgtgagccactgcgcccrgccacctgggactattattaagaagactgatgttccaacaacaagaactagaaagaaaatgctgataaaattctgaaatgtatttataaagagcatttag

SEQ ID NO: 7712 - DNA, 201 bp, Homo sapiens
gtagagacggggtttcactgccaggacggtctcgatctcccaaccttgtgatccgcccgccttcacctcccaaagtgctgggattacaggcgtgagccacygcgcccggccacctgggactattattaagaagactgatgttccaacaacaagaactagaaagaaaatgctgataaaattctgaaatgtatttataaagag

SEQ ID NO: 7713 - DNA, 201 bp, Homo sapiens
atatttttagtagagacggggtttcactgccaggacggtctcgatctcccaaccttgtgatccgcccgccttcacctcccaaagtgctgggattacaggcrtgagccactgcgcccggccacctgggactattattaagaagactgatgttccaacaacaagaactagaaagaaaatgctgataaaattctgaaatgtatt

SEQ ID NO: 7714 - DNA, 201 bp, Homo sapiens
cctcagctcactgcaagctacaactcccgggctcaggccattctcctgcctcagcctccccagtagctgggagtacaggtgcccaccaccacgcccggctrattttttttatatttttagtagagacggggtttcactgccaggacggtctcgatctcccaaccttgtgatccgcccgccttcacctcccaaagtgctggg

SEQ ID NO: 7715 - DNA, 201 bp, Homo sapiens
atgaaggaactgttgaaattctgcttctataagcttcaataatatttaaaatgctgaaggtcatcagtttaacactaaaacttcactagacaaaatacaggtatgtttctgatttgcccagtgaaaacatggtacttcttaggaaaagaagtgtaggcgtcatcagtaactataaccatgaacactggagtatctaagcct

SEQ ID NO: 7716 - DNA, 201 bp, Homo sapiens
ataaatgagagtgtttctgtggggatggcctggcccactctacgcacacagaatgcaaatatacctccctgagagaacagcagaaaaccaaagctttggaratcccacttaatgacagtattatttttgctctgttcattataccaagctctatttggtatgacaactgtcattttcctaactgtaccctattattggtaa

SEQ ID NO: 7717 - DNA, 201 bp, Homo sapiens
cataaatctgttgttcaaagagtggtggattatcattgaggtcggtaacgtccaccgtgacaatcacatcactgctcagcgtgggcataccaccatcaacwgccctcacaaaaatcgtgtgctgccgggactgctcgtaatccagggttctgagtagtgagatgaggccagtgctgctgtctacatgaaaatgatcatgac

SEQ ID NO: 7718 - DNA, 201 bp, Homo sapiens
atgaaaaatgtttataattctaaatacagcaacccatgtaagacatgttcatgtatctgatctctccttcatcctatgtacagctagaaatgaatgactayactgaaatgtactaacaaaatgtcacacttcagtggaaaaagacagaatgaaaccctggttatagtaaaaaaaaaaaaatcagggtgctagataatggca

SEQ ID NO: 7719 - DNA, 201 bp, Homo sapiens
agtgacactttagtgagatgaaaaagtggctcttactgtcatagtcaaagtcccagctaggcttctggatggagtcgctgtcagaaggggagtttgaaggrggtgggggaggcaggtttggcgccacgctgcagaccgccactgcttttcggtgcccgtgcacagactcggggttaaaagtgctgaattcgggatgctctg

SEQ ID NO: 7720 - DNA, 201 bp, Homo sapiens
aaaagttgtaaatgttagccgggcgcggtggctcacgcctgtaatcctagcactttgggagactaaggcgggtggatcacctgaggtcaggagttcgagamcagcctggtcaacatggggaaaccccatctctactaaaaatacaaaaattagccgggtgtgctggcatgtgcctgtaatcccagctactcgggaggctga

SEQ ID NO: 7721 - DNA, 201 bp, Homo sapiens
tcaaaaccagtgatgtgccatgagtgccattttgtgagaagccatttgtattttgagcaaactcagtggcctgatgatgactgacagggatggcaacatamcagcatacatggactcaagatatagcagagaagaacttcttatacatcagctcatttactccttacagcaaccctaagaagtaggtaacgttatcatatc

SEQ ID NO: 7722 - DNA, 201 bp, Homo sapiens
tatgaaagaggtggtgaagcaatcgtatattttttcccacttattttactacattggttggtttgctgtagcaggctatttgttaaaatctgaaactcaaraattttttataacgtgccatctaaagaactacttcataattttataaattctcaatcaaccataattcacaggcccagtaaactaacctgtttactgcta

SEQ ID NO: 7723 - DNA, 201 bp, Homo sapiens
tttaaacttttcatacaactgcttaaggcagcaattgtattaaaagctgctttgttcaatcacaagaaaaacttaaatgtgagatataattttaacgataytttccctacaggcaacaacagacagaaactcttttctccaattcaataccctcagcgtaaacagggtaactcttttgaaaataagcattttcccaaatat

SEQ ID NO: 7724 - DNA, 201 bp, Homo sapiens
catggactcaagatatagcagagaagaacttcttatacatcagctcatttactccttacagcaaccctaagaagtaggtaacgttatcatatcctatttcmcagaaaggaaacagacagtacaagcaacctgccagaagtcacacagtccattagtggggaactgggattcaaccctaaaagtcaggttccagacaatcgt

SEQ ID NO: 7725 - DNA, 201 bp, Homo sapiens
ttcttctaaaatagagacaataatagtatattcaactaacatgcatataatgattagaacacttggcacataatataggctataaaagtatttgttattakaatcaggtgtcaggcactaaatggagcactttaaaaatattatctcactgaagtctcaaaataggtgagcactaagagatcatctaatggcccaacactt

SEQ ID NO: 7726 - DNA, 201 bp, Homo sapiens
tggcccaatgtttgacacagaggaggtccactattgttggattggtaaatggacagatgaataaagcgttaagagtgagaaatgtgaggcaggactgtgtkggggaggggatatagagagggataacataggaaaataaaacatccatccttctcaaattaacagaaaatccaggcacaaccacgaggctggtaacaacac

SEQ ID NO: 7727 - DNA, 201 bp, Homo sapiens
aaagcttaaatatctttagcatagatctctgaaaatctataaatacggcagaaaaataacttttgcagtaaaaatcagatattaatatcttcatatttctwcattagggagaccttcatgtaaaatgcttccatcaattactgtgactgcacattcttcacaaaacagaacacagcccctgtgctgaaaacctaactgcat

SEQ ID NO: 7728 - DNA, 201 bp, Homo sapiens
cttaaactcactgcaatttgggatttctaaaatgcattttccgaagccaaaacaaagagtgtttacttagtctagccttgaaggagaagggctcccagtcyaaagcttaaatatctttagcatagatctctgaaaatctataaatacggcagaaaaataacttttgcagtaaaaatcagatattaatatcttcatatttct

SEQ ID NO: 7729 - DNA, 201 bp, Homo sapiens
aagggggacggtgagtaagcttactctggctttcttgccccgtactagatggccaagaggacagctgctgatgccaaggcaccaaggaggacaaggcaagrgaacgatggcctcatgtaactcgatgcagagggaggtacaaatcacgttagctttggcgtgcaggcctgaaagctgggacctaaccaccatcttaaacat

SEQ ID NO: 7730 - DNA, 201 bp, Homo sapiens
taaaattttttagatccttaaaaaataactgatttccattttgttgcctcaaccaacagactaacttggtatttacatgacaaacccgccttttttcactkaaatatgtaaacaccttcagctgggcaacaaatcgaaagaagaggatcatgggacaaacatgcacaggatctatgaaaagatgaacaccccctgagcagg

SEQ ID NO: 7731 - DNA, 201 bp, Homo sapiens
gacccatcaaggatcaccagaatggagagcttcattctgctccctctggagttattattaatccttttgggtatcagagatccctatgaaaaatgtaaaartggttaaattccctcagtgatccttccaaaaagattcagagggaatttttttttaatcacaaaacattgcatgtaatagttaacaaaactgagtttttca

SEQ ID NO: 7732 - DNA, 201 bp, Homo sapiens
aaatacaaattcaacatgggaaaaaaaaaaacatagcatagtacttacaacactgttgccattcctaaagctcaaatatttccagctcatgacagtatcaratatatgggttcaaaaggaaaagcatgttatcaagtctacagtttagaagatgatttttgaaaaatgactttgtgctaaactcttggattgagattgcct

SEQ ID NO: 7733 - DNA, 201 bp, Homo sapiens
aaagactaaacatctcagaattgtcatattaaatgttaatcactaaaaacatcaattcttccttaaaattaaattttaaaagtagattgtaagcttcctaytagaatgcaaactttttaaggacaaagaattgttacgtgtttggttcaaggccgggtcaatagtgagtgcttataaaaaatgatatccattacagacaag

SEQ ID NO: 7734 - DNA, 201 bp, Homo sapiens
ctgagcggtgggctgttgccactatcaatcaacagcaacactgtcggacaccaaaggtgctggggacctggtggggctataaccatgaggaaaggccacarggagtttcccagtgtggaaggaagggtcttcctcatgcatgcaggacaacagacgggagacgatctgaggattccgctcagagttttggggttcagtacc

SEQ ID NO: 7735 - DNA, 201 bp, Homo sapiens
ataatgcctatcgtgattgctgagataagcttctgcttcgatgcattttaattattacctctttgtaagataaaaaatcactgaatacaacttacggagarctataaagtaaatttcaactgccaaagggagaggagggcacaccgaagaatcttatcttctaaccaaaatcctcagatccctcatgtccaccaatcacgt

SEQ ID NO: 7736 - DNA, 201 bp, Homo sapiens
tttttaacatacttcacaacaaatactgctgtgtactaactatggtatcctccactattacctgacttcaactcataaggaaagaaagcctctgtgtgcaytgcactgaatttcctcctgccgccctgccagcggagtgcctgtgctcccgccggggctggggtgtggctgtggacacctggagagggtttattccttctg

SEQ ID NO: 7737 - DNA, 201 bp, Homo sapiens
tacacacacaagccggctgtggcacctgtcccctgaacgaccctgggtgctcctgcactctacacacacaagccggctgtggcacctgtcccctgaacgaygctgggcgctcctgcactctacacacacgagcctcaacaggggacagaaacaccatgaatcacaaaatcgaaggacctggaagtcagttcgccccaagat

SEQ ID NO: 7738 - DNA, 201 bp, Homo sapiens
taatagatgagacacacttgtcaatgttcctctgactcctaacgaaagttctgttccagccctatccaaaagtgatggcaagacacagtagacgggtggargagtggtataaaaaaagacttcagagaatgagacagaaaggggcaaaacaaggaaaattaggctttgctggtttcccttgggctatctccttcaagctca

SEQ ID NO: 7739 - DNA, 201 bp, Homo sapiens
ctgtagtcaccatctcacagggctcttgtaaagatgaagtctgtggaagctgctcgtaatagatgagacacacttgtcaatgttcctctgactcctaacgmaagttctgttccagccctatccaaaagtgatggcaagacacagtagacgggtggaagagtggtataaaaaaagacttcagagaatgagacagaaaggggc

SEQ ID NO: 7740 - DNA, 201 bp, Homo sapiens
tatgtttcaatataaaattgtgctctttgacatttcttataaatcagtaacaaaaccatctccaaacttctcaaaattcaagagataaagtagacttcgcraagcagatagacgtaaaagtgaacatcaaaggactagtaggtgaagacagtcatgtgacatggtccacacagctggagcgatgaatgcattcagtcaact

SEQ ID NO: 7741 - DNA, 201 bp, Homo sapiens
agttctaatatttcttctatcataatattactccacagtattaaagcccctcatttaaaaattagtcttcttttctgtactggaaaactcacgaggacagyggctgtctttcttgcatagcttgctcacatagctatctctccgtcatcctcaagaaacacttaaacgtgtgaacatgtgaatttcttaaaactatgaatg

SEQ ID NO: 7742 - DNA, 201 bp, Homo sapiens
cttaaataattcacatttaagaatagacattattaatctaatttattttctcccataatctttactaatttcacagaactatcacttaagggatattcaamatgtttctctgcagcaataagtgaaaggcttgtgttttcacttaattcaaaggtttttttccttaagtagttactaagaatctaaatcaacattattttc

SEQ ID NO: 7743 - DNA, 201 bp, Homo sapiens
caatctgtgttgatggtgaacaggtgcatgcaggatgatctgcacctccgaccttaaaaccaggtggagcctgtgtggcaggacaatcaccagggctgaaygttctcctcccagtgctgcggcttttttctcatatggaaataccttaaataattcacatttaagaatagacattattaatctaatttattttctcccata

SEQ ID NO: 7744 - DNA, 201 bp, Homo sapiens
gcttcaccaaaaccacaaacaaaactcccctaagcactaaaatgtcgtccccaatctgtgttgatggtgaacaggtgcatgcaggatgatctgcacctccraccttaaaaccaggtggagcctgtgtggcaggacaatcaccagggctgaacgttctcctcccagtgctgcggcttttttctcatatggaaataccttaaa

SEQ ID NO: 7745 - DNA, 201 bp, Homo sapiens
tgaattatccactctcataaataaagaactgttataaaaagtaatgtaattttccaggtaatcttgctcatttaatttcccataaaagaaaattaatgatyctcaaattctgtattctagaaaacaaatttcctatcaaactagaatatctatgagttttgacctctcttgagaactttaataactgctcaactgtctgca

SEQ ID NO: 7746 - DNA, 201 bp, Homo sapiens
cgtggtcattcgtgtcgctgacattgaccacaatccttgcaaagttgcgttttacaggcacatcttgatctcgtacctaaaaagaattgacacattatcartcccattggtgctttccttataactaattaaaaatcacgctcgaacacacaaaggcctcaggaccaaatggtgggaggagagcgggtagagcgcctacca

SEQ ID NO: 7747 - DNA, 201 bp, Homo sapiens
tagctgtttctttttgttgttgttttttttttgagatggagccttgctctgtcactcaggctggagtgcagtggcacaatctcggctcactgcaagctccrcctcctgggttcacaccattcacctgtctcagcctcccgagtagctgggactacaggcgcccgccaccacgcctggctaatttttttttgtatttttagt

SEQ ID NO: 7748 - DNA, 201 bp, Homo sapiens
gaagaggcctaaacctattacacaaaatttgtgatattaatagcttagctgtttctttttgttgttgttttttttttgagatggagccttgctctgtcacycaggctggagtgcagtggcacaatctcggctcactgcaagctccgcctcctgggttcacaccattcacctgtctcagcctcccgagtagctgggactaca

SEQ ID NO: 7749 - DNA, 201 bp, Homo sapiens
aagaagaggcctaaacctattacacaaaatttgtgatattaatagcttagctgtttctttttgttgttgttttttttttgagatggagccttgctctgtcrctcaggctggagtgcagtggcacaatctcggctcactgcaagctccgcctcctgggttcacaccattcacctgtctcagcctcccgagtagctgggacta

SEQ ID NO: 7750 - DNA, 201 bp, Homo sapiens
aatctgtacataaaatttacaaaaaaaagagacaggaaaattaaaataatcaaatctatataaatacatgaatcatgctgacaacacaggactgatttttygtttgattattttaacacagacagatgtaaatcccaaaagacgttgggaaatggcacagccgatgaaaacctcacgatgacagtagttgggacactggaa

SEQ ID NO: 7751 - DNA, 201 bp, Homo sapiens
tccatggttcagtgttgaaagagagcttgctctgagttaggtaagctaccaaagaactacagggaccaaccagatgcatggaaaacagagagggcaacacmactggtccagggtcaaccaactgcacggaaaagagagggcaacacaattggtcattattttgatttttacaatgaagtattaaataattaaataatttat

SEQ ID NO: 7752 - DNA, 201 bp, Homo sapiens
aatacaactccccacttcacgatttacttagagcacacaagaaggctaaggaaagctgtacctgtgtccatactaccaattccacataaaaaggctgggcrtggtggctcacacctgtaatcccagcactttgggaggctgaggcaggcggatcacctgagctcagaggttcgagaccagcctggccaacatggcgaaacc

SEQ ID NO: 7753 - DNA, 201 bp, Homo sapiens
agttttaagaccatattgatattttcacaattttcacaagcctttatatagtaatgcacatttaacattcagaagggattccctcaaagggaaacgcaatygggtaaaagtgcctctggaagtaggaacatgaacacagtactcggcagctcctctcagcaaggttagcctacctccctacctgtggctggatgaacgaac

SEQ ID NO: 7754 - DNA, 201 bp, Homo sapiens
caattacaaaatactgcaattaaaatcacactcttggccaggtgcggtagctcatgccttaatcccagcactttgggaggcccaggggggtggattacttraggtcaggagttggaggccagcctggccaacatgatgaaaccctgtatctacaaaaagttagccaggcatggtggcgcgtgactgtaatcccagctaatt

SEQ ID NO: 7755 - DNA, 201 bp, Homo sapiens
aatctgatgagtctggatatacatactaatacacctttttatttggatagcaaatgaaagtactgaaaaaatattttctaaaagaattgggtaacactggygaacaattccattattcagagataaccacttttattaccttctgtattttgttagtgtcttcacttgaaatgttttatggcttggtaggcttatcactct

SEQ ID NO: 7756 - DNA, 201 bp, Homo sapiens
tagtcctaaagagccctaaaaataattttattataaatataaattatataaatataaatttatataaattatataaatataaattatataatttatataawttatataaatataaattatataatttatataaatataaattatataatttatataaatataaatttatataatttatataaatataaatttatataattt

SEQ ID NO: 7757 - DNA, 201 bp, Homo sapiens
taacccaccccactttacaggttttgaagattgcaacaacattcccttcttatctttttcaggtcaacttatcctctaggtcagtggttttcccctggggrcaattctgctccctaggagacatctggtaatgcctgcagacatttttggttgtcactacttgtcggaagagggtgctcctggcgtctcgtgggtggagac

SEQ ID NO: 7758 - DNA, 201 bp, Homo sapiens
gtaatgcctgcagacatttttggttgtcactacttgtcggaagagggtgctcctggcgtctcgtgggtggagaccaggggtgttgctaagcatcctacaaygcacaggacagccctacacaaccaaaaatatctggttccaaatgtcagcagtgctgaagctgagaggctgctcaaagatagagtgttttacctccttttc

SEQ ID NO: 7759 - DNA, 201 bp, Homo sapiens
cgtctttactcaggtggtgtcctaagaccacacgtcactacagccggctgcgcgctctttcggcagctgtggccgtctcagcagctattgtttgtccctgmagtactggtgccggcaggattaggcgtggagccaaaaatggaattctattcatagactggcgaggctggaaagcagctcagaactcatttagttcaaact

SEQ ID NO: 7760 - DNA, 201 bp, Homo sapiens
cgggtgtaaaaatgacgcttgaatgtggcacaagcttaattttcattagtcaaaaaccttttaagttaatctctttttttccccaatcaaaaatgtaccaycctctcctaactgtggttgtaaatagttcaggaacgacaaggagccccttgattagtcccacatctaattattgtaatgtgtccaccaagaagttgtgat

SEQ ID NO: 7761 - DNA, 201 bp, Homo sapiens
gagccaccgcacccggccaacgcttttttttttttttttaaaaaccaaacaaaatttttttagaagggtaaacgctaatatacattattcgcaaatttgtrtgactatgacctttaaaaggtaaacaacttactctgttaaaacaaatgtaaatataatttcatgggaatctggcttcttagactatttcgtataggagcc

SEQ ID NO: 7762 - DNA, 201 bp, Homo sapiens
gaaatgtactaacaaaatgtcacacttcagtggaaaaagacagaatgaaaccctggttatagtaaaaaaaaaaaaatcagggtgctagataatggcactgmcaccaccaaaattcagttgaaacaaatgcacaaaatatcttggaaatctagttaaaactatgaaaaatcaaatctgtacataaaatttacaaaaaaaaga

SEQ ID NO: 7763 - DNA, 201 bp, Homo sapiens
cagcgctcctgcagggcgcaaacacccagagacccagggacccggcagccccgcgcaggcctcccgcgtgcaccgctcagcgagcgggtctttcgcagacrgcgggatgccccaggagaccgcgaggccggcgcagcccggcgagctcccggagggaaggcggcgtgtcagaaaggatcggaccccagcaatggccccgga

SEQ ID NO: 7764 - DNA, 201 bp, Homo sapiens
cctccagaaccgcgacagaatccacctctgtcgtttaaatttatggaaagtagccttagggaaataaaccttttttaaaaaaattaatggctttattgagrtataactgatataccaaaaactacatatgtttaacatatacaatctgatgagtctggatatacatactaatacacctttttatttggatagcaaatgaaa

SEQ ID NO: 7765 - DNA, 201 bp, Homo sapiens
caagaaaaaatgaaaaatagagaataactgcagtagttcttatattatctctgtccttaactttctctgagagcaaagttgttcattaagagagctgttcyttaacaaagtaataataaacatttcattttaaagtgacattttcttctttaatactaaccattaataaaataaagtgataacagaagatgtagaatatga

SEQ ID NO: 7766 - DNA, 201 bp, Homo sapiens
gaaaaatgtaatttctaaaagagcttaaccaagatagttgaaaatagagctcacagcaaaatttctgtatggaaggattcattaatgtccacttacttaaytaaacggatactgacgttgtctttccacagcctgattattcaaaggttatagggttgctccaataaacggttcaaaagtaaatcacagtttccaataata

SEQ ID NO: 7767 - DNA, 201 bp, Homo sapiens
atcttcctcttctgccaagcactgataattaaaaatagaaaggaagaaaaactagaaatttttctttccttggtccagaaaaacactgcattctatataayaaaactatgataaatgtaggtgggctgagacagcagacacagtatattctcaccaatgagcagttaccagttcaccccagaaatgtatgcacaatgcagt

SEQ ID NO: 7768 - DNA, 201 bp, Homo sapiens
taatctctttgaggagaagaatggcagctgggacttactacttctctaaaaatctctgttaaagaaggccacaagtttgtttttcttcccccccatgtatrtgtcaatgtgttcaaagacatccactcccaaaatttccaaacagaaataatgtcaaaatgcttagtgagtcaatacagttacacgtttctatttcaaatc

SEQ ID NO: 7769 - DNA, 201 bp, Homo sapiens
gtgcgctgggcattgtggatttcagatttctggatgtgggatgtcaactggtataacgcgtatatctcaaaatccaaataaatccaaaacacttctagtcycaagtatttcagataaagatgctcaacttctattagtctgtctctgtgctggcactctatattctaaaaatcacattctttaagaatacctaccaaccag

SEQ ID NO: 7770 - DNA, 201 bp, Homo sapiens
cataattaagcacaaaaaccttgaagagaaaaaacattcaaaaaagttcactcaaacttgttgtttagaacacaaaattcataagctcactcactaaaccyactcctagaaagctttcttgttgtgacttttaaaatattttgttacactatgacaaaaggggaaggagaaaaagatattgaggagatgtctccctctttt

SEQ ID NO: 7771 - DNA, 201 bp, Homo sapiens
catggttcagtgttgaaagagagcttgctctgagttaggtaagctaccaaagaactacagggaccaaccagatgcatggaaaacagagagggcaacaccaytggtccagggtcaaccaactgcacggaaaagagagggcaacacaattggtcattattttgatttttacaatgaagtattaaataattaaataatttattt

SEQ ID NO: 7772 - DNA, 201 bp, Homo sapiens
tgtaatgtgtccaccaagaagttgtgattgatggtaacatcacgtggaatagcagcttgacacgttcccaggaaaacagtattcttctgcagagcacttamtcactcaccaacagcactgcgcaaatacttatgagcaaatacaactccccacttcacgatttacttagagcacacaagaaggctaaggaaagctgtacct

SEQ ID NO: 7773 - DNA, 201 bp, Homo sapiens
ttgattagtcccacatctaattattgtaatgtgtccaccaagaagttgtgattgatggtaacatcacgtggaatagcagcttgacacgttcccaggaaaayagtattcttctgcagagcacttaatcactcaccaacagcactgcgcaaatacttatgagcaaatacaactccccacttcacgatttacttagagcacaca

SEQ ID NO: 7774 - DNA, 201 bp, Homo sapiens
atagttggctcttcgttcttgtcattcaggtgaccactccatctaaggaggccatgcacaccctgcaaaaatccttaacacatgccctgttttcctccacwgcaccgctcagctgaaactgtgcgttcttttcttctcatctccgtgttgactcgtgtctcctctctccagaagaatagctccaagaagggcacagcacca

SEQ ID NO: 7775 - DNA, 201 bp, Homo sapiens
cactaaaaatacaaaaaaacactaacactaaacaaataacactaaaaatacaaaaaaattacccgggcgtggtggcgggagcctgtagtcccagctactcsggaggctgaggcaggagaatggcgtgaacctgggaggcggagcttgcagtgagctgagatcgcaccactgcactccagcctgggtgacagagtgagactc

SEQ ID NO: 7776 - DNA, 201 bp, Homo sapiens
tgtactacttcacctgaacacgtaccaatcaagaggctctgtgcttagctgtgacttggagaatcatgactctactaatttgttttgtttttgcttctttytcctaagcactaaaagtgactaaattaaatctatgttcataaacagtagtaatgtcataatgtttacgatctcagtcacccacttgttcactgtgcactg

SEQ ID NO: 7777 - DNA, 201 bp, Homo sapiens
atgttggccaggctggtcttgaactcctgacctcgtgatccacccgcctcggcctcccaaagtgccaggatcccaggcgtgagccaccgcacccggccaaygcttttttttttttttttaaaaaccaaacaaaatttttttagaagggtaaacgctaatatacattattcgcaaatttgtatgactatgacctttaaaagg

SEQ ID NO: 7778 - DNA, 201 bp, Homo sapiens
gaggatgatacaggcaatagcactactctacagcccaaggacacaacacgtaactcaggtatattcacctggaaggccagcctcagaatctagatactcartctcacaaaggaggctgctcctaggtaagcaaagcagaaacaaagaggaacccgcattgctactaaactgctttgttgttcttattcttgtaattttgga

SEQ ID NO: 7779 - DNA, 201 bp, Homo sapiens
aacttggtactaagctaaattagaaacaaacaaaactttgacagtaagaggattaatttccataatgaaaagacgtatggatttggcacagcggaaatcaytgccaattataaaacatgctttagagtttaagaagaagaaaactgcgcttcgtgggggcatatggaacaaagggatctgctggtccaagcagcacagggg

SEQ ID NO: 7780 - DNA, 201 bp, Homo sapiens
tttctccatgttggccaggctggtcttgaactcctgacctcgtgatccacccgcctcggcctcccaaagtgccaggatcccaggcgtgagccaccgcaccyggccaacgcttttttttttttttttaaaaaccaaacaaaatttttttagaagggtaaacgctaatatacattattcgcaaatttgtatgactatgacctt

SEQ ID NO: 7781 - DNA, 201 bp, Homo sapiens
ttttttaaacaagtggtataaacgccttctaaattttaaatccttttttcaattaggtgatattcttgctgttttttaaaaaatctcaccttgaattttaygcactaaattgctggtaagatttctaagagatgtcaacttcggagcatcagaatacatttgaaaagggcaaaatgtaatttcaaattttgtgtgtgatct

SEQ ID NO: 7782 - DNA, 201 bp, Homo sapiens
atgctaaagtttagaaaataagcttccttcataataatgtagcaagtttaatattaaaattactatttttcattaaccctcagacaacaaattaacttaayataggtatgtatcaaagcatgccaattcaagcaaaatacaattgaacaagcgttgcaagattataacacagcctctgatacactgtaacaatcaatctgt

SEQ ID NO: 7783 - DNA, 201 bp, Homo sapiens
actaaaaatacaaaaaaacactaacactaaacaaataacactaaaaatacaaaaaaattacccgggcgtggtggcgggagcctgtagtcccagctactcgrgaggctgaggcaggagaatggcgtgaacctgggaggcggagcttgcagtgagctgagatcgcaccactgcactccagcctgggtgacagagtgagactct

SEQ ID NO: 7784 - DNA, 201 bp, Homo sapiens
tatttgcacgttgtgccatgtgattgcattacccatttaaaacaagtgatagaatttatgaggtgtgctacccacacatacacatacatcacaaacacacrtcacaaacacacatctgccttccggccttgctgagcagggtaaactgatgatgaatggtacctggggaaggaggactgagaagtgccattccggctactg

SEQ ID NO: 7785 - DNA, 201 bp, Homo sapiens
ggcacctggaattcaaactcctggcctccagaaccgcgacagaatccacctctgtcgtttaaatttatggaaagtagccttagggaaataaaccttttttwaaaaaattaatggctttattgaggtataactgatataccaaaaactacatatgtttaacatatacaatctgatgagtctggatatacatactaatacacc

SEQ ID NO: 7786 - DNA, 201 bp, Homo sapiens
acccagggacccggcagccccgcgcaggcctcccgcgtgcaccgctcagcgagcgggtctttcgcagacggcgggatgccccaggagaccgcgaggccggsgcagcccggcgagctcccggagggaaggcggcgtgtcagaaaggatcggaccccagcaatggccccggatcggtcccgcgcggtcgcctccttttcccgc

SEQ ID NO: 7787 - DNA, 201 bp, Homo sapiens
gacccagggacccggcagccccgcgcaggcctcccgcgtgcaccgctcagcgagcgggtctttcgcagacggcgggatgccccaggagaccgcgaggccgrcgcagcccggcgagctcccggagggaaggcggcgtgtcagaaaggatcggaccccagcaatggccccggatcggtcccgcgcggtcgcctccttttcccg

SEQ ID NO: 7788 - DNA, 201 bp, Homo sapiens
cctccatccccccaccagaaggctctggcactgttccatcccctaagacacacagaccatggccaacacgtcagactgctttggctgttctctccccatgstgtcccaggtgctcagtcccaccacagcccccaccaccacccactcatccccaactggattcccaaacatgcaattaccttccacatcctactcagcagt

SEQ ID NO: 7789 - DNA, 201 bp, Homo sapiens
atgagagcaataaaaacatatttacctgtctcttcacctattttgaaaacaccaacgccagagccatctctaatggagtatcggatctccccatctcttcyggcgtcctcatcatgagccgacaccgtcattaccaatgaaccaacaggtgcatcttctttcactgtccccttttccacaaagctggaaaacacgggtggg

SEQ ID NO: 7790 - DNA, 201 bp, Homo sapiens
tccccatgtagaagaggaaaaagttagttctaagaaatcatttgcttgtccaggatcaccaattaccaactagaagagccaggattccaagccaggtcttytcagttcagcatgccactaccccgcctctgcctctcgaccaaaacctagacgaggtactaagtgaagaccacattagagaagttttggcacatcatctct

SEQ ID NO: 7791 - DNA, 201 bp, Homo sapiens
cgtcaggagttttcccgtgttatttcactttactctcacttaaaccttccggtatttctaagtgtccccatgtagaagaggaaaaagttagttctaagaartcatttgcttgtccaggatcaccaattaccaactagaagagccaggattccaagccaggtcttttcagttcagcatgccactaccccgcctctgcctctc

SEQ ID NO: 7792 - DNA, 201 bp, Homo sapiens
ccaccccagcatttttttttttttttttttggtaggaacgaggttttgctgttacccaggctggtcttgaactcctggcctcaagcaatcctcccacctgygcctcccaaagtgctgcgattacaggcgtgagccatcgcacccagcccaaaataatgtttttctaaacagcagttacatttttcatgtgctacacaccta

SEQ ID NO: 7793 - DNA, 201 bp, Homo sapiens
ggtatctggcacccacccacaccaggctaattcaacaggcagaactacttaactcttccacttcctttcccacaagggcatgcacacccgccacacgactsgactccgcacaccacctcacctgggcgatcaagccttgctttgttggtggtgatctcttaatatccagaggaaaattaacacaccatgtgactctttaaa

SEQ ID NO: 7794 - DNA, 201 bp, Homo sapiens
ttacattttcccaggcttctacaatgactatatactgcctttttattggaaataaagatcatttttttaatgaggggagttcgctaattctgtccaaatgstatggagactcaaagctgaaaaaaaaaaaaaaaaaaagccaacactatgtaatcatttccaaattcccttttcatgaccttaaatgggacttctaaagct

SEQ ID NO: 7795 - DNA, 201 bp, Homo sapiens
atcactacactgctgattatacactatggacacaggtgagtgaattaactcatagggatacttgggaaggaaaagagaacttatattcttgatttcaacarcaaaattacatttttaaatttaatttgacaagcctgatagcagcgaaaacgaaaaattcaactacttctgattttacgaagtagcatctggccaatgaaa

SEQ ID NO: 7796 - DNA, 201 bp, Homo sapiens
cgtataaaagtatataaaatatgatgctactgctgttcagaaaaattttttaaacacacatacacaattatatgtgcagagaaaaaaggtctgaaataaamaaggtgatcagcagataaatccatccagtgaacagaaacttttttaatctgtaaatttctgtaaccatggatttaaaaatctatatttaaaatgtataca

SEQ ID NO: 7797 - DNA, 201 bp, Homo sapiens
acgtataaaagtatataaaatatgatgctactgctgttcagaaaaattttttaaacacacatacacaattatatgtgcagagaaaaaaggtctgaaataamcaaggtgatcagcagataaatccatccagtgaacagaaacttttttaatctgtaaatttctgtaaccatggatttaaaaatctatatttaaaatgtatac

SEQ ID NO: 7798 - DNA, 201 bp, Homo sapiens
catgtaagatgtcaacaacgtgagaagctggggcagggagcagggagttatgtgagcattctactttctgctccatttttctgcaaatgttttattttttwaaaaagttgtctatgagagctcataatatgtagattgtttccttccttcaattaaaaacttttttgaacttacctgtttttaatctcgttttcattaaat

SEQ ID NO: 7799 - DNA, 201 bp, Homo sapiens
tactgcatgttctcactcacaggtgggaattgaacaatgagaacacatggacacagggtggggaacatcacacaccggggcctgtcgtggggtggggggargggggagggatagcattaggagatatacctaatgtaaatgatgagttaatgggtaaagcacaccaacatggcacatgtatacatatgtaacaaacctgca

SEQ ID NO: 7800 - DNA, 201 bp, Homo sapiens
atactgcatgttctcactcacaggtgggaattgaacaatgagaacacatggacacagggtggggaacatcacacaccggggcctgtcgtggggtggggggrggggggagggatagcattaggagatatacctaatgtaaatgatgagttaatgggtaaagcacaccaacatggcacatgtatacatatgtaacaaacctgc

SEQ ID NO: 7801 - DNA, 201 bp, Homo sapiens
aaccaaatactgcatgttctcactcacaggtgggaattgaacaatgagaacacatggacacagggtggggaacatcacacaccggggcctgtcgtggggtkgggggaggggggagggatagcattaggagatatacctaatgtaaatgatgagttaatgggtaaagcacaccaacatggcacatgtatacatatgtaacaa

SEQ ID NO: 7802 - DNA, 201 bp, Homo sapiens
aaaccaaatactgcatgttctcactcacaggtgggaattgaacaatgagaacacatggacacagggtggggaacatcacacaccggggcctgtcgtggggkggggggaggggggagggatagcattaggagatatacctaatgtaaatgatgagttaatgggtaaagcacaccaacatggcacatgtatacatatgtaaca

SEQ ID NO: 7803 - DNA, 201 bp, Homo sapiens
gacatgtgttacaaatcttgggctcctaaaaattgttttaaatgtccatggttcagtgttgaaagagagcttgctctgagttaggtaagctaccaaagaaytacagggaccaaccagatgcatggaaaacagagagggcaacaccactggtccagggtcaaccaactgcacggaaaagagagggcaacacaattggtcatt

SEQ ID NO: 7804 - DNA, 201 bp, Homo sapiens
aactgaagcgggtttaaacttttaaactcactgcagggcctggcgtgggttcctgctgctgcattctccaagttctaatatttcttctatcataatattamtccacagtattaaagcccctcatttaaaaattagtcttcttttctgtactggaaaactcacgaggacagtggctgtctttcttgcatagcttgctcacat

SEQ ID NO: 7805 - DNA, 201 bp, Homo sapiens
gaactttaataactgctcaactgtctgcatattttggaactagaaggcaattacaatttataaaatgtattcttatgcttcaccaaaaccacaaacaaaaytcccctaagcactaaaatgtcgtccccaatctgtgttgatggtgaacaggtgcatgcaggatgatctgcacctccgaccttaaaaccaggtggagcctgt

SEQ ID NO: 7806 - DNA, 201 bp, Homo sapiens
cagctcctaatggggaaagcactgtggctgtgaaaccaccttttccagagggtattcccagttcccaatgcacacacacacacacacacacacacacacayacactgcacaactataaaaactaagtatttactgacaacgttaagaaaatttgaccaaggataaaatgaaattaagcaggcagcattataaacagcaata

SEQ ID NO: 7807 - DNA, 201 bp, Homo sapiens
aaactacatgacaaataagaagaagaaatggctttagcaagtaaactttactggaggatgaaataatctaatgaatcctcctacctgttgaaaatgaggtratataaaactaaaaacccatagctggtaccataactttgtaccataagctggtatgaatcaaaatttgtaagcttattccctattaaatattgacatgtg

SEQ ID NO: 7808 - DNA, 201 bp, Homo sapiens
ctgacatttaacttctttctttttcatttaggccacagtagattataaacaagcctttagcttctgccatcccagtgtaagctccaagagggcaagattgktgcctcttctgtttcctactattcaccttccagaatggtgcctggcatgtaacaagtgttcaacaaatacttggtaaataaatgagtgaatgacactctg

SEQ ID NO: 7809 - DNA, 201 bp, Homo sapiens
tcctctgctcttcaatccatccccgcggtatcctagtgtctcactgcccagctgactgctctgctcttcaatccatccccgcggtatcctagtgtctcacygtccaggtgactcctctgctcttcaatccatccccatggtatcgtagtgtctcgcctcccagctgattcctgtgctcttcaatcaatccccgcggtatgc

SEQ ID NO: 7810 - DNA, 201 bp, Homo sapiens
gagggaccaacatggcacctggcacataaagcgagcttcatcagcctacagaatgaatgaatgaatgaatgagggaccaacatggcacctcgcacataaastgagcttcatcagcctacagaatgaatgaatgaatgaatgagggaccaacatggcacctggcacataaagtgagcttcaccagcccacagaatgaatgca

SEQ ID NO: 7811 - DNA, 201 bp, Homo sapiens
atgaatgaatgagggaccaacatggcacctggcacataaagcgagcttcatcagcctacagaatgaatgaatgaatgaatgagggaccaacatggcacctsgcacataaactgagcttcatcagcctacagaatgaatgaatgaatgaatgagggaccaacatggcacctggcacataaagtgagcttcaccagcccacag

SEQ ID NO: 7812 - DNA, 201 bp, Homo sapiens
agcgagcttcatcagcctacagaatgaatgaatgaatgaatgagggaccaacatggcacctcgcacataaactgagcttcatcagcctacagaatgaatgmatgaatgaatgagggaccaacatggcacctggcacataaagtgagcttcatcagcctacagaatgaatgaatgaatgaatgagggaccaacatggcacct

SEQ ID NO: 7813 - DNA, 201 bp, Homo sapiens
acctggcacataaagcgagcttcatcagcctacagaatgaatgaatgaatgaatgagggaccaacatggcacctcgcacataaactgagcttcatcagccyacagaatgaatgaatgaatgaatgagggaccaacatggcacctggcacataaagtgagcttcatcagcctacagaatgaatgaatgaatgaatgagggac

SEQ ID NO: 7814 - DNA, 201 bp, Homo sapiens
catggcacctggcacataaagcgagcttcatcagcctacagaatgaatgaatgaatgaatgagggaccaacatggcacctcgcacataaactgagcttcaycagcctacagaatgaatgaatgaatgaatgagggaccaacatggcacctggcacataaagtgagcttcatcagcctacagaatgaatgaatgaatgaatg

SEQ ID NO: 7815 - DNA, 201 bp, Homo sapiens
gagggaccaacatggcacctggcacataaagcgagcttcatcagcctacagaatgaatgaatgaatgaatgagggaccaacatggcacctcgcacataaastgagcttcatcagcctacagaatgaatgaatgaatgaatgagggaccaacatggcacctggcacataaagtgagcttcatcagcctacagaatgaatgaa

SEQ ID NO: 7816 - DNA, 201 bp, Homo sapiens
atgaatgaatgagggaccaacatggcacctggcacataaagcgagcttcatcagcctacagaatgaatgaatgaatgaatgagggaccaacatggcacctsgcacataaactgagcttcatcagcctacagaatgaatgaatgaatgaatgagggaccaacatggcacctggcacataaagtgagcttcatcagcctacag

SEQ ID NO: 7817 - DNA, 201 bp, Homo sapiens
aaagtccctattttctctaggatcgagttcaaatcccttggaacgaccgccactgcccactgtaatccagttcacccttttccaagactctcagtgcagaytccccacttctggcaaactcagtggctactcccacaatccctcctcacactccatggcccctccccacccactcctgacgacccacttactgccccccga

SEQ ID NO: 7818 - DNA, 201 bp, Homo sapiens
aaacaattccttttaacatctttcacatcattctagtcctaaagagccctaaaaataattttattataaatataaattatataaatataaatttatataawttatataaatataaattatataatttatataatttatataaatataaattatataatttatataaatataaattatataatttatataaatataaattta

SEQ ID NO: 7819 - DNA, 201 bp, Homo sapiens
ctctcatttttaaaaatccctttttaaacaattccttttaacatctttcacatcattctagtcctaaagagccctaaaaataattttattataaatataawttatataaatataaatttatataaattatataaatataaattatataatttatataatttatataaatataaattatataatttatataaatataaatta

SEQ ID NO: 7820 - DNA, 201 bp, Homo sapiens
aaccattcaactctcacctgggcactgaccaaacctgccgctgggacagacacaggtgtgtttctcctcccagggatcagacacacattcggatccctcakggcacggatcatcttcacagccatggtggacaggtgggcaccttccctcttcattcaaagaggggagaaagggaaaagataattaacagacatttcaaga

SEQ ID NO: 7821 - DNA, 201 bp, Homo sapiens
cacagcggtgcaatcgtggctcactgcaacctctgccttctgggttcaagcgattctcatgcctcagcctcctgagtagctaggaatacaggcatgcaccmccatgaccagctaacttttgtattttagtagagacggccaggctaatctcgaattcctggctgcaagtcatccacccacctcagcctcccaaagtgctgg

SEQ ID NO: 7822 - DNA, 201 bp, Homo sapiens
cgccacttaaatcactcaggcccttttgtttccatcttcatggcttactacgaataaacacatctacaatacagcagccgggccaaaaaaaatattcacaygcacttctataccgagcccaaagagcaacagggaattttgaagaagctgccacagggcagatggttaaaaaaaaaaaaaaaatggaaaagggcatcaaat

SEQ ID NO: 7823 - DNA, 201 bp, Homo sapiens
aaatgcccatcagtgatagactagataaagaaaatgtggtacacatactcgatggaatactgggcagtcacaaaaaggaattacatgtgccctgtaatttyttcagtgattggaacagtaaaagtaccttttgtttaaaaaaatatttaggctgggctgggcacggtggctcacgcctgtaatcccagcactatgggaggc

SEQ ID NO: 7824 - DNA, 201 bp, Homo sapiens
acacaattggtcattattttgatttttacaatgaagtattaaataattaaataatttatttactattattaaataatttatctattattaaataatttatytattattaataattgataaattatttgatgcttcattattattcataaattaataattaacaaataattactaaatttatttattaataataaatttatt

SEQ ID NO: 7825 - DNA, 201 bp, Homo sapiens
agcattaggtaatatcaaaagtcaaaactgaataatgtttttaaaaaaggtgggcaagatacataacacttgaaacacatgtaggatgtctctataaactrtaacagtttttgttttttgagacagtttcactcttgtcgcccaggctggagtgcagtggcgtgatctcaactcactgcaacctctgcctcccctgttcaa

SEQ ID NO: 7826 - DNA, 201 bp, Homo sapiens
tatgaaagctttacattattcaagtcttattcctgtacatacgaagaagaatttttgtttcaaaaaaattttaggtaaaattacttctgaactttttcttkattgcaccacctacagataagctctccagatctcatgtaaatcactatgaatggtaaaaaggaacaaagacataacatacattgagatattttttgcaaa

SEQ ID NO: 7827 - DNA, 201 bp, Homo sapiens
ataccctagtgcctgaggcatcaggtccaaacctctggtcctggttttctatgtggccaataacctgtgtgtaaaataccttcctattttatctcactctrctttcttcttatgattactccaatacaactgggtaaagtcccctaaatatatttcttggcttctatctgcatgcctgtgtccatgcaattcctcgctgga

SEQ ID NO: 7828 - DNA, 201 bp, Homo sapiens
cagccttgctgcctctccttatttgttcatatttatctcaatccctcatgtcacttctatcaacatctccaacggcaagtaccatatctacacttagggtyttccagtctctaaatctgactaaaatctccaaatactggctgagtaattctgcctgaatatgctatttccctttaaaaaccagcatattgaaaaccacat

SEQ ID NO: 7829 - DNA, 201 bp, Homo sapiens
agtttaacactaaaacttcactagacaaaatacaggtatgtttctgatttgcccagtgaaaacatggtacttcttaggaaaagaagtgtaggcgtcatcartaactataaccatgaacactggagtatctaagcctcttctgcctgatagcaaatggggcccagagctatcctccctcctcctgaaccttgacagcatcat

SEQ ID NO: 7830 - DNA, 201 bp, Homo sapiens
aatgcgactggcccgtcctttccttcctttgcagctatcaaatgttaccggaaacccctggaagttgtttgcagctttagctatttcctattgcagtttgytcagtattcgttccagccacaataaaatgccatttactctggttcagaaaaaaatagttgtaaagtgttactggactaacacatgatgagcacccagtat

SEQ ID NO: 7831 - DNA, 201 bp, Homo sapiens
gcagcctgggcaacaagagcgaaactccgtctcaaaaaaaaataaaaataaaaataaaaataacgatactagtttgacatgcagtattatctcataaatcraaacctttgaattcttttagaaacaatacagtagatcgtgtgtgtgtgtggtgtgtgtgtgtgtaaatatacatttaatgttcttgcttctgccatcagt

SEQ ID NO: 7832 - DNA, 201 bp, Homo sapiens
tgccgttttcccaacatttgaaaatctgggctaaagcgaatttcattgtatcgggagggaaaaggaatggacttattatatgatggtacatacacagcttyaaaaaagaagacatgcatattaattacacagaagaatgtcagtgatacagaaattgagagaaaaatataaacgtataaaagtatataaaatatgatgcta

SEQ ID NO: 7833 - DNA, 201 bp, Homo sapiens
cacatctgccttccggccttgctgagcagggtaaactgatgatgaatggtacctggggaaggaggactgagaagtgccattccggctactgggtacaacasaacagcacaatttgggagggacaaaaagtgcatacatatctgtatttccacaaactccagaaacataaccaggatattgctaagtttcgatttaaaataa

SEQ ID NO: 7834 - DNA, 201 bp, Homo sapiens
acttccactaacaaatacagtcaccactagcctcctgagaccagtggaatttaaattaattaaaattcagtaaagtttacacttcagtttctcaatcacamtaagccaaatttccagggtacggcagcccccaggggccggtgacgacagcatggagcaaggcagatggagaacgcgctccccacggcaggaagctctgct

SEQ ID NO: 7835 - DNA, 201 bp, Homo sapiens
ctaggggctggcggcaccctgcgggtatttagaagcacagacccgaggcgcagggaagaagctgtgggcatacagacaggtgtgactcagaccacacccayagaagtgagcataatactaaagagaacagtgggcctataaaaacggtagagaaaatagcgggccgatcttcaacctaggaagcaatctgctggaagagaa

SEQ ID NO: 7836 - DNA, 201 bp, Homo sapiens
ttcaatttgtatctcagtagataccatcactgggccatttaaaagcttacttactaacaaaactttctgatactttgagcaaattgacctaataaaatagmtattaaaaatcaatgttaactctaaaaaaaatagcggtcgttaactttaattagtcctggctactataaactatttgaaaagaattttttttctcatttt

SEQ ID NO: 7837 - DNA, 201 bp, Homo sapiens
cagaagctccagaaacattttccctgactgaggtcaacaatcaggttagcctgggccggaattccgttccgttcccactgtagaaacgcactcacctgtgygcacctaagccgggcggccaggagccgaccccacacaggtgacacagggatgaggccaggagccgacccccacacaggtgacacagacatgaggccagga

SEQ ID NO: 7838 - DNA, 201 bp, Homo sapiens
gatgaaagaggcacgacaccctgatcggttgcaaagactgttagccaataatgggaggtcgattcacggtccagtcgatctgacgtctctatgacacctasagagaaaaaagaaaagcgtaaagcagcacatcaacgaccaaaactgccagcttcagaaagtgtcaacaactacggcttactgagagctttatatgtctct

SEQ ID NO: 7839 - DNA, 201 bp, Homo sapiens
cagcctttctgtgactcagcttcctttcttctaaaatagagacaataatagtatattcaactaacatgcatataatgattagaacacttggcacataatayaggctataaaagtatttgttattagaatcaggtgtcaggcactaaatggagcactttaaaaatattatctcactgaagtctcaaaataggtgagcactaa

SEQ ID NO: 7840 - DNA, 201 bp, Homo sapiens
aatctgaaatgctgcaaaatctgaaactttggagcaccaacatggtgcgctgggcattgtggatttcagatttctggatgtgggatgtcaactggtataaygcgtatatctcaaaatccaaataaatccaaaacacttctagtcccaagtatttcagataaagatgctcaacttctattagtctgtctctgtgctggcact

SEQ ID NO: 7841 - DNA, 201 bp, Homo sapiens
tcagcctcctgagtagctgggactataggtgcgtctgtagatttagactgacagaattttacatactcaggaaccaccagcacgcctggctcatgtttgtwttttttatagagacggggtttcaccacgttgcccaggctggtctcaaacacccaggctcaagcgatctgcccaactcggcctcccgaactgctaggatta

SEQ ID NO: 7842 - DNA, 201 bp, Homo sapiens
ccccatgctgtcccaggtgctcagtcccaccacagcccccaccaccacccactcatccccaactggattcccaaacatgcaattaccttccacatcctacycagcagttctcacgggacacaatacagctgggacggacttgtggaccacattcctaactgaaatctttgaaaaacctgaatgtactctgcaaacttggct

SEQ ID NO: 7843 - DNA, 201 bp, Homo sapiens
aagcacaagtagtcattctagcctttatggaacaggacattattaaacttttcatttcacatgttatgataaaaacacaaaattattaagttgagaactcwgtgttctccctcactgtgctcttctccactctcattttctatcaacatagtgaaagcgtcagtagaatttaactcatgattaaaatttggaatttcgagt

SEQ ID NO: 7844 - DNA, 201 bp, Homo sapiens
tcccccaaaacaaagaggcaatccacaggtatgaaaaatgaatgacaacattctcctgattctcttccatactcttttatactctacactgactcacctamaactctggcattacaaacttgtcttccaactcttcctccacatgcatttattaccacccttaaagatctcatctactctgcctcaaatcatgaaggatca

SEQ ID NO: 7845 - DNA, 201 bp, Homo sapiens
aaaggaaggggttgggagaacatcaaatgtggaacctagctccagctttgtcactaatcaactgtgtgaattcaaggaacttgcttaatcctttcgactcyatgtattcgagaaattgaaggatggactaaaatctttacagcctcctggctctcaaaccttcatttctcaaaagttatccaaacttgacatttctttctc

SEQ ID NO: 7846 - DNA, 201 bp, Homo sapiens
ctcctcacatacagcttatttgttttcacctttctcttcaacgtttctttctttttctctctccttaacctctgcctcataaaaacaatcctccctttttwaataagattatttaagtcatagtcaagattctctatgttctacctagacaaaaaaaagaagccaatccttttcctaagataacatggtacggtgaggtct

SEQ ID NO: 7847 - DNA, 201 bp, Homo sapiens
gtatagaagcctttattatttttactttatagacttatcttcacatacataatgaacccttggaattaagcaagaattcaggcaatgtatttaaatctggracttacagtaaaagatgacttaaaaaacttaaaagagtgaaatatgcagattcctcatcagaatatatttttgaaatgaaaagttcccctcaggtatgag

SEQ ID NO: 7848 - DNA, 201 bp, Homo sapiens
aggatcggaccccagcaatggccccggatcggtcccgcgcggtcgcctccttttcccgctccgccgccgggacccccctagccagtgctgaatttcccaaytgggaaggaccgagtcactccaccctccgggaagtcgcgcgctcatccgttttcggcagcgccggagcccgagccggggaccgggcggacacccacagag

SEQ ID NO: 7849 - DNA, 201 bp, Homo sapiens
agcctctgatacactgtaacaatcaatctgtgttacttccaaaaggactgtgatccttttagactatataaagcaccactattttaaaaaaaaacttccarttttggaatagttttttttttttcctccttaggatttaaaaaatccttggagaggcgggagaaggttaggcaatccgtgcttcaaatgcaatgcgcacac

SEQ ID NO: 7850 - DNA, 201 bp, Homo sapiens
caaactgtcaaagcatgttccgccattcttacagggttcatctttgcagtatggactaagctgacacctgaagagtaaggagaaacagacataaacctcaygatcctattgcaaataaatacagcaaaacagaaagcaaaacagaacacattagcaaattaacgtgcagactttttacatgtaccattatatgtttaagaa

SEQ ID NO: 7851 - DNA, 201 bp, Homo sapiens
taattaactattaactgaacacataagcattaggtaatatcaaaagtcaaaactgaataatgtttttaaaaaaggtgggcaagatacataacacttgaaayacatgtaggatgtctctataaactgtaacagtttttgttttttgagacagtttcactcttgtcgcccaggctggagtgcagtggcgtgatctcaactcac

SEQ ID NO: 7852 - DNA, 201 bp, Homo sapiens
aattaatacgactttttggaaaactaatatagtgatacaaaaaaatttaaaatgtcattgatgtttgagatagcaaattctagttttataatctatacacygtatagaaatgaacgcatcagtatgtaaagatacatgtataaagatttctttatctgaaagaaagagaacaactcgaatctttacacataagaacaatgt

SEQ ID NO: 7853 - DNA, 201 bp, Homo sapiens
aaaactaatatagtgatacaaaaaaatttaaaatgtcattgatgtttgagatagcaaattctagttttataatctatacaccgtatagaaatgaacgcatmagtatgtaaagatacatgtataaagatttctttatctgaaagaaagagaacaactcgaatctttacacataagaacaatgttgaataagtacagccatgc

SEQ ID NO: 7854 - DNA, 201 bp, Homo sapiens
cattcataccttcacctgcagtaagtaatgatctttctccttcctcttgatggcagatgatgtcaggaggactccttgcgggttaacttcaaaagccttcycatcatttccagttacaatagtaaagaagaagggtggaccgttatgggaagaatcctcatctgttactaccagctgcagcacgctgaagcccactggctt

SEQ ID NO: 7855 - DNA, 201 bp, Homo sapiens
aaaaaatgattcttcaaatgaaatgggctccagggacggtttgggcttggagatccattcaatatggagtctggtggttgatgacttttgagggcgaccaytgtcaactgccttaatctacaacatttgggcagaggggattaaaaacagcaaatcaggagttacaacccagaaatgaatgaagcacagactggtttggtc

SEQ ID NO: 7856 - DNA, 201 bp, Homo sapiens
gataaagacctgctaagtatacttagagccaactgtttgagctgaaattgggagctctgaaaacttaacaggacacatcaacacagaaaaagtaggaaaayctcaaaatctaggaaaatttatcttctaatgagaaacaattacttcccaatgtagaagagatctaacagtctactaaccaacttgcaaaatcgtatctga

SEQ ID NO: 7857 - DNA, 201 bp, Homo sapiens
cgtgtgtgtgtgtggtgtgtgtgtgtgtaaatatacatttaatgttcttgcttctgccatcagttggcaaatttatgttatttactactgtggactaaaawagaacaagaaatgaaaaaggaggagtctattgggctgaaggcatttaagattctaaaatggctattcagtctactttctcagggaatgacacaggaaatg

SEQ ID NO: 7858 - DNA, 201 bp, Homo sapiens
agcatccctcgtgggccaatcaaactgctaggcagtatactagtgtaccgtacaggtgcctctctgcccccttacagataaaaatacagtaaatcatgtayaatttctttctctccagtttaactgaagccatgacactgaccaccatgacccaatctttcaaaaccagtgatgtgccatgagtgccattttgtgagaagc

SEQ ID NO: 7859 - DNA, 201 bp, Homo sapiens
cccacaagggcatgcacacccgccacacgactcgactccgcacaccacctcacctgggcgatcaagccttgctttgttggtggtgatctcttaatatccasaggaaaattaacacaccatgtgactctttaaaaagactaccgcactcacaagcccattagaagatctcatacctactttttcccatcacccaaatgaagg

SEQ ID NO: 7860 - DNA, 201 bp, Homo sapiens
atgatcagctagccaacatggtgaaaccccgtctctacaaaaaatacaaaaattagccaggcatgatggcgggtgcctgtaatcccagctacttgggaggytgaagcagaagaatcgcttgaacccaggaggcagaggttgcagggagccaagatcgtgccactgcactccagcctgggcaacagagcgagactccatctc

SEQ ID NO: 7861 - DNA, 201 bp, Homo sapiens
taatatgtattatatataaaacacacacacacacacacacacacacacacacacacacacacatttttgagacggagtttcactcttgtcccccaggctgragggcagtggcacaatctcgactcactgcaacctccagctcccagattcaagcaattctcctgcctcagcctctggagcagctgagactacaggtgtgcg

SEQ ID NO: 7862 - DNA, 201 bp, Homo sapiens
gaaggaaaggtttccccggagaccccacgatggcttaccaggccagcctaaccattatgcattgagtgcctgttatatacaccaagcattcaaagacttasgtgcgcccacaaagagctgacaatctagaggaaaggcgcgtgtaaataaacaattacactagagtgatactgcagtcatatgtttaagtacataaaagat

SEQ ID NO: 7863 - DNA, 201 bp, Homo sapiens
aactgcaaacacaaatatgacacctgtccatctcttcaatggccaatgagacaagggaagctacaggcactcacctggattcacccacgccttcgctggcmtgatcttgacttgctgactgccaccgcgacggaattcaaactcctgtcctcctaattgtgctagatagcaatatgtcattcagagtaaaaatgctggaag

SEQ ID NO: 7864 - DNA, 201 bp, Homo sapiens
gttcactaaagtcaggcactttggggggagttgagagtcagacttccgtgtgctgctgggaatccaggggcgggatcgtcacctcttcgaagtggccgtcktccccgctctcatagtcactcatcatgacctcggactccacttcgcagcaggctgacacgtcagagcaggaggcggtggaggcgtacacagacatgggca

SEQ ID NO: 7865 - DNA, 100 bp, Homo sapiens
acactttccaataatgaaaaatgtttataattctaaatacagcaacccaygtaagacatgttcatgtatctgatctctccttcatcctatgtacagctag

SEQ ID NO: 7866 - DNA, 100 bp, Homo sapiens
acatttactcagacataccaccccaggtgcctgtccggcctatttcctayaccccgagtattccaagtgactcaagaaacaatctggaccgaaattcctt

SEQ ID NO: 7867 - DNA, 100 bp, Homo sapiens
gcaaacccagaagctatgcacacatcgaagagtcggtggatgtatctccrggctgcttcctgacggccacggaagactgcgccagcaacccttgccagaa

SEQ ID NO: 7868 - DNA, 201 bp, Homo sapiens
ggttcattggaggaaaggaatagccctgtgtgtgatgagcattgagaggaggtctggcgagcaccatctagggctgaagaactaggcagtggctccagcgyggggcggtgggggggacaagtgagccagggcaagaagaatggatttggccctagagtacgggttctccaaatgtaacctcggccctacagatctctgaga

SEQ ID NO: 7869 - DNA, 201 bp, Homo sapiens
ccagtgggccttaggtccctatgccggcgcggggttacagcagtggacagacaggccagtccctgtcctcgaggagcccatgatccgcggggagacaggcrtttaacgacgactcacacgatcacttaaatacaactgtggtgaaccgcacaagagggacgcgcggcggtctgcggggaatgacgaggccgacctcgtctg

SEQ ID NO: 7870 - DNA, 201 bp, Homo sapiens
ggtgatcttggggagagactgttcccaggcaaccctggagtctggctcagcgcacaaatctgtccagggcagatggccgggcccccgtgggcttggccttygcctccttatgatgctgctgctgaaggctctgccggaccttgtcctggggaccggagacggggaggacacaggcacagagtgagaagtggcaggctgaca

SEQ ID NO: 7871 - DNA, 201 bp, Homo sapiens
ggaacaggaccttctctctcccaggcccaacgcaggggccctcactggctgcagctgatctgtttccttataccagatcctcagtctcactaaagacagcratatgggagacacccaggggcctggcccgccagcccaaaagatggtcatcgggaagagaaaaagaaaaaaatgctgcagttgttctctcaagctagggca

SEQ ID NO: 7872 - DNA, 201 bp, Homo sapiens
gacgaggaggcctcgccccaacacagtgtgtcaagctggctggtgccacccactacccgctagaccggtgctgctatgggaaattcctgctgacgtcccayaggctggacccctggaagatgcaggaagcctggaagctggtgggtggctctgacggggaaaggactgcgcccttttgctcctggttccagggagtcctgg

SEQ ID NO: 7873 - DNA, 201 bp, Homo sapiens
agaggctgagcaggaaggaggccaggttttgcacagcgaggaagtgcctcttctgtacttgggccgggtgcactggcgcgtgaacccctctcggacaccgsggggcaggcaccgcgtatcagaggagcagtggcctcacacctggggcccctttccaccctatgcctcaggcacggggtatgtgctgtcagcgtctgctgt

SEQ ID NO: 7874 - DNA, 201 bp, Homo sapiens
ggaccctcttcgggccttcggggttgggggaggagctgctgagcctctcactagcctccctgctcccagcccccgcctcaccggggccgcccctggccctkccccgcctcttgatccccaaccaggaagcttgcagtggtcccggggcccctcccttcctgctcatcctggtgtgcacggctccggagaacctgaaccaga

SEQ ID NO: 7875 - DNA, 201 bp, Homo sapiens
cccctgggggaaggcaggagcagaatttgacattcccttccccaacaataacacggctaaaactcccgcgggaagcgtttcaggcggagagagagccggtyactccatccccacgggattaccctccctaccacaacccacgaatgtagctgaccgaaatcccggccgggttttccgaagggccctcgattcccgccccct

SEQ ID NO: 7876 - DNA, 201 bp, Homo sapiens
gacttacgtgcctgtagaatctactgccacagcccggaccccaccacgatgacagagaatctttgccagtggctccttcatagctggactccataaagacrcagtacctggaagagaagaagaaccaaagttgctaatacacacctaagcctgaggttactaaacatgggaaagatgggaactcaagaccaagagataaca

SEQ ID NO: 7877 - DNA, 201 bp, Homo sapiens
ctcaggaacagcagaaatccaaagcagacaccacctccacccctcacatcagccagacctggagagaacgatcatcttgaatgacaatgatgaacacagcrctccctattttgctaagcgctgtgctaaactatatgccttaactcatcttaatgtctacaacagcttatatgagggctttaaaccaaggcttggtaaact

SEQ ID NO: 7878 - DNA, 201 bp, Homo sapiens
agactctgtctcaaaaaaaaaaaaaaaatagccacaagtttttatacctaaaggataacgggagcaccacaccagggcaggctcaacgattcatccttttrtctccagaacctcagcgcagagccctgcccacagcaggtgcccagtgaatacctgatgacaaaaggaatcagaggaaaatacaaatcagacagaaaagct

SEQ ID NO: 7879 - DNA, 201 bp, Homo sapiens
aaccatagccatggccgggtgcagtggctcacgcctgtaatcccaacacttgcactttgggaggccgaagcaggtggatcacgatgtcaggagttcaagaycagcctggccaagatggtgaaaccccatctctactaaacattaaaaaattaactgggcgtggttcgtgggcgcctgtaatcccagctactcaggaggctg

SEQ ID NO: 7880 - DNA, 201 bp, Homo sapiens
tgaccttctccagcaggggggaacctgaccttctccaggaaggaggaacctcaccctctccaggacgggggaacctgaccctctccagcaatgggggggayctcaccctctccagcaggggagcctcaccttctctagcagggccttcacctcccactcctggcgctgcttccggcttctgtatggattactctccaggcc

SEQ ID NO: 7881 - DNA, 201 bp, Homo sapiens
caggggggaacctgaccttctccagcagtggggaacctgaccttctccagcaggggggaacctgaccttctccaggaaggaggaacctcaccctctccagsacgggggaacctgaccctctccagcaatgggggggatctcaccctctccagcaggggagcctcaccttctctagcagggccttcacctcccactcctggc

SEQ ID NO: 7882 - DNA, 201 bp, Homo sapiens
gaggggaatctcaccctctccaggaagaggaaaccttaccttctccagcaggggggaacctgaccttctccagcagtggggaacctgaccttctccagcasgggggaacctgaccttctccaggaaggaggaacctcaccctctccaggacgggggaacctgaccctctccagcaatgggggggatctcaccctctccagc

SEQ ID NO: 7883 - DNA, 201 bp, Homo sapiens
ccgtccaggagaggggaatctcaccctctccaggaagaggaaaccttaccttctccagcaggggggaacctgaccttctccagcagtggggaacctgaccytctccagcaggggggaacctgaccttctccaggaaggaggaacctcaccctctccaggacgggggaacctgaccctctccagcaatgggggggatctcac

SEQ ID NO: 7884 - DNA, 201 bp, Homo sapiens
gaccccgtccaggagaggggaatctcaccctctccaggaagaggaaaccttaccttctccagcaggggggaacctgaccttctccagcagtggggaacctkaccttctccagcaggggggaacctgaccttctccaggaaggaggaacctcaccctctccaggacgggggaacctgaccctctccagcaatgggggggatc

SEQ ID NO: 7885 - DNA, 201 bp, Homo sapiens
tctgtttccttataccagatcctcagtctcactaaagacagcgatatgggagacacccaggggcctggcccgccagcccaaaagatggtcatcgggaagaraaaaagaaaaaaatgctgcagttgttctctcaagctagggcagaagaggggtgtcaagctcctcaataaacttgtctccacttcttcgagtgcagtgtgg

SEQ ID NO: 7886 - DNA, 201 bp, Homo sapiens
gtttttttgtttttgtttttgttttcttttaaggggtcatctagtcataagggaaaatccttcgggctgtgaccgaagcaacaaaggcaaaaacgcggacsttggttatgaagggtgtggtctccctggtggagtacgtcggtgggttgggatggggagcggctggacagaccggtctcactccgtttggtgccactccac

SEQ ID NO: 7887 - DNA, 201 bp, Homo sapiens
aatgtaagcattagtttctttttataataacttgggcagtcagttctgggcactgacaaaattgagtttgtgatcttggaatactttgattatggggatamagtgatttgcctaaataattgtgacccttagagattctgaggaactgacagcccaataccttaatcaaagcctgtaactcataagaccctggtttactgc

SEQ ID NO: 7888 - DNA, 201 bp, Homo sapiens
tcttcctgtcttctggtggttgtcagtaatccttagtgttccttggcttgtagctgcattactccaatctgttgctgtcatctcatggtcctcttcgtgtstctctcatgatttgtcattggatctagagcccaccctaatcaaatataacgtcattttacctaattatttccgtaacgaccttatttccaaatagggcca

SEQ ID NO: 7889 - DNA, 201 bp, Homo sapiens
aaggagtacatccatctttctttggcttttaagaatcgaatcaatgaatgcaagaatattatttcacttgagtatttctctccacaaacctaatgaattcytggctttctagatacataacgttctttttttttcccttaagtcagaatgtgtagttagttgtggaaatagcctaccagtatgtgtccatgcgtgcagggc

SEQ ID NO: 7890 - DNA, 201 bp, Homo sapiens
ctgagtgggacatttactcagatgagccataattgacactcctttcctgtcgaagtgtgaaggagtacatccatctttctttggcttttaagaatcgaatmaatgaatgcaagaatattatttcacttgagtatttctctccacaaacctaatgaattcttggctttctagatacataacgttctttttttttcccttaag

SEQ ID NO: 7891 - DNA, 201 bp, Homo sapiens
catccagatcaccttgactgctggattaagaaaagaaagtggtttagggagagactgacccctttagcatttaccacagaaaataagtgattaaagccaakatagtggtctaaggtcaagccaaaacatttcacctggggaagtggggaggaggtatggttgctcacccgaattcgctaagattttcctgaaccacgagct

SEQ ID NO: 7892 - DNA, 201 bp, Homo sapiens
ctctagtgatccctgaaaagttccagcatattttgcgagtactcaacaccaacatcgatgggcggcggaaaatagcctttgccatcactgccattaaggtragtgaagtagggtaaggaatagggaatgtaaatgagaattgggttgtgaagacataagcaaaaatgaagcaaggctggggagacttgagtctcatccaga

SEQ ID NO: 7893 - DNA, 201 bp, Homo sapiens; identical to SEQ ID NO: 837

SEQ ID NO: 7894 - DNA, 201 bp, Homo sapiens
ggggtcacaggagagctacctgtcccagcctccatccaactcacccagacactccctgcctccagcacttcccaactctccggctggacctcacctttcgrgatttgtcaatgcgacagaacttctggaccacttccacagggacgggggcggggcctgggaatggatcttgggcctaggggaaaggaggacgcaattagc

SEQ ID NO: 7895 - DNA, 201 bp, Homo sapiens
gtgggtgtgtccaagaagaaataagtctgtaggccttgtctgttaataaatagtttatatacctatggcttcctgtcctttctgtccattctaatagggartgttaaagtgctgggtcctttttccatttagagctgccctactcagttgcccacacagtgctattagttttagcagtggtgatgctgcagaccccccagt

SEQ ID NO: 7896 - DNA, 201 bp, Homo sapiens
aggttcttcagcaagcagcagctcagaacgagcagctttgatacttgtttcctcttcctcagcttcagccacctcaagtcggcttcgagttttggctttakaatgtggtagctgtaacattgttggtggggaggagtggcagaagaaccacaggataagtggggtcacaggagagctacctgtcccagcctccatccaact

SEQ ID NO: 7897 - DNA, 201 bp, Homo sapiens
ccaagaaaccaccccccagccagtgaatctctcactctgtccactgcgagatgaccaatgttggccgaagcacccgtggggcaggagggtcactggaaccrggtggctccacctcacaggatacacgatggctgggttaggggggcaataggcagagctcaggacatgacaccaatcccccacacctggccagaaccctgg

SEQ ID NO: 7898 - DNA, 201 bp, Homo sapiens
atcttgagcggcagtcagagcaacagagggagacccttgctcagctgcagcaggagttccagcgggcccaggcagcaaaggcaggggctcctggcaaggcmtgaccccatggtggggggaggggaggggaggggagggaatgaggcagctctaggatctatactgtagctaataaaatgtaaaaacacctggctctgtttc

SEQ ID NO: 7899 - DNA, 201 bp, Homo sapiens
cctccccttccagaaacctgaaagcaagggttaggatggcagtaaagcttcccaatatgaagcaagtataccaacataaaaacgagaaaagacagtcccawaaggcagggaatgggggtccagattagggctcactcacccaggttcttcagcaagcagcagctcagaacgagcagctttgatacttgtttcctcttcctc

SEQ ID NO: 7900 - DNA, 201 bp, Homo sapiens
cagaatggagaaacctgggggagaggaagagtggttcaattgggaaatgaggtcacaggctatcattcaatcaggaatggactatctcaccccaactgacygctgacagtgaggccactgaccggatgtcccgcaccgcctccatgacgttgatctcgcacataagcttctttgttacccaatcaagggcagccacatgac

SEQ ID NO: 7901 - DNA, 201 bp, Homo sapiens
cagcctcatcactggagcccccgtggcctgacaagctcctgaggaggaccagagaaaagcagggatgggctgaagatcacaaggaccagagctgtttagcmtcaaggtgttgattaaacttcaggcctcagcgaactagtgattaagccctaagcacaggagtggctgacccaggtagcccacggagggcaagctacagct

SEQ ID NO: 7902 - DNA, 201 bp, Homo sapiens
cctgaccttctccagcaggggggaacctgaccttctccaggaaggaggaacctcaccctctccaggacgggggaacctgaccctctccagcaatggggggratctcaccctctccagcaggggagcctcaccttctctagcagggccttcacctcccactcctggcgctgcttccggcttctgtatggattactctccagg

SEQ ID NO: 7903 - DNA, 201 bp, Homo sapiens
accccaaaccacaccttccccagcagcaggggcctcactctctgcagcaggggaacctcacctccaacaggggcaatctcaccctctccagcaggggggawcctgaccctctccaggagagggaatttcaccctctccagcagagggaaacctgaccctctccagcagggggaatctcaccctctccagcagagggaaacc

SEQ ID NO: 7904 - DNA, 201 bp, Homo sapiens
ctcccaggcccaacgcaggggccctcactggctgcagctgatctgtttccttataccagatcctcagtctcactaaagacagcgatatgggagacacccargggcctggcccgccagcccaaaagatggtcatcgggaagagaaaaagaaaaaaatgctgcagttgttctctcaagctagggcagaagaggggtgtcaagc

SEQ ID NO: 7905 - DNA, 201 bp, Homo sapiens
gcatcattgtggagtgggttagctgagcctagccagttgcagttaaggtgagtttgcaggtcttggtcactctgggtttttttgtttttgtttttgttttyttttaaggggtcatctagtcataagggaaaatccttcgggctgtgaccgaagcaacaaaggcaaaaacgcggacgttggttatgaagggtgtggtctccc

SEQ ID NO: 7906 - DNA, 201 bp, Homo sapiens
atcgaatcaatgaatgcaagaatattatttcacttgagtatttctctccacaaacctaatgaattcttggctttctagatacataacgttctttttttttyccttaagtcagaatgtgtagttagttgtggaaatagcctaccagtatgtgtccatgcgtgcagggctaggcctgtcttcttggcttctgttgcatggtag

SEQ ID NO: 7907 - DNA, 201 bp, Homo sapiens
catccatctttctttggcttttaagaatcgaatcaatgaatgcaagaatattatttcacttgagtatttctctccacaaacctaatgaattcttggctttstagatacataacgttctttttttttcccttaagtcagaatgtgtagttagttgtggaaatagcctaccagtatgtgtccatgcgtgcagggctaggcctg

SEQ ID NO: 7908 - DNA, 201 bp, Homo sapiens
cgcttccttcgtcaacatccagcagctacttgatgagcgccctccagtgggccttaggtccctatgccggcgcggggttacagcagtggacagacaggccrgtccctgtcctcgaggagcccatgatccgcggggagacaggcatttaacgacgactcacacgatcacttaaatacaactgtggtgaaccgcacaagaggg

SEQ ID NO: 7909 - DNA, 201 bp, Homo sapiens
gatagggaagtccagcatccagcccagacactccgctcaccttcctccgcttgtcaaaattgatgtatccattctgcgaggaaaatggggatggggtgaargttccaaccctaccttccggccacagagagagaatatcccctctcttaaacacacacagccacatccaactcacaaccacttccctccagcctctctgac

SEQ ID NO: 7910 - DNA, 201 bp, Homo sapiens
cctccaaccctttccttcccttttaaccccccttcttctccctcccctggatctcaagttttccacctatctctttcttgcgtttagcactctccatagtragtcctactaatttctccctttctgcttgtctcccttgtctctccttagtaagcgatacgaatcccagcttcgggatcttgagcggcagtcagagcaaca

SEQ ID NO: 7911 - DNA, 201 bp, Homo sapiens
gtgagggcacgctctccttagaggggcggaacagtttttggcaccttatcgcgagcggcagcttatgcaagagtgacttaaaaaagaaaggcaggtccggrgccaggggctaagtagcggtgcggtttctttttctggattagtttccccatcttgcctaaaaatgtcctagtctagtctttttagcagaactccactccc

SEQ ID NO: 7912 - DNA, 201 bp, Homo sapiens
gaagctctctaggtgccatcttgagtgagggcacgctctccttagaggggcggaacagtttttggcaccttatcgcgagcggcagcttatgcaagagtgayttaaaaaagaaaggcaggtccggagccaggggctaagtagcggtgcggtttctttttctggattagtttccccatcttgcctaaaaatgtcctagtctag

SEQ ID NO: 7913 - DNA, 201 bp, Homo sapiens
tcttggtctgaagtttgtctttcttgggcgggacatccttgcccggcttgggggctgtctccatctcgcccacccgaacggcgatccacgtgcaaaactcytctcagctgccacacagtcggcttgaaaactcccggaagccctctgtccttcatccaatcagcagcgtaccaggtatgaagctctctaggtgccatcttg

SEQ ID NO: 7914 - DNA, 201 bp, Homo sapiens
actgagagagaaagacagagagaatgacccagtcctgattgccctctgtattccctctgctggggtcctaaaggagaggtggtcatcccaagggcttccamccagttcctgagctccatggccactcacagctgtagccaggaggaagtggaagggcaggaactcaagccgtgttactcggtcacagcggcggatacagtg

SEQ ID NO: 7915 - DNA, 201 bp, Homo sapiens
tgagaattgggttgtgaagacataagcaaaaatgaagcaaggctggggagacttgagtctcatccagatcaccttgactgctggattaagaaaagaaagtrgtttagggagagactgacccctttagcatttaccacagaaaataagtgattaaagccaagatagtggtctaaggtcaagccaaaacatttcacctgggga

SEQ ID NO: 7916 - DNA, 201 bp, Homo sapiens
cctttgccatcactgccattaaggtaagtgaagtagggtaaggaatagggaatgtaaatgagaattgggttgtgaagacataagcaaaaatgaagcaaggytggggagacttgagtctcatccagatcaccttgactgctggattaagaaaagaaagtggtttagggagagactgacccctttagcatttaccacagaaaa

SEQ ID NO: 7917 - DNA, 201 bp, Homo sapiens
aaacagtttccggaagcacttctcctagatcgcaccgcctcttcctcctggaagctatataatgatatcgcgtcacttccgctctctcttccacaggaggyctacacgccgccgcttgtgctgcagccatggtaagactggaatccgtgccgtgatccagcggcatcgcagctcgggcaaggaaagccggctgtcagggtt

SEQ ID NO: 7918 - DNA, 201 bp, Homo sapiens; identical to SEQ ID NO: 841

SEQ ID NO: 7919 - DNA, 201 bp, Homo sapiens; identical to SEQ ID NO: 838

SEQ ID NO: 7920 - DNA, 201 bp, Homo sapiens
tgcgagggggccgttgggggcaatgggagagaagcacggaaccccagagagaggctgagcaggaaggaggccaggttttgcacagcgaggaagtgcctctwctgtacttgggccgggtgcactggcgcgtgaacccctctcggacaccggggggcaggcaccgcgtatcagaggagcagtggcctcacacctggggcccct

SEQ ID NO: 7921 - DNA, 201 bp, Homo sapiens
gatccctccctgccttcctcctcaatctatcatggcctaagcactccacttgaccctttaaattgaatttctcaggtagacaacgagtctgctttgcagaygagaggactggatagtatccaattcgacaggattccttatccagagaggataaggaacttgtccaaggtctcagtatttgtttatttaacaaactctagc

SEQ ID NO: 7922 - DNA, 201 bp, Homo sapiens
ctctctgactcttcgatccctccctgccttcctcctcaatctatcatggcctaagcactccacttgaccctttaaattgaatttctcaggtagacaacgartctgctttgcagatgagaggactggatagtatccaattcgacaggattccttatccagagaggataaggaacttgtccaaggtctcagtatttgtttatt

SEQ ID NO: 7923 - DNA, 201 bp, Homo sapiens
gggggcaataggcagagctcaggacatgacaccaatcccccacacctggccagaaccctggagtcccaacctcacccgccagtcacctctgagcctctgtmagtggccggagcccctgtagccacctctggatatcatggtcaggttggaggttatagccacgacattcattctggagccgtcgcaactcagaaaggactg

SEQ ID NO: 7924 - DNA, 201 bp, Homo sapiens
tcccaacctcacccgccagtcacctctgagcctctgtcagtggccggagcccctgtagccacctctggatatcatggtcaggttggaggttatagccacgrcattcattctggagccgtcgcaactcagaaaggactgcaaactcctgggaaggagccctcaaactgcaggagccaaaactcagggacccctgacttttcc

SEQ ID NO: 7925 - DNA, 201 bp, Homo sapiens
agaaaagtggaagtcccaagaaaccaccccccagccagtgaatctctcactctgtccactgcgagatgaccaatgttggccgaagcacccgtggggcaggwgggtcactggaaccaggtggctccacctcacaggatacacgatggctgggttaggggggcaataggcagagctcaggacatgacaccaatcccccacacc

SEQ ID NO: 7926 - DNA, 201 bp, Homo sapiens
ggcctcttctgcacccccactcagcggggagccacaggaggctgagcggcggtgacctcgagaaggcctaggggaggaggctggtggggagaggtggctgrggtcagctggactgtgcagggatggactgctttccaaggcagagtctagtgacgagacagatggccacttcatgtgctaggaacaaacaacatgggactg

SEQ ID NO: 7927 - DNA, 201 bp, Homo sapiens
aagcacacacacagttgttccccccacagccgcccagatgtggaagtactccactctcctcccgagtctgcctttccctcatggcctctgacctcgctccyctggtagcagctgtaccagctcatactctgaagccactgcagagtcacgattgtttttcttaaggacacgactgatgacacttggagccttgtcctggct

SEQ ID NO: 7928 - DNA, 201 bp, Homo sapiens
tgcagagtcacgattgtttttcttaaggacacgactgatgacacttggagccttgtcctggcttgtcacctggcagaacaggagaccaaaagagcaatcartcagccatgatttcccatccttctaccctcagccactgaacccaaccacaaaatgttacttgtgtccaaggctttaaaatgaacaggaaaacccaatatg

SEQ ID NO: 7929 - DNA, 201 bp, Homo sapiens
cagccagaggaaggaaaactgggaatgaagagtcagaggtgagaagctaaagtcatgatctcaccaagggatcaagaggtcgatattggcggcttgtgacrgtaaacacggcaccatcctcctcctcatcccagacggacacaggggcctggaggagcaaggaaggggaagtcagacagttccacaccaccccccattgcc

SEQ ID NO: 7930 - DNA, 201 bp, Homo sapiens
ggagaagcatggagccataaggaagaacctcagtccaacagctccagcccaactaagcccccagttcctggatgtctctggcccaaacttccacccagagktcattcacttcaagccccatcccctggcccactcaccagggaccagcatgctggtgatgcccccagtgtgccccacccccagcacatcttcaaaggggca

SEQ ID NO: 7931 - DNA, 201 bp, Homo sapiens
tctttcttgggcgggacatccttgcccggcttgggggctgtctccatctcgcccacccgaacggcgatccacgtgcaaaactcctctcagctgccacacaktcggcttgaaaactcccggaagccctctgtccttcatccaatcagcagcgtaccaggtatgaagctctctaggtgccatcttgagtgagggcacgctctc

SEQ ID NO: 7932 - DNA, 201 bp, Homo sapiens
actctccggctggacctcacctttcgggatttgtcaatgcgacagaacttctggaccacttccacagggacgggggcggggcctgggaatggatcttgggyctaggggaaaggaggacgcaattagcagacagccttggattgaccccaaccctctcactctcaaggaacgaggcggcctgcctcgccacccatcaggtcc

SEQ ID NO: 7933 - DNA, 201 bp, Homo sapiens
ctcgccacccatcaggtcccacgctcaccccggacaagccgcgctgggactccgggttcttccattctcggggtttcttcgggacctgaggcttcttagaratccgagacttctttaagatgtaagcattttttggtctctgaggacggagctcccgattcttcttgttacgaggaggccctggagaggctccggctgtgg

SEQ ID NO: 7934 - DNA, 201 bp, Homo sapiens
ggacctcacctttcgggatttgtcaatgcgacagaacttctggaccacttccacagggacgggggcggggcctgggaatggatcttgggcctaggggaaasgaggacgcaattagcagacagccttggattgaccccaaccctctcactctcaaggaacgaggcggcctgcctcgccacccatcaggtcccacgctcaccc

SEQ ID NO: 7935 - DNA, 201 bp, Homo sapiens
tgttcactcacccgctgcccccatccttttctgcttcctcagatccatatccacctgactaggattgtggggataggtggcacatttgatgtttctaaatygcctttcctctcatccccagacttaagtaaatccatgtcggggaggcagaaacttgaagcacaactaacagaaaataatatcgtgaaagaggtgagggac

SEQ ID NO: 7936 - DNA, 201 bp, Homo sapiens
ctggaccctcttcgggccttcggggttgggggaggagctgctgagcctctcactagcctccctgctcccagcccccgcctcaccggggccgcccctggccstgccccgcctcttgatccccaaccaggaagcttgcagtggtcccggggcccctcccttcctgctcatcctggtgtgcacggctccggagaacctgaacca

SEQ ID NO: 7937 - DNA, 201 bp, Homo sapiens
gggatgacagaggataactgtgtagaaactaatggcatcacctgagctaggcgtggtggctcatgcctgtaatcccagcactttgggaggccgaggtgggyggatcacctgaggtcaggagtttgagaccagccaagccaacatggcaaaaccccatctctactaaaaatacaaaaattagcgcatgcagtggcatgcact

SEQ ID NO: 7938 - DNA, 201 bp, Homo sapiens
aaaaatagtaataaaataaataaatgcatcacctggccaatcattctcaaaaaccatagccatggccgggtgcagtggctcacgcctgtaatcccaacacytgcactttgggaggccgaagcaggtggatcacgatgtcaggagttcaagaccagcctggccaagatggtgaaaccccatctctactaaacattaaaaaat

SEQ ID NO: 7939 - DNA, 201 bp, Homo sapiens
gaccatctggaacactaactttgtacatcaattaggcaaaatgttaacctcaaaaagagaaattcagttcttcccattagtagatctgtattacacaaathtatttgattattattattttttttttctgagaccgggtctcactctgttgcccatgctagagtgcagtggcatgatcacagctcactgcagccttaacct

SEQ ID NO: 7940 - DNA, 201 bp, Homo sapiens
agctactccggaggctgaagccacagaattgcttgaacccaggaggcggaggttgcagtaagccaagatcatgccactgcactgcagcctgggcggaagaktgagactccgtctcaaaaaaaaaaaaaaaagaaaaattatcccttatataagtgaaagaaaaaaaaaaaagcattccagccactcagtggagagagattg

SEQ ID NO: 7941 - DNA, 201 bp, Homo sapiens
aaagggctgcaatttattttcttttctttctttttttttttttttttttgagacagggtctcactttgtcacccaggctggagtacagtgggacaaccttrgctcattgcagcctcaccctcccagattcaagcgatccttctgccacagctccccaagtagctgggactatagctgtgtgccaccatgcccagctaattt

SEQ ID NO: 7942 - DNA, 201 bp, Homo sapiens
aaagaaaggcaggtccggagccaggggctaagtagcggtgcggtttctttttctggattagtttccccatcttgcctaaaaatgtcctagtctagtctttktagcagaactccactccctaaacatgtcagaactacacttcccatcaagggtcagaaagaaacttccggcacagtcttttcccagcattccttgtttact

SEQ ID NO: 7943 - DNA, 201 bp, Homo sapiens
acccgctagaccggtgctgctatgggaaattcctgctgacgtcccacaggctggacccctggaagatgcaggaagcctggaagctggtgggtggctctgayggggaaaggactgcgcccttttgctcctggttccagggagtcctgggcatcctgcggtgtcgagcaatagcctggcttcagagctgagagtgcctggggc

SEQ ID NO: 7944 - DNA, 201 bp, Homo sapiens
gtcttcacggagcttgttgtccagaccattggctaggacctggctatattttccatcctttacatccttctgtctgttcaagaaccagtctgggatcttgyactggcgtggattctgcataatggtgatcacacgttccacctcatcatcagtgagttctcccgccctcttggtgaggtcagtgtctgctttcctcaacac

SEQ ID NO: 7945 - DNA, 201 bp, Homo sapiens
acgaaggccccagaagtgacgcagccctctatgggcccgaatcttcttcagtcgctccaggtcttcacggagcttgttgtccagaccattggctaggaccwggctatattttccatcctttacatccttctgtctgttcaagaaccagtctgggatcttgtactggcgtggattctgcataatggtgatcacacgttccac

SEQ ID NO: 7946 - DNA, 201 bp, Homo sapiens; identical to SEQ ID NO: 840

SEQ ID NO: 7947 - DNA, 201 bp, Homo sapiens
acaaaattgagtttgtgatcttggaatactttgattatggggatacagtgatttgcctaaataattgtgacccttagagattctgaggaactgacagcccmataccttaatcaaagcctgtaactcataagaccctggtttactgcatcagcttggagtggcaggccccttgttctcctaaatgcaagaatcagaaggcac

SEQ ID NO: 7948 - DNA, 201 bp, Homo sapiens
caaaattgagtttgtgatcttggaatactttgattatggggatacagtgatttgcctaaataattgtgacccttagagattctgaggaactgacagcccartaccttaatcaaagcctgtaactcataagaccctggtttactgcatcagcttggagtggcaggccccttgttctcctaaatgcaagaatcagaaggcact

SEQ ID NO: 7949 - DNA, 201 bp, Homo sapiens
tttgccattcccctctgccctggggctcagagccttgaagcctttgcttggcccttgcatgttaggatatggccaagaatcagaaactgatgcgtttttcsagcactacctgtgtgctgcactcatggaaggtgggaagctatacacaggtatccaacttggttataagacaccagttcccacagggctggatttctcagc

SEQ ID NO: 7950 - DNA, 201 bp, Homo sapiens
ggaggctgaggcaggagaatggcgtgaacccgagaggcggagcttgcagtgagccgagatcgcgccactgcactccagcctgggcgacagagcgagactcmgtctcaaaaaaaaaaaaaaaaagttttttgccttcttcattctataagtgtacagtggagtttttcagaagctacatgatatgtattgacaccatggttc

SEQ ID NO: 7951 - DNA, 201 bp, Homo sapiens
acagggacgggggcggggcctgggaatggatcttgggcctaggggaaaggaggacgcaattagcagacagccttggattgaccccaaccctctcactctcmaggaacgaggcggcctgcctcgccacccatcaggtcccacgctcaccccggacaagccgcgctgggactccgggttcttccattctcggggtttcttcgg

SEQ ID NO: 7952 - DNA, 201 bp, Homo sapiens
attaggagcagatgatagggtattattttagggagctactacagaagcttgggccagagatgatggtggcttccacaggatggcagtgagtgccctcactmtgctttctggaagagaggaaggtggtgaggaattcaggatattaaaaggcagttgaggtgtacatggtcagtttagagacatataaactatcatgggcac

SEQ ID NO: 7953 - DNA, 201 bp, Homo sapiens
gccaggctggtctcaaactcctgacctcaggcgatccacccgccttggcctccaaagtgctgggattacaggcgtgagccaccgcacctggccatattacrtttaattttataacctaaaaatgtgtgggccaggcgcagtggctcacgcctgtaatcccaacactttgggaggccgaggcgggcagatcatctgaggtca

SEQ ID NO: 7954 - DNA, 201 bp, Homo sapiens
ctctccaggagagggaatttcaccctctccagcagagggaaacctgaccctctccagcagggggaatctcaccctctccagcagagggaaacctgaccccrtccaggagaggggaatctcaccctctccaggaagaggaaaccttaccttctccagcaggggggaacctgaccttctccagcagtggggaacctgaccttc

SEQ ID NO: 7955 - DNA, 201 bp, Homo sapiens
cagcttcagccacctcaagtcggcttcgagttttggctttagaatgtggtagctgtaacattgttggtggggaggagtggcagaagaaccacaggataagyggggtcacaggagagctacctgtcccagcctccatccaactcacccagacactccctgcctccagcacttcccaactctccggctggacctcacctttcg

SEQ ID NO: 7956 - DNA, 201 bp, Homo sapiens
ccgagacagagtctcaccccgtcacccaggccggagtgcaatggtgcaatcttatctcactgcaacctcagcctcccaagtagctgagattacaggcacaygcccagctaatttttgtatttttagaagagatggggtttcaccatgttggtcaaactggtcttaaacttctgacctcaggtgatccacccacctcagcct

SEQ ID NO: 7957 - DNA, 201 bp, Homo sapiens
gtgggttagctgagcctagccagttgcagttaaggtgagtttgcaggtcttggtcactctgggtttttttgtttttgtttttgttttcttttaaggggtcmtctagtcataagggaaaatccttcgggctgtgaccgaagcaacaaaggcaaaaacgcggacgttggttatgaagggtgtggtctccctggtggagtacgt

SEQ ID NO: 7958 - DNA, 201 bp, Homo sapiens
cagaaaataagtgattaaagccaagatagtggtctaaggtcaagccaaaacatttcacctggggaagtggggaggaggtatggttgctcacccgaattcgmtaagattttcctgaaccacgagcttgtgagatttcttctagattcggtttctttacccatcccaccatcataacagcaacccttcctgcgaaatttatat

SEQ ID NO: 7959 - DNA, 201 bp, Homo sapiens
gaggtcaggagttcgagaccagcctggtcaacatggtgaaacctcgtcatttaattaataaaaaatttgaaagaccctgctctcttctgaatcaacctaakaatttgacccttggtcatgtttatttatttatcccgagacagagtctcaccccgtcacccaggccggagtgcaatggtgcaatcttatctcactgcaacc

SEQ ID NO: 7960 - DNA, 201 bp, Homo sapiens
aggtcaggagttcgagaccagcctggtcaacatggtgaaacctcgtcatttaattaataaaaaatttgaaagaccctgctctcttctgaatcaacctaatmatttgacccttggtcatgtttatttatttatcccgagacagagtctcaccccgtcacccaggccggagtgcaatggtgcaatcttatctcactgcaacct

SEQ ID NO: 7961 - DNA, 201 bp, Homo sapiens
tcgagaccagcctggtcaacatggtgaaacctcgtcatttaattaataaaaaatttgaaagaccctgctctcttctgaatcaacctaataatttgaccctkggtcatgtttatttatttatcccgagacagagtctcaccccgtcacccaggccggagtgcaatggtgcaatcttatctcactgcaacctcagcctcccaa

SEQ ID NO: 7962 - DNA, 201 bp, Homo sapiens
cctggtcaacatggtgaaacctcgtcatttaattaataaaaaatttgaaagaccctgctctcttctgaatcaacctaataatttgacccttggtcatgttkatttatttatcccgagacagagtctcaccccgtcacccaggccggagtgcaatggtgcaatcttatctcactgcaacctcagcctcccaagtagctgaga

SEQ ID NO: 7963 - DNA, 201 bp, Homo sapiens
atgtttatttatttatcccgagacagagtctcaccccgtcacccaggccggagtgcaatggtgcaatcttatctcactgcaacctcagcctcccaagtagytgagattacaggcacacgcccagctaatttttgtatttttagaagagatggggtttcaccatgttggtcaaactggtcttaaacttctgacctcaggtga

SEQ ID NO: 7964 - DNA, 201 bp, Homo sapiens
catcatctagttctgtatagcccacaagccaagaatggtttttacatttttaagtggttgaaaaaaaatcaaaagaatattttgagactgtgaaaaccgtrtgaaattcaaattccaatatccaacaaataaagttttattggaacggggccacactatttacttaatactgtggctgcttttgctctacaacacacagcc

SEQ ID NO: 7965 - DNA, 201 bp, Homo sapiens
atgaaattcaaattccaatatccaacaaataaagttttattggaacggggccacactatttacttaatactgtggctgcttttgctctacaacacacagcygagtggtcacgacagcgactacagcatcctgatttgcactgctgctttgtacactacaagtcacagtgacacagtcgtaagtgcttcacagcatttcaag

SEQ ID NO: 7966 - DNA, 201 bp, Homo sapiens
cggaattacaggcccccgccacgacacccggctaattttgtgaatttttagtagagacagagtttcgccatgttggccaggctggtctcaaactcctgacmtcaggcgatccacccgccttggcctccaaagtgctgggattacaggcgtgagccaccgcacctggccatattacgtttaattttataacctaaaaatgtg

SEQ ID NO: 7967 - DNA, 201 bp, Homo sapiens
gcctgtaatcccagctacttgggagactgaggcaggagaatcgcttgaatctgggaggcggaggttgcagtgagccgagatcacgccactgcactccaacytgggagacagagcaagactacgtctctctcaaaagatttaaaaaaaaaaaggtcaggcgcagtggctcacgcctataatcccagcactttgggaggctga

SEQ ID NO: 7968 - DNA, 201 bp, Homo sapiens
tctggcagaggctggaaaagactctgaggctgtccctggggaagggagaaaagtggccctgaggacaggcctggctctgtcaccccctcttccccgccttytgaggaacccccaccccagtccaatgcctcagcctccgcacctggttgcttccccccaggctgcccgaagcctgtggatggggctggactgcagggctga

SEQ ID NO: 7969 - DNA, 201 bp, Homo sapiens
cctattttgctaagcgctgtgctaaactatatgccttaactcatcttaatgtctacaacagcttatatgagggctttaaaccaaggcttggtaaactactrcccatgggccaaacctggcccatcatctagttctgtatagcccacaagccaagaatggtttttacatttttaagtggttgaaaaaaaatcaaaagaatat

SEQ ID NO: 7970 - DNA, 201 bp, Homo sapiens
gaaacccccagagtgggaagaagagctcctgcgaggacctacattttgccattcccctctgccctggggctcagagccttgaagcctttgcttggcccttrcatgttaggatatggccaagaatcagaaactgatgcgtttttccagcactacctgtgtgctgcactcatggaaggtgggaagctatacacaggtatccaa

SEQ ID NO: 7971 - DNA, 201 bp, Homo sapiens
gaatattcattgagcttggaaaggggttggaatgagagaaccgtttggaagcactggaatacagctttattcctacacgattagacccgttaccccgtggstctggccgaccgtcctgactcggagatccctgagctgcgccgccgcttccttcgtcaacatccagcagctacttgatgagcgccctccagtgggccttag

SEQ ID NO: 7972 - DNA, 201 bp, Homo sapiens
ggaagcactggaatacagctttattcctacacgattagacccgttaccccgtgggtctggccgaccgtcctgactcggagatccctgagctgcgccgccgyttccttcgtcaacatccagcagctacttgatgagcgccctccagtgggccttaggtccctatgccggcgcggggttacagcagtggacagacaggccagt

SEQ ID NO: 7973 - DNA, 100 bp, Homo sapiens
tggctggctccctttctgaatttctgtctcaatgtgatataattgccacmattcaggatggctacccacatctggtatgaacaccatgacttctgtaagc

SEQ ID NO: 7974 - DNA, 201 bp, Homo sapiens
gtttaccacctcctttttaaagggggaactctgagctgatttttggtagtgcaaatttcctagtcatatgctttcaatatgtgtttgttttttgttcttgktgtctgtcagagattatcatctgttgtggcagagaaaggcatttttcctcctccctcttctctgatgcttgcaaacgctcctagtggccaatgaacattg

SEQ ID NO: 7975 - DNA, 201 bp, Homo sapiens
cccttatatcctcctctccatgaccatttgctttcatgcctccatttagctcagcgtttcatttggaatagaggtctgcatcatacccaacctgcaaagcrgcctgggtggaaattattccatgcagcattccatgatgcttcccctggaataaatttccccctccttagaaattcttttttttttgaaatggagtttcgc

SEQ ID NO: 7976 - DNA, 201 bp, Homo sapiens
gtgaaaaatgtcattgttgaggaggtcactggctaggaattttagaagtgagaacacagtggtcattgctgtagtctagatttgggtggtccttcaacacytcagatgtataattaatttgggatttgtgtatcaaaagttctgctaccttttaatactcaataatactgatattataacctttgaaagggtggagagaga

SEQ ID NO: 7977 - DNA, 201 bp, Homo sapiens
ctgctgcctgcagattcactccttcttggtgttcttggcttctcattggaggcggctgcgttctcatcctacccactactttctccaggcttcatgtccaygacctgcccaatcccaagtctccctcacgctcttccattcagctcctttggctaacccaaagtgcactaattctgaagacccaaagggaggggtgtatca

SEQ ID NO: 7978 - DNA, 201 bp, Homo sapiens
acgggagacaggttagtggcagaatgtgtgtgttcatggggcctttatgatctgtgtagagaacagacttacaatcagttaactgggtgcagcctagaacygaatgtatgttataaaagaggtgcaggaaagtgctgcgaccctgaggatgcagaggttccttcagttggttggactggagtagcctcatggtagtggtgg

SEQ ID NO: 7979 - DNA, 201 bp, Homo sapiens
ctttggcctggtcacctccactttgaaatttgatcattggtatgagtcctgggagagtcgttcaggcagatgcatttgttcatgtaagcccacatttcagkcattcgttcaggacacatttaatgagggccaactctatacctgacactgtgtaaagccctggatgtgtgataacaatgaagaggacatgggctctgcttt

SEQ ID NO: 7980 - DNA, 201 bp, Homo sapiens
tctgatggctccaggaatcctctggattcggagtagtaatagtaatagcactttaaagtaggctcattactagagcggttattgcttttgttcgaaatggyccatctaagtcaggccctattaaatagagcaatttaactgacacttagcgtctttagggagataaattatcctttggcctggtcacctccactttgaaat

SEQ ID NO: 7981 - DNA, 201 bp, Homo sapiens
ttttgttcttgttgtctgtcagagattatcatctgttgtggcagagaaaggcatttttcctcctccctcttctctgatgcttgcaaacgctcctagtggcyaatgaacattggatgcacccatgaagtagaatccacacatttaattctagattgattctctgaggccttccctgccaggctcctttcagccaagcatatt

SEQ ID NO: 7982 - DNA, 201 bp, Homo sapiens
acatgggactcccccaggtgttgtctttcatttcctttttctctaaccctgggattactgaggctgaggaggtgtttaccacctcctttttaaagggggarctctgagctgatttttggtagtgcaaatttcctagtcatatgctttcaatatgtgtttgttttttgttcttgttgtctgtcagagattatcatctgttgt

SEQ ID NO: 7983 - DNA, 201 bp, Homo sapiens
aattcatgttgctccaataggggcttttttcaaactgatgtcttatccttcttagttcctcaagctcgatcctgttcagacatgttataacaagttagtaygagtttatttgggtacagaaaaattttaaaatccatgcataattttttcataatatgcattttcacaaactttgaagatccctttcatttacctatctcc

SEQ ID NO: 7984 - DNA, 201 bp, Homo sapiens
taggaagttccaaactttcccacatcttcctgccttcttctgagctctccaaactgttccaacctctgcccattacccagttcgaaagtcactttcacatkttctggtatctttacagcagtgccccactcctggtacccattttctgtattagttcattttcacactcctataaagaactgccttagactgggtaatttc

SEQ ID NO: 7985 - DNA, 201 bp, Homo sapiens
ccatgtcacgatcagcattttggtcaagaacattcaacaagtctctaggaagttccaaactttcccacatcttcctgccttcttctgagctctccaaactrttccaacctctgcccattacccagttcgaaagtcactttcacattttctggtatctttacagcagtgccccactcctggtacccattttctgtattagtt

SEQ ID NO: 7986 - DNA, 201 bp, Homo sapiens
agttggcaaggcttgaggcttgcaccctctgacaccacagcttgagctgtaccttggccccttttagctggagctggagtggctaggacacagggcaccaygtcccaaggctgcagagagcaactgggtcctgggccctgctcacaaaaccatttttccctcctggcctgtgatgggaggggctgctgtgaagttctctga

SEQ ID NO: 7987 - DNA, 201 bp, Homo sapiens
aataaaaatcaccagtaatcctatcattcagaaaatgttggcatagtattctttcagttatattgtatacgtgtgtgtgtgtgtgtgtgtgtgtgtgtgtscacataatttgtaacgttctttttaaattttatatacagcggacatttttctattcattaaaagcatttctaacttggttttcactcagacttttttacc

SEQ ID NO: 7988 - DNA, 201 bp, Homo sapiens
gaaatttttcctcctggctggagagtccggctgtctgtaaatgcattatcatttgtgcagcacggggtagattgtgatctgagctggaaagtgagccatgscaggcaggggttggagcctgttggagctgattatcgcgggtgttcagtgcaaagctgaatctcttgccccgtgtctcttaaaaaccatggtctctcatgt

SEQ ID NO: 7989 - DNA, 201 bp, Homo sapiens
gcttccgagattcaagcaattctcctgcctcagcctcctgagtagctgggattgcaggcatgcaccaccaagcctggctgattttgtatttttagtagagrtggggtttctccatgttggtcaggctggtctcgaactcctaacctcaggtgatctgcctgccttggcctcccaaagtgctgcaattacaggcgtgagcca

SEQ ID NO: 7990 - DNA, 201 bp, Homo sapiens
aatctggggagagggatcctttctcccaggagtttgttggggtcaagaaacgtaactttaaatgctcctattgcaagattgggtttgtcgatacacaggcrattctttgggtgttccagtcctatggggtgagaaagaatgaatatatatattttttatctgtctctgtatgtgcctgtgtcaattcctagtaaatattta

SEQ ID NO: 7991 - DNA, 201 bp, Homo sapiens
aggctccggcacatggagaatacccaataaatggtagttatcattagggccatttttatgtgaggagggcatattatttgtcatttgtaaagaacacttgrggacgcaaaccaggcagaatgggtaaacaaattgggtaaaatcctatattttttcaaaaagccatttgaatgtgcacctgaggcctgaaaatgtggatta

SEQ ID NO: 7992 - DNA, 201 bp, Homo sapiens
tactccctgcttttgggctttgtgttgtttccaggtttttgttgttacaaacatcactgtgaatgacaggtttgtagctattactagcatacacttaacartcattcctgttgatcagaaaaatccccagaaattccacatccctttgttcctccagagttgaatggcttgcagcagagacagctgcctggcactggcccc

SEQ ID NO: 7993 - DNA, 201 bp, Homo sapiens
gctccttcattcctgccagctcacccttacctctccagtagtaaagggcttgtgcctttgcctgctctgggtgagagtcccagagcacagtagcccatcamactgtgttgcagctgtcactattccctggatacagaaagaaacaaaggccaaagttagggtgctaatggtttgggattcaccatggggagaaggtgaatc

SEQ ID NO: 7994 - DNA, 201 bp, Homo sapiens
taaatgcattatcatttgtgcagcacggggtagattgtgatctgagctggaaagtgagccatgccaggcaggggttggagcctgttggagctgattatcgygggtgttcagtgcaaagctgaatctcttgccccgtgtctcttaaaaaccatggtctctcatgttgttagcataaaggcacttgattgacaaaaggagaga

SEQ ID NO: 7995 - DNA, 201 bp, Homo sapiens
ttgttttccaacttgctctttcccttctgactctattgtggctattcttccgtgtcagtacgttctaactcctgaattctttttaaaggctgatgtggtastatggctatattgcatcataggaggggacctcagaaagtttgtggaaagacataattaaaagataaaaatataaactttactcctcaacataagcttcat

SEQ ID NO: 7996 - DNA, 201 bp, Homo sapiens
ggttctgaagaaaagatgccaatagaaaatatacccacattctaaaaggacctctcagttccttccctgcagagtgtgtgttctaagattgtgcagatatraatgtaaataccagtacactatacatctacatctctagcgatgaacaaacatgggattctgctatacatattgttttccaacttgctctttcccttctga

SEQ ID NO: 7997 - DNA, 201 bp, Homo sapiens
agttttttttcctttccttactaagtcgagaactttcaccttttcacttaaaggaagcactttacagcttctctttggcatacctgaattaccagcatcaytcttcttgtgctttggggccattattaaataaaattggttactgaaacacaaacattgcaagacagaggcagttgatctgataactgagaccgttcttaa

SEQ ID NO: 7998 - DNA, 201 bp, Homo sapiens
atctggggagagggatcctttctcccaggagtttgttggggtcaagaaacgtaactttaaatgctcctattgcaagattgggtttgtcgatacacaggcawttctttgggtgttccagtcctatggggtgagaaagaatgaatatatatattttttatctgtctctgtatgtgcctgtgtcaattcctagtaaatatttat

SEQ ID NO: 7999 - DNA, 201 bp, Homo sapiens
ctgttcagcctacctgagtggcctcttctcctttgtggaagggagcaaatgagtcttttgattaaagttgttataaatattagatgcttgtaaaggctccrgcacatggagaatacccaataaatggtagttatcattagggccatttttatgtgaggagggcatattatttgtcatttgtaaagaacacttggggacgca

SEQ ID NO: 8000 - DNA, 201 bp, Homo sapiens
gttggatttttccatggctatgtttttgtggccagataaaagaattgagtgaagatgaaataaagtttaggcagacccaacccttgtagaaatcccagacmctcagtttactccacgtgacctctggtggactgttcagcctacctgagtggcctcttctcctttgtggaagggagcaaatgagtcttttgattaaagttg

SEQ ID NO: 8001 - DNA, 201 bp, Homo sapiens
caggtgctgggaagcgggtgtgagatggttggatttttccatggctatgtttttgtggccagataaaagaattgagtgaagatgaaataaagtttaggcasacccaacccttgtagaaatcccagacactcagtttactccacgtgacctctggtggactgttcagcctacctgagtggcctcttctcctttgtggaaggg

SEQ ID NO: 8002 - DNA, 201 bp, Homo sapiens
ccgaagtaattaatgcactttctactagtgagagaaggtgtaattcgcaggaatgtgtgtcaagacccaccctgctaaatttataccctgtaatttgcaaygtttgttggcactgaattggcaggttggtgagtctagcctacctgctttgcaattatatctactggccggtattgtaggattgagtaactggagagactc

SEQ ID NO: 8003 - DNA, 201 bp, Homo sapiens
ccaagagggaggaaatggctgctccattgccaccatcctgctcaaggttcagccctactggtcccatatttgtgccttgacctgggttactctgtccccarccccacacagtgggcctcagtgactctctcagtctgtgggggagaaagttaacaattctgattccaagagctttggaaaaatcccacctcctccagcagt

SEQ ID NO: 8004 - DNA, 201 bp, Homo sapiens
gtggattcagaccttacttctggctgcatctgccttgctccagatgtcgactattccccttcctgcaggggaagtcgcacttttagcccaagagggaggamatggctgctccattgccaccatcctgctcaaggttcagccctactggtcccatatttgtgccttgacctgggttactctgtccccaaccccacacagtgg

SEQ ID NO: 8005 - DNA, 201 bp, Homo sapiens
ttccaacctctgcccattacccagttcgaaagtcactttcacattttctggtatctttacagcagtgccccactcctggtacccattttctgtattagttyattttcacactcctataaagaactgccttagactgggtaatttctgaagaaaaaagggctaatttactctcaattctgcaagcttaacaagaagcatgac

SEQ ID NO: 8006 - DNA, 201 bp, Homo sapiens
ctgcttagaaatttcttctgtgagataccctaaatcatctctgtcaagttcaaagttccacagatctctagggcaggggcagaatgccaccagtctctttrctaaagcatagcaagagtgacctttactcccgttcccgataagttcctcatctccatctgagaccacctcagcccggacttcattgtccatgtcacgatc

SEQ ID NO: 8007 - DNA, 201 bp, Homo sapiens
ttgatagggtcttacagcaaaaatgagccctgtgacatcctgtctcttggaagggttggaatgcttttgtccctgttctaaagagtcactctccagggacrgagcatcatgttagttcagcttagattacatgatctccctttggctagaaagggtagaacctctgcctatggtcctactacattatagccactgagaaag

SEQ ID NO: 8008 - DNA, 201 bp, Homo sapiens
gttgatagggtcttacagcaaaaatgagccctgtgacatcctgtctcttggaagggttggaatgcttttgtccctgttctaaagagtcactctccagggayagagcatcatgttagttcagcttagattacatgatctccctttggctagaaagggtagaacctctgcctatggtcctactacattatagccactgagaaa

SEQ ID NO: 8009 - DNA, 201 bp, Homo sapiens
cgggtgttcagtgcaaagctgaatctcttgccccgtgtctcttaaaaaccatggtctctcatgttgttagcataaaggcacttgattgacaaaaggagagrcagggagagtctctggagatgtgctggcactctggttcattatgtttctttattctgctggcatttcctatgtcagtcttgcttcgtgtggagccattat

SEQ ID NO: 8010 - DNA, 201 bp, Homo sapiens
catgtttattttttgtgccatgcttgttcgttttctttattcatttttttcttggtttgtttgcagttctcttaaggagttccaattagggacatagaggrttgttttaaaacacacatttagaaaaaaaaatctcgatgggcatttctggctataaaactctataaaagaccaagtacttcttctttctggcattgaagg

SEQ ID NO: 8011 - DNA, 201 bp, Homo sapiens
accagcatcattcttcttgtgctttggggccattattaaataaaattggttactgaaacacaaacattgcaagacagaggcagttgatctgataactgagrccgttcttaagtgactaataggcagatagtgtagacagtgtgtgtatgctggacaaagggaagattcatatcctgggcaggacagagcaggacgacacga

SEQ ID NO: 8012 - DNA, 201 bp, Homo sapiens
tggtctcgaactcctaacctcaggtgatctgcctgccttggcctcccaaagtgctgcaattacaggcgtgagccaccgcacccagcccctcttagtaattsttacattccatttcttactttcttctgtggcatttatgacttccaacttttataattataaaataattttaattttatagctctttaggtgcacacttct

SEQ ID NO: 8013 - DNA, 201 bp, Homo sapiens
cggcctgggtggaaattattccatgcagcattccatgatgcttcccctggaataaatttccccctccttagaaattcttttttttttgaaatggagtttcrctcttgttgcctaggctggagtgtgatggtgcgatcttggctcactgcaacctctgcttccgagattcaagcaattctcctgcctcagcctcctgagtag

SEQ ID NO: 8014 - DNA, 201 bp, Homo sapiens
attacaactgtggagattatagcagtctcctacagctttggttatgaaaataatatatatcgtctttttattccctttaattgaccattctcttaccttcytttgtctccacatggagacacggctagatatctccctcctttgtatttttttctctcttctccaacactctgagatcaaggcccaagtaagtacacacct

SEQ ID NO: 8015 - DNA, 201 bp, Homo sapiens
ctgaggcttgcctgagtgtggaaggaccggcggcttgggaaggcatttcttcagcagtcctcctcagccagcactctggaaaaggaaaacacaaaactgtkagaacagaaatggtcttatggtccattttatgagctgcatcagccctaataatcagctctgggggagactcgtgttagtttttaaaactagaagtcactt

SEQ ID NO: 8016 - DNA, 201 bp, Homo sapiens
ttctgagaattaaatggaacaggtttagtgaaagcgctgagctgtgtgccaggcacatacgaagtaggagttactgaatggatgtgtgatggtggttcacyctccccgaatcccagactgggcaccttgggctcgctgcctctccatagctgctgcagttcctagtgtttaagagtgtgggttttagagtcatacagacct

SEQ ID NO: 8017 - DNA, 201 bp, Homo sapiens
gggatgagatgcctcccagagttgttctgagaattaaatggaacaggtttagtgaaagcgctgagctgtgtgccaggcacatacgaagtaggagttactgratggatgtgtgatggtggttcaccctccccgaatcccagactgggcaccttgggctcgctgcctctccatagctgctgcagttcctagtgtttaagagtg

SEQ ID NO: 8018 - DNA, 201 bp, Homo sapiens
catgtgttattacgttatcatcacattttgttagggaaaaccgtacacatttccaattaagacaaagaatgtgcaatttcctgaagtcaggattgaggtcrtaactttgagtgctcaagaattccaagtttaattaagccaccaaatgctgttgataaagagaaaatgccctatcaatatcagaggtgatgagagggtgat

SEQ ID NO: 8019 - DNA, 201 bp, Homo sapiens
cttgcttcactggagaagggcccctttggcacacctaccacattgcttcccactttccagtagaaaagaattagagatggactgcctaaataataaggtgscatttatgccatagaagctcacaggcatcctacaaatggaatatgtaagaacagctatttcccgtacaacagtgcccattttatcccttagctttctggc

SEQ ID NO: 8020 - DNA, 201 bp, Homo sapiens
ccccattgataccctcagctaacatcatctcccggtgctttttctaactctggcttatcttaccagccacccagggtcacactaggtcttcatcaggcccstcctggactggggagggtccactggaacctcacttggctttaggacagtgagtgtcatcgaactggacaaggtcagaggaagtcagaaatgttattcctg

SEQ ID NO: 8021 - DNA, 201 bp, Homo sapiens
caactcttttggttagtatagttttaaaattattagctttattttttgtcgtttatgttgttgaaaacaataggcttttaggttacttgagacccagtgarcagctctgttctaatattaattaacatttacaaaacacaaagggccccttttgctggggctcctcgtctaggggggttgctttcgcatttcttctaaacc

SEQ ID NO: 8022 - DNA, 201 bp, Homo sapiens
gcagaatgtgtgtgttcatggggcctttatgatctgtgtagagaacagacttacaatcagttaactgggtgcagcctagaaccgaatgtatgttataaaasaggtgcaggaaagtgctgcgaccctgaggatgcagaggttccttcagttggttggactggagtagcctcatggtagtggtggcattactgatccttgaag

SEQ ID NO: 8023 - DNA, 201 bp, Homo sapiens
gtcgtgcacccccatgccccatgactgtatttttagtagagacggggtttcaccatgttggccaggctggtctccaactcccgacctcaagtgatccaccygcttggcctcccacagtgctggaattataggcatgagccactacatctggcccatgtttcatttaatacagttcttcaaagatatgcttcaggatcttgg

SEQ ID NO: 8024 - DNA, 201 bp, Homo sapiens
ctttttttttttttttgagtctcgctctgttctccaggctggagtgcattggcgtgatcttggctcactgcaacctccacctcccagattcaagcaattckagtgcctcagcctcccgagtagctgggattacagtcgtgcacccccatgccccatgactgtatttttagtagagacggggtttcaccatgttggccaggc

SEQ ID NO: 8025 - DNA, 201 bp, Homo sapiens
ttgtgcagatataaatgtaaataccagtacactatacatctacatctctagcgatgaacaaacatgggattctgctatacatattgttttccaacttgctytttcccttctgactctattgtggctattcttccgtgtcagtacgttctaactcctgaattctttttaaaggctgatgtggtagtatggctatattgcatc

SEQ ID NO: 8026 - DNA, 201 bp, Homo sapiens
gaggaagaaagccaggttcagacatctcccttggctgcaggcagaaatcagcattcagttgtctaatctgtagactcatcaaacataaattattctggatkgcttttctctctgtatagcttgctataaactttatgatttatttttattttattttttgccaaagacaaataaaaaatgtttaaacaaaagaagggggga

SEQ ID NO: 8027 - DNA, 201 bp, Homo sapiens
ataagtgttgtccgctaggatcaggaagacattggtggagagctaaggtaaggcaggctttgcaggcacacccccttttttttcctcaaaaagatactttrtaaaaaagtcttcagttggttctttcttttgaaacctttcctcctgtggtttttggttgtgtgtcctgttgctgaactgtgggcctgtgattcttgggcc

SEQ ID NO: 8028 - DNA, 201 bp, Homo sapiens
aatatattctatagtagtctccccttatcttcggggggtacatttcaagacccccagtggatgcctgaaaccgaatatagtaccaaattgctgtcaactgraacctatttctgtccatgtgttccacctacaaatttaatgcctttccatcctaactaagcacttatcacacactctggctataacttttgcagtttgagg

SEQ ID NO: 8029 - DNA, 201 bp, Homo sapiens
aggcatcacgtctaagggaagtctgagtggcggcctgtcaccagcatcatgactgtttgacttcatagtctaactgcatgactgtggggaagaaggcaggyacggtcatagaagtttgctattttcttcgaaagtgatttcttactattgattttaatcagtttagattgttgttcttctatattctaaagtctctagggg

SEQ ID NO: 8030 - DNA, 201 bp, Homo sapiens
ttgttgtctttggggttttgaagatttgaaggaaactggtcagaattattgacaaagtgctcaggcctcaaaaaatactatcagaataagggactgaagartataacctactttattgtgtttgtgtctggagtatctgagtgttaaaatttgaagcccagggtagctctctgtattgcttgttacattttaggattgctt

SEQ ID NO: 8031 - DNA, 201 bp, Homo sapiens
ttgctctgagacagaccttttaatagtattaaatcaaatgcttccaaaccatagtttagaccccctgctctgggagcagtcatcataggcagggctttgaygaactccctttgcaggatctggttgtctatcctggtcacctggatttacaaaaggctaagaatagcattggagaagacagtcctgtattatttttcactt

SEQ ID NO: 8032 - DNA, 201 bp, Homo sapiens
ttggtgttgggacctcttcaaggcttgagaaaatataaggaggaatttagaatctggggagagggatcctttctcccaggagtttgttggggtcaagaaaygtaactttaaatgctcctattgcaagattgggtttgtcgatacacaggcaattctttgggtgttccagtcctatggggtgagaaagaatgaatatatata

SEQ ID NO: 8033 - DNA, 201 bp, Homo sapiens
ttttaaaactagaagtcactttgcagcctctgcagaccagtgattttagtacagtcctcgtaaattttctttctgaggggaaactggcaggagaatccgayaggctgcaatgtaagcttgtagttcaggtgctgggaagcgggtgtgagatggttggatttttccatggctatgtttttgtggccagataaaagaattgag

SEQ ID NO: 8034 - DNA, 201 bp, Homo sapiens
ttccttaagggtgcagtcaaggggatgagatgcctcccagagttgttctgagaattaaatggaacaggtttagtgaaagcgctgagctgtgtgccaggcayatacgaagtaggagttactgaatggatgtgtgatggtggttcaccctccccgaatcccagactgggcaccttgggctcgctgcctctccatagctgctgc

SEQ ID NO: 8035 - DNA, 201 bp, Homo sapiens
aattcgacatgagatttggacagagacacaaatccaaaccatatctaagatgttgagcaacttaaacaaaaactgcgcccttgcccactatagatgcccastcgttcctcatcccacaggaaatatgggctcagagacctcaatggtgggtagcatcattgagtgttttcctctagccccagcagtttgattctgtttaat

SEQ ID NO: 8036 - DNA, 201 bp, Homo sapiens
ctacattatagccactgagaaagtgataattcaaataaagtagaaggagaatggatgttgtattagtccgttttcacattgctataaagaaccacctgagmctgggtaatttatgaagaaaagaggtttagttgactcacagttccataggtttaacagaaagcatggctgggaggcctcaggaagcttacaatcatggtg

SEQ ID NO: 8037 - DNA, 201 bp, Homo sapiens
tcaaagtcttatctgagacaaagtaaatcccttctgcctatgagcctgtaaaatcaaaatcaagttaattacttccaagatacaatggggatacaggtatwgggtgaatgcttttgtttcaagtgggggaaattggctgaaaaaatggggctgtagtccccacacaagtctgaaacccagcagggcagtcattaaatctta

SEQ ID NO: 8038 - DNA, 201 bp, Homo sapiens
gactccatgtctcacatccagggcacaccgatgcaaaaggtgggctctcaaggccttgggcatctctgcttctgtgagtctgcagggtacagcccccatgrcagctttcacaggctggcattgagtgcctgtggcttttccaggtgcatagtgcaagcaatcagtggatctacattctggggtctgaataatggtgacccc

SEQ ID NO: 8039 - DNA, 201 bp, Homo sapiens
gctcacaaaaccatttttccctcctggcctgtgatgggaggggctgctgtgaagttctctgaaatgccctggagacatttctcctgttgtcttggctattracattcagctccattttacttatgcaaacttctgcagcagggttgaatttctttccagaaaatagggttttcttttctaccacatggccgggctgcacat

SEQ ID NO: 8040 - DNA, 201 bp, Homo sapiens
ctgccagctcacccttacctctccagtagtaaagggcttgtgcctttgcctgctctgggtgagagtcccagagcacagtagcccatcacactgtgttgcarctgtcactattccctggatacagaaagaaacaaaggccaaagttagggtgctaatggtttgggattcaccatggggagaaggtgaatcaacctctctgtg

SEQ ID NO: 8041 - DNA, 201 bp, Homo sapiens
tgccagctcacccttacctctccagtagtaaagggcttgtgcctttgcctgctctgggtgagagtcccagagcacagtagcccatcacactgtgttgcagstgtcactattccctggatacagaaagaaacaaaggccaaagttagggtgctaatggtttgggattcaccatggggagaaggtgaatcaacctctctgtgg

SEQ ID NO: 8042 - DNA, 201 bp, Homo sapiens
gcagtcattatttatttatactttaatcttcatggattactctgagttgctcatagctttccagaaagctccgagtaagtggaagtcgtacatgcacccgragtaattaatgcactttctactagtgagagaaggtgtaattcgcaggaatgtgtgtcaagacccaccctgctaaatttataccctgtaatttgcaatgtt

SEQ ID NO: 8043 - DNA, 201 bp, Homo sapiens
agaaattcaatccatgcagaaaattctatgagtcacttcatttcctgcaacattttttttccattattcatattatggaaaagagcacatcaaaaaggcargtctgcaaataacacagttttcaaaaagattgttttatttttcttacgaagaagttttccagaaatctgtaaccagtatcaggaattctccagctttgta

SEQ ID NO: 8044 - DNA, 201 bp, Homo sapiens
ctccctcacgctcttccattcagctcctttggctaacccaaagtgcactaattctgaagacccaaagggaggggtgtatcacctctttgtcttttctggasctccacgtgtgtcactggcctcctggaaatctcctgttggatcaaaggccccctgtggtgctgtcagccatggcagggtcctccccaagggatgatggtg

SEQ ID NO: 8045 - DNA, 201 bp, Homo sapiens; identical to SEQ ID NO: 857

SEQ ID NO: 8046 - DNA, 201 bp, Homo sapiens; identical to SEQ ID NO: 851

SEQ ID NO: 8047 - DNA, 201 bp, Homo sapiens; identical to SEQ ID NO: 860

SEQ ID NO: 8048 - DNA, 201 bp, Homo sapiens; identical to SEQ ID NO: 859

SEQ ID NO: 8049 - DNA, 201 bp, Homo sapiens; identical to SEQ ID NO: 858

SEQ ID NO: 8050 - DNA, 201 bp, Homo sapiens; identical to SEQ ID NO: 856

SEQ ID NO: 8051 - DNA, 201 bp, Homo sapiens; identical to SEQ ID NO: 855

SEQ ID NO: 8052 - DNA, 201 bp, Homo sapiens; identical to SEQ ID NO: 852

SEQ ID NO: 8053 - DNA, 201 bp, Homo sapiens
aaggtggggtggccggacctggttgcctaaccctcatcctgggagctctggaatcccgtgttaccaacccctgtgcttacttcctatgagacaccttgccytctgtctgtgaggttcctgatttctcttcttgaaacgatattatttcctgctagtctaaatgttctgcctgatttcaaaaaaaaaaaaaaaagatttgag

SEQ ID NO: 8054 - DNA, 201 bp, Homo sapiens
agtgttgagaaataatttggggcatagaatactatttatctccaaagtaattcgaaatacaggcttttgctcatttgtctgttctctgggttttttcgggktttttttgttgttgttttgttttgttttttggtttggttgattttggtttatttatttattttgaggaccaacactaaagggaatggaaaatctttccag

SEQ ID NO: 8055 - DNA, 201 bp, Homo sapiens
accttgccttctgtctgtgaggttcctgatttctcttcttgaaacgatattatttcctgctagtctaaatgttctgcctgatttcaaaaaaaaaaaaaaaagatttgagatatttacagatttcttttttttgtagtcacccagaatctatagaacccttttcttatttcttagaattttagcatggtcttatcttagaat

SEQ ID NO: 8056 - DNA, 201 bp, Homo sapiens
gtcttaccaatggtggtttgttccctcctgaacaattttctgcttcacactggcaagcttcctaaattcatctccagaactgcacgcctggggagttgagytgcaatcagagaaagaaggcagcagagagggatgatgtttcatcggcctggtgcttcacttaaagatgggtctgggggcattgctcttgtgcactgaccc

SEQ ID NO: 8057 - DNA, 201 bp, Homo sapiens
cctctacctctgttggttgtaaatctgtcttaccaatggtggtttgttccctcctgaacaattttctgcttcacactggcaagcttcctaaattcatctcyagaactgcacgcctggggagttgagttgcaatcagagaaagaaggcagcagagagggatgatgtttcatcggcctggtgcttcacttaaagatgggtctg

SEQ ID NO: 8058 - DNA, 201 bp, Homo sapiens
agaatactatttatctccaaagtaattcgaaatacaggcttttgctcatttgtctgttctctgggttttttcggggtttttttgttgttgttttgttttgytttttggtttggttgattttggtttatttatttattttgaggaccaacactaaagggaatggaaaatctttccaggagagtcataagggtaccctaaaga

SEQ ID NO: 8059 - DNA, 201 bp, Homo sapiens
agacagtgttgagaaataatttggggcatagaatactatttatctccaaagtaattcgaaatacaggcttttgctcatttgtctgttctctgggttttttmggggtttttttgttgttgttttgttttgttttttggtttggttgattttggtttatttatttattttgaggaccaacactaaagggaatggaaaatcttt

SEQ ID NO: 8060 - DNA, 201 bp, Homo sapiens
gctgaagggaaacaaacaaaaaggaaccagaggccacttgtatatataggtctcttcagcatttattggtggcagaagaggaagatttctgaagagtgcasctgcctgaaccgagccctgccgaacagctgagaattgcactgcaaccatgaggtaaatattttcccttcgtattcggtagtgctgttgagtcatcttgtc

SEQ ID NO: 8061 - DNA, 201 bp, Homo sapiens; identical to SEQ ID NO: 854

SEQ ID NO: 8062 - DNA, 201 bp, Homo sapiens; identical to SEQ ID NO: 850

SEQ ID NO: 8063 - DNA, 201 bp, Homo sapiens
gcaggagtttataggaaggacccgccttccattcaaagctccaaataggtcttagcaaagagccaggttgtctaagtcccttgatgtaactaaccccaggygcgggagccccggagagtgcttggcttggtatcaggcatcctaatggcagatgcattcccgttgaaaagctcatgtccaaacagatctgtttttattctt

SEQ ID NO: 8064 - DNA, 201 bp, Homo sapiens
cctgtgatctagaagccagcttgactgtcctgaagctgtactagttcaacccagccttctttcagaccacggtcaccacccagatcccgctgaaggccttwaccaacccatgccacaccagcttcaccctgtgcaagcacatggtcatccaagcgcatcaagaaaagcagctgatccaacagattttgtacctgggagatc

SEQ ID NO: 8065 - DNA, 201 bp, Homo sapiens
caagttgctcaacaatatccacaggtataattctgagaacctggcctccctggggagctatgtggagatacaggccaaggagaatgcctgtgatctagaarccagcttgactgtcctgaagctgtactagttcaacccagccttctttcagaccacggtcaccacccagatcccgctgaaggcctttaccaacccatgcca

SEQ ID NO: 8066 - DNA, 201 bp, Homo sapiens
ctggaaatctccccaggtattcctggaacccgaatcaaggtagcccaaaagtgctcatcaggagagtatgtgtctttagaccaggcaaaaaagtcttgaaygatggagttgttgaaaatatatttaacaaatgcttgacttaaaacaaaataagcactgccaacaaatatctgaatgttatgggggggtgcttccttggag

SEQ ID NO: 8067 - DNA, 201 bp, Homo sapiens
ccatacaacagaattataatgattccatagaaagtattccattgtaaagaaacttatctagaatgataacttatgaattgaggacttaggcttaatgttctggtgtgtgacacttggagctattggtcagttcttatttttaatcagtaaatgcattttaaagaaacagttgaactaaaaaggaggccattcatgatactg

SEQ ID NO: 8068 - DNA, 201 bp, Homo sapiens
catacaacagaattataatgattccatagaaagtattccattgtaaagaaacttatctagaatgataacttatgaattgaggacttaggcttaatgttctggtgtgtgacacttggagctattggtcagttcttatttttaatcagtaaatgcattttaaagaaacagttgaactaaaaaggaggccattcatgatactgt

SEQ ID NO: 8069 - DNA, 201 bp, Homo sapiens
atacaacagaattataatgattccatagaaagtattccattgtaaagaaacttatctagaatgataacttatgaattgaggacttaggcttaatgttctggtgtgtgacacttggagctattggtcagttcttatttttaatcagtaaatgcattttaaagaaacagttgaactaaaaaggaggccattcatgatactgtt

SEQ ID NO: 8070 - DNA, 201 bp, Homo sapiens
caacagaattataatgattccatagaaagtattccattgtaaagaaacttatctagaatgataacttatgaattgaggacttaggcttaatgttctggtgtgtgacacttggagctattggtcagttcttatttttaatcagtaaatgcattttaaagaaacagttgaactaaaaaggaggccattcatgatactgttttg

SEQ ID NO: 8071 - DNA, 201 bp, Homo sapiens
taataacatcaaaggctagatcactttcccttgtgtatggaattttggacaccttttaaaatatgggaggactgagtttaaacagtattgggcatagtatrgtattcaattccacactgactccatttatcaggcaccctcttatttccatcctgattttactatcatgatgtggtagtgagatttctatccataaataac

SEQ ID NO: 8072 - DNA, 201 bp, Homo sapiens
ccacactgactccatttatcaggcaccctcttatttccatcctgattttactatcatgatgtggtagtgagatttctatccataaataacttttctgaggrcaaagtgatccagtctctctgctgttcttcaagcttttctgccaagcatttaatcaagatagggtccaccttagaatcaaatttattagcaaaccaatgt

SEQ ID NO: 8073 - DNA, 201 bp, Homo sapiens
ggtggtattttggggtattctgtgttaactatacctaattttgagagatgttggtttccaaacagaagggaaggtaatgtaaactcctaaaatataaatakagtgtgtcttatattgtctgcatttctgcttagcatatttgaggagggattgctctggtttgggcagaggtctagagaactggatgtcatcaacagggcc

SEQ ID NO: 8074 - DNA, 201 bp, Homo sapiens
aaattaatttagaaagctgtcatatttcacacaaccttttgaagaaagtttagtgactcttagcttgatagttccatacaacagaattataatgattccayagaaagtattccattgtaaagaaacttatctagaatgataacttatgaattgaggacttaggcttaatgttctggtgtgtgacacttggagctattggtc

SEQ ID NO: 8075 - DNA, 201 bp, Homo sapiens
gctagatcactttcccttgtgtatggaattttggacaccttttaaaatatgggaggactgagtttaaacagtattgggcatagtatggtattcaattccayactgactccatttatcaggcaccctcttatttccatcctgattttactatcatgatgtggtagtgagatttctatccataaataacttttctgagggcaa

SEQ ID NO: 8076 - DNA, 201 bp, Homo sapiens
caggtacggccccgaccccgcccaggcggtgccggcgctcacagtgtcctcggtggcgcatgaagctgtctcgccacatgaacttcttggcgcagactccrcactcgtagggcttgagacctgtgtgcgtcttcatgtgctcagtcagatggtgcttcatcttgaactttttgttgcacacggggcagtcaaacggccgca

SEQ ID NO: 8077 - DNA, 201 bp, Homo sapiens
tcgcttcacgtatacccagtgtttctgtggcatgatgctagggggtgtgtaggtgggtctccggagcccagccccaggaaccactgcccccctcccatccycaccatcatcgcacagctcatctgcctccagcagcagctttccagatgtggcccctccactgccaacgacaggggctgggaatacagggccacctcctcg

SEQ ID NO: 8078 - DNA, 201 bp, Homo sapiens
ctaccccctagttcttcatcttcatcatcctcacaggtcaacaccagatcttcctcctcctcttcctcctccagatctgggtcttggggaaccaggggtgytggcgctgggcaattaccacctcgcttcacgtatacccagtgtttctgtggcatgatgctagggggtgtgtaggtgggtctccggagcccagccccagga

SEQ ID NO: 8079 - DNA, 201 bp, Homo sapiens
tctccggagcccagccccaggaaccactgcccccctcccatccccaccatcatcgcacagctcatctgcctccagcagcagctttccagatgtggcccctscactgccaacgacaggggctgggaatacagggccacctcctcgacgctccccactgcccactgcagaagctgcaaatgcctcttgggaggaagatgagaa

SEQ ID NO: 8080 - DNA, 201 bp, Homo sapiens
caggggccacagtgcccccactcccggatggcaccccagcaccagggacagtgacagaggtggctgcagcagtagtgatggtggtggtagctgaggcccgsccttctcggagtagttcagtgcacttgtccacaatgtgccacatttggagcacagaccccactgtaaggaagttgacaatgtcagcagcagccatgctga

SEQ ID NO: 8081 - DNA, 201 bp, Homo sapiens
ctccaccttgtggactctgggtggggaccagacacgtctgctggacgggggcgtggccgcactcgcttcgtcgccgctgcccccgcccactccgggagacyctctcttggacggcaaggatggccccgtgggagtcccaggcccaggtacggccccgaccccgcccaggcggtgccggcgctcacagtgtcctcggtggcg

SEQ ID NO: 8082 - DNA, 201 bp, Homo sapiens
ctgccacaggacccccaccctcatatgggccaaagtcattggaggactcacagaagttgacctgctcctcccccttgtctgggggctcactcagggtacgsacatcacttatgctgagggtagcctcaggccctccccccactggaaccctggagctaccccctagttcttcatcttcatcatcctcacaggtcaacacca

SEQ ID NO: 8083 - DNA, 201 bp, Homo sapiens
ctgaaaaccaacgcttgctccatctcccctcaggctatgccccccaagctctctcgccgaccacgccccctttcgccccagcttctctagccccgcccctytccaggcccaccccccccgtgccccgcccactatcgggcctttcgaccccgccccttgtctacctccgcccacaacggaccccgcccccccccgctccgc

SEQ ID NO: 8084 - DNA, 201 bp, Homo sapiens
gggcagggcagctctgctactgaaaaccaacgcttgctccatctcccctcaggctatgccccccaagctctctcgccgaccacgccccctttcgccccagyttctctagccccgcccctttccaggcccaccccccccgtgccccgcccactatcgggcctttcgaccccgccccttgtctacctccgcccacaacggacc

SEQ ID NO: 8085 - DNA, 201 bp, Homo sapiens
aagtaaatgaccaataaatattttaatcactgttaaaaaaaataaaaaccttgtactcctacgacttactccctccttgtctccacccactcctccatgaraaccgagttgggaatttccacgggaagtcgggggtggcggggagagacagggtagaaataaagagcgcatccttgagagggggtaggttctaggacaagg

SEQ ID NO: 8086 - DNA, 201 bp, Homo sapiens
aaccttgtactcctacgacttactccctccttgtctccacccactcctccatgagaaccgagttgggaatttccacgggaagtcgggggtggcggggagaracagggtagaaataaagagcgcatccttgagagggggtaggttctaggacaagggtggggctcaaaggccttgtctccacgacaacacaaacacagactt

SEQ ID NO: 8087 - DNA, 201 bp, Homo sapiens
ctcctacgacttactccctccttgtctccacccactcctccatgagaaccgagttgggaatttccacgggaagtcgggggtggcggggagagacagggtaraaataaagagcgcatccttgagagggggtaggttctaggacaagggtggggctcaaaggccttgtctccacgacaacacaaacacagacttcaggcacag

SEQ ID NO: 8088 - DNA, 201 bp, Homo sapiens
tctgtggagcaggggcttcagtgtacccatcagagggaaaggaagggtttagttctggaaataccttgggggggaggggttgagtagtagaatgggcgggygatggtgaaactgtggttccccttccagaatatatacaagtccacagagataaaggaagacagtaagtgtggtgggagatcacccgggggccacagcgcc

SEQ ID NO: 8089 - DNA, 201 bp, Homo sapiens
ctgctgctgggagattgattctcactggcccggctggaggcatgggagcgcgcagagcccatggtagcaggggccacagtgcccccactcccggatggcascccagcaccagggacagtgacagaggtggctgcagcagtagtgatggtggtggtagctgaggcccggccttctcggagtagttcagtgcacttgtccaca

SEQ ID NO: 8090 - DNA, 201 bp, Homo sapiens; identical to SEQ ID NO: 892

SEQ ID NO: 8091 - DNA, 201 bp, Homo sapiens; identical to SEQ ID NO: 888

SEQ ID NO: 8092 - DNA, 201 bp, Homo sapiens; identical to SEQ ID NO: 885

SEQ ID NO: 8093 - DNA, 201 bp, Homo sapiens; identical to SEQ ID NO: 891

SEQ ID NO: 8094 - DNA, 201 bp, Homo sapiens; identical to SEQ ID NO: 890

SEQ ID NO: 8095 - DNA, 201 bp, Homo sapiens; identical to SEQ ID NO: 889

SEQ ID NO: 8096 - DNA, 201 bp, Homo sapiens; identical to SEQ ID NO: 887

SEQ ID NO: 8097 - DNA, 201 bp, Homo sapiens; identical to SEQ ID NO: 893

SEQ ID NO: 8098 - DNA, 100 bp, Homo sapiens
acgagttcagagccacaagaacctactgaatcaaaggcagccaaggagakgcccaagcaggaggtgaccaaagcagtggtcgtggacctgggcactggct

SEQ ID NO: 8099 - DNA, 201 bp, Homo sapiens; identical to SEQ ID NO: 895

SEQ ID NO: 8100 - DNA, 201 bp, Homo sapiens
tcattagtatttcatcagtgattctcttctatttaaaaaatttttaatcctcatataagaattaagacaattcagtaattgtttagcacccacatgtaagrtacataagatttatgatagggttcttggcacatgttagatacaaactaaagcaaaatgatattttacaaatatgcatatttgtcagaaaaatgttctgta

SEQ ID NO: 8101 - DNA, 201 bp, Homo sapiens
gttctcccaaaatgcttgttctaagcaattttttcattagtatttcatcagtgattctcttctatttaaaaaatttttaatcctcatataagaattaagasaattcagtaattgtttagcacccacatgtaagatacataagatttatgatagggttcttggcacatgttagatacaaactaaagcaaaatgatattttac

SEQ ID NO: 8102 - DNA, 201 bp, Homo sapiens; identical to SEQ ID NO: 896

SEQ ID NO: 8103 - DNA, 201 bp, Homo sapiens; identical to SEQ ID NO: 897

SEQ ID NO: 8104 - DNA, 201 bp, Homo sapiens; identical to SEQ ID NO: 901

SEQ ID NO: 8105 - DNA, 201 bp, Homo sapiens; identical to SEQ ID NO: 902

SEQ ID NO: 8106 - DNA, 201 bp, Homo sapiens; identical to SEQ ID NO: 894

SEQ ID NO: 8107 - DNA, 201 bp, Homo sapiens
attcagtaattgtttagcacccacatgtaagatacataagatttatgatagggttcttggcacatgttagatacaaactaaagcaaaatgatattttacawatatgcatatttgtcagaaaaatgttctgtaaacatatacatcaatttaattttctttctgttaaaatgtgttttctgaatttttgtccatgttttccag

SEQ ID NO: 8108 - DNA, 201 bp, Homo sapiens; identical to SEQ ID NO: 898

SEQ ID NO: 8109 - DNA, 201 bp, Homo sapiens; identical to SEQ ID NO: 899

SEQ ID NO: 8110 - DNA, 100 bp, Homo sapiens
tcagaagatgatatggggaccgactttattaagtcaacaactcacctacrgaaagaaattacctctctgactggcactacaaactccataacaagagact

SEQ ID NO: 8111 - DNA, 201 bp, Homo sapiens; identical to SEQ ID NO: 915

SEQ ID NO: 8112 - DNA, 201 bp, Homo sapiens; identical to SEQ ID NO: 914

SEQ ID NO: 8113 - DNA, 201 bp, Homo sapiens; identical to SEQ ID NO: 913

SEQ ID NO: 8114 - DNA, 201 bp, Homo sapiens
ctgagatctccagggttgctgggagccggggcagcaaccaggggtgcggcttgctctccagggagctgcggcagagcctggggccacagctgcactcagcyggtgcacccacggacagagggtcagactcggctcagcactgggctcaagccctggatgagaacaagaaccaagcttcttagcctcaggctccatctggga

SEQ ID NO: 8115 - DNA, 201 bp, Homo sapiens; identical to SEQ ID NO: 916

SEQ ID NO: 8116 - DNA, 201 bp, Homo sapiens; identical to SEQ ID NO: 912

SEQ ID NO: 8117 - DNA, 201 bp, Homo sapiens
tcgtctttggtgaggcctgtctctgtgccctacaactgcggtgaggcgtggagcgtccccagggagaaccggagcgggaggatggcccgcgaatgtccccragggggatcctgtgctgcttaggaccacgccgtcccctctccacggccccgaggggtgccagcaacccctttcagcagcagggttaggaactggggccct

SEQ ID NO: 8118 - DNA, 201 bp, Homo sapiens
gatcctgtgctgcttaggaccacgccgtcccctctccacggccccgaggggtgccagcaacccctttcagcagcagggttaggaactggggcccttgcaargccacaggtcaggcggttctggccagaagtccgcagtcctagttcttccctgtcctgtcccacaggccactggttgtcagtagaggtttttgcccctcag

SEQ ID NO: 8119 - DNA, 201 bp, Homo sapiens
agatggcctcagagctcccctgcggggctccctggagctatggagaccccatttatccagagtcaggtcggtgcctgagcttgggcagccccaggtggaargagcccatggtgggaggagcctgtagtgggaggagcctgtagtgggaggagcctatgatgggaggggccgtggtggggggagcccgcggtgggaggagcc

SEQ ID NO: 8120 - DNA, 201 bp, Homo sapiens
ccgggccaggggagccaaggggagtgtggtggagggggtagagtgcgggcacctggtggtctcagggaagcgggcctgggaccggggcgtgtaggaagcakcgaggggctcagaaccacctttccgggttcacgaccagcctctctgggtgttccacctgggcagctgctggagactagaaaacatccctcacacgtcaca

SEQ ID NO: 8121 - DNA, 201 bp, Homo sapiens
ggtgggcccgggccaggggagccaaggggagtgtggtggagggggtagagtgcgggcacctggtggtctcagggaagcgggcctgggaccggggcgtgtakgaagcagcgaggggctcagaaccacctttccgggttcacgaccagcctctctgggtgttccacctgggcagctgctggagactagaaaacatccctcaca

SEQ ID NO: 8122 - DNA, 201 bp, Homo sapiens
gctccgcttcagaggcagggcaagtgggcgcggtcctggggcggcggcgggggccgggagaggagggctgggggtctcgagaaggtaaggggcaggcagakcggccggggaggtgggcccgggccaggggagccaaggggagtgtggtggagggggtagagtgcgggcacctggtggtctcagggaagcgggcctgggacc

SEQ ID NO: 8123 - DNA, 201 bp, Homo sapiens
ccgggccgcagcgtcacaaaggccgctggtccccagggcaacccgcggagtgcggagggaggctgggctctgggaagtccgcgcgcggctccgcttcagakgcagggcaagtgggcgcggtcctggggcggcggcgggggccgggagaggagggctgggggtctcgagaaggtaaggggcaggcagagcggccggggaggt

SEQ ID NO: 8124 - DNA, 201 bp, Homo sapiens
ccccgggccgcagcgtcacaaaggccgctggtccccagggcaacccgcggagtgcggagggaggctgggctctgggaagtccgcgcgcggctccgcttcakaggcagggcaagtgggcgcggtcctggggcggcggcgggggccgggagaggagggctgggggtctcgagaaggtaaggggcaggcagagcggccggggag

SEQ ID NO: 8125 - DNA, 201 bp, Homo sapiens
caccagggacaggatcccgggtccacagcgagggcccacagcgtgggaggagggctgctcctccgggcccaggcctgggcgccctcctcccatgctgaccrgccagctggcctcgtctttggtgaggcctgtctctgtgccctacaactgcggtgaggcgtggagcgtccccagggagaaccggagcgggaggatggcccg

SEQ ID NO: 8126 - DNA, 201 bp, Homo sapiens; identical to SEQ ID NO: 930

SEQ ID NO: 8127 - DNA, 201 bp, Homo sapiens
tgctgtggaaatgcccaagatctgagggcaggagaccattctccagtgacagcctcttgggaggttgaggccccagccccttatctcttcaaggctgattyactaataccccagcaccacagaggggagagggactctgtcctcctaaacactaaagtcaagtccaaaagcccccactggaacacagggcctacccggttc

SEQ ID NO: 8128 - DNA, 201 bp, Homo sapiens; identical to SEQ ID NO: 926

SEQ ID NO: 8129 - DNA, 201 bp, Homo sapiens; identical to SEQ ID NO: 935

SEQ ID NO: 8130 - DNA, 201 bp, Homo sapiens; identical to SEQ ID NO: 932

SEQ ID NO: 8131 - DNA, 201 bp, Homo sapiens; identical to SEQ ID NO: 931

SEQ ID NO: 8132 - DNA, 201 bp, Homo sapiens; identical to SEQ ID NO: 918

SEQ ID NO: 8133 - DNA, 201 bp, Homo sapiens; identical to SEQ ID NO: 920

SEQ ID NO: 8134 - DNA, 201 bp, Homo sapiens
aaggggcgtgcaagatggacgccatgaggggctacgcggccaaagtggaggagctgacgaagaaggaagtggggggcgtggagcgcgaacaaaggggcgtscaagatggacgccatgaggggctacgcggccaaagtggaggagctgacgaagaaggaagtggggggcgtggagcgcgaacaaaggggcgtccaagatgga

SEQ ID NO: 8135 - DNA, 201 bp, Homo sapiens
ggaagtggggggcgtggagcgcgaacaaaggggcgtgcaagatggacgccatgaggggctacgcggccaaagtggaggagctgacgaagaaggaagtgggrggcgtggagcgcgaacaaaggggcgtccaagatggacgccatgaggggctacgcggccaaagtggaggagctgacgaagaaggaagtggggggcgtggag

SEQ ID NO: 8136 - DNA, 201 bp, Homo sapiens; identical to SEQ ID NO: 928

SEQ ID NO: 8137 - DNA, 201 bp, Homo sapiens; identical to SEQ ID NO: 921

SEQ ID NO: 8138 - DNA, 201 bp, Homo sapiens; identical to SEQ ID NO: 929

SEQ ID NO: 8139 - DNA, 201 bp, Homo sapiens; identical to SEQ ID NO: 920

SEQ ID NO: 8140 - DNA, 201 bp, Homo sapiens; identical to SEQ ID NO: 922

SEQ ID NO: 8141 - DNA, 201 bp, Homo sapiens
acgcggccaaagtggaggagctgacgaagaaggaagtggggggcgtggagcgcgaacaaaggggcgtccaagatggacgccatgaggggctacgcggccaragtggaggagctgacgaagaaggaagtggggggcgtggagcgcgaacaaaggggcgtccaagatggacgccatgaggggctacgcggccaaagtggagga

SEQ ID NO: 8142 - DNA, 201 bp, Homo sapiens; identical to SEQ ID NO: 919

SEQ ID NO: 8143 - DNA, 201 bp, Homo sapiens; identical to SEQ ID NO: 933

SEQ ID NO: 8144 - DNA, 201 bp, Homo sapiens
aggcttccactcccacccgcccagctcgcgccacatacagtccctcaacgcgctcctgccgcgccgccccctccagacagcagcgttccggatcctagacrctttttgacggctggtcctccccagaaaatgcgccgtgtgagcccaaacatggtggggtttacgctggaccccgagcttgcaatctgtgcttgacaaaac

SEQ ID NO: 8145 - DNA, 201 bp, Homo sapiens
tccccagtattgctctccgaaagtcccctgcaatccctccttggcttccctcttcctcctcctcttgttattacctgtttcctaatggccctgatcctgtytgcttcttctccttccgagattttttgcaggggggaccagaatctccccagttgtgaggagagacgcctccattgaaggaagtagaagagaccatgcctg

SEQ ID NO: 8146 - DNA, 201 bp, Homo sapiens
caatgaaagagaacaaattgtcagaggaaacacgccctccccttcttaccttgcaagtaccaggccgaggaggctgtgaatggggggtttgggacagccgrgctggagaagggatgcagagggagctggtcaccaggccatggctgggagagtccaccctcgtggaggaatcagcaactggggccaaggaagccaaggggg

SEQ ID NO: 8147 - DNA, 201 bp, Homo sapiens
atattcagacagagcagctgaaacagccaatgaaagagaacaaattgtcagaggaaacacgccctccccttcttaccttgcaagtaccaggccgaggaggmtgtgaatggggggtttgggacagccgggctggagaagggatgcagagggagctggtcaccaggccatggctgggagagtccaccctcgtggaggaatcag

SEQ ID NO: 8148 - DNA, 201 bp, Homo sapiens
ggtttcagtaacatccagccctgaccaacactgtcttcaccacctgatttcaataaccattagttctatatgctttttggggcccttcaagtggtgtgggsggggggcaaaccacccccacaccttaagttgccaccttctgctccacccctcacgtcgatttccggtctttctgttgcatttcccccctatttcttagag

SEQ ID NO: 8149 - DNA, 201 bp, Homo sapiens
tgaagggactagaagagtaaaaaccctagaaaggactagagagatgccccatccgcctcatacctgacatataagggtcactgagaggcatcccaccaacmccctacctggcctatagtcatctgtgaggtggcagccaaagttgtagatgagatcgaggtgacgtcgctcctgtaacctgatgcccacatctcggaaggc

SEQ ID NO: 8150 - DNA, 201 bp, Homo sapiens
cccatcccttcacctcacacattttctgaactccttgggtttcagtaacatccagccctgaccaacactgtcttcaccacctgatttcaataaccattagytctatatgctttttggggcccttcaagtggtgtggggggggggcaaaccacccccacaccttaagttgccaccttctgctccacccctcacgtcgatttc

SEQ ID NO: 8151 - DNA, 201 bp, Homo sapiens
tttcccattcttctcatgcactgacctttgcctttccacatagctagaaacagaaacataaatatgtggaggggtacgggaagactgaggctggagggggrcagtccagtctctcccagcagactcagttccccagtattgctctccgaaagtcccctgcaatccctccttggcttccctcttcctcctcctcttgttatt

SEQ ID NO: 8152 - DNA, 201 bp, Homo sapiens
gcttttttttttttttaaagaaacaccaccaaaaggggattagcttagtccatcccttcctcagtcatctgcttcccaccttcctccaaatgttatcccaraacattctggaggcagggagaaggggaggcagctaatcagagtctgagagcacgatgatctcttctggatcgcattgtgtggccacacttgtctgcaggg

SEQ ID NO: 8153 - DNA, 201 bp, Homo sapiens
aggaggcttcgggggtgtctgcagagtgggaagaggtgccttggagccgagctcttctcttttttctctcgccctcctcacttttgtcttgcaacattgcrtatttggagatgacctcatccagccgactcatggccaaactccggttttcccgaaggcgccgggccaacacaggatctgatagtgcagggtcaacgccta

SEQ ID NO: 8154 - DNA, 201 bp, Homo sapiens
cccctgggatgccattccactagggccctgggagacaaagaagtttctctaaggaatcccttgccccagagggtttggttcttgctttccttctcatgctmccccatcagtcaacctggactccctggtggccagtgcaggggaaggacaatgtctctctgaaggctgtaccccatccacacctcaccagaatccaaggag

SEQ ID NO: 8155 - DNA, 201 bp, Homo sapiens
gtccggccggtccgctagatgcgcttcccgccaaatccccctcccccagttcagcccccggccgctccactccctttcagggacaggaaggtaccacagcwttcccctcagactcagcgcccagctctccccaatacctctccctctatatccccgcccccgcctctgatccccgcaccgtccggcccccacctcagaaac

SEQ ID NO: 8156 - DNA, 201 bp, Homo sapiens
ggctttaggttgaagatattttacccaagtcccctccctttcaccccaccctaattttccccattctctcggtgacccgtaactgatcaaaagtccccccrcaccgcgctacgctctcgcgattcctcttagatcccaaccgtgggtccggccggtccgctagatgcgcttcccgccaaatccccctcccccagttcagcc

SEQ ID NO: 8157 - DNA, 201 bp, Homo sapiens
cctatcctgaatgatcaccccaactcctagactctctgaggtgaaagaggttccctcccaacagtccgttctcttttctcctccttgaattatctccatakttcaccctccgatgagtctcctcaaactggggctttaggttgaagatattttacccaagtcccctccctttcaccccaccctaattttccccattctctc

SEQ ID NO: 8158 - DNA, 201 bp, Homo sapiens
atatgctttttggggcccttcaagtggtgtggggggggggcaaaccacccccacaccttaagttgccaccttctgctccacccctcacgtcgatttccggyctttctgttgcatttcccccctatttcttagagttggcaagttgattcttcctcccacactgcaccccaaatcgtcctgacacccccttgcacagacaac

SEQ ID NO: 8159 - DNA, 201 bp, Homo sapiens
gggccctggctgagcagctgcttcatcttcgtcatcatcatccagcacgatgatgctgttagcggtggccataggggatcaaatcccccggagggaggaartggtggggatttcagaattcctgctggaaggggatggggcctcagaatgagcccctccagcatagccccatcccttcacctcacacattttctgaactcc

SEQ ID NO: 8160 - DNA, 201 bp, Homo sapiens
gtgtctgcagagtgggaagaggtgccttggagccgagctcttctcttttttctctcgccctcctcacttttgtcttgcaacattgcatatttggagatgayctcatccagccgactcatggccaaactccggttttcccgaaggcgccgggccaacacaggatctgatagtgcagggtcaacgcctacgtgggaagacata

SEQ ID NO: 8161 - DNA, 201 bp, Homo sapiens
ctcccaacagtccgttctcttttctcctccttgaattatctccatatttcaccctccgatgagtctcctcaaactggggctttaggttgaagatattttamccaagtcccctccctttcaccccaccctaattttccccattctctcggtgacccgtaactgatcaaaagtccccccgcaccgcgctacgctctcgcgatt

SEQ ID NO: 8162 - DNA, 201 bp, Homo sapiens
aaacaggaggatttagaggataaaatgggtgggaaaaaggaagagacaggatgtggcacgtggaatattcagacagagcagctgaaacagccaatgaaagmgaacaaattgtcagaggaaacacgccctccccttcttaccttgcaagtaccaggccgaggaggctgtgaatggggggtttgggacagccgggctggagaa

SEQ ID NO: 8163 - DNA, 201 bp, Homo sapiens
ggccacacttgtctgcagggaagtgagagacaaagagtcaaagagatctggagtacaggagaaaagaaacaggaggatttagaggataaaatgggtgggaraaaggaagagacaggatgtggcacgtggaatattcagacagagcagctgaaacagccaatgaaagagaacaaattgtcagaggaaacacgccctcccctt

SEQ ID NO: 8164 - DNA, 201 bp, Homo sapiens
ccttgagaacagtgcagagctcattgatgtagacatagagcttggctggccggctccgggcccgagacaggaccctagagaggatgttgcagaactccgcygaggccaaaaacagagagtgggcacgttgctgccggttatagaggaatgggaccacctcagggtggtctgctgtctgcatcttacaaagttcaaggaact

SEQ ID NO: 8165 - DNA, 201 bp, Homo sapiens
tttttttttttttaaagaaacaccaccaaaaggggattagcttagtccatcccttcctcagtcatctgcttcccaccttcctccaaatgttatcccagaamattctggaggcagggagaaggggaggcagctaatcagagtctgagagcacgatgatctcttctggatcgcattgtgtggccacacttgtctgcagggaag

SEQ ID NO: 8166 - DNA, 201 bp, Homo sapiens
caccaggccatggctgggagagtccaccctcgtggaggaatcagcaactggggccaaggaagccaagggggaaggtgggctgggcagggtacatatctttytcccattcttctcatgcactgacctttgcctttccacatagctagaaacagaaacataaatatgtggaggggtacgggaagactgaggctggaggggggc

SEQ ID NO: 8167 - DNA, 201 bp, Homo sapiens
accccgtctctactaaaaatacaaaattagcctggtgtggtggcacatgcctgtaatcccagctactcgggagaccgaggcagtagaattgcttgaacccrggaagcagaggttgcggtgagccgagattgtgccattgcactccagcctgggcaataagagggaaaccccgtttcaaaaaaaaaaaaaaaaatcccaaat

SEQ ID NO: 8168 - DNA, 201 bp, Homo sapiens
ccccaactcactgtacacagcaagctccagggtgacctgtccttgcaggtatggcaggtgtatggtggccagataggtgccctcctgaaagggttgaactstaggcagccagaaggtcccatttccggtccatgggccccatggctcatcatcatcccaagcagcaaatgccacggccccttcttgggctgctggcatctg

SEQ ID NO: 8169 - DNA, 201 bp, Homo sapiens
cccatgtcaaagcccctcaaatttccaggaaacttctagcctcccattacccctctaactcccaggaacctctttctatctctacttacttgcccaggcaycctcttatccatcatccctccccctattacggtccccacaatccagtgcccaccctctacccctggagacctctgtcccccaactcactgtacacagcaa

SEQ ID NO: 8170 - DNA, 201 bp, Homo sapiens
tcccaggttcaagtgattctcctgcctcggcctgccaagtagctgagattacaggcatgcaccaccatgctcaactaattttttgtatttttagtagagayggggtttcaccatgttggccaggctggtctcaaactcctgaccttaggtgatccacctgccttgggctcccaaactgctgggactataggtgtgagccac

SEQ ID NO: 8171 - DNA, 201 bp, Homo sapiens
gggcgcctataatcccagccactggggaggctgaggcagagaactacttgaacccgggaagcggaggttgcagtgagccgagatcgcgccactgcactccmgcctgggcgacagagcgagactcgtctcaaaaaagaaaatcaaatacaatgaaaagaaaaatacaacataccaaagtttgtgggacaccacttaggtggg

SEQ ID NO: 8172 - DNA, 201 bp, Homo sapiens
catgccaccacacccgggtaatttttgtacttttagtagagacaaggtttccccatatcggtcaaactggtctcgaactcctgacctcaggtgatctgccsgcctcggcctcccaaagtgctgggattacaggcgtgagccaccgtgcctggctgcatattttttagaagatacaatgatactctgttttataaccataac

SEQ ID NO: 8173 - DNA, 201 bp, Homo sapiens; identical to SEQ ID NO: 7868

SEQ ID NO: 8174 - DNA, 201 bp, Homo sapiens; identical to SEQ ID NO: 7869

SEQ ID NO: 8175 - DNA, 201 bp, Homo sapiens
ccccggaataccccgcctccgctgccaggagggagagctcccagatatccaggtcagactctcctcattcttgaattatctgcacagtccctcccacgtcycagcctagaaaagcttctgactcctgggcctcaaactgcaatgcacctttcagtgcaataggagctatccaatctccagccgcgtccatccgcccactcg

SEQ ID NO: 8176 - DNA, 201 bp, Homo sapiens
cctgagtagctaggactacaggcgcccgccactatgcccaactaatttttttgtatttttagtagagacggggtttcaccgtgttagccaggatggtctcsatctcctgacctcgtgatctgcccatctcggcctcccaaagtgctgggattacaggcttgagccaccgcgcctggccctaaattttttaaaaaagtggta

SEQ ID NO: 8177 - DNA, 201 bp, Homo sapiens
ctctactaaaaatacaaaaaaaaaaaaaaaaaaaattagcggggcgtggttgtgggtgcctgtgatcccatcaacttgggaggctgaggcaggagaattgyttgaacccaggaggcagaggttgcagtgagccaagatcaccccattgcactccagcatgggtgacaagagtgaaactccgtctcaaaaaataaatatgta

SEQ ID NO: 8178 - DNA, 201 bp, Homo sapiens
cataaagcgagaccaccggctgatctggacccttagaatctacccacccttctccacctcccctccccagctacctgttgccatggtgatgagaacaggckcctgctgaggctctggctgtggtcgcaagaggctggagaggctgaggactgggctggatatgctgaccatcagccaagccccatccagggcccgcgggca

SEQ ID NO: 8179 - DNA, 201 bp, Homo sapiens
catcggaatggtggcgcagggccgagagccacctctgcccctcggccttctgagagcggccccctgggccaccccggagttcccactccacctccaggccyccagaagggtagaagtgggacacaaggcagagcaattccgggggtgcctcccctggggcggcccgtgcaagggttgctggcatcagggacactttggggg

SEQ ID NO: 8180 - DNA, 201 bp, Homo sapiens
ggaaatccccgctctggttaggtgaaggtgcctgggggaccggtgtttccccactggccaggcagggacccgggtagatcctctccagttctcaccaggayaccccagccttaccgcgccctcctggactacccagcagccccgagttcgagccctccccaaccccaggccctcccccgccccccaactcctgtgtgtgct

SEQ ID NO: 8181 - DNA, 201 bp, Homo sapiens
cctctagttcttgggcgatgagtcgcggggttcgctcacccaaagccacagcgaggagcagagacagggacttcatggcgctgcgacctcctcagccatgwagcctcctcttcctcctttcactttcactttcctccaaagggcggcatgaggggcggtggaaatccccgctctggttaggtgaaggtgcctgggggaccg

SEQ ID NO: 8182 - DNA, 201 bp, Homo sapiens
ccctctagttcttgggcgatgagtcgcggggttcgctcacccaaagccacagcgaggagcagagacagggacttcatggcgctgcgacctcctcagccatkaagcctcctcttcctcctttcactttcactttcctccaaagggcggcatgaggggcggtggaaatccccgctctggttaggtgaaggtgcctgggggacc

SEQ ID NO: 8183 - DNA, 201 bp, Homo sapiens
ggcgcaggtggggatagagtgctgggttttgaaagagtgacccgcaaagctgagggtgcagagcaagacacagatctgggaagagcagagaaaaaacgctsctgcttctgaacccctcccacctcgcatcacctgacaagtctctcaaggtctggtgtcgggaaaccccacctcttcaaagccccgcccttcgaaacacca

SEQ ID NO: 8184 - DNA, 201 bp, Homo sapiens
ggagagatttcatttctaattttacatcagtacaacagctttcattttcttaaatccctgatcaagcagaaatgcttgaaaagaaagagcacagcaggccrggcgtggtggctcatgcctgtaatcccagcactttggaaggccaaggtgggtggatcaccttaggtcaggagttcaagaccatcctggccaacatggtga

SEQ ID NO: 8185 - DNA, 201 bp, Homo sapiens
tttacattgtctttcccattttctcccaaacatctatcaagcttgtccaacctccagcccagggaccacatgcagccaaggacggcttggaatacagcccracacaaattcataaactttcttaaaacattatgagattttttcacattttttttttttagcttatcagccatcgttagtgttcgtatattttatgcatgg

SEQ ID NO: 8186 - DNA, 201 bp, Homo sapiens
aaagtgactacaagtctgatcccatcacctacctgtttaaaaatcccaaatatgggccagacgcagtggttcatgcctataatcccagcactttgggaggmcgaggcgggtggatcacctgagttcgggagtttgaaaccagcctgaccaacatggtgaaaccccgtctctactaaaaatacaaaattagcctggtgtggt

SEQ ID NO: 8187 - DNA, 201 bp, Homo sapiens
ctagcctcccattacccctctaactcccaggaacctctttctatctctacttacttgcccaggcaccctcttatccatcatccctccccctattacggtcmccacaatccagtgcccaccctctacccctggagacctctgtcccccaactcactgtacacagcaagctccagggtgacctgtccttgcaggtatggcagg

SEQ ID NO: 8188 - DNA, 201 bp, Homo sapiens
tagggaaatcagtccatactgtcctccctaagagaccctcagtttgcctgctggcttcctcagaactaaagaaggttaggtttcttctcctgaaatagggwacccactgtctctccattggtgcgtcacagaaatacccatgtcaaagcccctcaaatttccaggaaacttctagcctcccattacccctctaactcccag

SEQ ID NO: 8189 - DNA, 201 bp, Homo sapiens; identical to SEQ ID NO: 7908

SEQ ID NO: 8190 - DNA, 201 bp, Homo sapiens
cagccatgaagcctcctcttcctcctttcactttcactttcctccaaagggcggcatgaggggcggtggaaatccccgctctggttaggtgaaggtgcctsggggaccggtgtttccccactggccaggcagggacccgggtagatcctctccagttctcaccaggacaccccagccttaccgcgccctcctggactaccc

SEQ ID NO: 8191 - DNA, 201 bp, Homo sapiens
agtgtggtgcgggggcgccccggggataccgcctgaaggcagcctggagggcgcccgcggggtctgagtgtagagaaggaagttgcagctgtagagtcacygccgggaaaggggctggaagggcagcgttcggggaacttcaaatgcacagactaccccgtagtgagactcactttacaaaggggaagctgaggcctgagg

SEQ ID NO: 8192 - DNA, 201 bp, Homo sapiens
cgtgcaagggttgctggcatcagggacactttggggggttctggggaaagaggacgaaatgagcatagggaaatcagtccatactgtcctccctaagagaycctcagtttgcctgctggcttcctcagaactaaagaaggttaggtttcttctcctgaaatagggaacccactgtctctccattggtgcgtcacagaaata

SEQ ID NO: 8193 - DNA, 201 bp, Homo sapiens
ccaacctcaggtcatggtcagggtagggctgacacttaccagcccagcccagtgccttgaagagcccaagcagaagaaaggcagacaggaaaaggcctacrctgtcctcaagggagggccctgaaagacctggcaggcagaaggggtgagagtgagctcctgtcttcctgggtgctggctcagattccgcagagctcccag

SEQ ID NO: 8194 - DNA, 201 bp, Homo sapiens
tcagcccaggagttgcagccaggagcagatgtcccttacccaggtgctggcgtcgccactctagcccaaagggagggggacccggagccagagatgaggcrgcctcggaggtggggggcatgtaggcaaagctcaagtccagcagagcatcttgtcccagtctcactcgaggggcaggggtgtgggtgaggacagtcagta

SEQ ID NO: 8195 - DNA, 201 bp, Homo sapiens
tcacacctgtaatcccagcactttgggaggccaaggcggaaagatcacgaggtcaggagatcgagaccatcctggctaacacggtgaaaccccgtctctamtaaaaatacaaaaaattggccgggtgtggttgcgggtgcctgtagtcccagctacttgggaggctgaggcaggagaatggcacgaacctcggaggtggag

SEQ ID NO: 8196 - DNA, 201 bp, Homo sapiens
aaggattttaatatattgttaaattctagtttttttttgtttttgtttttgtttttgagacggagtctcgctctgtcgcccaggctggagtgcagtggcgsgatctcggctcactgcaagctccgcctcccgggttcacgccattctcctgcctcagcctcccgcgtagctgggactacaggcgcccgccaccacgcccgg

SEQ ID NO: 8197 - DNA, 201 bp, Homo sapiens
ctcctgggtttaagcgattcttctgcctcagcctcctgagtagctgggattacaggcacacgccaccatggatggctaatttttgtatttttagtagagayggggtttcaccatgttggccaggctggactcaaactcctgtcttcaagtgatccacccgcctcagcctcccaaagtgctgggattacaggagtgagccac

SEQ ID NO: 8198 - DNA, 201 bp, Homo sapiens
ttttaatgtgatgattctcattaaagaggtagtatggtgtagtgtttaaaagtacgggttctggccgggcgcggtggctcacgcctgtaatcccagcactytgggaggccgaggcgggagaatcacgaggtcaagagtttgagaccagcctgaccaacatggtgaaaccccatctctactaaaaatacaaaaattagctgg

SEQ ID NO: 8199 - DNA, 201 bp, Homo sapiens
tgggacatttgttcaataagtaaaacaataaacagataaatttcagaagtagggccgggcgcggtggctcacgcctgtaatcccagcactttgggaggccsaggcgggcggatcacgaggtcaggagatcaagaccatccttgctaacacggtgaaacctcacctctaccaaaaatacaaaaaattagccaggcttggtgg

SEQ ID NO: 8200 - DNA, 201 bp, Homo sapiens; identical to SEQ ID NO: 7940

SEQ ID NO: 8201 - DNA, 201 bp, Homo sapiens
gaactcctgacctcaggtgatccgccctcctcagcctcccaaagtgctaggattacaggcgtgaaccaacgcacctggccaagactgtaatttctttttcttttttttttgttgttgagacgaagttttccttttgtcacccaggctggagtgcaatggtgtgatctcagctcactgcaacctctgcctcccaggttcaag

SEQ ID NO: 8202 - DNA, 201 bp, Homo sapiens
aaaatacaaaattagcctggtgtggtggcacatgcctgtaatcccagctactcgggagaccgaggcagtagaattgcttgaacccgggaagcagaggttgyggtgagccgagattgtgccattgcactccagcctgggcaataagagggaaaccccgtttcaaaaaaaaaaaaaaaaatcccaaatacggccaggcgtggt

SEQ ID NO: 8203 - DNA, 201 bp, Homo sapiens
gacctttgcctatcttttaaaagaatcaagtaaaataacaggctttttccgggcatggtggctaacacatgtaatcccagcactttgggaggctgaggcgrgtggattacctgaggtcaggagttcgagagcagcctggccaacatggtgaaaccccatctctactaaaaatacaaaaaaaaaaaaaaaaaaaattagcgg

SEQ ID NO: 8204 - DNA, 201 bp, Homo sapiens
aactcaggaggcagaagttgaaatgagcagagatcacaccattgcactccagcctgggcaacagggtgagactctgtctcaaaaaaaaaaaaaaaaaaaamaagtatatttggggccaggcagctcacacgtgtaatcccagcagtttcggaggccaaggtgggcagatcaattgagcccaggagtccaagaccagcctgg

SEQ ID NO: 8205 - DNA, 201 bp, Homo sapiens
ccacctcttcaaagccccgcccttcgaaacaccagaaagtaacccccctgcccggccctgctttccccctaccccctgccaagctgcagttttttttttgttttttttttttaactgggtgagggctagaaggagcggtagagattgattcattctagccaaaccacctctcttaacaaaaaaaggaaactgaaccccgat

SEQ ID NO: 8206 - DNA, 201 bp, Homo sapiens
ccataaagcgagaccaccggctgatctggacccttagaatctacccacccttctccacctcccctccccagctacctgttgccatggtgatgagaacaggstcctgctgaggctctggctgtggtcgcaagaggctggagaggctgaggactgggctggatatgctgaccatcagccaagccccatccagggcccgcgggc

SEQ ID NO: 8207 - DNA, 201 bp, Homo sapiens
cacagtgtgtccatatgatgggaggcaaggacagaggcagaggggacagcaagggagagaaatgaaaatgatacagtgtgcagctgggcgcggtggctcasgcctgtaatcccagcactttgggaggctgaggtgggcagatcacaaagtcaggagatcgagaccatcctgaccaacatggtgaaaccccgtctctactaa

SEQ ID NO: 8208 - DNA, 201 bp, Homo sapiens
atggggtttcaccatgttagccaggatggtcttggtctcctgacctagtaatccacctgcctcggcctcccaaagtgctgggattacaggcgtgagccacygcgcccggcctccttaggtttgtagacattaattgggccataatgcttacttgggtagagaagttctttgccatccctcctctgctttggaaaacacagc

SEQ ID NO: 8209 - DNA, 201 bp, Homo sapiens
ctggttcaagcgattcttctgtctcagcctcccatgcagctgggattataggtgcgcaccaccacacctggctaattttttgtatttttagtagagacggsgtttcaccatgttggccaggctggtctcaaacttctgacctcaaatgatccatctgccttggcctccaaaagtcctgggatgacaaatgtgagccactgc

SEQ ID NO: 8210 - DNA, 201 bp, Homo sapiens
ggtggctcacacctgtaatctcaacactttgggaggccaaggcaggcagattacctgatgtcgggatttcaagaccagcctggccaacatggtgaaacccygtctctactaaaaatacaaaaattagctgggcatggtggtgggagactgtaatcccagctacttgggaggctgcgggaggagaatcccttgaatctggga

SEQ ID NO: 8211 - DNA, 201 bp, Homo sapiens
actcgagcccacctgtttgcggaccacagagcggcagcacatccctacacggggctgtcaggcaaggtcaacgcgctagagtgcaagagcctttgctttgmggattgccgcagcgccgggtgtgggcgcaggtggggatagagtgctgggttttgaaagagtgacccgcaaagctgagggtgcagagcaagacacagatct

SEQ ID NO: 8212 - DNA, 201 bp, Homo sapiens
gcgtccacaaccgtgcccagctaatttttgtatttttggtagagatggggtttcaccatgttgcccaggctggtcttgaactcccgacctcaggtgatccrcctgctttggtctcccaaagtgctgggattacaggcatgagccaccacgcctggcctctagctctgcttcttacacactgtgtgtccttgggcaaattat

SEQ ID NO: 8213 - DNA, 201 bp, Homo sapiens
gtgtataggaaacataaatgatttctgtgtttagatttgggtctgatcccaaagatattaaatatatgcaaatattccaaagtctgaaaaaatccaacatmcaaaaacacttctgacccaagcatttcagataagggaccagaattattagattaaataaggtatattattaagttaattttacctgtttctgcttatttt

SEQ ID NO: 8214 - DNA, 201 bp, Homo sapiens
aaggtatattattaagttaattttacctgtttctgcttatttttttaatgtgagtactagagtatttaaatttacatatgtggcttgcattatctttctaytggacagcactgcctaagtaactttttaaaatccctacacccaaggaaacatatagattaagtagcatgctcaaagagtcctacagttaggatatagtgc

SEQ ID NO: 8215 - DNA, 201 bp, Homo sapiens; identical to SEQ ID NO: 7941

SEQ ID NO: 8216 - DNA, 201 bp, Homo sapiens
cacgcctggctaatttttttgcatttttagtagagacagggtttcaccatgttggccaggccagtctcaaactcctgacctccaatgatccacccgcctcrgcctcccaaagtgctgggattacaggcgtgagccaccgcgcccggccaaaatctaccattcgaatagtattacatgcttccttccagaaagaaacgggcc

SEQ ID NO: 8217 - DNA, 201 bp, Homo sapiens
tgggcttggtggcacacgcctgtaatcccagctactcaggaggctgaggcaggagaatcgcttgaacccaggaggtggaggttgcagcgagccaagatcgygccactgcactccagcctgggcaacagagcgagactctgtctcaaaaaaaaagtgcttttataagggaagagcgctatggaaacataagatttcgttgtt

SEQ ID NO: 8218 - DNA, 201 bp, Homo sapiens
tatcatggacttgctggttaacttggaaaaatcatttaacctgtattttcctcactagtccaaagatctgacctttgcctatcttttaaaagaatcaagtraaataacaggctttttccgggcatggtggctaacacatgtaatcccagcactttgggaggctgaggcgagtggattacctgaggtcaggagttcgagagc

SEQ ID NO: 8219 - DNA, 201 bp, Homo sapiens; identical to SEQ ID NO: 7950

SEQ ID NO: 8220 - DNA, 201 bp, Homo sapiens; identical to SEQ ID NO: 7952

SEQ ID NO: 8221 - DNA, 201 bp, Homo sapiens
tttgagaccagcctgggcaacatagcaagaccccatctctatttaaaagaaaaaatttaaaaaaataataaacaagacctaaaggttttacagtttaactyttttttttttttttttttttttggagacagggtctcactctgtcacccatcaaaggtgcaatcctcccaacacagcctcccgagtagctgggaccatagg

SEQ ID NO: 8222 - DNA, 201 bp, Homo sapiens
taaacaaacaaacaaaaaaccaaaaaagaccaaagagaataactactaaaggggagacaaatacagtattagaaaatatttaatctggtcaggtgctgtgkctcacgcctgtaatcccagcactttgggaggccgaggcgggcagatcacttgaggtcaggagttcgagaccagctgggcaacatggcgaaaccctgtctc

SEQ ID NO: 8223 - DNA, 201 bp, Homo sapiens
aaattagccaggtgtgggggcaggcacctgtagtcctagctacttgggaggctgaggcagaagaatcacttgaacctgggaggtagaggttgccgtaagcygaaatcatgccactacactccagcctgggcaacagagtgagactccgtctcaaaactaaataaataaataaaataaaaatcccaaatacctaggaagtca

SEQ ID NO: 8224 - DNA, 201 bp, Homo sapiens
ggctaattttttgtatttttagtagagatggggtttcatcatgttggctaagctggtcttgaactcctgacctcaggtgatcctcccgcctcggcctcccraagtgcagggattacaggcatgagccatcgcacccggcctgtaatttcttatattgtttacatgttgcaataatattttggatgtacaggttgagcatcg

SEQ ID NO: 8225 - DNA, 201 bp, Homo sapiens
ggtgcccgccaccatgcccggctaatttttttctatttttagtagaggtggggtttcaccgtgttagccaggatggtctcgatctcctgacctcataatcygcccgcctcggcctcccaaagtgctgggattacaggagtgagccaccgcgcctggtctctctgtgctctcttatcctgaagtatgccgaaaaggagtgca

SEQ ID NO: 8226 - DNA, 201 bp, Homo sapiens
ggactgcagaatccgaggccacttctgacacaacctgaaccactctatctccaagcaccacccttgaggaaccaggcctttcttgattacaggcgaagacwatgattgagccatgactgtcagtcttgtggtgctgtacagaatatttactgactctagaaggttccagctctagcctagacctgagcacagacctctatg

SEQ ID NO: 8227 - DNA, 201 bp, Homo sapiens
tctcctgcttcagcctcccaagtagctgggactacaagcacatgccaccatgcccagatgatttttgtatttttagtagagacggggtttcaccatgttgrccaggctggtcttgaactcctaacctcatgatccacctgtcttggcctcccaaagtgctgggattacaggtgtgagccactgtgcccggccgaatatatt

SEQ ID NO: 8228 - DNA, 201 bp, Homo sapiens
ggggtttcaccatgttggccaggctggtcttgaactcctgacctcaggtgatccgccctcctcagcctcccaaagtgctaggattacaggcgtgaaccaaygcacctggccaagactgtaatttctttttcttttttttttgttgttgagacgaagttttccttttgtcacccaggctggagtgcaatggtgtgatctcag

SEQ ID NO: 8229 - DNA, 201 bp, Homo sapiens
tacagccggacgcggtggctcacgcctgtaatcccagcactttgggaggccgcagcgagcagatcacgaggtcaggagatcgagaccatcctggctaacayggtgaaaccccgtctctactaaaaatacaaaaaaatagccgggtgccctggcgggcgcctatactcccagctacttgggaggctgagccaggagaatggc

SEQ ID NO: 8230 - DNA, 201 bp, Homo sapiens
ttcccagaaatgtctaggtccttcaggtagaagtaatctttttcttcttgtaattatttttatgttctttttaatcctagcttctgaggcctataaggttwaactgttctcatcttcatggaattgttcagtagagtaaaaacagtatgcaatttcacttagtttgtcaaaatccagaaacatacttttgaattgttaaaa

SEQ ID NO: 8231 - DNA, 201 bp, Homo sapiens
agattccgcagagctcccagctcttacctgctacctccagggtgacctcagcgctgcgccccgaggcaggcaggctgggatggtgaattcgacaggcatascgtgccccatgctgctcagtggtgactgggggcggctgcaagtgcccagagaggctgacagagccatcggaatggtggcgcagggccgagagccacctct

SEQ ID NO: 8232 - DNA, 201 bp, Homo sapiens
gcctcagcctcctgagtagctgggactacaggtgcccaccaccaggcctggctaatttttgtatttttagtagaaacggggtttcaccatgttggccaggmtggtctcgaactcctgaccttgtgatccacctgcctcggtctcccaaagtgttgggattaccagtgtgagctactgcacccggccatcaagtgcttatag

SEQ ID NO: 8233 - DNA, 201 bp, Homo sapiens
attctcctgcctcagcctcctgagtagctgggactacaggtgcctgccaccacgcccggctaatttttttgaaattttttagtagagacggggtttcaccrtgttagccaggatggtctcgatctcctgacctcatgatctgcctgcctcagcctcccaaagtgctgggtttacaggcgtgagccactgtgcccggcctga

SEQ ID NO: 8234 - DNA, 201 bp, Homo sapiens
gtggctcacacctgtaatcccaacactttggtagcctgaggcgggtggattacctgaggtcaggagttcaagaccagcctggccaacatggcaaaaccctrtctctactaaaaatacaaaaattagccaggtgtgggggcaggcacctgtagtcctagctacttgggaggctgaggcagaagaatcacttgaacctgggag

SEQ ID NO: 8235 - DNA, 201 bp, Homo sapiens
tcccagtgtggctcagggaagccaaaagattggagacccctgatctaaatactccatgtacatgaaggtcactttcactgctgtttcttcccagaaatgtytaggtccttcaggtagaagtaatctttttcttcttgtaattatttttatgttctttttaatcctagcttctgaggcctataaggttaaactgttctcatc

SEQ ID NO: 8236 - DNA, 201 bp, Homo sapiens
aggctgaggtgggtggatcacctgaggtcaggagttcaagaccagcctggctaacatgaccaaaccctgtctccactaaaaatacaaaaattagctgggcytggtggtgggcgcctgtagtctcagctacttgggaggctgagacaggagaattacttgaactcaggaggcagaagttgaaatgagcagagatcacaccat

SEQ ID NO: 8237 - DNA, 201 bp, Homo sapiens
tggcacatgcctgtggtctcagctactcaggagactgaggcacgaggatcacttgagccacggaggtggaggttgcagtgagctgagatcatgccactgcwctccagcctgcactgcactccagcctgggcgacagagggagaccctgtctcaaataaataaataaataagcatatttgtcaataaacatttaaaaatatt

SEQ ID NO: 8238 - DNA, 201 bp, Homo sapiens
ataaataaataaataaatagcaggcaggcgcagtggctcacgcttgtaatcccagcacttcgggaggcgaggtgggaggatcacctgaagttgggagttcragaccagccttaccaacatggagaaacctcatctctactaaaaatacaaaattagctgggtgtggtggcaggcacctgtaatcccagctactcgggaggc

SEQ ID NO: 8239 - DNA, 201 bp, Homo sapiens
ctctactaaaaatacaaaattagctgggtgtggtggcaggcacctgtaatcccagctactcgggaggctgaggcaggagaattgcttgaaccagggaggcrgaggttccggtgagcgtgagatcacgccattgcactccagcctgggcaacaagagcaaaactctgtctcaaaaataaataaataaataaaataaaaataa

SEQ ID NO: 8240 - DNA, 201 bp, Homo sapiens
aataaataaataaataaaataaaaataaataaatagcacagcaccttgctttgaccccagttgtttgtgaaatacagacaatcttaccacccgggcacttscagggctccctgtctgcatgtccttcactttctactttacattaggattatccgtggcaaatacgcccagaacctcctggagagcagagtctacatcaga

SEQ ID NO: 8241 - DNA, 201 bp, Homo sapiens
tcatctttgtgacccttaagggcacccagggccaccccagagattctgatttaatcggccaagctaagcatgggattgaatcaggtttcagtatattttaraaacctccaacagtgtggactgagaactgctgagtcctaactcattcttggtgctaaaaagtatttattgaatcaatggataaattaacacagtgccatc

SEQ ID NO: 8242 - DNA, 201 bp, Homo sapiens
gaccagcctgggcagaagaaaaagaaaataaaaagtgtaaattgggaggccgaggcaggcagatcacgaggccaggagatcgagaccatcctggctaacamggtgaaaccccgtctctactaaaaatacaaaaaaattagccgggcatggtggcggcacctgtagtcccagctactcgggaggctgaggcaggagaatggc

SEQ ID NO: 8243 - DNA, 201 bp, Homo sapiens
ttacatttaaagaatcattctgggctgggcttggtggctcatgcctataatcccagcactttgggaggccgaggtgggtagatcacgaggtcaggagatcragaccatcctggctaacacggtgaaaccccgtctctactaaaaatacaaaaattagctgggcgtggtggcacatgcctgtagtcgcagctactcgggagg

SEQ ID NO: 8244 - DNA, 201 bp, Homo sapiens
cctgagtagctgggactacaggcgcccgccaccacgcccagataatttttttgtatttttagtagagacggggtttcaccgtgttagccaggatggtctcratctcctgacctcatgatccacctgcctcggcctcccaaagtgctgggattacaggcgtgagccactgggcccggccggtttcgataagttttatgagga

SEQ ID NO: 8245 - DNA, 201 bp, Homo sapiens
gcagtgagccgagatcgcaccattgcaccccagcctgggcgacagagactctgtctcaaaaaaaaagagaaggaaaaaaatcttcaggccatgtgtataasgtgtataggaaacataaatgatttctgtgtttagatttgggtctgatcccaaagatattaaatatatgcaaatattccaaagtctgaaaaaatccaacat

SEQ ID NO: 8246 - DNA, 201 bp, Homo sapiens
gtgagcgtgagatcacgccattgcactccagcctgggcaacaagagcaaaactctgtctcaaaaataaataaataaataaaataaaaataaataaatagcwcagcaccttgctttgaccccagttgtttgtgaaatacagacaatcttaccacccgggcacttccagggctccctgtctgcatgtccttcactttctactt

SEQ ID NO: 8247 - DNA, 201 bp, Homo sapiens
gaaatgcaaatcaaaaccgcaatgagataccatcttacatggtatcttacatagaatggcgatcattaaaaaggaaacaaggccgggcgcggtggctcacrcctgtaatcccagcactttgggaggccgaggcgggcgaatcacgaggtctaaaacggtgaaaccccgtctctactaaaaatacaaaaaattagccgggcg

SEQ ID NO: 8248 - DNA, 201 bp, Homo sapiens; identical to SEQ ID NO: 7971

SEQ ID NO: 8249 - DNA, 201 bp, Homo sapiens; identical to SEQ ID NO: 7972

SEQ ID NO: 8250 - DNA, 201 bp, Homo sapiens
tctcctgaaatagggaacccactgtctctccattggtgcgtcacagaaatacccatgtcaaagcccctcaaatttccaggaaacttctagcctcccattayccctctaactcccaggaacctctttctatctctacttacttgcccaggcaccctcttatccatcatccctccccctattacggtccccacaatccagtgc

SEQ ID NO: 8251 - DNA, 201 bp, Homo sapiens
tctagcctcccattacccctctaactcccaggaacctctttctatctctacttacttgcccaggcaccctcttatccatcatccctccccctattacggtmcccacaatccagtgcccaccctctacccctggagacctctgtcccccaactcactgtacacagcaagctccagggtgacctgtccttgcaggtatggcag

SEQ ID NO: 8252 - DNA, 201 bp, Homo sapiens
cacgcctggctaatttttttgtatttttagtagggacggcgtttcactgtgttagccagatggtctccatctcccgacctcgtgatccacccacctcggcytcccaaagtgctgggattacaggcgtgagccaccgcgcccggccaatttcctttcttaattgcctctgcccacctcttctcttctgcttccatattacag

SEQ ID NO: 8253 - DNA, 100 bp, Homo sapiens
gagccacctctgcccctcggccttctgagagcggccccctgggccacccyggagttcccactccacctccaggcccccagaagggtagaagtgggacaca

SEQ ID NO: 8254 - DNA, 201 bp, Homo sapiens
ccactcgagcccacctgtttgcggaccacagagcggcagcacatccctacacggggctgtcaggcaaggtcaacgcgctagagtgcaagagcctttgcttygcggattgccgcagcgccgggtgtgggcgcaggtggggatagagtgctgggttttgaaagagtgacccgcaaagctgagggtgcagagcaagacacagat

SEQ ID NO: 8255 - DNA, 201 bp, Homo sapiens; identical to SEQ ID NO: 7875

SEQ ID NO: 8256 - DNA, 201 bp, Homo sapiens; identical to SEQ ID NO: 7897

SEQ ID NO: 8257 - DNA, 201 bp, Homo sapiens; identical to SEQ ID NO: 7909

SEQ ID NO: 8258 - DNA, 201 bp, Homo sapiens; identical to SEQ ID NO: 7921

SEQ ID NO: 8259 - DNA, 201 bp, Homo sapiens; identical to SEQ ID NO: 7922

SEQ ID NO: 8260 - DNA, 201 bp, Homo sapiens; identical to SEQ ID NO: 7923

SEQ ID NO: 8261 - DNA, 201 bp, Homo sapiens; identical to SEQ ID NO: 7924

SEQ ID NO: 8262 - DNA, 201 bp, Homo sapiens; identical to SEQ ID NO: 7925

SEQ ID NO: 8263 - DNA, 201 bp, Homo sapiens; identical to SEQ ID NO: 7926

SEQ ID NO: 8264 - DNA, 201 bp, Homo sapiens; identical to SEQ ID NO: 7927

SEQ ID NO: 8265 - DNA, 201 bp, Homo sapiens; identical to SEQ ID NO: 7928

SEQ ID NO: 8266 - DNA, 201 bp, Homo sapiens; identical to SEQ ID NO: 7929

SEQ ID NO: 8267 - DNA, 201 bp, Homo sapiens; identical to SEQ ID NO: 7949

SEQ ID NO: 8268 - DNA, 201 bp, Homo sapiens; identical to SEQ ID NO: 7968

SEQ ID NO: 8269 - DNA, 201 bp, Homo sapiens; identical to SEQ ID NO: 7970

SEQ ID NO: 8270 - DNA, 100 bp, Homo sapiens; identical to SEQ ID NO: 7973

SEQ ID NO: 8271 - DNA, 201 bp, Homo sapiens
atatacaattttgaaggtaaagaccattttatactactatttttattaatatttcctccctccttgtgtaagatcattgctagacatgtagacaataaatktttgctggttaagtttgctgaagttgaagctagccaaatatttaaacagcccatgcctacaatatatattgggtcatttttaaggcctattttcttaagc

SEQ ID NO: 8272 - DNA, 201 bp, Homo sapiens
aaaaaaaggtactggtcaccacaagattttattcatccactggaccacccgctggtgggggtgttttcaaaaaagtgctagcattttcaatcagggcgacratctagagtcccttctggtgcactgttacagaattctgattactgtaggttcaacttttcagtttgtgacaggattagctttaatttattgcaattaatt

SEQ ID NO: 8273 - DNA, 201 bp, Homo sapiens
gattccaaaagtagaggagacagaatcacttatccttgttacactgcttttcttcatctcttgccctttcctttcacatacattttttccctcttctcatyattacctgtctttcaaacactgtattctgcctttgcaacactgagatccaaatacccacaagtggttaacttgtgtcatcacaagatctataaggtgaac

SEQ ID NO: 8274 - DNA, 201 bp, Homo sapiens
aaacatcatttattctgaaggaatatgagagggaaatgcaatcatcagttttaacaaagaaaccaccaatcaagtttctctctggggtatagggatgcaartaagaattttagaagttatgatttggcaaaaataaattttacatagtcatattcttaataaaagtgattaacacacaacagaaattattcataacactgc

SEQ ID NO: 8275 - DNA, 201 bp, Homo sapiens
ctctgcaaccaggatttggtatgttttattagagcaaatttttaacaaaaggtggctttcatttacagaatttaatgtgtgtggggactgtccaacccatrtggactcaagtaaggataaccattaagcttgctaatgtattttcttattttcagtttacatacaaattttttttgtttgcttcacattcataaaaacccc

SEQ ID NO: 8276 - DNA, 201 bp, Homo sapiens
ccaatcatgtatgaaggaaataagggacaatctacacttgcctttcatggatgggaatctggctacatagttccacctaaagtatcttctgtcacaggatrtatctaccagaacaatttcttattatctctaaagtgaattagagacatagcctcctggaaaaaacaaaaaactactctgcaaccaggatttggtatgttt

SEQ ID NO: 8277 - DNA, 201 bp, Homo sapiens
tgtgaataatccctgaggggtttgtcataactgtaaaaaaaaactagaccttgtataagccccccaaaattaaatccaatcatgtatgaaggaaataaggracaatctacacttgcctttcatggatgggaatctggctacatagttccacctaaagtatcttctgtcacaggatatatctaccagaacaatttcttatta

SEQ ID NO: 8278 - DNA, 201 bp, Homo sapiens
acaccaaatacattgtgaaataaggaataaagacataatcaaagatatgcctaacatggggtagactgtactcttgtaacactttaggacctcactgcttrtaactgaaaatatttaaatgtgaataatccctgaggggtttgtcataactgtaaaaaaaaactagaccttgtataagccccccaaaattaaatccaatca

SEQ ID NO: 8279 - DNA, 201 bp, Homo sapiens
ggaaatctatcagaaagaggttgaaaggaactgggaaactgaagtgagactcgtggtcaataggagttaaaaatatttatgtacattcatacatacatatmtgtttgtctaaatgtttaacaatttataaagctgaaaactcatttagttctcccccctcccctacacaccaaatacattgtgaaataaggaataaagaca

SEQ ID NO: 8280 - DNA, 201 bp, Homo sapiens
gaggagtgaaaaggaccatctagtgctccatggcaaacaggttaccaagccatgctctagagctatactgtccaaacggtagccgctagacacgtggctayctaaatttaatcaaaattaaatagcactacaaaaaaagtagtttattggcaccaattacaccagttaagtgaaaaaccaagatttattataatagagata

SEQ ID NO: 8281 - DNA, 201 bp, Homo sapiens
cataataaaatgagataatgcccacctatgtcacccctcaactcagaaagaaatgagttacaaaccctgaatatccaaatagaggaatatagaaaaatttmattgattccaaaagtagaggagacagaatcacttatccttgttacactgcttttcttcatctcttgccctttcctttcacatacattttttccctcttct

SEQ ID NO: 8282 - DNA, 201 bp, Homo sapiens
tcttctttacaatatagccttagatgtacttttttaaattcaacacagacttgaagaaaatgggctaaatgcaaaaaaaaaaaaaaaaaaaaaaaagacaytcacatagaacttacctcttttctgatcatgacatcatttttgtaattgctgttgttggcatatctaagctttcctgtgggaagtggaaaaaaatcaatt

SEQ ID NO: 8283 - DNA, 201 bp, Homo sapiens
ataaactgataggatgccactgaaattatcttggctagcaaactgactatagttctaaaatgagcctctgtaataatgaaaacttcgccaaaatgctttawcatacttactttgactgatttacatcaataagagaacctatttttgatgtggtaaaagatatgtgctcatctccaattacaatttcaagctcctaaaaaa

SEQ ID NO: 8284 - DNA, 201 bp, Homo sapiens
attatcttggctagcaaactgactatagttctaaaatgagcctctgtaataatgaaaacttcgccaaaatgctttaacatacttactttgactgatttacrtcaataagagaacctatttttgatgtggtaaaagatatgtgctcatctccaattacaatttcaagctcctaaaaaatatagcagaaaaatgtagttaata

SEQ ID NO: 8285 - DNA, 201 bp, Homo sapiens
ggttagttctctgaactttctcattcctatggatgcaaacactgtatctaatttaaatggaaactctttcaatctataaattgccttcttctttacaatayagccttagatgtacttttttaaattcaacacagacttgaagaaaatgggctaaatgcaaaaaaaaaaaaaaaaaaaaaaaagacattcacatagaactta

SEQ ID NO: 8286 - DNA, 201 bp, Homo sapiens
atggaaactctttcaatctataaattgccttcttctttacaatatagccttagatgtacttttttaaattcaacacagacttgaagaaaatgggctaaatrcaaaaaaaaaaaaaaaaaaaaaaaagacattcacatagaacttacctcttttctgatcatgacatcatttttgtaattgctgttgttggcatatctaagc

SEQ ID NO: 8287 - DNA, 201 bp, Homo sapiens
ctttcccagcaccgcgtgccgtgggcctcttctcaccgtccggccgaaattcgaactccagaaactcgtgcccaaacttgcccttgtgccctacgtagtascgcaggtagaaatcgctagccacagccatttttgtacccgggaagcccgccgaaaacgcagccaacgtgtcccccggcgccttgcagtgacgtcatcgcg

SEQ ID NO: 8288 - DNA, 201 bp, Homo sapiens
acatggggtagactgtactcttgtaacactttaggacctcactgcttataactgaaaatatttaaatgtgaataatccctgaggggtttgtcataactgtaaaaaaaaactagaccttgtataagccccccaaaattaaatccaatcatgtatgaaggaaataagggacaatctacacttgcctttcatggatgggaatct

SEQ ID NO: 8289 - DNA, 201 bp, Homo sapiens
ttttaaattcaacacagacttgaagaaaatgggctaaatgcaaaaaaaaaaaaaaaaaaaaaaaagacattcacatagaacttacctcttttctgatcatsacatcatttttgtaattgctgttgttggcatatctaagctttcctgtgggaagtggaaaaaaatcaatttataatagcaaaaactgctaaaaaaattaac

SEQ ID NO: 8290 - DNA, 201 bp, Homo sapiens
tgtaatcccaggactgtgggtggctgacgctggtggatcccttgacctcaggggtttgaagccagcctgggcaacatggggaaacccatctctacaaaaaataacataacataacataacataacataacataacataacataacataacataacataattagctgggtgaggtggcgtgggcctgtattcccagcacctc

SEQ ID NO: 8291 - DNA, 201 bp, Homo sapiens
gtaatcccaggactgtgggtggctgacgctggtggatcccttgacctcaggggtttgaagccagcctgggcaacatggggaaacccatctctacaaaaaataacataacataacataacataacataacataacataacataacataacataacataattagctgggtgaggtggcgtgggcctgtattcccagcacctcg

SEQ ID NO: 8292 - DNA, 201 bp, Homo sapiens
taatcccaggactgtgggtggctgacgctggtggatcccttgacctcaggggtttgaagccagcctgggcaacatggggaaacccatctctacaaaaaataacataacataacataacataacataacataacataacataacataacataacataattagctgggtgaggtggcgtgggcctgtattcccagcacctcgg

SEQ ID NO: 8293 - DNA, 201 bp, Homo sapiens
aatcccaggactgtgggtggctgacgctggtggatcccttgacctcaggggtttgaagccagcctgggcaacatggggaaacccatctctacaaaaaataacataacataacataacataacataacataacataacataacataacataacataattagctgggtgaggtggcgtgggcctgtattcccagcacctcggc

SEQ ID NO: 8294 - DNA, 201 bp, Homo sapiens
atcccaggactgtgggtggctgacgctggtggatcccttgacctcaggggtttgaagccagcctgggcaacatggggaaacccatctctacaaaaaataacataacataacataacataacataacataacataacataacataacataacataattagctgggtgaggtggcgtgggcctgtattcccagcacctcggca

SEQ ID NO: 8295 - DNA, 201 bp, Homo sapiens
tcccaggactgtgggtggctgacgctggtggatcccttgacctcaggggtttgaagccagcctgggcaacatggggaaacccatctctacaaaaaataachtaacataacataacataacataacataacataacataacataacataacataattagctgggtgaggtggcgtgggcctgtattcccagcacctcggcag

SEQ ID NO: 8296 - DNA, 201 bp, Homo sapiens
atttgtcttactcattactgtaccttaaaattttgtatttgcttgttgtccagcacaaaacgtgcattcaaaaaaacccaaaaaatatatatccaaatgarctttcttgttgcaggtaggcaagatcaatgtaacattctctaaggatagcgctgtcagaaaacacactgttgcacactacttgggtagcagtttcacctc

SEQ ID NO: 8297 - DNA, 201 bp, Homo sapiens
aaggtgaactgtaataaatgcaagtatactgaggcaggagaatcgcttgagcctgggaggcagaggttgcagtgagctgagatcaagccactgcactccarcttgggtaacagagcgagactctgtccctaaatcaataaatcaataaatgcaagtgtagttcacgtcaaggttagttctctgaactttctcattcctatg

SEQ ID NO: 8298 - DNA, 201 bp, Homo sapiens
cccagaggtatctgtattcttgctacaagcagatcccaattttagttgcaagttttctagcagccaacagagggagtggggggcgagggggaaagaaacayggtttcttagatataaactatatccttaaaataaagactgctcacgcgcactacccccaagtttaggaccaacaaagaattgctttccagagacataaag

SEQ ID NO: 8299 - DNA, 201 bp, Homo sapiens
ggtatagggatgcaaataagaattttagaagttatgatttggcaaaaataaattttacatagtcatattcttaataaaagtgattaacacacaacagaaaytattcataacactgcattgtgaaaacatcctaacgttggctggggtgactacagagaaagatgtctaaatttagagctatgcactgactccttcactact

SEQ ID NO: 8300 - DNA, 201 bp, Homo sapiens
tccctccttgtgtaagatcattgctagacatgtagacaataaatgtttgctggttaagtttgctgaagttgaagctagccaaatatttaaacagcccatgyctacaatatatattgggtcatttttaaggcctattttcttaagctacatcatgaactagaaagagaatctgcaaaaggcactaagattcctttaaagttt

SEQ ID NO: 8301 - DNA, 201 bp, Homo sapiens
ttaagcttgctaatgtattttcttattttcagtttacatacaaattttttttgtttgcttcacattcataaaaaccccaatactgtaaatgacaaataacycctcccatcccttaattaaatatacaaacagcctgaaaacatacaatttaaattggtttaatcttgaagtgtaatccaataagactgaaaactaaacatt

SEQ ID NO: 8302 - DNA, 201 bp, Homo sapiens
aatgtgtaatattaataaccaccaccactttagcacctactgtatgtcaggccctagtggtagggactttgtactctctgtaatcttgaaaataaccttaytaacctattttacaaatgtgtaatccaaaactcatagagcagaagaaaatacttgttgatatttataaccactaataatgatggtacttatatttgatcc

SEQ ID NO: 8303 - DNA, 201 bp, Homo sapiens
aatttcaagctcctaaaaaatatagcagaaaaatgtagttaatataaaaatctatcccagaggtatctgtattcttgctacaagcagatcccaattttagytgcaagttttctagcagccaacagagggagtggggggcgagggggaaagaaacatggtttcttagatataaactatatccttaaaataaagactgctcac

SEQ ID NO: 8304 - DNA, 201 bp, Homo sapiens
cttctactgagagacaagataataagcctttaatgacataaaaatcaggattacatctgcataataaactgataggatgccactgaaattatcttggctarcaaactgactatagttctaaaatgagcctctgtaataatgaaaacttcgccaaaatgctttaacatacttactttgactgatttacatcaataagagaac

SEQ ID NO: 8305 - DNA, 201 bp, Homo sapiens
tgttggattaaaagtttttggacaatcaatgaaatactctgctaacttctactgagagacaagataataagcctttaatgacataaaaatcaggattacawctgcataataaactgataggatgccactgaaattatcttggctagcaaactgactatagttctaaaatgagcctctgtaataatgaaaacttcgccaaaa

SEQ ID NO: 8306 - DNA, 201 bp, Homo sapiens
atacagctgttggattaaaagtttttggacaatcaatgaaatactctgctaacttctactgagagacaagataataagcctttaatgacataaaaatcagrattacatctgcataataaactgataggatgccactgaaattatcttggctagcaaactgactatagttctaaaatgagcctctgtaataatgaaaacttc

SEQ ID NO: 8307 - DNA, 201 bp, Homo sapiens
taatacaacttgggcattattatatacagctgttggattaaaagtttttggacaatcaatgaaatactctgctaacttctactgagagacaagataataascctttaatgacataaaaatcaggattacatctgcataataaactgataggatgccactgaaattatcttggctagcaaactgactatagttctaaaatga

SEQ ID NO: 8308 - DNA, 201 bp, Homo sapiens
ccatagaagagatgctcagaaatgaaattactaggccaaaggtgaatgaaaaatgtcaacagtttttgatgcatattaccaaactgctttccaaaaaccaytaccaatttataatcccagtagggtatcaatgccacacccttaccaaatgtaggaaaagaaatttgatagtttaaaagcatttggatggtctttgtgaac

SEQ ID NO: 8309 - DNA, 201 bp, Homo sapiens
aatttttaattaatttaataattctctccttgttagacactggggttaatttcctattataaataatacttcaatgagcatcttcatgcataataaagctyttccaatatttaggaatagttccatagaagagatgctcagaaatgaaattactaggccaaaggtgaatgaaaaatgtcaacagtttttgatgcatattac

SEQ ID NO: 8310 - DNA, 201 bp, Homo sapiens
tcttgtaccaaatagtaaaatactcgaaggccttcaggatccctaaaatttaaaaaggtaaaagttactttttcttcctaggataaaacaattctttaaaygcctaaaacaaaacaaatcaaaatctcataacaattaagttaacaaaatttaggagaaaggaaggattttgctgacaactaaaatgaacatacaattaat

SEQ ID NO: 8311 - DNA, 201 bp, Homo sapiens
tttattataatagagatattacagtaaaaaagatgttaagtatagaatctaggtaggggtaggcatataggtgttcactttatagttctcaagagtttttwatgttttatccttttcacgttagaaaaaaattgtttaaatagcaccataaattcagttatacaaggcacacctcaagtaatcagtaggcctcatttggcc

SEQ ID NO: 8312 - DNA, 201 bp, Homo sapiens
catgcataataaagcttttccaatatttaggaatagttccatagaagagatgctcagaaatgaaattactaggccaaaggtgaatgaaaaatgtcaacagwttttgatgcatattaccaaactgctttccaaaaaccattaccaatttataatcccagtagggtatcaatgccacacccttaccaaatgtaggaaaagaaa

SEQ ID NO: 8313 - DNA, 201 bp, Homo sapiens
ctagtttatatttaattttaatccatcatgattgctgtattatctgatgtatgcttccccttatggctagtcagttgcccagacacagctataatgtgcawcaggtactctaaaatgatagaaatgacagtctttgatggcttggcaccaggcacagtggctcatgcctgtaatcccagcaatttgggaggctgagatggg

SEQ ID NO: 8314 - DNA, 201 bp, Homo sapiens
ccacgaggcggaggttgcagtgagccgagatcgcaccactgcactgcagcctggacgacagagcaagactctgtctcaaaaaaaaaaaaaaaaaaaaaaaraaaagaaaagaaacgcgtcttcgggaggctcaatatcaccaatggaagtatgtgtaacagtgtagtggcagatacattgattagaaccactgttctagca

SEQ ID NO: 8315 - DNA, 201 bp, Homo sapiens
ggcggaggttgcagtgagccgagatcgcaccactgcactgcagcctggacgacagagcaagactctgtctcaaaaaaaaaaaaaaaaaaaaaaaaaaaagraaagaaacgcgtcttcgggaggctcaatatcaccaatggaagtatgtgtaacagtgtagtggcagatacattgattagaaccactgttctagcataaaac

SEQ ID NO: 8316 - DNA, 201 bp, Homo sapiens
ggttgcagtgagccgagatcgcaccactgcactgcagcctggacgacagagcaagactctgtctcaaaaaaaaaaaaaaaaaaaaaaaaaaaagaaaagawacgcgtcttcgggaggctcaatatcaccaatggaagtatgtgtaacagtgtagtggcagatacattgattagaaccactgttctagcataaaacttccct

SEQ ID NO: 8317 - DNA, 201 bp, Homo sapiens
acataacataacataacataattagctgggtgaggtggcgtgggcctgtattcccagcacctcggcaggctgaggtgagggatcacttgcactagggaggsggaggttgcagtgagctgagatcgtgccactgcactcagatctgggtgacagagtgagaccttgtttcaaaataataataataattgcaggactgtggtt

SEQ ID NO: 8318 - DNA, 201 bp, Homo sapiens
ccctacgtagtagcgcaggtagaaatcgctagccacagccatttttgtacccgggaagcccgccgaaaacgcagccaacgtgtcccccggcgccttgcagkgacgtcatcgcgcggaataagtgcgtcaccacaggcgcttctcttcctcctgcagtgcagccctagactaaagcgtgaaagccgagtatcgcgtgagagt

SEQ ID NO: 8319 - DNA, 201 bp, Homo sapiens
aggcggaggttgcagtgagctgagatcgtgccactgcactcagatctgggtgacagagtgagaccttgtttcaaaataataataataattgcaggactgtrgttaacgtgagttctgcctgaaatgcttgatactcttctcctttcctaatatacgttccttctctaattttttattcttgctctcacagaacattgtcca

SEQ ID NO: 8320 - DNA, 201 bp, Homo sapiens
catgattgctgtattatctgatgtatgcttccccttatggctagtcagttgcccagacacagctataatgtgcaacaggtactctaaaatgatagaaatgmcagtctttgatggcttggcaccaggcacagtggctcatgcctgtaatcccagcaatttgggaggctgagatgggtggatcacctgaggtcagcagttaga

SEQ ID NO: 8321 - DNA, 201 bp, Homo sapiens
gttagctagtttatatttaattttaatccatcatgattgctgtattatctgatgtatgcttccccttatggctagtcagttgcccagacacagctataatrtgcaacaggtactctaaaatgatagaaatgacagtctttgatggcttggcaccaggcacagtggctcatgcctgtaatcccagcaatttgggaggctgag

SEQ ID NO: 8322 - DNA, 201 bp, Homo sapiens
attttagaattatgactaggaagcatacaaacgatgcttctggatcaaagttgatgagtttgttagctagtttatatttaattttaatccatcatgattgytgtattatctgatgtatgcttccccttatggctagtcagttgcccagacacagctataatgtgcaacaggtactctaaaatgatagaaatgacagtcttt

SEQ ID NO: 8323 - DNA, 201 bp, Homo sapiens
tgggatgaggtgcagacagtacttggaaaaagtctgattatttcaagtggtctctttattaaggaaggaggtaaaaggaacataacctgagcgcaataaawatctagtttcatataaaactagtattatacaaaattcagtttctaatgatcactgtccatcagcaacttacaatcaaataaaagacagatcaaagtataa

SEQ ID NO: 8324 - DNA, 100 bp, Homo sapiens
gggtacaaaaatggctgtggctagcgatttctacctgcgctactacgtarggcacaagggcaagtttgggcacgagtttctggagttcgaatttcggccg

SEQ ID NO: 8325 - DNA, 201 bp, Homo sapiens
aaaccaacctaatgtagatgttcctagtgtgctgtaattactgtatagatttttccctatattgtttatctgcaggcctaaaaccaataattaaaaagctrtatctgtaatgaatcttcaagttaacagacactattgaagacaatcctagctatttatttaatcagaggcctaattatgcagtttatgacacacacagaa

SEQ ID NO: 8326 - DNA, 201 bp, Homo sapiens
cactactaggaggtagcacagaaaaacagaactaagagataaaattaaagagaatttaccaggtgcctattaaatagaaagccaaagaatcaacttagacwcattccaaataaataacgggaaacaaaatagtattatcaatttttaatatttatacacttaaagaatcactaaatacaaacctgtcggccaaccctatca

SEQ ID NO: 8327 - DNA, 201 bp, Homo sapiens
agcgtcgtggccgggggcagggcggcggggtaggttgttcctgaggtgggaggcggtacccgtggctgagaagaaggaggcctgagagcgacatgtccccrgcggctcaggcggagcggcccgtggcgctgtttttctgagtccggggtggcctggcagccggccgaggacgagggtcggcgggggctgcccccgtggtgg

SEQ ID NO: 8328 - DNA, 201 bp, Homo sapiens; identical to SEQ ID NO: 1151

SEQ ID NO: 8329 - DNA, 201 bp, Homo sapiens; identical to SEQ ID NO: 1158

SEQ ID NO: 8330 - DNA, 201 bp, Homo sapiens; identical to SEQ ID NO: 1160

SEQ ID NO: 8331 - DNA, 201 bp, Homo sapiens; identical to SEQ ID NO: 1161

SEQ ID NO: 8332 - DNA, 201 bp, Homo sapiens; identical to SEQ ID NO: 1162

SEQ ID NO: 8333 - DNA, 201 bp, Homo sapiens; identical to SEQ ID NO: 1164

SEQ ID NO: 8334 - DNA, 201 bp, Homo sapiens; identical to SEQ ID NO: 1165

SEQ ID NO: 8335 - DNA, 201 bp, Homo sapiens; identical to SEQ ID NO: 1166

SEQ ID NO: 8336 - DNA, 201 bp, Homo sapiens; identical to SEQ ID NO: 1167

SEQ ID NO: 8337 - DNA, 201 bp, Homo sapiens; identical to SEQ ID NO: 1168

SEQ ID NO: 8338 - DNA, 201 bp, Homo sapiens; identical to SEQ ID NO: 1169

SEQ ID NO: 8339 - DNA, 201 bp, Homo sapiens
ctttccttctgggctgtctccatctgaccctaccccttccatgtcccaccccactcccaccaaaaagtacaaaatcaggatgtttttcactgtccattgckttgtgttttaataaacaatttgcagtgacactctgtgttgggactgagttcgaacttgatctcaaagcgctgaagtgatggggtgggaaaaaggagaccc

SEQ ID NO: 8340 - DNA, 201 bp, Homo sapiens; identical to SEQ ID NO: 1155

SEQ ID NO: 8341 - DNA, 201 bp, Homo sapiens; identical to SEQ ID NO: 1154

SEQ ID NO: 8342 - DNA, 201 bp, Homo sapiens
atggctgggacagtggatggtaggttgtgttctgacctgcttttttgacttgagtggagggatatggttgaggaagcccttgggaggtaattgagctgatsactattttggaaacacttaaagctaaattgtaggggattcagaatcagttggataaggatgaagcataacatggtactagccacaagctttggagtcagg

SEQ ID NO: 8343 - DNA, 201 bp, Homo sapiens
catcaaagaggagggggactacgtgctggtcttgaaatttgcagaggtctactttgcacagtcccagcaaaaggtgaggcctagtcaggctgctgcttgaycagtaggacattgctgctcttggacaatccacgattatggggctagagagtgtgagagtctctccagaaaggcagaacagatgagctctagagaagcatg

SEQ ID NO: 8344 - DNA, 201 bp, Homo sapiens
ggttattagcattgccctggaaatgcctctggctgttctggggtctttgcttttcttttgtgtcttgcctctgatgtgctttctctttgtcttttgtcctyagcctcagactatggcatgaaactgccaatcctgcgttccaaccctgaggaccagatcctgtatcaaactgagcggtacaatgaggagacctttggctac

SEQ ID NO: 8345 - DNA, 201 bp, Homo sapiens
agagcgaaactccgtctccaaaaaacaaaaacaaaaacaaaaaaacaattccccacccatgcacaaaattttctgtgtatccgtaaatcaaatgtagtcgrtgttccagatttgtaatgatcacagtcctcatggaagaaggaaattcttagagctcagttggaagagaaacagcagtctttcagtcttcataggtttgta

SEQ ID NO: 8346 - DNA, 201 bp, Homo sapiens
gtgaccaggagatctgagggtagggtgggagtgacgctagagcaccaaggggggctttacagctgtgttctcatggaggacaggcttctgctcattctggytttcccactcttgtggttcccagttgcagttttccagttagttttattacttccttttcttttgatccattccctaaactgccttgagtggaggcatttg

SEQ ID NO: 8347 - DNA, 201 bp, Homo sapiens
tactggcctcactggagaaagaagtgatccagaagaacagtctagtgaccaggagatctgagggtagggtgggagtgacgctagagcaccaaggggggctytacagctgtgttctcatggaggacaggcttctgctcattctggctttcccactcttgtggttcccagttgcagttttccagttagttttattacttcctt

SEQ ID NO: 8348 - DNA, 201 bp, Homo sapiens
gtcactgctacctctgatttgctcaaagccatgggagttgtttagaattctctacctctactgtcacctaacaggcaggcttcatctgcaggccttccaartagtggaagttcacaggtagaaaatttaggtccctgaatccgtgggttcgctgtctcagcccattcagaacaattctttaggtactggcctcactggaga

SEQ ID NO: 8349 - DNA, 201 bp, Homo sapiens
tcctttcacctggggaaggatttggctttggggaggtaagagcttgaaacatgggatgagagaggagtcactgctacctctgatttgctcaaagccatggsagttgtttagaattctctacctctactgtcacctaacaggcaggcttcatctgcaggccttccaaatagtggaagttcacaggtagaaaatttaggtccc

SEQ ID NO: 8350 - DNA, 201 bp, Homo sapiens
gcatgaaccatcacgcctgaccatgttccagatttgtaacttggtcattttgagttcctcttcactctgactaggaaaagacctggttatttgacctgagrgcacagaattttgcttgagtttagggaaggctatttcctcttcagagaaagatacctgctaaagtcgcaggtcctcgagaaacttgctttacgtctctga

SEQ ID NO: 8351 - DNA, 201 bp, Homo sapiens
aatctgggtaagaattggagcagtattaaggcatggatggggagtgggaggtggcgcttgtcagctgcagtttggaccagcttgttgcaacattgcgcttrccaggttcctgagaaaggcattttgctggctttaggtcgggctgagatgcgcataagcttgcactctcaggaggcagctctctactaaggagtcagtcct

SEQ ID NO: 8352 - DNA, 201 bp, Homo sapiens
ctaggagattgatactgtatgctgggttcagaggctaccaaattggcagtatgccacctccagacaaccaggagacagactcactcttcactttctctcaytctttttctgcgatgcccagatttggctcttgcttttactaaaatagttagttcttcccaagtcgattgcagtgtcctggagtttgttatattaaggagt

SEQ ID NO: 8353 - DNA, 201 bp, Homo sapiens; identical to SEQ ID NO: 1150

SEQ ID NO: 8354 - DNA, 201 bp, Homo sapiens
tctgttgtgcagagaataaagccgagtaagaccacacaggtttagttcccagatactgcccttattcagaaattctggttttaatttgctgatgcaggtgktgtgtgtgtgtgtgtgtgtgtgtgtgtttctttggcttggtcagcagtcagccaagatctgtgtccttgggttattggctcatggttgcagttccttgga

SEQ ID NO: 8355 - DNA, 201 bp, Homo sapiens
ttaagtaatttttgttcacatggttgagttttcttcactgtgggactgagactgccgcagattacgttactgtcagttcctcactttttccacttggcaaraaaaaaaaaaagattcggcctggtgtggtggctcacgcctataatcctagcactttgggaggccgatgcgggcagatcacctgaggttggagttggagac

SEQ ID NO: 8356 - DNA, 201 bp, Homo sapiens; identical to SEQ ID NO: 1152

SEQ ID NO: 8357 - DNA, 201 bp, Homo sapiens; identical to SEQ ID NO: 1163

SEQ ID NO: 8358 - DNA, 201 bp, Homo sapiens; identical to SEQ ID NO: 1157

SEQ ID NO: 8359 - DNA, 201 bp, Homo sapiens; identical to SEQ ID NO: 1153

SEQ ID NO: 8360 - DNA, 201 bp, Homo sapiens; identical to SEQ ID NO: 1156

SEQ ID NO: 8361 - DNA, 201 bp, Homo sapiens
agataccaggccttacattggttacatcgtcctattcagtctgttgtgcagagaataaagccgagtaagaccacacaggtttagttcccagatactgcccytattcagaaattctggttttaatttgctgatgcaggtggtgtgtgtgtgtgtgtgtgtgtgtgtgtttctttggcttggtcagcagtcagccaagatctg

SEQ ID NO: 8362 - DNA, 201 bp, Homo sapiens
acatggaattaaaaatagggcagaacatagctccagaggggaaaaaagttggttggggaccagagcctatcaggttgctaatgctgtaaccttaaggaatrccctttcctgggctgccttcctttcacctggggaaggatttggctttggggaggtaagagcttgaaacatgggatgagagaggagtcactgctacctctg

SEQ ID NO: 8363 - DNA, 201 bp, Homo sapiens
aatctttgtttcttctgttggagggattggaaaacaggtttcagaaggaagttctttgctaggagattgatactgtatgctgggttcagaggctaccaaaytggcagtatgccacctccagacaaccaggagacagactcactcttcactttctctcattctttttctgcgatgcccagatttggctcttgcttttactaa

SEQ ID NO: 8364 - DNA, 201 bp, Homo sapiens
gcctttcacacatgtgagggtcttgggacacagggctgttttgtgaagttctatgtttgtcttggagtttgttgagccctggcatgtagatcacagtagcmtgggttcagctgactcagggctccagtctttagcagcggtaacagcagccaaagccagactttatagcaggaggtcattactatctctatcctggaccct

SEQ ID NO: 8365 - DNA, 201 bp, Homo sapiens
tgttgcccaggctggtcttgaacttctgtcctcaagtgatcttcccaccttggcctcccaaactgctgggattacaggcatgaaccatcacgcctgaccawgttccagatttgtaacttggtcattttgagttcctcttcactctgactaggaaaagacctggttatttgacctgagggcacagaattttgcttgagttta

SEQ ID NO: 8366 - DNA, 201 bp, Homo sapiens
gaaatagaaagaaaaaagtctgaagacaaaagtgcaatgagtttcctcttccattgtctcatcagtccctctgatctcgtggctaatgtcacttacaggamctgttaacagttatgtttatttttttgaggtcttgacctcaaccactgggtctttttgttaatcttttaccttttgccatgtcttctcccttgttgatga

SEQ ID NO: 8367 - DNA, 201 bp, Homo sapiens
ggtgactttttttttctgctgttggtttatctgagtgaatgttcaagtaagtaggtgaggtggagttttgtgagtctgtgggaaggaaggaaattagcatyacacctttcttttatgagcctgtttttgtttacagctttggaactttttgaatgaaaattataaaaaaaacacacaacaactaaagctggaattttattc

SEQ ID NO: 8368 - DNA, 201 bp, Homo sapiens
gataaggatgaagcataacatggtactagccacaagctttggagtcaggtctatgtatatcttgttgctgccatttaatcagatgtttgtcttggatggawgcttttaatttccctataaattgggattaataatggtacctattggtgtaccctgacctttgtagtcatttgggatcacctaaaacttgtccttattctg

SEQ ID NO: 8369 - DNA, 201 bp, Homo sapiens; identical to SEQ ID NO: 1159

SEQ ID NO: 8370 - DNA, 100 bp, Homo sapiens
tgtgaacgaaaggaaggaacatctttctatggctaacaaaaactaaaggrgaagtgaggaaacaggaagaagtatggtgggggctggggtagactcccct

SEQ ID NO: 8371 - DNA, 100 bp, Homo sapiens
gtttccaagcccacccttttcccctgagctcagggttagggatgggcgcyttcctctctggttgtgaacgaaaggaaggaacatctttctatggctaaca

SEQ ID NO: 8372 - DNA, 100 bp, Homo sapiens
aaggaaaccctgactcctggggccatttcctaatggtactgtaagccaarcagctttgcttctgcctctgtttccaagcccacccttttcccctgagctc

SEQ ID NO: 8373 - DNA, 100 bp, Homo sapiens
ggaggccaaaccaactctttgccagcagccacaacatgcattgacagcgkcacagtgagatataactgatgggctttgaacctggttggccggggaagct

SEQ ID NO: 8374 - DNA, 100 bp, Homo sapiens
caggtaataagatggcatttccctgctgttaatttctaacctaaaaaaargaacagtgactcctctgagttcagagtcctttccactaggtatacaaatg

SEQ ID NO: 8375 - DNA, 201 bp, Homo sapiens
ggggtgccctgcctgcgcacctgccggaacccccgtggagactgcctgcgggacgtccggggcctggaaggtgggctggggccggtcgggaggggtggccwgggctccgccgcctgtggccttctcctggcccctcgaggagcctctgtggccccagcttccagcacattctggtgctgtcggcgaggcccgctgcttggg

SEQ ID NO: 8376 - DNA, 201 bp, Homo sapiens
ggagtgcacctacaaagctgagggtgagcggccggcagcccctggggctggggtccgggggtctctgtctgcgcccagcctctgacgggcctgggccctcygtccccatagcctgtgtctgcacctacaatggacagcgcttccacccaggggacgtcatctaccacacgacggatggcacgggtggctgcatctccgccc

SEQ ID NO: 8377 - DNA, 201 bp, Homo sapiens
ccccagtctgggggtgcaatgcagttcccagggaactccacccctgtcggagctgctccctgcccgccgttggtagcatgggatgcccgtggaaggcacamggccgcccccacgcatcggcctgcccttcttccttgtctccagcctttgtacggagcgcggcgtggagtgcacctacaaagctgagggtgagcggccggc

SEQ ID NO: 8378 - DNA, 201 bp, Homo sapiens
gggtcctgacgccacctgctccatggggccaggctgaggagatgctcctggagggtctgggctcagacttcagactcacatggacagaggcctcctaggaccccccaacccagcacagagagagcccttgccacgggccacccccacgcactgtggcctcccgtccctctggtgtccatgctgcatctgtggccgcagcct

SEQ ID NO: 8379 - DNA, 201 bp, Homo sapiens
gaggcccctgtcctgggccgctgaggctggctgaggatcctgtcctgggccccctgaggctggctgaggcccctctcctgggcccctgaggctggttgagratcctgtcctgagccccctgaggctggctgatgcccctgtcccgggcccctgaggctggctgaggcccctgtcctgggcccctgaggctggctgaggatc

SEQ ID NO: 8380 - DNA, 201 bp, Homo sapiens
gccgctgaggctggctgaggatcctgtcctgggccccctgaggctggctgaggcccctctcctgggcccctgaggctggttgaggatcctgtcctgagccycctgaggctggctgatgcccctgtcccgggcccctgaggctggctgaggcccctgtcctgggcccctgaggctggctgaggatcctgtcctgggccccct

SEQ ID NO: 8381 - DNA, 201 bp, Homo sapiens
gtcctggccccctgaggctggctgaggcccctgtcccgggcccctgaggctggctgatgcccctgtcccgggcccctgaggctggctgaggcccccgtccygggcccctggagctggctgaggccccagctcgctgtggggccgccatgttgttcccctgcaacgcccactgcgtggacacagcaggcgcccgtcataggc

SEQ ID NO: 8382 - DNA, 201 bp, Homo sapiens
acacagtctccctatggtgagaccctgcacccaacatacagtctctgcacgatgagaccctgcacccaacacacagtctcccacgatgagaccctgcaccmaacacacagtctccctatggtgagaccctgcacccgacacacagtctctccacaatgagaccctgcacccgacacacagtctctgcacgatgagagcctg

SEQ ID NO: 8383 - DNA, 201 bp, Homo sapiens
agaccctgcacccaacacacagtctcccacgatgagaccctgcaccaaacacacagtctccctatggtgagaccctgcacccgacacacagtctctccacratgagaccctgcacccgacacacagtctctgcacgatgagagcctgcacccaacacacagtctcccacgatgagaccctacacccaacacacagtctctc

SEQ ID NO: 8384 - DNA, 201 bp, Homo sapiens
caccaaacacacagtctccctatggtgagaccctgcacccgacacacagtctctccacaatgagaccctgcacccgacacacagtctctgcacgatgagascctgcacccaacacacagtctcccacgatgagaccctacacccaacacacagtctctccacgatgagaccctgcacccaacacacagtctctccacgatg

SEQ ID NO: 8385 - DNA, 201 bp, Homo sapiens
catccactcattcactcactcactcatccactcactcacttattccctcattcattccttcactcattggttaaccatgtttatggcatttttcttgcacytccagccctacactaggcccaggggctaaacttcaggggtttgttgcccacctggccccaggggccaaatgagaattaggccaaggctgagctgatgtgc

SEQ ID NO: 8386 - DNA, 201 bp, Homo sapiens
cctgctaccacagaggctccatgatccccaatggggagtcggtgcacgacagcggggctatctggtaagagctcccgctgtggactgggggggtccctcgygtctcctggcccaggctgaggctctgaccaccatctcctcacagcacctgcacacatgggaagctgagctgcatcggaggccaagcccccgccccaggtg

SEQ ID NO: 8387 - DNA, 201 bp, Homo sapiens
gcacctgcacacatgggaagctgagctgcatcggaggccaagcccccgccccaggtgagtgccagaaaggaggcactgtggcccccagcctcctcatctcyataagaaatcctgaaaaatggcttcagggttagccccaccacaagtcagcggggctggtggttgtccatcagctgctcagtgtcaggcatggtttgtgcc

SEQ ID NO: 8388 - DNA, 201 bp, Homo sapiens
cttggggtgcccccagtgtgcacaggttgctctaagggcccccgtcctctgtgctgggcttgagggcaaggagcgcccaggtcagtgtggccttggacccrgccgaggaggggaggggagggtagccgagagggctgggctcactcactgctggctgcccactgccgggctgtgtgtcctgagaatcccctcttcctggca

SEQ ID NO: 8389 - DNA, 201 bp, Homo sapiens
ctccatgatccccaatggggagtcggtgcacgacagcggggctatctggtaagagctcccgctgtggactgggggggtccctcgcgtctcctggcccaggstgaggctctgaccaccatctcctcacagcacctgcacacatgggaagctgagctgcatcggaggccaagcccccgccccaggtgagtgccagaaaggagg

SEQ ID NO: 8390 - DNA, 201 bp, Homo sapiens
tccacagactgcaccaactggtaggtcccagcccccctccaggcccccaggatgtgctatgggacagacctgctgggggttgcgacccaggccggcaggcwccctcgtctgggctacggtgtaggcaggcctggggtgagacccggtcagcctcctgacgcggaggctggaggctggtctcctggggccggcacccacgtg

SEQ ID NO: 8391 - DNA, 201 bp, Homo sapiens
ccccaggggccacctactccacagactgcaccaactggtaggtcccagcccccctccaggcccccaggatgtgctatgggacagacctgctgggggttgcracccaggccggcaggcaccctcgtctgggctacggtgtaggcaggcctggggtgagacccggtcagcctcctgacgcggaggctggaggctggtctcctg

SEQ ID NO: 8392 - DNA, 201 bp, Homo sapiens
gcagggagggcaggggcaggcagacgtgagccctctctctgcctcccgcagcccagaagtgccccaacaacatgcagtaccacgagtgccgctccccctgygcagacacctgctccaaccaggagcactcccgggcctgtgaggaccactgtgtggccggctgcttctgccctgagggtgaggctcccccgcccctgggaa

SEQ ID NO: 8393 - DNA, 201 bp, Homo sapiens
ggagccaccgatggcccttctaaccccaccccagggacccggccctgggggctctgctgctcgggtgctgggctgacgggtaccgggacctgcaggcagascccgcctctgtgcttgccgcagacaccaagctgacacccatggaattcgggaacctgcagaagatggacgaccccacggagcagtgtcaggaccctgtcc

SEQ ID NO: 8394 - DNA, 201 bp, Homo sapiens
gcccattgggccccttgctctgtgtggctgctctgggtggcgacccctgactgcacgccctctcctgaaatgacagacctgcctccttcttggtctttgartctctgccaccaggcagtggccttgcaaatgtgacctgcaccagccaaggccccactccctgcctcctcctgccaggcccatgaagccccatacaagccc

SEQ ID NO: 8395 - DNA, 201 bp, Homo sapiens
cacaccctctgacactccgggcacacacatgcacagatacacggatgcagctgccctccctcctagcacagcacacacgtgcacacacgcgatcccgcaaygccggcctgtctcaggagtgcaggcagggagcaaatcgcccattgggccccttgctctgtgtggctgctctgggtggcgacccctgactgcacgccctct

SEQ ID NO: 8396 - DNA, 201 bp, Homo sapiens
ctcctctcccacagtaaggccccacatcgccctcagccccttcctcagtgtcccctgggggctcagtgttgtgtgcacacacaccctctgacactccgggmacacacatgcacagatacacggatgcagctgccctccctcctagcacagcacacacgtgcacacacgcgatcccgcaacgccggcctgtctcaggagtgc

SEQ ID NO: 8397 - DNA, 201 bp, Homo sapiens
ggctctgtggggacttcaacgggatgcccgtggtcagcgagctcctctcccacagtaaggccccacatcgccctcagccccttcctcagtgtcccctgggrgctcagtgttgtgtgcacacacaccctctgacactccgggcacacacatgcacagatacacggatgcagctgccctccctcctagcacagcacacacgtg

SEQ ID NO: 8398 - DNA, 201 bp, Homo sapiens
ggtgtctgatgtctctccctttgcagctggagctggacaccaaatacgccaacaagacctgtgggctctgtggggacttcaacgggatgcccgtggtcagsgagctcctctcccacagtaaggccccacatcgccctcagccccttcctcagtgtcccctgggggctcagtgttgtgtgcacacacaccctctgacactcc

SEQ ID NO: 8399 - DNA, 201 bp, Homo sapiens
ctgtcttcccatctctgaggaccatccctgtggtacgaggtgagtggagcccggaggcctgggtggggaagggtcatagctttgctgagctccccgctcargcctggaggtgccgggtggagagaggccccagctttccgggtgaacactgggtgggtattggagccagagggcccagcatctccctgcacacgtttctgg

SEQ ID NO: 8400 - DNA, 201 bp, Homo sapiens
tgtctgggcctcgatggggatctcctgcggggggaggtctcagcctctgagctgggatgtgatggtgaggcccacaagggaactgtttcaccgcccccctsaggctaagagggtgatgggggaggctccaggtcctgtggtctggactgccccttgctgggccagcaggtcccttcctctgcttctgagggacacctggga

SEQ ID NO: 8401 - DNA, 201 bp, Homo sapiens
ttccctgtctgggcctcgatggggatctcctgcggggggaggtctcagcctctgagctgggatgtgatggtgaggcccacaagggaactgtttcaccgccsccctcaggctaagagggtgatgggggaggctccaggtcctgtggtctggactgccccttgctgggccagcaggtcccttcctctgcttctgagggacacc

SEQ ID NO: 8402 - DNA, 201 bp, Homo sapiens
acgttccctgtctgggcctcgatggggatctcctgcggggggaggtctcagcctctgagctgggatgtgatggtgaggcccacaagggaactgtttcaccscccccctcaggctaagagggtgatgggggaggctccaggtcctgtggtctggactgccccttgctgggccagcaggtcccttcctctgcttctgagggac

SEQ ID NO: 8403 - DNA, 201 bp, Homo sapiens
tcccagtgaggtgccatgcataggcgccggggtcaggacttaggcgggtccttcgaggccacgtcagcttctttttctccaggaggggcttgcctctggcyccggccctcggtgctcagctgcactgcccggggcctccccaggtgtagctggaggtgggaaggaggaagcagcacctgtggtcgctgttggccacctggg

SEQ ID NO: 8404 - DNA, 201 bp, Homo sapiens
ccccatctcccagtgaggtgccatgcataggcgccggggtcaggacttaggcgggtccttcgaggccacgtcagcttctttttctccaggaggggcttgcstctggctccggccctcggtgctcagctgcactgcccggggcctccccaggtgtagctggaggtgggaaggaggaagcagcacctgtggtcgctgttggcc

SEQ ID NO: 8405 - DNA, 201 bp, Homo sapiens
cccaggactcctttcgtgttgtcaccgagaacgtcccctgcggcaccacagggaccacctgctccaaggccatcaagattttcctgggggtgagcgaggcygggtggtcgcatgccctccaggaggctcccatggcagcgtctggtcaggtgggctggggttcttgctgggggccctgagtgaccccttgccatgcagggc

SEQ ID NO: 8406 - DNA, 201 bp, Homo sapiens
catcctccttgcgggaaggagggcagggcctgcctggtccttgatggcctctgcttccccagaaccactgtggcgggaaagacagcacccaggactccttycgtgttgtcaccgagaacgtcccctgcggcaccacagggaccacctgctccaaggccatcaagattttcctgggggtgagcgaggctgggtggtcgcatg

SEQ ID NO: 8407 - DNA, 201 bp, Homo sapiens
cggccactacctcaccttcgacggacagagctacagcttcaacggagactgcgagtacacgctggtgcaggtgagccggcgcgtttggggtcctcacggcrgcccccgtggcccgaagctgctcactgcctctctgcggctgccccagggtgcacacaggttgtccccgcctcatcctccttgcgggaaggagggcagggc

SEQ ID NO: 8408 - DNA, 201 bp, Homo sapiens
caggcaccctgtgtgtgctctagcctgacccccagatgtcccccagcacctgtgacagcaggatgtggcggtgcacagatgacccctgcctggccacctgygccgtgtacggggacggccactacctcaccttcgacggacagagctacagcttcaacggagactgcgagtacacgctggtgcaggtgagccggcgcgttt

SEQ ID NO: 8409 - DNA, 201 bp, Homo sapiens
tgagctgtccctgggaggacctggcaggccccgtgccctgccccatcactcagtggtgtctgctggccctgcagtacagcccccagtgtgtgcctggctgygtgtgccccgacgggctggtggcggacggcgagggcggctgcatcactgcggaggactgcccctgcgtgcacaatgaggccagctaccgggccggccaga

SEQ ID NO: 8410 - DNA, 201 bp, Homo sapiens
taattggggggtcccgatctggcccaccctcccctgtccccatcttgtgatggccgggaggtgcaggggagggaagcagctttagaacagccctggggtgyggggcctctgcgagtgagttcctgggaccccaccgagcccttccttcctccctgcagctctgttctgcgactactacaaccccgaaggccagtgcgagtg

SEQ ID NO: 8411 - DNA, 201 bp, Homo sapiens
gggtattggagccagagggcccagcatctccctgcacacgtttctgggacttcccagatgcaggaaggacccctgggtgccccgtccagggcagcagcacytcctgcaggaccctggggaggggcaggaggtacagggcagaggcagggggtgcagggcgaggatgagggcgacgcccccaaacaccatgctgcttccacc

SEQ ID NO: 8412 - DNA, 201 bp, Homo sapiens
gcagacgtgagccctctctctgcctcccgcagcccagaagtgccccaacaacatgcagtaccacgagtgccgctccccctgcgcagacacctgctccaacsaggagcactcccgggcctgtgaggaccactgtgtggccggctgcttctgccctgagggtgaggctcccccgcccctgggaaacacaggtgcaccccgaca

SEQ ID NO: 8413 - DNA, 201 bp, Homo sapiens
cacgcccggggacacaggggctggctgtcagaagagctgccacacactggacatgacctgtgtaagtccctgaggactccccaatgacagaccctccatcygcccctgcctgctaagggcgcctgtccccagggtgggcagtggtgagcctctgacacattaggccatgggctgccccacgtcccagaggacccctgccca

SEQ ID NO: 8414 - DNA, 201 bp, Homo sapiens
gactgcaccaactggtaggtcccagcccccctccaggcccccaggatgtgctatgggacagacctgctgggggttgcgacccaggccggcaggcaccctcrtctgggctacggtgtaggcaggcctggggtgagacccggtcagcctcctgacgcggaggctggaggctggtctcctggggccggcacccacgtggcacca

SEQ ID NO: 8415 - DNA, 201 bp, Homo sapiens
gggacagacctgctgggggttgcgacccaggccggcaggcaccctcgtctgggctacggtgtaggcaggcctggggtgagacccggtcagcctcctgacgyggaggctggaggctggtctcctggggccggcacccacgtggcaccatctcttgctctcagcacctgctccggaggccggtggagctgccaggaggttcca

SEQ ID NO: 8416 - DNA, 201 bp, Homo sapiens
ctggggtgagacccggtcagcctcctgacgcggaggctggaggctggtctcctggggccggcacccacgtggcaccatctcttgctctcagcacctgctcyggaggccggtggagctgccaggaggttccatgcccgggtacctgctctgtgcttggaggtgcccacttctcaacgtttgacgggaagcaatacacggtgc

SEQ ID NO: 8417 - DNA, 201 bp, Homo sapiens
gggacagggcactcttccccgccgtccacacaatgagtgttggccggaggaagctggccctgctctgggccctggctctcgctctggcctgcacccggcayacaggtacggcttggcccctggccgctctactggtcctgggtggtgcggtactgagtgggcctcaggcagctcagtctttgccctgggttccgggcaggc

SEQ ID NO: 8418 - DNA, 201 bp, Homo sapiens
gggggtgtcccggtgtgcaactccagccctcgagggccggcctgctcccacagcctctccggagagggtagaaggtgccctgggcccagtcagggtcagaytccaccccacacagcaggcaagaacaggtgcccagacaccaatggtgtcccggggtctgtgcccccaggatggagactgctttcgggggtgtctcttccg

SEQ ID NO: 8419 - DNA, 201 bp, Homo sapiens
gtgcccagacaccaatggtgtcccggggtctgtgcccccaggatggagactgctttcgggggtgtctcttccgtgggcctcggcccctcctcggaaatctyaggctcgagcctcatctgtccatctgcccctggtggggatgggtgtctgatgtctctccctttgcagctggagctggacaccaaatacgccaacaagacc

SEQ ID NO: 8420 - DNA, 201 bp, Homo sapiens
tgggagccacttccctaaaactcagtcggttcgcctggctcttcagaacctgtgccgctcatgtgggttctgagcagggaccgcgggtggggacaggaagwcagacctgctggcgcagctccagaccggtgacagagccgcagggaggggcggggcggcccccaagtgcgggcctctcatgctcagctgccttctcttctg

SEQ ID NO: 8421 - DNA, 201 bp, Homo sapiens
gtcctgccctcagcagcccccgggcctggcctcatgggggtgtcaggggtctggcagcccaggctggccccggggatgcatggctatcacttgcctcacamtgctcagggctcaggtacccccatgtcctcgccctcttctgggggatgtctcagggccccaaggcatcatctgagcttctctgagagtagaaagctctgg

SEQ ID NO: 8422 - DNA, 201 bp, Homo sapiens
aacggcaccattgagaggagggtctacccctgcagccccaccacccctgtccccccaaccaccttctccttctccacacccccgcttggtaaggcaaatgyggccgaggagccccagggtgagcccctcccactgcctggcacagctgcccttgctggacgctgaggtcacagcagctctgggcatgggcggcagcccctg

SEQ ID NO: 8423 - DNA, 201 bp, Homo sapiens
cagtggggaagtgttcctgaaccagatctacacccagctgcccatctctgcaggtgagggcagtggcttcttccccaccccggggctgcctggggtcccgmcccacagcccccagcaaaacccttgtcctttgtgtccccagccaacgtcaccatcttcagaccctcaaccttcttcatcatcgcccagaccagcctgggc

SEQ ID NO: 8424 - DNA, 201 bp, Homo sapiens
ccatgcagctgttcatgcagctggcgcccaagctccgtgggcagacctgcggtaagagggctgccttctgggcttggagcccacccactctggccagggcrcatggtcctcaacctgcctaacccgcccccaggtctctgtgggaacttcaacagcatccaggccgatgacttccggaccctcagtggggtggtggaggcc

SEQ ID NO: 8425 - DNA, 201 bp, Homo sapiens
gctctccccctcctgcccagatgccctggcgcccaaggacccctgcacggccaaccccttccgcaagtcctgggcccagaagcagtgcagcatcctccacrgccccaccttcgccgcctgccacgcacacgtatgctggccggggggcgtttctctgggcccaagggggtcatggtgacccaaggagcccccagaagggag

SEQ ID NO: 8426 - DNA, 201 bp, Homo sapiens
ggagtggggttttctagtgagggagaggagcacagccgggtggactggcagggccaggtgggctgggcgttggatggagtgtgaggacccctggtgtgtcrtgttccgcagccctgtgacagcagtgccttcactgtactggctgagctgcgcaggtgcgggctgacggacagcgagacctgcctgaagagcgtgacactg

SEQ ID NO: 8427 - DNA, 201 bp, Homo sapiens
ccgcctgccccaacatcaggaacagcttcgaggacccctgctctctgagcgtggagaatggtacgggtgtccacggctcgcctctgtgctggccgcctggygctggttcacccgcttccatttggcactgcaggcagcgaggctggccctgcgtgtgcctgtgagccgggtggggtggctcacgaaggggcccaaggacag

SEQ ID NO: 8428 - DNA, 201 bp, Homo sapiens
tgtactggctgagctgcgcaggtgcgggctgacggacagcgagacctgcctgaagagcgtgacactgagcctggatggggtgcagacggtgagtggagcckggcagggcaaaccccgggaagagggaaggggcctgtctcttctgcaagtcacctctgcccaagcccttcatccctggcatgaacagcgagaggcggggac

SEQ ID NO: 8429 - DNA, 201 bp, Homo sapiens
ctggctgcgtgtgccccgacgggctggtggcggacggcgagggcggctgcatcactgcggaggactgcccctgcgtgcacaatgaggccagctaccgggcyggccagaccatccgggtgggctgcaacacctggtatgccgggggctcaaagcccatggggggtgtcaggcccaggaaaccagaggccctccttaaagacg

SEQ ID NO: 8430 - DNA, 201 bp, Homo sapiens
tggagaatggtacgggtgtccacggctcgcctctgtgctggccgcctggcgctggttcacccgcttccatttggcactgcaggcagcgaggctggccctgygtgtgcctgtgagccgggtggggtggctcacgaaggggcccaaggacaggctcatggtgggcgcccaccccagcttatgtggagcttcaggaatgtgggg

SEQ ID NO: 8431 - DNA, 201 bp, Homo sapiens
tctgagcgtggagaatggtacgggtgtccacggctcgcctctgtgctggccgcctggcgctggttcacccgcttccatttggcactgcaggcagcgaggcyggccctgcgtgtgcctgtgagccgggtggggtggctcacgaaggggcccaaggacaggctcatggtgggcgcccaccccagcttatgtggagcttcagga

SEQ ID NO: 8432 - DNA, 201 bp, Homo sapiens
ccactgtggtgtgggtgagctgtccctgggaggacctggcaggccccgtgccctgccccatcactcagtggtgtctgctggccctgcagtacagcccccartgtgtgcctggctgcgtgtgccccgacgggctggtggcggacggcgagggcggctgcatcactgcggaggactgcccctgcgtgcacaatgaggccagct

SEQ ID NO: 8433 - DNA, 201 bp, Homo sapiens
ccagcctcccacaggctcccccagcttggctgcatgtcactgctgcccctggggtcacccttgggggtccccgatgttgagacctcaaggaagcactccasctccccagcgctagtcctcacagggccatgaaggctgcagatcagagcctccagcacccacccagcattgggcctcacccagcactgggccctctgcacc

SEQ ID NO: 8434 - DNA, 201 bp, Homo sapiens
cccctcctgggatccccaggctcttattctgccccttcctagctcctcgtgacccccgagctccagaggtcaatgtccccatcccagacgcgacttcacgrtcacgatgaccgtgtcacatttgcgaccgcaggcatctgccctgcctggggtctctcctcactgcgctcccagcccctcagccctgccttcctccacagg

SEQ ID NO: 8435 - DNA, 201 bp, Homo sapiens
tccctgtggtacgaggtgagtggagcccggaggcctgggtggggaagggtcatagctttgctgagctccccgctcaggcctggaggtgccgggtggagagrggccccagctttccgggtgaacactgggtgggtattggagccagagggcccagcatctccctgcacacgtttctgggacttcccagatgcaggaaggacc

SEQ ID NO: 8436 - DNA, 201 bp, Homo sapiens
ctgctgactctggaacgtctcctctggctgcggagcccccgccccacgtggggccgtgcgtgaatcctaccagcccctgtctccgcaggggtcccgctccrtggggcgactgtcttcccatctctgaggaccatccctgtggtacgaggtgagtggagcccggaggcctgggtggggaagggtcatagctttgctgagctc

SEQ ID NO: 8437 - DNA, 201 bp, Homo sapiens
gctgggacctgctgactctggaacgtctcctctggctgcggagcccccgccccacgtggggccgtgcgtgaatcctaccagcccctgtctccgcaggggtyccgctccgtggggcgactgtcttcccatctctgaggaccatccctgtggtacgaggtgagtggagcccggaggcctgggtggggaagggtcatagctttg

SEQ ID NO: 8438 - DNA, 201 bp, Homo sapiens
gagctgggacctgctgactctggaacgtctcctctggctgcggagcccccgccccacgtggggccgtgcgtgaatcctaccagcccctgtctccgcagggktcccgctccgtggggcgactgtcttcccatctctgaggaccatccctgtggtacgaggtgagtggagcccggaggcctgggtggggaagggtcatagctt

SEQ ID NO: 8439 - DNA, 201 bp, Homo sapiens
caccctgccctctctcctatcgcccgggggcccagcggtgagtctgagtgtccggcccccaccctaagcctgtcagattccaccctccaccgtgtggcacrgcccctagggccactggtcttagggtggctccccagctggccactgctgaggaccaaacctggggggacaggaggacacccccacatccatggccctggt

SEQ ID NO: 8440 - DNA, 201 bp, Homo sapiens
cagcagaatccggagttggcttcggagccaggagctgggacctgctgactctggaacgtctcctctggctgcggagcccccgccccacgtggggccgtgcrtgaatcctaccagcccctgtctccgcaggggtcccgctccgtggggcgactgtcttcccatctctgaggaccatccctgtggtacgaggtgagtggagcc

SEQ ID NO: 8441 - DNA, 201 bp, Homo sapiens
gagtgaccccttgccatgcagggcttcgagctgaagctaagccatgggaaggtggaggtgatcgggacggacgagagccaggaggtgccatacaccatccrgcagatgggcatctacctggtggtggacaccgacattggcctggtgctgctgtgggacaagaagaccagcatcttcatcaacctcagccccgagttcaag

SEQ ID NO: 8442 - DNA, 201 bp, Homo sapiens
cctggggggtgttaaccccaagggctgccgaggaagccccaggcactgtggatatccagatgggcccagccggccacttggggatgggcattcgccctccytgagctccactggaactcggccccggtcaatgtgccagcatgggcccggtccccaagagcccgcggggtgggtgggggggtccctggaacctgaagcccc

SEQ ID NO: 8443 - DNA, 201 bp, Homo sapiens
cgagcccttccttcctccctgcagctctgttctgcgactactacaaccccgaaggccagtgcgagtggcactaccagccctgcggggtgccctgcctgcgyacctgccggaacccccgtggagactgcctgcgggacgtccggggcctggaaggtgggctggggccggtcgggaggggtggcctgggctccgccgcctgtg

SEQ ID NO: 8444 - DNA, 201 bp, Homo sapiens
ctacaaccccgaaggccagtgcgagtggcactaccagccctgcggggtgccctgcctgcgcacctgccggaacccccgtggagactgcctgcgggacgtcyggggcctggaaggtgggctggggccggtcgggaggggtggcctgggctccgccgcctgtggccttctcctggcccctcgaggagcctctgtggccccagc

SEQ ID NO: 8445 - DNA, 201 bp, Homo sapiens
cctgaggctgactgaggcccctgtcctgggccgctgaggctggctgaggatcctgtcctgggccccctgaggctggctgaggcccctctcctgggcccctraggctggttgaggatcctgtcctgagccccctgaggctggctgatgcccctgtcccgggcccctgaggctggctgaggcccctgtcctgggcccctgagg

SEQ ID NO: 8446 - DNA, 201 bp, Homo sapiens
gtctctgcacgatgagaccctgcacccaacacacagtctccccaagatgagaccctgcacccaacacacagtctctcccagatgagactctgcacccaacrcagtctccccaagatgagaccttgcactcaacacatagtctcccccgatgagaccctgcacccaacacacagtctcccacaatgagaccctgcacccaat

SEQ ID NO: 8447 - DNA, 201 bp, Homo sapiens
tgtgacagcagtgccttcactgtactggctgagctgcgcaggtgcgggctgacggacagcgagacctgcctgaagagcgtgacactgagcctggatggggygcagacggtgagtggagcctggcagggcaaaccccgggaagagggaaggggcctgtctcttctgcaagtcacctctgcccaagcccttcatccctggcat

SEQ ID NO: 8448 - DNA, 201 bp, Homo sapiens
ttaataaccttggttttcactgaagaatgaaaggcatggtcctcgcagaaaattcagaaaatcaggcgagcacaaggccaccttgtaggagccgcagctgsagggaaaggcctcccaggcacctgcaggcacatttcacagcctccgcggggctgaggtgccgcaagcctgccccgcgctcacacatctgtctggctgccc

SEQ ID NO: 8449 - DNA, 201 bp, Homo sapiens
gggctgggtgggacatgcaggaaacgagagaagcctcggttctggatgttgtaccctgcgtttgggggagcttttcctaggggagggcgccacaccacccrggctgagtgtgtagcaggatgaagggcccaatatcagactgcccagagaagctggcaccccaaaccccacaccagaggccaagctgggtgggatgagtgt

SEQ ID NO: 8450 - DNA, 201 bp, Homo sapiens
gcctcggttctggatgttgtaccctgcgtttgggggagcttttcctaggggagggcgccacaccacccgggctgagtgtgtagcaggatgaagggcccaayatcagactgcccagagaagctggcaccccaaaccccacaccagaggccaagctgggtgggatgagtgtgctgcctgatcttaatcctaaccctatccctc

SEQ ID NO: 8451 - DNA, 201 bp, Homo sapiens
ggaacccagtctgtctgtccagctccattccccacatccccacccacccattcactcattcacacattcaccactcacccacacactcacccattcacctrctcactcacccgttcacccattcactcacccactcactcacccattcacccatttacccactcacccattcactcactcacccactcatccacccattca

SEQ ID NO: 8452 - DNA, 201 bp, Homo sapiens
agaggcagggcaggcaagggcagccagggcagggggcttcaggcaaactctcagattgcatttctccaaatcgggccagacaggcctaatctcagcacctragagattgtcttgagccgctgatgcagactcaggttctgaggcccatgggcatgtgagagctggcagcccctggggacttcttcctggtgacagccggga

SEQ ID NO: 8453 - DNA, 201 bp, Homo sapiens
cagtggctgctctgggactcgcctcgcctggagactgccctgaagcctgggagcctgacgtggagcaggcaggtggccggagaggctgcacccagcacccygcccatccctcccacagggtctttgagccgtgccacactgtgatccccccactgctgttctatgagggctgcgtctttgaccggtgccacatgacggacc

SEQ ID NO: 8454 - DNA, 201 bp, Homo sapiens
tccccccactgctgttctatgagggctgcgtctttgaccggtgccacatgacggacctggatgtggtgtgctccagcctggagctgtacgcggcactctgygcgtcccacgacatctgcatcgattggagaggccggaccggccacatgtgccgtgagtgccaccactgtcctcagggtcccaagtcgcttgtgaggggca

SEQ ID NO: 8455 - DNA, 201 bp, Homo sapiens
gtaagagccacggagctcagaccccctcagccatagggacggagcttcccactgaccctgaggcccaggtagactttggagcaactgccaactccggccgrggccagggactcgagtctctgcagacacagcccactatcaagtgtggctgaggcccgaggtcggccccaggtcccggaaatatggacatctacaccctgg

SEQ ID NO: 8456 - DNA, 201 bp, Homo sapiens
ctacagggaacttgaatgtctttgcaattagtcttcagctgcaaagtcttgagaaggtcactggcgctagtggaggcagcccggccgtcaggagagggccrtgctgtagcccggcgtctctgatcaccctgggcttcccaggcacgtgctttccagacactgggtgtgtggggccgaaggctgaggctgtgctgaggacag

SEQ ID NO: 8457 - DNA, 201 bp, Homo sapiens
cggctacccggctgtgaaggtggctgaccaagatggctgctgccatcactaccagtgccagtgtgagtggagcgccgagcgggacccagggcagccggggyagccactccccacccaggtggaaatgggcggggcagaggagggggcttggctgaagcagaaaagaattgggtgggacagcaggaaggacttcccagcatc

SEQ ID NO: 8458 - DNA, 201 bp, Homo sapiens
ggcagaggagggggcttggctgaagcagaaaagaattgggtgggacagcaggaaggacttcccagcatcaaggcggggccgcatggggccgagcctccccscttaggggtgctgagtgaatccctgtgagcctcggagcagcctggctggagaaggtggaggagtctgtccctgcctcgctccagccttgtcaagcgcccg

SEQ ID NO: 8459 - DNA, 201 bp, Homo sapiens
gcggtgcggaggacgggctctcctgcccgaggtccatcatcctggagtaccaccaggaccgcgtggtgctgacccgcaagccagtccacggggtgatgacraacgaggtgggggcgcgcccggtgtgccgcggagggggtgggggacgcggctttcccggcaagagcctgagcagcggctgaccgcccgcccgcctgcctt

SEQ ID NO: 8460 - DNA, 201 bp, Homo sapiens
cccggtgtgccgcggagggggtgggggacgcggctttcccggcaagagcctgagcagcggctgaccgcccgcccgcctgccttctgacttcccgtcgaccrcgccctgcgtccagatcatcttcaacaacaaggtggtcagccccggcttccggaaaaacggcatcgtggtctcgcgcatcggcgtcaagatgtacgcgac

SEQ ID NO: 8461 - DNA, 201 bp, Homo sapiens
cccaatatgggaccctgcctctcgcccctattgtggtggctgacccccagtaacctcagatctctctccttccagggtgtctggggccccacggagagccrgtgaaggtgagtggaaggcatggcccaagagggcactggggtccaagagcccgaggagggaggctcttgaaacaccggccccagaaatggtcaggtgggg

SEQ ID NO: 8462 - DNA, 201 bp, Homo sapiens
tgcctctcgcccctattgtggtggctgacccccagtaacctcagatctctctccttccagggtgtctggggccccacggagagccggtgaaggtgagtggmaggcatggcccaagagggcactggggtccaagagcccgaggagggaggctcttgaaacaccggccccagaaatggtcaggtggggctcaggggtcggggt

SEQ ID NO: 8463 - DNA, 201 bp, Homo sapiens
ctctgtgggtgggtgctggccccgaggctggctgtgctcttcccttccttgggacgccccttctgcccagccaagactgtggaggtgtgaggtggggggcrcaggccagtcaccccacagcctgcccaccttgcagagctttgtgcccatccctgggccctaccctgcacttttgaagccctactcctgctgggtcctcag

SEQ ID NO: 8464 - DNA, 201 bp, Homo sapiens
gagctttgtgcccatccctgggccctaccctgcacttttgaagccctactcctgctgggtcctcagtgcaggccacacggcctccacacctggctgccccrgcactgcatgagccgggctggctgctgcacccctgggtggagccgctgcggacgctggacctcagtccccttccttgcaggtgggccacaccgtcggcat

SEQ ID NO: 8465 - DNA, 201 bp, Homo sapiens
gccccagcactgcatgagccgggctggctgctgcacccctgggtggagccgctgcggacgctggacctcagtccccttccttgcaggtgggccacaccgtyggcatggactgccaggagtgcacgtgtgaggcggccacgtggacgctgacctgccgacccaagctctgcccgctgccccctgcctgccccctgcccggct

SEQ ID NO: 8466 - DNA, 201 bp, Homo sapiens
gacccccgagcgggctgtctaggcggtccgcaatcctagagaccccagggggtgggccttcgggtgggggcgggggacagactcctaattgcctcactccygcccccgcagcctgcaacaccagccgctgccccgcgcccgtgggctgtcctgagggcgcccgcgcgatcccgacctaccaggagggggcctgctgcccag

SEQ ID NO: 8467 - DNA, 201 bp, Homo sapiens
tcctagagaccccagggggtgggccttcgggtgggggcgggggacagactcctaattgcctcactcctgcccccgcagcctgcaacaccagccgctgcccsgcgcccgtgggctgtcctgagggcgcccgcgcgatcccgacctaccaggagggggcctgctgcccagtccaaaactgcagtgagtggcctggaccaggcc

SEQ ID NO: 8468 - DNA, 201 bp, Homo sapiens
cctagagaccccagggggtgggccttcgggtgggggcgggggacagactcctaattgcctcactcctgcccccgcagcctgcaacaccagccgctgccccrcgcccgtgggctgtcctgagggcgcccgcgcgatcccgacctaccaggagggggcctgctgcccagtccaaaactgcagtgagtggcctggaccaggccc

SEQ ID NO: 8469 - DNA, 201 bp, Homo sapiens
ctagagaccccagggggtgggccttcgggtgggggcgggggacagactcctaattgcctcactcctgcccccgcagcctgcaacaccagccgctgccccgmgcccgtgggctgtcctgagggcgcccgcgcgatcccgacctaccaggagggggcctgctgcccagtccaaaactgcagtgagtggcctggaccaggccct

SEQ ID NO: 8470 - DNA, 201 bp, Homo sapiens
agtgtggctgaggcccgaggtcggccccaggtcccggaaatatggacatctacaccctggcctgcctggctccggggggctccgggggactttgcctctcytggcaccacagcacagccaggcctggatcccacggctctgtcctgagccggctgagtatgtggccctgcagagtgtgtggccttgttgggcaccccatcc

SEQ ID NO: 8471 - DNA, 201 bp, Homo sapiens
tgagtgtctgctgccctggctctccccagcccggcgccgtggtctcctcgagcctgtgcgaaacctgcaggtgtgagctgccgggtggccccccatcggaygcgtttgtggtcagctgtgagacccagatctgcaacacacactgccctgtggtgagcgctcccaccctgccccgaccctgccctggctcttggggggcag

SEQ ID NO: 8472 - DNA, 201 bp, Homo sapiens
aggtcgcctgtgtcaccaacaccagcaagagccccgcccacctcttctacgtgagtagtggctgccacaaagaggaagggcagggtctgggagcactgggkcatgtggggacctgtcgttgccaggcatgcgtctggcagaggctggggactctctggaagcccacgggctggggtgcagacagagggacagacggaggga

SEQ ID NO: 8473 - DNA, 201 bp, Homo sapiens
gatgggctcgtggtggtcaccacgaagaaggcgtgccccccgctcagctgttctctggtgaggtccaggatccccgctccagccaaggggggcttcacccytagatgggtttggggggctgtgatcatccctgcagcgccagcagacaccccctcctgcttggggctgtccactcctgagcctggccccatgtccccatcc

SEQ ID NO: 8474 - DNA, 201 bp, Homo sapiens
cccccgctcagctgttctctggtgaggtccaggatccccgctccagccaaggggggcttcacccctagatgggtttggggggctgtgatcatccctgcagygccagcagacaccccctcctgcttggggctgtccactcctgagcctggccccatgtccccatccctcacttctgtgggggccgccgagcgcctcggcact

SEQ ID NO: 8475 - DNA, 201 bp, Homo sapiens
tctgtgggggccgccgagcgcctcggcactgagggcgcccctctgtcggcacaggacgaggcccgcatgagcaaggacggctgctgccgcttctgcccgcygcccccgcccccgtaccagaaccgtgagtgcccagcctgctgggcggggcgggctccaccctcagaggtccaggagcagctgggctggtcctaaaccctg

SEQ ID NO: 8476 - DNA, 201 bp, Homo sapiens
gagggcgcccctctgtcggcacaggacgaggcccgcatgagcaaggacggctgctgccgcttctgcccgccgcccccgcccccgtaccagaaccgtgagtrcccagcctgctgggcggggcgggctccaccctcagaggtccaggagcagctgggctggtcctaaaccctgtgttcctctccagagtcgacctgtgctgtg

SEQ ID NO: 8477 - DNA, 201 bp, Homo sapiens
caaggacggctgctgccgcttctgcccgccgcccccgcccccgtaccagaaccgtgagtgcccagcctgctgggcggggcgggctccaccctcagaggtcyaggagcagctgggctggtcctaaaccctgtgttcctctccagagtcgacctgtgctgtgtaccataggagcctgatcatccagcagcagggctgcagctc

SEQ ID NO: 8478 - DNA, 201 bp, Homo sapiens
tgccgggggaactgtggggacagctcttccatgtacgtgcctgggcagcaggcagggagacgcgattggctgtggggtgcagtcagggcccccagggctcyaggtgccagatagacgaggggcaggaccatgaggggccaggcaaagggctctgagggtgaggcgggaaaggggtcctgagatggcaagggtggggctggg

SEQ ID NO: 8479 - DNA, 201 bp, Homo sapiens
tgggcagcaggcagggagacgcgattggctgtggggtgcagtcagggcccccagggctctaggtgccagatagacgaggggcaggaccatgaggggccagrcaaagggctctgagggtgaggcgggaaaggggtcctgagatggcaagggtggggctggggtaactacatccccagagcctgtgtcggcatcacgctctcc

SEQ ID NO: 8480 - DNA, 201 bp, Homo sapiens
gggactgttggcgcctggggaactggcaaaggagagctggttgtcagacactggcagcatgcctccaggagcagggaacacgatgaggccgcccagagctyggcacggcgccggcttacggcaggaggctggggtggcgcagcagctggtgctgagcagcccctgcccacaggtactcgctcgagggcaacacggtggagc

SEQ ID NO: 8481 - DNA, 201 bp, Homo sapiens; identical to SEQ ID NO: 1227

SEQ ID NO: 8482 - DNA, 201 bp, Homo sapiens; identical to SEQ ID NO: 1237

SEQ ID NO: 8483 - DNA, 201 bp, Homo sapiens
gcatccagcctgctgttctggggacgtgagcatcacctgagggtctcaggaatgacgcttggacatggtgatcagctgcctggtggctgcaggaggaagamcctcactcctacctcagccctcagcctgcgctcccctcctcagtacacggccaatctgttgcataaatacacttgagcattttgcaatttgtggactgtg

SEQ ID NO: 8484 - DNA, 201 bp, Homo sapiens
ggaatgacgcttggacatggtgatcagctgcctggtggctgcaggaggaagaacctcactcctacctcagccctcagcctgcgctcccctcctcagtacayggccaatctgttgcataaatacacttgagcattttgcaatttgtggactgtgcattttttgagattgttcataaaatccaggaatagggtgggggcaaac

SEQ ID NO: 8485 - DNA, 201 bp, Homo sapiens
tgttggcgcctggggaactggcaaaggagagctggttgtcagacactggcagcatgcctccaggagcagggaacacgatgaggccgcccagagctcggcayggcgccggcttacggcaggaggctggggtggcgcagcagctggtgctgagcagcccctgcccacaggtactcgctcgagggcaacacggtggagcacagg

SEQ ID NO: 8486 - DNA, 201 bp, Homo sapiens
taccaggtaagagccacggagctcagaccccctcagccatagggacggagcttcccactgaccctgaggcccaggtagactttggagcaactgccaactcyggccggggccagggactcgagtctctgcagacacagcccactatcaagtgtggctgaggcccgaggtcggccccaggtcccggaaatatggacatctaca

SEQ ID NO: 8487 - DNA, 201 bp, Homo sapiens
tgggccctaccctgcacttttgaagccctactcctgctgggtcctcagtgcaggccacacggcctccacacctggctgccccagcactgcatgagccgggstggctgctgcacccctgggtggagccgctgcggacgctggacctcagtccccttccttgcaggtgggccacaccgtcggcatggactgccaggagtgcac

SEQ ID NO: 8488 - DNA, 201 bp, Homo sapiens
ccctgggccctaccctgcacttttgaagccctactcctgctgggtcctcagtgcaggccacacggcctccacacctggctgccccagcactgcatgagccsggctggctgctgcacccctgggtggagccgctgcggacgctggacctcagtccccttccttgcaggtgggccacaccgtcggcatggactgccaggagtg

SEQ ID NO: 8489 - DNA, 201 bp, Homo sapiens
ccttgggacgccccttctgcccagccaagactgtggaggtgtgaggtggggggcgcaggccagtcaccccacagcctgcccaccttgcagagctttgtgcycatccctgggccctaccctgcacttttgaagccctactcctgctgggtcctcagtgcaggccacacggcctccacacctggctgccccagcactgcatga

SEQ ID NO: 8490 - DNA, 201 bp, Homo sapiens
accagccagcctgccaccggcctcacccgacgcccaccacggtcgggcccaccacagttgggtctaccacggtcgggcccaccacagttgggtctaccacsgtcgggcccaccacaccgcctgctccgtgcctgccatcacccatctgccagctgattctgagcaagtgagacttgggtgcaagggagggagggtcagtgt

SEQ ID NO: 8491 - DNA, 201 bp, Homo sapiens
cccaaacctgcttctgcaacgtggctgaccggctctaccctgcaggttcgtgagtgtttctggtgcaattgtttctgagctcaccctggtcagttttttayccaggaacgccaagctgtgatgatgataggagtctctgctctttgtggcacaggctcattgtcacagagtggctgctggcattctctgaaattttttccc

SEQ ID NO: 8492 - DNA, 201 bp, Homo sapiens
cacccaaacctgcttctgcaacgtggctgaccggctctaccctgcaggttcgtgagtgtttctggtgcaattgtttctgagctcaccctggtcagtttttyatccaggaacgccaagctgtgatgatgataggagtctctgctctttgtggcacaggctcattgtcacagagtggctgctggcattctctgaaattttttc

SEQ ID NO: 8493 - DNA, 201 bp, Homo sapiens
cggtgacctctgtgaccccatatgggacttctcctaccaatgctctgtatccttccctgtctacttccatggtatccgcctccgtggcatccacctctgtrgcatccagctctgtggcatccagctctgtggcttactccacccaaacctgcttctgcaacgtggctgaccggctctaccctgcaggttcgtgagtgtttc

SEQ ID NO: 8494 - DNA, 201 bp, Homo sapiens; identical to SEQ ID NO: 1262

SEQ ID NO: 8495 - DNA, 201 bp, Homo sapiens
cggcctccacacctggctgccccagcactgcatgagccgggctggctgctgcacccctgggtggagccgctgcggacgctggacctcagtccccttccttscaggtgggccacaccgtcggcatggactgccaggagtgcacgtgtgaggcggccacgtggacgctgacctgccgacccaagctctgcccgctgccccctg

SEQ ID NO: 8496 - DNA, 201 bp, Homo sapiens
acgcttggacatggtgatcagctgcctggtggctgcaggaggaagaacctcactcctacctcagccctcagcctgcgctcccctcctcagtacacggccartctgttgcataaatacacttgagcattttgcaatttgtggactgtgcattttttgagattgttcataaaatccaggaatagggtgggggcaaacccgggc

SEQ ID NO: 8497 - DNA, 201 bp, Homo sapiens
gcttccgcaacagcctcatctggagacccccgagcgggctgtctaggcggtccgcaatcctagagaccccagggggtgggccttcgggtgggggcgggggrcagactcctaattgcctcactcctgcccccgcagcctgcaacaccagccgctgccccgcgcccgtgggctgtcctgagggcgcccgcgcgatcccgacct

SEQ ID NO: 8498 - DNA, 201 bp, Homo sapiens
cagaggctggggactctctggaagcccacgggctggggtgcagacagagggacagacggagggagggtcactcaccccggggcctggcctccctccagccyggcgagacctggtcagacgcagggaaccactgtgtgacccaccagtgtgagaagcaccaggatgggctcgtggtggtcaccacgaagaaggcgtgccccc

SEQ ID NO: 8499 - DNA, 201 bp, Homo sapiens
ccacagttgggtctaccacggtcgggcccaccacagttgggtctaccaccgtcgggcccaccacaccgcctgctccgtgcctgccatcacccatctgccasctgattctgagcaagtgagacttgggtgcaagggagggagggtcagtgtggccgccccacctcccacccttccaagggctggaggggaagaagcgcattt

SEQ ID NO: 8500 - DNA, 201 bp, Homo sapiens
ggctgtccactcctgagcctggccccatgtccccatccctcacttctgtgggggccgccgagcgcctcggcactgagggcgcccctctgtcggcacaggaygaggcccgcatgagcaaggacggctgctgccgcttctgcccgccgcccccgcccccgtaccagaaccgtgagtgcccagcctgctgggcggggcgggctc

SEQ ID NO: 8501 - DNA, 201 bp, Homo sapiens; identical to SEQ ID NO: 1225

SEQ ID NO: 8502 - DNA, 201 bp, Homo sapiens
aaattagttatctctgccctttgggaggctgaggcaggtggatcacttgaggtcaggagtttgaacctagcctgggcaacatggtgaaaccccgtctgtascaaacatacaaaaattagctgggtgtggtggcgtgcctgtaatcccagctattggggaggctgaggcaggagaatcactcgaacccgggaggtggaggtt

SEQ ID NO: 8503 - DNA, 201 bp, Homo sapiens
caaaaattagctgggtgtggtggcgtgcctgtaatcccagctattggggaggctgaggcaggagaatcactcgaacccgggaggtggaggttgcagtgagycgagatcacaccactgcactccagcttgggaaacagagtaagactccatctcaaaaaaaaaaaaaaaaaaaagttattgattaaaatttaaatataaatt

SEQ ID NO: 8504 - DNA, 201 bp, Homo sapiens
tgggagatgagttaagaggttttattcttatacatgcggaagaattatgccttcttgagccatgctcaggagatgtcagccttttccattgtctccccgcycccaccgccagccctgcttaaattatcccctctttttaaacagaatatcctaatcttgcaagtggcatatcatgttccttcttttttaagagagaaggag

SEQ ID NO: 8505 - DNA, 201 bp, Homo sapiens
attatgccttcttgagccatgctcaggagatgtcagccttttccattgtctccccgcccccaccgccagccctgcttaaattatcccctctttttaaacaraatatcctaatcttgcaagtggcatatcatgttccttcttttttaagagagaaggagaaattcctgcagatcatcagggactgaggctaactgaaacttt

SEQ ID NO: 8506 - DNA, 201 bp, Homo sapiens
agaatctaattttactgtgcattttcttgattattagtgaagctaaacattattttttattgatgtgttaacaatttctttcttttgcaaatgatctattmatgttctgtgactgatttctatcttggtgtctttacgtttgtgaatggtaagaatttttatgtgttcaggaactatttaaatgttcaagacattaacctg

SEQ ID NO: 8507 - DNA, 201 bp, Homo sapiens
tacaagggccggatgcggtggctcacacctgtaatcccagcactttgggaggcctaggcgggtggatcacttgaggcctggagtttgagaccagcctggcyaacatggtgaaaccctgtctctactaaaaatacaaaaattagccaggtgcggtggcgcaaacctgtaatcccagctacttgggaggctgaggcaggagaa

SEQ ID NO: 8508 - DNA, 201 bp, Homo sapiens
gggttttaccatgttgcctaggctggtctcgatctcctgggctctagcaatcctcccacctcggcctcccaaagtgttgggattacaggcgtgagctaccrtgcccggccttacgtttcagcatctttcaatccatctaatacgcagtgccagggaaggtttgtgaaaacatttgaatcacagagtcacaaacagtgagaa

SEQ ID NO: 8509 - DNA, 201 bp, Homo sapiens
gaaaagattactgacgatcaacatgctgaactgacatttcacagatatgcagatttattcatctctgttcaaggtatgccttttccaatcataatagccaygtagaggacattaaacaaatattttattgtggtaaaaacacttaacatgagacctacccttttaacaaatttttaaatatataatttattattattgttg

SEQ ID NO: 8510 - DNA, 201 bp, Homo sapiens
gttgacctggaatgacctagaccagcagtcacaagctcctgcccatggacaaaatacagccggtacctctttggctatggcctgcaggctcagaatagttyttacattttcaatcatctgcaaaaaagaataaagaggagaatattatttcttgaaggaggaaaatgatatggaattctgatttcagtgtcataaagtttt

SEQ ID NO: 8511 - DNA, 201 bp, Homo sapiens
aaggccagttatgtgatggatacttctattaccttatgtctttctgatttcatacacttaaatgtacagtttttatcttccttcaaaaccttatttttccragcaagttttatttattcactttcagtcattactgaagtgaataacaaacatataacagatgctattttgggtcatagctgttttgctaagtaatactta

SEQ ID NO: 8512 - DNA, 201 bp, Homo sapiens
ttgcctgtcatctgttgtttttctaatcttctagtaaacatttggaaagtgaaggtttaggcatgtatgtttctcttatgtaggaaggggaaataaggccwtgagattgcatgagttttctttccaagtttgtgcagatctgcacaatgattgaaatatttgcaacctgtagagcagcagggtatttatttggcagcaaac

SEQ ID NO: 8513 - DNA, 201 bp, Homo sapiens
tcttatttatcctgcatttataaatacacaaattcttgtacaattaactcagtttttcactcctttcttgcttgcaacttgtcaggtcgttccctccccastagttgtgaacttctttatgctagcttcttccatcaggggctcacaaccagggactgtagaggtttgcagaggtaaatcttggtagataaggattttatg

SEQ ID NO: 8514 - DNA, 201 bp, Homo sapiens
cctttgtttttgttgtcatcgttttatgattaacttatatctggtcctttagacatttagattttttctgttttatctctctctctctatatgtatatctrtatatatatttatctatatctatatagagatatatatatatatatataataatgaatgaaatggactgtttgcaacctcagatgtatttctaggacttag

SEQ ID NO: 8515 - DNA, 201 bp, Homo sapiens
tttatgattaacttatatctggtcctttagacatttagattttttctgttttatctctctctctctatatgtatatctatatatatatttatctatatctrtatagagatatatatatatatatataataatgaatgaaatggactgtttgcaacctcagatgtatttctaggacttagagtgattagcttgaggcgatgg

SEQ ID NO: 8516 - DNA, 201 bp, Homo sapiens
gcgtccaggactaaagtcatgtgcaatttaacaagatcttggtgagataaaggaagttgcgcttgaggaaacattgaaacacaccagatggaattttccarttccctcctacatgatagagactaggtgaagggagatagaccacaaattgattttgtgtaactcttaaattaagtggagcagagttaaaaaaaaaaaatc

SEQ ID NO: 8517 - DNA, 201 bp, Homo sapiens
atgaaaggaccagaatggcagttctgagctagaatgtgatgagtaagtaccaccatagttagcggctagggaagggaggttgttctacagagaaacatgcycatcatttcttctgttacctggtattcactctggcaatttctttttggactcattctaaaatcaggattaaggatatccactgagaagcttgcatttatt

SEQ ID NO: 8518 - DNA, 201 bp, Homo sapiens
ccatgagtaacgaagtcctctgtatctgatcctgggtctcctgttttctgctagcttcctcaaaacttggtagctaactcattaacttacaaggaagaggktgaacgtgtagacccttcacagtttgaaaaatcacctgatcaataactgagattatgaaaaggtaggaatgaaccaattatggcccaaaggctaactcca

SEQ ID NO: 8519 - DNA, 201 bp, Homo sapiens
gttccacatcctccctgtgggactaggggccagggcaatgggaatcagtgcagaaataaagctcatgctgtttgctctgccatgagtaacgaagtcctctrtatctgatcctgggtctcctgttttctgctagcttcctcaaaacttggtagctaactcattaacttacaaggaagaggttgaacgtgtagacccttcaca

SEQ ID NO: 8520 - DNA, 201 bp, Homo sapiens
tatgagcacggcatctaccgggctgttccacatcctccctgtgggactaggggccagggcaatgggaatcagtgcagaaataaagctcatgctgtttgctstgccatgagtaacgaagtcctctgtatctgatcctgggtctcctgttttctgctagcttcctcaaaacttggtagctaactcattaacttacaaggaaga

SEQ ID NO: 8521 - DNA, 201 bp, Homo sapiens
cttgataaaggttggggtttgtaagcttggggctcctcagccatgactgaaacgtactatgagcacggcatctaccgggctgttccacatcctccctgtgkgactaggggccagggcaatgggaatcagtgcagaaataaagctcatgctgtttgctctgccatgagtaacgaagtcctctgtatctgatcctgggtctcc

SEQ ID NO: 8522 - DNA, 201 bp, Homo sapiens
taaagacagtgcctccttccaggacaacggtttggcagatttgcttgataaaggttggggtttgtaagcttggggctcctcagccatgactgaaacgtacyatgagcacggcatctaccgggctgttccacatcctccctgtgggactaggggccagggcaatgggaatcagtgcagaaataaagctcatgctgtttgctc

SEQ ID NO: 8523 - DNA, 201 bp, Homo sapiens
gatggctttctttccagtataataaagacagtgcctccttccaggacaacggtttggcagatttgcttgataaaggttggggtttgtaagcttggggctcytcagccatgactgaaacgtactatgagcacggcatctaccgggctgttccacatcctccctgtgggactaggggccagggcaatgggaatcagtgcagaa

SEQ ID NO: 8524 - DNA, 201 bp, Homo sapiens
aggagcagaggacaggatggctttctttccagtataataaagacagtgcctccttccaggacaacggtttggcagatttgcttgataaaggttggggtttstaagcttggggctcctcagccatgactgaaacgtactatgagcacggcatctaccgggctgttccacatcctccctgtgggactaggggccagggcaatg

SEQ ID NO: 8525 - DNA, 201 bp, Homo sapiens
ggcaaagcgatctcagggtaaacactgcacaccagtaagtattcttggggcaaatgggaaaagggttaaaatgaccagatctccagagatctcactcactrtggtgaagacagcgccaagccatgagggctccgccccagtgattcaaatacctcccattacggacatgtttcaacatgagatttgagcggggacaaatat

SEQ ID NO: 8526 - DNA, 201 bp, Homo sapiens
atttcatggcaaagcgatctcagggtaaacactgcacaccagtaagtattcttggggcaaatgggaaaagggttaaaatgaccagatctccagagatctcmctcactgtggtgaagacagcgccaagccatgagggctccgccccagtgattcaaatacctcccattacggacatgtttcaacatgagatttgagcgggga

SEQ ID NO: 8527 - DNA, 201 bp, Homo sapiens
tttgtcaaatggggtcatagagggtgagaatcagagtttatgcagggcatagcactagtgtaatgctgggcagagagtgagcatccagcaagtggttttgrcaatgataataattataacccaagcgacacatacaatttaatcaggcactgtgtgtccacagcgatgtcaaggaacaatgcacaaagcagagtttttcca

SEQ ID NO: 8528 - DNA, 201 bp, Homo sapiens
gcatcagccttagcccagacccccaaagttcctgggcttcattctgctttgcattcatctcaaagttaagccttctggctggcaggggtttctgagacagwctgacagtattagcgtgctgcagtttcatgatggcaagaaggaggttaccaaagccgttttcatacaccttaactcatgagtggtagtgagtggccccag

SEQ ID NO: 8529 - DNA, 201 bp, Homo sapiens
ggaggtatgtgctgaggatctctttggcttctgcatctcaaaggatgagtgatttagccaggtggagaggttggggcggtatcctgaatgaaagaatagcrcagacaaaagtagtgagttgaaaacagaacagcatggcaggctcccagtaatcccatgagtcacgtgttctgcccacatggaatggatggtggagaaggg

SEQ ID NO: 8530 - DNA, 201 bp, Homo sapiens
aggatcctaaagagaagatgtaattataagatctaaaacgtggaggggggtggtgaattcagcctgcaggcatgtgtttgctgcccccacccccacatccyctttttttaaagttcgcataaaaacctggattcttggtttctcttaaaaaactggaaggtctggcacctttgctcccacatttcccgggcgcagcccttg

SEQ ID NO: 8531 - DNA, 201 bp, Homo sapiens
tttggctcgttttcagtttttattaatttcctgtgcttctggttcatgaatcccaagtcatgatgtgaatcagttcagttcagcaagcactgagctcccaygatataacaggtttttttcttttccgagctgtggcccatgcagagtttactgagacttggctcttgcctttatgctttaaggatcctaaagagaagatgt

SEQ ID NO: 8532 - DNA, 201 bp, Homo sapiens
agttttccaaactttatccccaggtggttgaactttctaagtttccccaagctgatcagtgttttggggtggtatggaactcagaatagatcactttttttattgactaactctgaccataagtatgcttctgtgcgagcctgacctccacggtaccaggcagagaacaacatgtatgcagagaactcattcactcaataa

SEQ ID NO: 8533 - DNA, 201 bp, Homo sapiens
atgctaatagtaatgatactagtaataaaatcaggataatgctgtttttaattcaccacactgtatgccatttgcttaaaatcagaaaggactcatcggtraggagtagggtggtagtatcattttggtctgcctttcacccccacaagacaacatccttaacagcagctatgttgaaggtttaggagtgcttgtcattag

SEQ ID NO: 8534 - DNA, 201 bp, Homo sapiens
ccaagcaccttggataggcaatgggaaatgttcacaacgttcccatttttacctataacagcagtagcaataatgctaatagtaatgatactagtaataaratcaggataatgctgtttttaattcaccacactgtatgccatttgcttaaaatcagaaaggactcatcggtaaggagtagggtggtagtatcattttggt

SEQ ID NO: 8535 - DNA, 201 bp, Homo sapiens
cctcattacctatagaataactccaaactttctgatgattaagtgagatatcatgtaaagtaccaagcaccttggataggcaatgggaaatgttcacaacrttcccatttttacctataacagcagtagcaataatgctaatagtaatgatactagtaataaaatcaggataatgctgtttttaattcaccacactgtatg

SEQ ID NO: 8536 - DNA, 201 bp, Homo sapiens
agagctgcaggcattaatgcaaagctgcactgcctcacgaggtcgctgatgcactctcattccttttcctccagggactcctgcactttgccaggcgtggrccagaatgccactcgtattgtttatcttaatgcttagtgatagtagctacctccagtgcacgccgcattagcctctccaatgagtttctcctttatttta

SEQ ID NO: 8537 - DNA, 201 bp, Homo sapiens
tgtatgtgggcccatttgccatgtgtgtgtgtgtgtctgtctatctatctatctatgtatatatatatatatatatatatatatatatatatatatatatagttataatgtggtgggttctcgaatcacagttgtaattcacatttttctccaccaattctgataacttgcattaagaaattgactgtgtaagttaaattt

SEQ ID NO: 8538 - DNA, 201 bp, Homo sapiens
ttgtatgtgggcccatttgccatgtgtgtgtgtgtgtctgtctatctatctatctatgtatatatatatatatatatatatatatatatatatatatatatagttataatgtggtgggttctcgaatcacagttgtaattcacatttttctccaccaattctgataacttgcattaagaaattgactgtgtaagttaaatt

SEQ ID NO: 8539 - DNA, 201 bp, Homo sapiens
aaaaaaagtctgattgcaactacgtgtttgggaatcagggagactatggaagaacaatctcagatctcagcttgaggctccacttgcaatatcacaatttytaaaacatgttgtatgtgggcccatttgccatgtgtgtgtgtgtgtctgtctatctatctatctatgtatatatatatatatatatatatatatatatat

SEQ ID NO: 8540 - DNA, 201 bp, Homo sapiens
gaacccgggaggtggaggttgcagtgagccgagatcacaccactgcactccagcttgggaaacagagtaagactccatctcaaaaaaaaaaaaaaaaaaaagttattgattaaaatttaaatataaattacaagtaataatgaaagtatgaaatttttattgattcataaatatttggttttaatcaaatatgatgtgaag

SEQ ID NO: 8541 - DNA, 201 bp, Homo sapiens
gagacctcccagcaggggttgccagagaacttacacaggagcgtttctgctggaatcagctcgatgcctcttgaggacagagactcccagaggaaggagcrggcagccatccttgctgtgctgcagcctccacaggtgacacctcctggtgtgggagggacccaggtgaacagggtctggagtagacccccagcaaactac

SEQ ID NO: 8542 - DNA, 201 bp, Homo sapiens
gccactatgcccagctaatttttgtagagatggagtttcaccatgttggccaggctggttttgaactcctgggctcaagtgatccacccaccttggcttcscaaagtgctgggattacaggcatgagccaccatgttcgaccccatttttataaatgtaaaattaacttaggtttaaactattaatacacaaggttgagaa

SEQ ID NO: 8543 - DNA, 201 bp, Homo sapiens
agagagactgtattccattttatttttatttatatttatttttgagacagagtcttgctctgtcacccaggttggagtgcagtggcacaatctcggctgamtgcaacctctgcctcccgggttcaagcaattctcctgcctcagtctgccgactagctgggactacaggcacacgccactatgcccagctaatttttgtag

SEQ ID NO: 8544 - DNA, 201 bp, Homo sapiens
gtgccaaaaataagaatctttaagaactcataaagtaatttagcaccacgttaataaaagaagcaccattttgaattagttctgtaagtatgtgtttgagktagaaatagagttttaaaaaactgtctgttcatatagttcatctgcttaataagtaaacagctctttcaaatcaccaagctcaaataaaacaaacaaata

SEQ ID NO: 8545 - DNA, 201 bp, Homo sapiens
ccgggaggcagaggttgcagtgagcctagactgcaccattgtactccatcctgggcgacagagcaagactccatctcaaaaaaaaaaaaaaaaaaaaaaaagtaactcattcaaggctacacatttactccatgaagtgagcacacttcagacttccagtcttgtgtggcctgtctaccacaccatgagacttcatgtctc

SEQ ID NO: 8546 - DNA, 201 bp, Homo sapiens
gtactttaaaatcgagtgtggctgtgtttgtcagtcgtggtttgtgttctttgatttgttctgcatgttcttcttttggagaggatgtgtcactttgccartcttggtccttgctgttgtctggtggagggaaacaagcctgccaggccggctcatctgacccctggtggcagggagtggaggtgcactcaggatgctctt

SEQ ID NO: 8547 - DNA, 201 bp, Homo sapiens
ttggactgcttttggaaaaagaaccacaagtctctatttttaaaatagaggtacaatgataaaacaaaacaaaacaaaacaaaaaaacaacaaaaaaaaaacccacacaggtctcatcagccaagggatttaaaaatcaaatttaacttcaaaaaactgaagttgatatagcaggatcttggagatgcagtttcttcactt

SEQ ID NO: 8548 - DNA, 201 bp, Homo sapiens
gcctgggaataggatggcaggtcgtgggaccagcattttaattacctaaagggaacttattgattttagtccagaacacggtggggaggagttcatattcwtttttttttttgagtctggattttagaataaattcactgtgtacatagctattccatctttaaaaacctttgtgaatgttaatatacagcctttataaat

SEQ ID NO: 8549 - DNA, 201 bp, Homo sapiens
cgatctcggctcattgcaagctccgcctcccgggttcatgccattcttctgcctcagcctcccgagtagctgggactacaggcgcctgccactacacctgkctaatttttttgtagttttagtagggatggggtttcaccgtgttagccaggatggtctagatctcctgacctggtgatccgcctgtcttggcctcccaaa

SEQ ID NO: 8550 - DNA, 201 bp, Homo sapiens
tcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctcctgc

SEQ ID NO: 8551 - DNA, 201 bp, Homo sapiens
ttcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctcctg

SEQ ID NO: 8552 - DNA, 201 bp, Homo sapiens
cttcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctcct

SEQ ID NO: 8553 - DNA, 201 bp, Homo sapiens
gcttcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctcc

SEQ ID NO: 8554 - DNA, 201 bp, Homo sapiens
tgcttcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctc

SEQ ID NO: 8555 - DNA, 201 bp, Homo sapiens
catgttgcctaggctggtctcgatctcctgggctctagcaatcctcccacctcggcctcccaaagtgttgggattacaggcgtgagctaccgtgcccggcsttacgtttcagcatctttcaatccatctaatacgcagtgccagggaaggtttgtgaaaacatttgaatcacagagtcacaaacagtgagaatagctgcag

SEQ ID NO: 8556 - DNA, 201 bp, Homo sapiens
cgatggtagtttctgtttttggagtctctgtaggtctcagactcacagtctgtacttcttgttttgggggctaattaagtggacagtttcagtgttggtasctcatttaagccataaacatgcagaccatgtggaatcccattagtcaaaccttagcagagtgccttgatgagtacctccttttctttctgaattctatta

SEQ ID NO: 8557 - DNA, 201 bp, Homo sapiens
tgattttatgtctttatttgtttcttaatgagctactttatcattgtgaaaacagttaaatatcaatagtcaatgaataaatattaccaaaaaaaaaaaaaggtttgtcgtttaaaaatttggagctgggctggaaactagggatactacttggtatattttagttctactgatatgacagtatttgatacttaatcatat

SEQ ID NO: 8558 - DNA, 201 bp, Homo sapiens
ggggaaacctgttggtcccctcataaaacagttaacaggaagcccaaggcatctttcagtgccatttttggctgatgtttggaatggttccatcaatcacygctgttcatgtatagctggtttttatgtcagttaaaccatcttccatcaagttggtgaagcagagtcagggaacaagatgaatagcaaaacgtcttctgt

SEQ ID NO: 8559 - DNA, 201 bp, Homo sapiens
tggactctgtgggtagagacatggatatttttccttttataagaaaggtcttgtctttcctcagaaggcattgtgagcaaaataagggaagaaaaagagamgtagataagaaaaacaaatcacaatattgaagcaggacccgagtactatagccttcctcatattttggtatctggaaccgaggttgctaattaatgaccc

SEQ ID NO: 8560 - DNA, 201 bp, Homo sapiens
agacatggatatttttccttttataagaaaggtcttgtctttcctcagaaggcattgtgagcaaaataagggaagaaaaagagacgtagataagaaaaacraatcacaatattgaagcaggacccgagtactatagccttcctcatattttggtatctggaaccgaggttgctaattaatgacccaagagctaagccttgt

SEQ ID NO: 8561 - DNA, 201 bp, Homo sapiens
tctcatgggcttgccttattttttcagggcatgctctgtctccatcccttggctctgctttccttacattggtcttcttgggcatccgtcttccattccayagtgtagcaagccagaagctgggggaaacatggtgcgtgcctgtaatctcagctactcgagaggctgaggcaggagaatcacttgaacccaggagatgga

SEQ ID NO: 8562 - DNA, 201 bp, Homo sapiens
tgctctcccgagccttctctcctctctggaacccatggctaataggggacaggagagagcggaagcagaaagaataagagatatgaaagccagccgggcayagtggctcacgcctgtaatcctagcactttgggaggccgaggcaggcagatcacttgaggtcaggagttcgagaccagcctggccaacatggtgaaaccc

SEQ ID NO: 8563 - DNA, 201 bp, Homo sapiens
gcggtgggctgggcaggaaaaccataaccacctgcaaatgtcatgtggtttatatcacaccttcacttaacaccctccccctaacaacctctacctggcartcttcatttaactccaaactcaggacctcaatcctctgtttggcctgtgttccacgggacaggcatggggcacagatgtctgttatatataagggacaaa

SEQ ID NO: 8564 - DNA, 201 bp, Homo sapiens
gggacagcgtgtagggtttgcatgatttgtggggccgtttcatgtttgcacggtttggcttggcttgggactctgccagtggtcactgcagtttaacaaaytccccccgggtgtgaaggaaagcgagataaatgcaggaaaaaggatacattttgaaatctggaaattttacataacaggcatcagatttgaagaatgtcc

SEQ ID NO: 8565 - DNA, 201 bp, Homo sapiens
tctccgaactctcattaatttttcacaggcttgtgatggatagtttttatttattcacgtctgagattccgttgtgtgaaaaggactcattttataacatwacatattcatggcttgggatggatgggataaggaacttattattaatgtgtcactgtgggaaacttactctagttcatttgcgaaccttgttaaattcgg

SEQ ID NO: 8566 - DNA, 201 bp, Homo sapiens
tgtgctttaagactgtaaaattttagcccattaaaaataaaatctgttgctttccacccacacctggcaatttggtgagggacgggggctaggatatttamtgtctgaaagttttagggaggcttttatgaactgggccatctctccttgtccccatttttctttgcatctccgaactctcattaatttttcacaggcttg

SEQ ID NO: 8567 - DNA, 201 bp, Homo sapiens
attggtcctgctgtcctgggacccaggtgtgagtgcatagggaaaagggaggagaaatttaatcctgtaactatctccttatggaaaacaggaaaccacaratgaatcaaatgaatccgtttcccctctttctgatcctctgcaaaagtcatcaaaatcactctgttctcaccaggcaactggagtttcgtcagctgagtc

SEQ ID NO: 8568 - DNA, 201 bp, Homo sapiens
accgggtctggagtgcaacagaggcccctgaccttgtctctagctctctgtctgcatcttcagcgtggcttcactggtttctaagtctctggtgtcttttktcttttgcagccggcttgcaattgcctccttctaactctcaaaaggatgcatgggatgggttcagtgtagtcactgttgtgccttttggacaaggctttc

SEQ ID NO: 8569 - DNA, 201 bp, Homo sapiens
aaatgtcatgtggtttatatcacaccttcacttaacaccctccccctaacaacctctacctggcaatcttcatttaactccaaactcaggacctcaatccyctgtttggcctgtgttccacgggacaggcatggggcacagatgtctgttatatataagggacaaatctctgggttggtcactcctggattccccagcccg

SEQ ID NO: 8570 - DNA, 201 bp, Homo sapiens
cacctccctacagtccagtggtggcggtgggctgggcaggaaaaccataaccacctgcaaatgtcatgtggtttatatcacaccttcacttaacaccctcsccctaacaacctctacctggcaatcttcatttaactccaaactcaggacctcaatcctctgtttggcctgtgttccacgggacaggcatggggcacagat

SEQ ID NO: 8571 - DNA, 201 bp, Homo sapiens
gtaatgctgaatgattgtgaatgattgtgaatgtttgtttattcggggtactccctcaaatttcttatccagtggtgtctagaacatgttgggattttgtktgatagtttcttgagttggaaattgcgtttctttggcctcccatgtgggtatcaatgagttttacatggtttaaaggccagttatgtgatggatacttct

SEQ ID NO: 8572 - DNA, 201 bp, Homo sapiens
tgcaaagacaggcgctgctctctggcagggacagcgtgtagggtttgcatgatttgtggggccgtttcatgtttgcacggtttggcttggcttgggactckgccagtggtcactgcagtttaacaaactccccccgggtgtgaaggaaagcgagataaatgcaggaaaaaggatacattttgaaatctggaaattttacat

SEQ ID NO: 8573 - DNA, 201 bp, Homo sapiens
tgggaatctcaagttcccaggagccaaccacaagagcttcacagctcagaattttcaagatgtggatgtaggcagggagcctatgtagtaattcaagtaarcatctcttcttcttgttttccttataggatgatagaaggtcagtgcttgttcaccccagtgaggtggagcctctgaggtgggaggttttctctcatcctt

SEQ ID NO: 8574 - DNA, 201 bp, Homo sapiens
cattgttacatcctacaagcgtgcttacctgcatcaccttgctgggctgtttcagcattggaatatcactgggaatctcaagttcccaggagccaaccacragagcttcacagctcagaattttcaagatgtggatgtaggcagggagcctatgtagtaattcaagtaaacatctcttcttcttgttttccttataggatg

SEQ ID NO: 8575 - DNA, 201 bp, Homo sapiens
cagggacagcgtgtagggtttgcatgatttgtggggccgtttcatgtttgcacggtttggcttggcttgggactctgccagtggtcactgcagtttaacaractccccccgggtgtgaaggaaagcgagataaatgcaggaaaaaggatacattttgaaatctggaaattttacataacaggcatcagatttgaagaatgt

SEQ ID NO: 8576 - DNA, 201 bp, Homo sapiens
atgaaagccagccgggcacagtggctcacgcctgtaatcctagcactttgggaggccgaggcaggcagatcacttgaggtcaggagttcgagaccagcctrgccaacatggtgaaaccctatctctactaaaaataacaaaattagctgggtatggtggtgtgcgcctgtaattccagctacttgggaggctgaggcatga

SEQ ID NO: 8577 - DNA, 201 bp, Homo sapiens
tttgcttttaaatgcccgtgttgatttcttaatattttcaacttcctcttctgaagccagttccccccgaccatcagtcatgagtccgttcttttaacctygttcaggtggcgtggggcggtgtgtttggtggggagtgatgggtgcttgcctggaagtgcgagcaattgatcagctgatgaggggtatttattatctgtc

SEQ ID NO: 8578 - DNA, 201 bp, Homo sapiens
aacttcctcttctgaagccagttccccccgaccatcagtcatgagtccgttcttttaaccttgttcaggtggcgtggggcggtgtgtttggtggggagtgmtgggtgcttgcctggaagtgcgagcaattgatcagctgatgaggggtatttattatctgtccctgactcccgagagaggaaataaatccttggaccccag

SEQ ID NO: 8579 - DNA, 201 bp, Homo sapiens
gggggcctggaaggggagaaggggcaccagaaggagaaatgggaggaaagggcgagtgagatagcaaagagaactcagaaagtaataaagccctgcagtartcagagggctgaggccaggtccccagtgagcggctgaacacacagtgattcaaacccactccagacctgtgttcttaatcattaccttcacctggaggga

SEQ ID NO: 8580 - DNA, 201 bp, Homo sapiens
tctctcagcttctcctctctttcccatccaactgagcagcaccaataaatagataagaaacctgaaggtctacatcaaatcagcttctattgctgcaaaaytcttctagctaacttcattctaaaagctgtctgaaatatatttacttacacccgagaagattcaaaaacattaccgctgaaccccgatgctttgggaaca

SEQ ID NO: 8581 - DNA, 201 bp, Homo sapiens
gctcctaggttttcttacttccaaaacagtgggcaagaacagctaccttttagaagcaggaaaaaggaacataatgaataaacctaaaggatttaaaaacktggaagacactaagaaactatattgccgagaaagagaaatgtaaattccgctggataaattagcgtttgcggttacttctctctttgttgcttaagcaga

SEQ ID NO: 8582 - DNA, 201 bp, Homo sapiens
accccatctctattaaaaatacataaattagtcgggcatggtggcatgtgcctgtagtcccagctgctcaggaggctgaggcaggagaatcactcgaaccygggaggcagaggttgcagtgagcctagactgcaccattgtactccatcctgggcgacagagcaagactccatctcaaaaaaaaaaaaaaaaaaaaaaaag

SEQ ID NO: 8583 - DNA, 201 bp, Homo sapiens
tgagcacacttcagacttccagtcttgtgtggcctgtctaccacaccatgagacttcatgtctctcctaaatgaggagaaccaaagctggaaattgtcacyccctgtcagcccacagcactggtttctaaacctactggcctctaccgcttcacttctcactgtaatctctctgaccctaccttccagcttctcttgagaa

SEQ ID NO: 8584 - DNA, 201 bp, Homo sapiens
tgggggaaaaaaccaatagaataatgttttattacatgtaaaaattgtatgaaattcaaatttcagtgttcataactaaattttaaaaacttttattgaarttccagagagatctgaagtagttttattggaacacagccctacacaccttcatttataagctatctgtggctacttttgcactatgccagcaaagttgag

SEQ ID NO: 8585 - DNA, 201 bp, Homo sapiens
gtagttttattggaacacagccctacacaccttcatttataagctatctgtggctacttttgcactatgccagcaaagttgagtagttgggatggagactrtatggcccataaagcctaaaatactctctgctcctttccagaaagcttggcaacccctactatcatctccacgtctgcctttgttcttcttatttgtccc

SEQ ID NO: 8586 - DNA, 201 bp, Homo sapiens
taggtagaaatttttatgtcacaggtgggcctaattaaccttgattaatgttctgcaaacccggatagactggagactcagaaagggacgcaaaagctagyctggttcccatgttagtccctgctctgtgagcagctgccacacagtcatgctgatggctcctgcagcagccattctggtttgactgtgctcgtgctgccc

SEQ ID NO: 8587 - DNA, 201 bp, Homo sapiens
tgtggagtatgcatttaattcacatttacaaattggtttctgtttttaactaaaggtactttttcagcagaaatgatgtgtatgatgtcatatctaacttktgatctcactggtatttgatgttaagcctcaaaatcatcaaattttttttacggcactgaaaaaaatacataaatctgcttgattggttcatagaaaaag

SEQ ID NO: 8588 - DNA, 201 bp, Homo sapiens
catcttacaaatgaatcaatatttagtggtttgaaaatatgttgtttaatttggggcgattcaatatcaaattaagatttttaggtttatttatcgatctytagaattacatcaacattaagctaattactttaaattgtgtttttaagtaaccaagaatacatctgtggacgctgttctgtgccatcttgagtcacgttt

SEQ ID NO: 8589 - DNA, 201 bp, Homo sapiens
taaaacgtggatgttccaatttatgtatagccgcataatacattaccccaaaacttagaggcttaaaacaacaaccattttgttttatcttgtgatttctstaagttagggctcagtggagtgactcttctgccccttgtggtgttgactggggtcagtcagtggtgctatgctggaggatgaattggactggcacttcag

SEQ ID NO: 8590 - DNA, 201 bp, Homo sapiens
tggatgttccaatttatgtatagccgcataatacattaccccaaaacttagaggcttaaaacaacaaccattttgttttatcttgtgatttctctaagttrgggctcagtggagtgactcttctgccccttgtggtgttgactggggtcagtcagtggtgctatgctggaggatgaattggactggcacttcagctggtcc

SEQ ID NO: 8591 - DNA, 201 bp, Homo sapiens
atgaattggactggcacttcagctggtccaggatggtcacccatgggtctggcactttcacgaggatgactgggatgcttggctcagctgagggactcttrcccagagccctacacatggcctttcctgcatggcagatatagggccatcagatttcttacatggtggctcagggctcccagaggattccaaaagaaagta

SEQ ID NO: 8592 - DNA, 201 bp, Homo sapiens
gtgtagctccaattgccttcatccttagaagacctttaatgatatcctatgccaaacttcctagcctccacctgtaccctgaattggccctagcctagttktccaaactttatccccaggtggttgaactttctaagtttccccaagctgatcagtgttttggggtggtatggaactcagaatagatcactttttttattg

SEQ ID NO: 8593 - DNA, 201 bp, Homo sapiens
gcactttttctgtttttgatgggatttatcacttgaaaatgcatattatagtaatttctgaattcatcctgattctcctactggtttctaaactcttcagkttagaattcctgttggatatccctctggcccgaaattcctgaatgagttaagcaggacacctagaactatgcagaggtaataccttccttgacctgtccc

SEQ ID NO: 8594 - DNA, 201 bp, Homo sapiens
tgatgggatttatcacttgaaaatgcatattatagtaatttctgaattcatcctgattctcctactggtttctaaactcttcaggttagaattcctgttgratatccctctggcccgaaattcctgaatgagttaagcaggacacctagaactatgcagaggtaataccttccttgacctgtcccttttctgggtcagttt

SEQ ID NO: 8595 - DNA, 201 bp, Homo sapiens
cttgaaaatgcatattatagtaatttctgaattcatcctgattctcctactggtttctaaactcttcaggttagaattcctgttggatatccctctggccygaaattcctgaatgagttaagcaggacacctagaactatgcagaggtaataccttccttgacctgtcccttttctgggtcagtttgcccttcatgatttc

SEQ ID NO: 8596 - DNA, 201 bp, Homo sapiens
tctggctctgcagctgaaattgggatcgcatggagaaaatagaaagtccagtgtttgtagctgtgatctctcagttgcttgcatgaattgtgctttaagaytgtaaaattttagcccattaaaaataaaatctgttgctttccacccacacctggcaatttggtgagggacgggggctaggatatttaatgtctgaaagtt

SEQ ID NO: 8597 - DNA, 201 bp, Homo sapiens
aagctccgattttcttgttgaatagccgtgtttcctcagcattctgtagatttttggccaggtttgtgtaagggatgaacgactctctataaaatgatgtmaggatcctttctttcctgcccattgccatttctagcattctctccttgagggaagttgcagttttctccctctgtgtattcatccttctgacctgtgctc

SEQ ID NO: 8598 - DNA, 201 bp, Homo sapiens
agatctcactcactgtggtgaagacagcgccaagccatgagggctccgccccagtgattcaaatacctcccattacggacatgtttcaacatgagatttgrgcggggacaaatatccaaactatatcaggatcccagcagactgggtgggtggaggttcagggatatctgggaaggactaagaatagctttttcttttagt

SEQ ID NO: 8599 - DNA, 201 bp, Homo sapiens
tctcactcactgtggtgaagacagcgccaagccatgagggctccgccccagtgattcaaatacctcccattacggacatgtttcaacatgagatttgagcrgggacaaatatccaaactatatcaggatcccagcagactgggtgggtggaggttcagggatatctgggaaggactaagaatagctttttcttttagtaga

SEQ ID NO: 8600 - DNA, 201 bp, Homo sapiens
tgcaagagtcagcaaagtttctctgtgatgggatatttaataaatattttggggccttgtagtgtttgttgccaactactcaactctgccctcatagtgcraaaacaggcataaacgatatgtaaaggagcaggcatggctgcgagaaactttatttatggatactggaatttgaatttcatatacattttcatgtgtcac

SEQ ID NO: 8601 - DNA, 201 bp, Homo sapiens
ttctctgtgatgggatatttaataaatattttggggccttgtagtgtttgttgccaactactcaactctgccctcatagtgcaaaaacaggcataaacgayatgtaaaggagcaggcatggctgcgagaaactttatttatggatactggaatttgaatttcatatacattttcatgtgtcacaaaatattattctttccc

SEQ ID NO: 8602 - DNA, 201 bp, Homo sapiens
acagccgtgtttggcccagcggttatagtttgccaacccctgcttagagtctagctttattcagagcttaaatatgtcatcgaggtcccctctttatttawtcccttagttttgatgatcttttatgggttatattcttcaaagggaaaattctctccgaatggggctgccactggcagacgagcactgtcccatcttggc

SEQ ID NO: 8603 - DNA, 201 bp, Homo sapiens
attcagagcttaaatatgtcatcgaggtcccctctttatttattcccttagttttgatgatcttttatgggttatattcttcaaagggaaaattctctccraatggggctgccactggcagacgagcactgtcccatcttggcttgttcccccagtgacaagaagctgttttccccactacccttggcccaaaagccacag

SEQ ID NO: 8604 - DNA, 201 bp, Homo sapiens
tcgaggtcccctctttatttattcccttagttttgatgatcttttatgggttatattcttcaaagggaaaattctctccgaatggggctgccactggcagrcgagcactgtcccatcttggcttgttcccccagtgacaagaagctgttttccccactacccttggcccaaaagccacagggagaaccaggattggcctag

SEQ ID NO: 8605 - DNA, 201 bp, Homo sapiens
tttaggcagacacctatccctgaatcagtcatgtccccggatgatgcggttctctgcagcctgggcagtcaaggctggagataattctctgcttctccacrgagtctgagaggccccgttccctaatggaaaaatgaggtccaattttgcaaaaggaggcacctggggaaacattctggacacacaaatctatagcttcta

SEQ ID NO: 8606 - DNA, 201 bp, Homo sapiens
catgtccccggatgatgcggttctctgcagcctgggcagtcaaggctggagataattctctgcttctccacagagtctgagaggccccgttccctaatggwaaaatgaggtccaattttgcaaaaggaggcacctggggaaacattctggacacacaaatctatagcttctaccgtcaatctgctatgatccttttatggt

SEQ ID NO: 8607 - DNA, 201 bp, Homo sapiens
aattttgcaaaaggaggcacctggggaaacattctggacacacaaatctatagcttctaccgtcaatctgctatgatccttttatggttctgacgttgcarttttatttttgcatgtttctagagacatcaggaggggatcttttcgggatgtggcttcagaaaggagcctgttggatggtctcttactagtggtcagcaa

SEQ ID NO: 8608 - DNA, 201 bp, Homo sapiens
taattaattagcaaaaacttatctttggaatgcttcaagaaacagttctatgttgttctcataacttaattttacacaactgtcttttgtttgtatcttamagaaaacaaaataccaccctccgccagaaaagtgcagaataaaaattttccactagcaaaagaaggaaaaaataaaagatcttgaatagtctcatcaatt

SEQ ID NO: 8609 - DNA, 201 bp, Homo sapiens
gaatttgttaattaattagcaaaaacttatctttggaatgcttcaagaaacagttctatgttgttctcataacttaattttacacaactgtcttttgtttktatcttacagaaaacaaaataccaccctccgccagaaaagtgcagaataaaaattttccactagcaaaagaaggaaaaaataaaagatcttgaatagtct

SEQ ID NO: 8610 - DNA, 201 bp, Homo sapiens
tttgaaatctggaaattttacataacaggcatcagatttgaagaatgtccaaaatattacgagtcatagcacaacctttgctaacaccatggaaatttttraacatggaatttgttaatgctgacttggcccaccatggggttaaaaaaagtgaatttctttttgataaccaaggtgatgatcttatgaagttgatgatgg

SEQ ID NO: 8611 - DNA, 201 bp, Homo sapiens
aaaaggatacattttgaaatctggaaattttacataacaggcatcagatttgaagaatgtccaaaatattacgagtcatagcacaacctttgctaacaccrtggaaatttttaaacatggaatttgttaatgctgacttggcccaccatggggttaaaaaaagtgaatttctttttgataaccaaggtgatgatcttatga

SEQ ID NO: 8612 - DNA, 201 bp, Homo sapiens
tgaaggaaagcgagataaatgcaggaaaaaggatacattttgaaatctggaaattttacataacaggcatcagatttgaagaatgtccaaaatattacgartcatagcacaacctttgctaacaccatggaaatttttaaacatggaatttgttaatgctgacttggcccaccatggggttaaaaaaagtgaatttctttt

SEQ ID NO: 8613 - DNA, 201 bp, Homo sapiens
cctcaaatccttctggaagtaggttggttatgaattatgaataattaaagaaataaactctggctctgcagctgaaattgggatcgcatggagaaaatagmaagtccagtgtttgtagctgtgatctctcagttgcttgcatgaattgtgctttaagactgtaaaattttagcccattaaaaataaaatctgttgctttcc

SEQ ID NO: 8614 - DNA, 201 bp, Homo sapiens
gtgagcatccagcaagtggttttgacaatgataataattataacccaagcgacacatacaatttaatcaggcactgtgtgtccacagcgatgtcaaggaamaatgcacaaagcagagtttttccagtctcctgatgtttgagccctgcgcgagccccactcttctcccttttctcataactgctgtgagcaacctcaaatc

SEQ ID NO: 8615 - DNA, 201 bp, Homo sapiens
ttctcccttaatgcctcatgaatgcccaagcagcacttcatggaagtacactgagtctctactgcttgcagggattaaacataacattctcaacagtggtragagagcctttcccttctctttggctcgttttcagtttttattaatttcctgtgcttctggttcatgaatcccaagtcatgatgtgaatcagttcagttc

SEQ ID NO: 8616 - DNA, 201 bp, Homo sapiens
ttctccgcctgctgtgccttcctatagtgtagctccaattgccttcatccttagaagacctttaatgatatcctatgccaaacttcctagcctccacctgkaccctgaattggccctagcctagttttccaaactttatccccaggtggttgaactttctaagtttccccaagctgatcagtgttttggggtggtatggaa

SEQ ID NO: 8617 - DNA, 201 bp, Homo sapiens
tcttgcttccgtcacctcgtgctttgaaacataaccacaatgtgctgaggtttcacattgttacatcctacaagcgtgcttacctgcatcaccttgctggsctgtttcagcattggaatatcactgggaatctcaagttcccaggagccaaccacaagagcttcacagctcagaattttcaagatgtggatgtaggcaggg

SEQ ID NO: 8618 - DNA, 201 bp, Homo sapiens
ctgaaataagtggacacatactccaccatccccaggtagtgtacagtgtgtgccctttcaggctagtatgtacagctttaaatcattcctttacagagctrtgtaatattccacaacccagaggagcagcttgaagccagctaaagtatgtatatccaagtggaattaagagcttcatgcgtagtttcttgattttgatta

SEQ ID NO: 8619 - DNA, 201 bp, Homo sapiens
tcttggttttagatttttttaattataaaagaacattattatacattatttgaataattttttaaaattatagagctgtctaaaggaggcattaaaaaaascctttctattccttcatctaattctatccctctgaggcaaccatgattagtattttgtacttcttgtacatcctccttcatgttaatatagatgtacaca

SEQ ID NO: 8620 - DNA, 201 bp, Homo sapiens
tctctgttagatacagtgtatctctgttagatacagagcattctgttagatacagagaatctctggtagatacaaagtattctgctattctgatcttcctkttagaagatcagatttacagaagtctacatttgctctcaagggaccttcagtctgtttggagcaatctctttattaatttatttattcagtaaattttat

SEQ ID NO: 8621 - DNA, 201 bp, Homo sapiens
taatgaccctctcctggcctcaattaactgaggccaggagagggtcattagcaaactgtcctttgctaaatgggactaatgggaagaatagtgtctgccawataaggtggttgaaggattggatgagactgacatttcatttgcatttagtgaatacttgttgaatgactgaatgaatggttgatgtacagaaacatgaac

SEQ ID NO: 8622 - DNA, 201 bp, Homo sapiens
ttggtgagaaaggaaatttttgctccaataaactgggtagctcagtccaggagagaaatgtactggactcagacttggaggacagagctttgtgaccctcstaggcaatgtaatgaccctctcctggcctcaattaactgaggccaggagagggtcattagcaaactgtcctttgctaaatgggactaatgggaagaatag

SEQ ID NO: 8623 - DNA, 201 bp, Homo sapiens
agaaactatattgccgagaaagagaaatgtaaattccgctggataaattagcgtttgcggttacttctctctttgttgcttaagcagaggagaaacagaartcatagcaaagagagaggtagctgcaaaagctaatttatccaaaagaatttacatttttctctcttggcactatagggggcatgtttactctcctgatgt

SEQ ID NO: 8624 - DNA, 201 bp, Homo sapiens
tcctgggctctagcaatcctcccacctcggcctcccaaagtgttgggattacaggcgtgagctaccgtgcccggccttacgtttcagcatctttcaatccrtctaatacgcagtgccagggaaggtttgtgaaaacatttgaatcacagagtcacaaacagtgagaatagctgcagttatgtttgtgatgctctaatgaac

SEQ ID NO: 8625 - DNA, 201 bp, Homo sapiens
ggtgtggaaatactctacctgggtgaggctctcgtggctttttgtgccaagtgtccgtaaacttcaacttaattgttttaaatcctttgtggtgattatgyggaaggtcaaatctaacaggaagctccatgtccacttgatgtgtacttacttctatttttgcaccttgtgttgtttgttatcctgaattatgccagggct

SEQ ID NO: 8626 - DNA, 201 bp, Homo sapiens
gacagatatgtcattgaagtttcatccttcttcatttcagagtctgctggaagacccttcatttaccactctctccttcctggaggtgtggaaatactctrcctgggtgaggctctcgtggctttttgtgccaagtgtccgtaaacttcaacttaattgttttaaatcctttgtggtgattatgcggaaggtcaaatctaa

SEQ ID NO: 8627 - DNA, 201 bp, Homo sapiens
gaattgggtaaggatccagctgattttctccagatgagtagttcattgtcccaacaccagttattgcaataagttattccttccccaggaaatatacctgrgctaattaagaaaactgtgcttcaatgtaattattccaccttaatgcatgaaatattaggttaacatggaaaaaacatggcatcccatgttttagtattt

SEQ ID NO: 8628 - DNA, 201 bp, Homo sapiens
tatgtatgtatatgtgcatacacatacattgttttgtatatatttgtcagatggaggtgtgtgtaaacaaataacagaaatgagttaaaattgacaagttrgcttggtaaacatcttgatttataatttattaaaaactacgtgggtatgtatatacatacagacacacacacttcttcaccacctgaacaaaaatccctt

SEQ ID NO: 8629 - DNA, 201 bp, Homo sapiens
cagtgtgtaaaatcatggcggtgccaagagggggtgtgatgggtgtggccgcccccctgccagcaggaggaatctgttttcactgacattgtttggaatcrccaagcatggtgatgataaaaagcagttaaactttggtcacttttattaatacttttaagtccttagcgaacaatgcacccgttattacttgcacctagt

SEQ ID NO: 8630 - DNA, 201 bp, Homo sapiens
gcatggaaaaggctttgcttttaaatgcccgtgttgatttcttaatattttcaacttcctcttctgaagccagttccccccgaccatcagtcatgagtccrttcttttaaccttgttcaggtggcgtggggcggtgtgtttggtggggagtgatgggtgcttgcctggaagtgcgagcaattgatcagctgatgaggggta

SEQ ID NO: 8631 - DNA, 201 bp, Homo sapiens
gcatttgtacaggagaactacttaatggcacagtttgttattacatggaattaaatacaacctatttaaatcatgtaccgtgaaaccaaagagctgtgtayggaaaaagcctcatataacccagtttgccaggtcctaactcccttcatacatatactaacatgcaaaagacctcctaccttttttttccccttctgtttc

SEQ ID NO: 8632 - DNA, 201 bp, Homo sapiens
aattgcaggttaagccctcattttgatctctgggatgagagcaagcaccgtttcattgacatgtcatcagctatgatctgagggagcacacagaggtgccytttggggaaagaggggcatcttgcacttgtctcccacattgaaagggtttattgcacagtgagtgtgtgcaagtgaacaaatagcagatgggttagaatg

SEQ ID NO: 8633 - DNA, 201 bp, Homo sapiens
ggaaaggattaagtgcagtgatcaatcagcagcaaagtcctggaagaaacccatttgttagtctctgggcctccccaggccttatcagggcttagccttckagcagtagcaacacttgcacctgcagttactaattcctgtggaatgaagtaggcgggcccgaaatgtacagcccttatccagtgaattctcataggagca

SEQ ID NO: 8634 - DNA, 201 bp, Homo sapiens
gtaaggtttagtcaagaagttggaaattaatggggaaggaaggttttgggttatgtgtggatttcatttatccatgctatctcttccctccattagcatgkttaattaagagttgtcaatacatctttgttggagtatttgattattttttcaacagggaagattagaatgaagtcttcagatctggcaagtgtcatggga

SEQ ID NO: 8635 - DNA, 201 bp, Homo sapiens
gttagtgcatattcttggctcaagcaggataagacactagtaaccatgaacctgtatatcaaaaagcgtgactagagtttcatagttaaacatgtgctgawatccacagtggacaccagagagggtcatggaatctgggaatggatgacttgtcccatgatgataatatctgtgttcctacggctgggcccggtggctcac

SEQ ID NO: 8636 - DNA, 201 bp, Homo sapiens
tcaaaaaaaaaaaaagagaaagaaaacagattaatacaatgatctgtgagatattgggactgttcttattcccatttcacagatgagccactaactggctyctggcaggacagtgaataaggggcacaacagagacacaaacacatggctaaccaatggtctcatccgtcagccacactgcctgtctcagcatgggccctg

SEQ ID NO: 8637 - DNA, 201 bp, Homo sapiens
ggccaggagtttgagaccagcctggccaacatggtaaaaccctgtctccactaaaaatacaaaagaaattagctgggcatggtggcaggtgcctgtaatcycacctacttgggaggctgaggcaggagaatcacttgaacctgggaggtggaggttgcagtgagccgagattgcaccactgcactccagcctgggtgacaa

SEQ ID NO: 8638 - DNA, 201 bp, Homo sapiens
tgaatgttaatatacagcctttataaatttgaggtataatgttcaaaatgctctaatccctaaattttccagtctaggttattatacttttatgactattmattttgatgtaggccttttaaaatcaattcctccctgttattacaatgctgctttatggtatttgtgatatatcatgtgaatatacttgagggtcatgag

SEQ ID NO: 8639 - DNA, 201 bp, Homo sapiens
aggataaaatcctatgcagtttacagaaatgtaaactaagtgcttcgttaaatgaatcctagatcccgtgccttctgactgggtgagacctcccagcaggsgttgccagagaacttacacaggagcgtttctgctggaatcagctcgatgcctcttgaggacagagactcccagaggaaggagcgggcagccatccttgct

SEQ ID NO: 8640 - DNA, 201 bp, Homo sapiens
atggctaaccaatggtctcatccgtcagccacactgcctgtctcagcatgggccctgtgtggaccattccatctcaatttgtttctgattcttgtcaattmaataagaacagctgaaaagtaaaataataaatatatacataaaaacaatggggggagtaataatgataatagatacaattttttggtctttataatcccc

SEQ ID NO: 8641 - DNA, 201 bp, Homo sapiens
ccagcatgtgatcatacatctacctaacctctcccattggttgaatttaatatactagtgaattttccattgcaaagatgaggttacgaatcatagtgttsatactcagaaggactttataaatattttgcctttttgaagtatatacaagaaatgaaaaaaaaaacaggaataaataaaaagaataaaaagagccaggac

SEQ ID NO: 8642 - DNA, 201 bp, Homo sapiens
aaacactagttctgcaatttcccaacacctgccccctgccccttataaaagctcatggttccatgtgactttccactcctgcgtctctggccttggggcargtcagtccgtggatcacctcactgtcctagggatgctcttctggtccacactgtgcctaccttggatatggagttccacttgttcccttacctttcaccc

SEQ ID NO: 8643 - DNA, 201 bp, Homo sapiens
agcctcttgtcgaggagtgcactgggaggggaggctggacttctgggctctgctctgcctctaatctgctgcccagcatcagccttagcccagacccccaragttcctgggcttcattctgctttgcattcatctcaaagttaagccttctggctggcaggggtttctgagacagactgacagtattagcgtgctgcagtt

SEQ ID NO: 8644 - DNA, 201 bp, Homo sapiens
tcccattgcacttctcttcaagtttgcccagatagtaagttctactagacatgtcaattttttctgaggtctaatcttgatttttttttcctgcacaatayggaattcagtgtttttatttaatcattcagtaagtcttgactgcctgctatggaggttaagccctttactaagttccaaggatgtacctgtgaataaggc

SEQ ID NO: 8645 - DNA, 201 bp, Homo sapiens
ttttttttggcaagattaagtgagatcttccatttgacatgcctggctaattggcagtgcccaacagatagaaactattggtattgtaaggactgcttatygggtacatatgctgtgccatgggaggtggaggtgctgtcatgctgaacccctattaacctcaataggaaaggcaccaggttcaagagctgaagaagacac

SEQ ID NO: 8646 - DNA, 201 bp, Homo sapiens
tccttctcctcctcctcctctccttttcttttcttttcctttccttcttcttcctttcttcctttatttctttcttcctgtattattttcttgtatagctyaggtctcactgctttgctgccattcttgtggagaataataggtaacagaggtgtgcacctggcctcatttattgtcacactggataggtaatagacgccg

SEQ ID NO: 8647 - DNA, 201 bp, Homo sapiens
ttttggctgaagatgatcactttagctgaaaccagttcaggttcaaactcagacattggtgctattttcatatatctgaaatgttctgaaaagattactgrcgatcaacatgctgaactgacatttcacagatatgcagatttattcatctctgttcaaggtatgccttttccaatcataatagccatgtagaggacatta

SEQ ID NO: 8648 - DNA, 201 bp, Homo sapiens
cagagcttacaagttattcaacagccagatttctattctgatatgcccttttagttttcaaagcatcgaaaaagggtaatctttagaaccgaagtatttgsaaaactcctagacttgaataaggtatttttgaatttgaagagctaagaacccatcaaatcaaaatgctaataattcttccaagtcaaaaggtaactctca

SEQ ID NO: 8649 - DNA, 201 bp, Homo sapiens
gctgctttatggtatttgtgatatatcatgtgaatatacttgagggtcatgagaagttcatatgtgtgtgtgtagtgtgggccccagactttcgccacacygctggctaaagtggccatgtttttgtacgtctctgcagagcttacaagttattcaacagccagatttctattctgatatgcccttttagttttcaaagca

SEQ ID NO: 8650 - DNA, 201 bp, Homo sapiens
tgccttggcctcctaaactgccgggattacaggtgtgagccaccacacccagcccctctccctattttaatgcgaggtaattaacaaccttaatttcaccrgtaacctgaattctcctttgccacgcagtctaccatattcacgggtttcagggattaggacctggacatctttggttgggaaatgggcatcattttgtct

SEQ ID NO: 8651 - DNA, 201 bp, Homo sapiens
agaagcaccattttgaattagttctgtaagtatgtgtttgaggtagaaatagagttttaaaaaactgtctgttcatatagttcatctgcttaataagtaarcagctctttcaaatcaccaagctcaaataaaacaaacaaataatgggacaattggcaaaactctaaaaagtgatacaaaagaccaagggatatttgaaaa

SEQ ID NO: 8652 - DNA, 201 bp, Homo sapiens
aaaaaaaaaaaaagagaaagaaaacagattaatacaatgatctgtgagatattgggactgttcttattcccatttcacagatgagccactaactggctcckggcaggacagtgaataaggggcacaacagagacacaaacacatggctaaccaatggtctcatccgtcagccacactgcctgtctcagcatgggccctgtg

SEQ ID NO: 8653 - DNA, 201 bp, Homo sapiens
gaacacagccgtgtttggcccagcggttatagtttgccaacccctgcttagagtctagctttattcagagcttaaatatgtcatcgaggtcccctctttayttattcccttagttttgatgatcttttatgggttatattcttcaaagggaaaattctctccgaatggggctgccactggcagacgagcactgtcccatct

SEQ ID NO: 8654 - DNA, 201 bp, Homo sapiens
caggcatggctgcgagaaactttatttatggatactggaatttgaatttcatatacattttcatgtgtcacaaaatattattctttcccccccgcccccarccatttaaaaatgtgaagcatttttagcctgtgtgctgtataagaacacagccgtgtttggcccagcggttatagtttgccaacccctgcttagagtcta

SEQ ID NO: 8655 - DNA, 201 bp, Homo sapiens
gatttaatgccaacatgttcttttttggtattaacatattgcattggtgtgaaaactaaaatgccttcagcgatgatcttttcctttggaaaactagattmccactcggatgctacgaggggtaatctgtgctaagtttatggtgtgtctgccagggctctgctttaaaaaacaaaacaaacccttttggaggccttgaca

SEQ ID NO: 8656 - DNA, 201 bp, Homo sapiens
tcttttttttgagactggagtcttgctctgttgcccaggcaggaatgcagtggggtgatctcagctcattgcaagctccgtctcctgggttcacaccattytcctgcctcagcctcccaagtagctgggactacaggcacccgccaccaagcccagctaattttttgtaattttagtagagatggggtttcaccatgttag

SEQ ID NO: 8657 - DNA, 201 bp, Homo sapiens
cctaggaacagcctagaaggtgaatgatgcagcccagttgtttttattctgagtttggcaaaaatgatagagaagaaaatgtacttttatgtgttcgttcracagttaaagagtattccagattcctccctccaaaaaaaaaaaaaaaaaaaaaaaagggcatattccctagccaaggcccacatggcttttctttacttt

SEQ ID NO: 8658 - DNA, 201 bp, Homo sapiens
cccatgtctactaaaaatacaaaaaattagccgggagtggtggtgttcgcctgtagtcccagttactcaggaggctgagccaggagaatcgcttgaacctsggaggtggaggttgtagtgagccgagatcgtgccgttgcactccagcctgagtgacaagagcaacactccatctcaaaaaaaaaaaaaaaaaaaaaagga

SEQ ID NO: 8659 - DNA, 201 bp, Homo sapiens
ttattatgcattgaccaccattcactttctgttggactgcttttggaaaaagaaccacaagtctctatttttaaaatagaggtacaatgataaaacaaaasaaaacaaaacaaaaaaacaacaaaaaaaaaacccacacaggtctcatcagccaagggatttaaaaatcaaatttaacttcaaaaaactgaagttgatata

SEQ ID NO: 8660 - DNA, 201 bp, Homo sapiens
gcatggtctcagatccacttctaaggtcagtgtgaaagggaaggcaaattcactttgagcaggggaggcatgatctggaagataaagcagctaggagtatrgactagggggctgatggaggggaacacctatcacaatatgtgttctcacaccaatgatatatattttccacacatttagattctccatgccactccttat

SEQ ID NO: 8661 - DNA, 201 bp, Homo sapiens
gttattatacttttatgactattcattttgatgtaggccttttaaaatcaattcctccctgttattacaatgctgctttatggtatttgtgatatatcatrtgaatatacttgagggtcatgagaagttcatatgtgtgtgtgtagtgtgggccccagactttcgccacactgctggctaaagtggccatgtttttgtacg

SEQ ID NO: 8662 - DNA, 201 bp, Homo sapiens
agaaaatctggtgtagtggcttagctagcataacttttgagaggtctctgtgtgatggtcttttttaatgtctttcgtgaagaattcttcttttttttttytgagacaatgagttgttctgtcactcaggctagagtgcagtggcgtgatcatggctcactgcagtcttaacctcccaggctcaagcgatcctcctgcctg

SEQ ID NO: 8663 - DNA, 201 bp, Homo sapiens
aatgctgctttatggtatttgtgatatatcatgtgaatatacttgagggtcatgagaagttcatatgtgtgtgtgtagtgtgggccccagactttcgccayactgctggctaaagtggccatgtttttgtacgtctctgcagagcttacaagttattcaacagccagatttctattctgatatgcccttttagttttcaaa

SEQ ID NO: 8664 - DNA, 201 bp, Homo sapiens
aagtttgcccagatagtaagttctactagacatgtcaattttttctgaggtctaatcttgatttttttttcctgcacaatatggaattcagtgtttttatktaatcattcagtaagtcttgactgcctgctatggaggttaagccctttactaagttccaaggatgtacctgtgaataaggcaagttcctttttatcattg

SEQ ID NO: 8665 - DNA, 201 bp, Homo sapiens
gacaatggcctttatttttccttctacttaagggctctcacgttctagaatacatcttaccagcgattaattatgccttgagattgccaggagacgtagaygagcttttattgttttagccactgaatatacctctagataacacaatacatatttacagtgacaagctttgtattatttataggattatagcaaatcatc

SEQ ID NO: 8666 - DNA, 201 bp, Homo sapiens
gggtgtatttcgctgtatatgtgtaccatgtcagcttaccctagaatttgaaacattttcctttgatgattaaattttttttttttttttttgagatggaktcttgctcttttgcccaggctggagtgcactatcgcgatctcggctcattgcaagctccgcctcccgggttcatgccattcttctgcctcagcctcccga

SEQ ID NO: 8667 - DNA, 201 bp, Homo sapiens
aagcgattctcctgcctcagcctcctgagtacctgggaccacaggcacatgccaccatgccagctaatttttagtagagatggggtttcaccatgttggcsaggctggtctcaaactcctgacctcaagtgatctgcctgccttggcctcctaaactgccgggattacaggtgtgagccaccacacccagcccctctccct

SEQ ID NO: 8668 - DNA, 201 bp, Homo sapiens
catctaaatagtgcattgtctgttttcactcaggactttaaaaatagttctagtactaattgtatttttattctaatactgctattccttttactggtacytctgcatcttaaaaaaacaaaacaaaacaacgaaaacttggcatgttggctcacttggtgaatgaaagcatatactgttcagttgtttattcttcagcaa

SEQ ID NO: 8669 - DNA, 201 bp, Homo sapiens
tgggtccacatcagctccacattgcagactgaccccctggaccctcacgtctcaggatccctatctccctgtcagtgctttgtcacccaaagtcaccgcarctcctcttgagtgctttcaagatcagaccgaggggtcctagttcaagctaattcctacctgtgcgatcactagccaagtactgaacctctctgaacttca

SEQ ID NO: 8670 - DNA, 201 bp, Homo sapiens
tacgtctctgcagagcttacaagttattcaacagccagatttctattctgatatgcccttttagttttcaaagcatcgaaaaagggtaatctttagaaccraagtatttgcaaaactcctagacttgaataaggtatttttgaatttgaagagctaagaacccatcaaatcaaaatgctaataattcttccaagtcaaaag

SEQ ID NO: 8671 - DNA, 201 bp, Homo sapiens
tttttatcattgtctttgcagtctattaggggctacacaatttaaacagagaatatatataaaatggtagaaagtacaagtaagtataccttatttttttwaaaaaaatgaatgtggtatttcacccacagcctcaagaatcactttccttaaaattgccagagtaggaaaacttacaattgaagaatttcaggtatttat

SEQ ID NO: 8672 - DNA, 201 bp, Homo sapiens
cattgatacctgccttgcgttctgttacctggaagcacaggtcaaggtagtcttcttgttccactgatttgatgggggtcaggatgctttcagaaaggaartgagaagagtggcttagaacagggaaaatgtggccgggcgcagtggctcacgcctgtaatctcagcactttgggaggcctaggtgcgcagattacgaggt

SEQ ID NO: 8673 - DNA, 201 bp, Homo sapiens
tgttcaaaatgctctaatccctaaattttccagtctaggttattatacttttatgactattcattttgatgtaggccttttaaaatcaattcctccctgtwattacaatgctgctttatggtatttgtgatatatcatgtgaatatacttgagggtcatgagaagttcatatgtgtgtgtgtagtgtgggccccagacttt

SEQ ID NO: 8674 - DNA, 201 bp, Homo sapiens
tatttatgggaaaaatagtattagggcaattgcggtcaaacacattcgtctgttcgttcaattacagcagtaaggatggaagtctaaagagagtttctacrtgatcttatttatcctgcatttataaatacacaaattcttgtacaattaactcagtttttcactcctttcttgcttgcaacttgtcaggtcgttccctcc

SEQ ID NO: 8675 - DNA, 201 bp, Homo sapiens
atatgtcatcgaggtcccctctttatttattcccttagttttgatgatcttttatgggttatattcttcaaagggaaaattctctccgaatggggctgccrctggcagacgagcactgtcccatcttggcttgttcccccagtgacaagaagctgttttccccactacccttggcccaaaagccacagggagaaccaggat

SEQ ID NO: 8676 - DNA, 201 bp, Homo sapiens
aaaaaaaaaaaaaaaggacagggaaaatgtccaggaaggatgtggcttagctgaagatcagcttcagcttgatcccacgggaagctctggagggtgaattstacagcagagttggtcctgactgagaccagggcctggctgacctatggcagtcagcgatgagccagtgtctgctggggaagagggcggcgtggacatagc

SEQ ID NO: 8677 - DNA, 201 bp, Homo sapiens
aatacaaaaaattagccgggagtggtggtgttcgcctgtagtcccagttactcaggaggctgagccaggagaatcgcttgaacctgggaggtggaggttgyagtgagccgagatcgtgccgttgcactccagcctgagtgacaagagcaacactccatctcaaaaaaaaaaaaaaaaaaaaaaggacagggaaaatgtcca

SEQ ID NO: 8678 - DNA, 201 bp, Homo sapiens
atgtggccgggcgcagtggctcacgcctgtaatctcagcactttgggaggcctaggtgcgcagattacgaggtcaggcgattgaggccaggctggccaatrtgatgtgagaccccatgtctactaaaaatacaaaaaattagccgggagtggtggtgttcgcctgtagtcccagttactcaggaggctgagccaggagaat

SEQ ID NO: 8679 - DNA, 201 bp, Homo sapiens
aagagtggcttagaacagggaaaatgtggccgggcgcagtggctcacgcctgtaatctcagcactttgggaggcctaggtgcgcagattacgaggtcaggmgattgaggccaggctggccaatatgatgtgagaccccatgtctactaaaaatacaaaaaattagccgggagtggtggtgttcgcctgtagtcccagttac

SEQ ID NO: 8680 - DNA, 201 bp, Homo sapiens
ggaaatgagaagagtggcttagaacagggaaaatgtggccgggcgcagtggctcacgcctgtaatctcagcactttgggaggcctaggtgcgcagattacraggtcaggcgattgaggccaggctggccaatatgatgtgagaccccatgtctactaaaaatacaaaaaattagccgggagtggtggtgttcgcctgtagt

SEQ ID NO: 8681 - DNA, 201 bp, Homo sapiens
atgctttcagaaaggaaatgagaagagtggcttagaacagggaaaatgtggccgggcgcagtggctcacgcctgtaatctcagcactttgggaggcctagrtgcgcagattacgaggtcaggcgattgaggccaggctggccaatatgatgtgagaccccatgtctactaaaaatacaaaaaattagccgggagtggtggt

SEQ ID NO: 8682 - DNA, 201 bp, Homo sapiens
cgtcaatctgctatgatccttttatggttctgacgttgcagttttatttttgcatgtttctagagacatcaggaggggatcttttcgggatgtggcttcaraaaggagcctgttggatggtctcttactagtggtcagcaaagaacagttcttttgtaaattgcactgcattaagagcattcctgtttccatctcattgat

SEQ ID NO: 8683 - DNA, 201 bp, Homo sapiens
atatttaataaatattttggggccttgtagtgtttgttgccaactactcaactctgccctcatagtgcaaaaacaggcataaacgatatgtaaaggagcargcatggctgcgagaaactttatttatggatactggaatttgaatttcatatacattttcatgtgtcacaaaatattattctttcccccccgcccccaacc

SEQ ID NO: 8684 - DNA, 201 bp, Homo sapiens
gtcgatatgctagagtgatgtgaaaaaaataataaaagcgagatatttcatggcaaagcgatctcagggtaaacactgcacaccagtaagtattcttgggkcaaatgggaaaagggttaaaatgaccagatctccagagatctcactcactgtggtgaagacagcgccaagccatgagggctccgccccagtgattcaaat

SEQ ID NO: 8685 - DNA, 201 bp, Homo sapiens
aatgctacattttctcggatttgacattttcagtgatggagaactattatattttgtaaatggaaataccactactaaaaacagaaggctataaatagaaygatatccttcgtttccaaagtcgatatgctagagtgatgtgaaaaaaataataaaagcgagatatttcatggcaaagcgatctcagggtaaacactgcac

SEQ ID NO: 8686 - DNA, 201 bp, Homo sapiens
gaacagaactaacatcagaatcatctgaatcatcagaattgtgtattttggaaaaatcggattcatcaaatgaatcttcagccaacaactgttcgagaatkatgttaacatcacatgcaggaatgctacattttctcggatttgacattttcagtgatggagaactattatattttgtaaatggaaataccactactaaaa

SEQ ID NO: 8687 - DNA, 201 bp, Homo sapiens
gccagcgctcatttaattttacataaacatgctctttgaagctgaagcaaatgtgaccgattttcaaagtgataataaaatataaaaacagttcttggaawtatttctgaacagaactaacatcagaatcatctgaatcatcagaattgtgtattttggaaaaatcggattcatcaaatgaatcttcagccaacaactgtt

SEQ ID NO: 8688 - DNA, 201 bp, Homo sapiens
ggtaaaatcaacaagatttggccaacagctctgaaggggatgacaggcgtggtgaatggagaaggaaggacagaaggctagtttgggacttctggcttggmcagtgtattgtgtagtggaaccatcgctgaagataggaggagtccttttcagtcatactgaattcatgacgcctgtggggcacccaagtggaagtcatcc

SEQ ID NO: 8689 - DNA, 201 bp, Homo sapiens
atcctatgccaaacttcctagcctccacctgtaccctgaattggccctagcctagttttccaaactttatccccaggtggttgaactttctaagtttcccsaagctgatcagtgttttggggtggtatggaactcagaatagatcactttttttattgactaactctgaccataagtatgcttctgtgcgagcctgacctc

SEQ ID NO: 8690 - DNA, 201 bp, Homo sapiens
aggttgaaggaatgagtgcgtgtatcttgtcaaaggaaatcacaagcccatgtaaactcgctcttgcttccgtcacctcgtgctttgaaacataaccacartgtgctgaggtttcacattgttacatcctacaagcgtgcttacctgcatcaccttgctgggctgtttcagcattggaatatcactgggaatctcaagttc

SEQ ID NO: 8691 - DNA, 201 bp, Homo sapiens
tttttttttttttttttttttttttactttcaccaggtatttttttgtggagtatgcatttaattcacatttacaaattggtttctgtttttaactaaagrtactttttcagcagaaatgatgtgtatgatgtcatatctaacttgtgatctcactggtatttgatgttaagcctcaaaatcatcaaattttttttacggc

SEQ ID NO: 8692 - DNA, 201 bp, Homo sapiens
gtcgaagcagaaaggagttgcagcttctggccagtagaattaattatttattatccttttcataaatactttccgaggccgacataactgaaaattgctcrggctgtttgaaaacacacacacacagttttccagtggctaatttgaaaaatgtcaccgtattagttttcatttacatctgtcaggaaacatatctataca

SEQ ID NO: 8693 - DNA, 201 bp, Homo sapiens
atactgagatcctggtgtgcacaggaaaagagctaacctttgtggatgaaattgtagagtcactacctgcatttgctgtagctcttacaattattttattyttggaagacatcgagagcatggtccaaagctgcataggttgcaagtgggtagaggcagaatttctctccaggcctggtggattctaaagctgtttactct

SEQ ID NO: 8694 - DNA, 201 bp, Homo sapiens
cactatgccagcaaagttgagtagttgggatggagactgtatggcccataaagcctaaaatactctctgctcctttccagaaagcttggcaacccctactrtcatctccacgtctgcctttgttcttcttatttgtcccttccctctgaaggcaggatagcatagggtgaccataagactctctggaactagcctgcttga

SEQ ID NO: 8695 - DNA, 201 bp, Homo sapiens
taaaaattgtatgaaattcaaatttcagtgttcataactaaattttaaaaacttttattgaagttccagagagatctgaagtagttttattggaacacagycctacacaccttcatttataagctatctgtggctacttttgcactatgccagcaaagttgagtagttgggatggagactgtatggcccataaagcctaaa

SEQ ID NO: 8696 - DNA, 201 bp, Homo sapiens
gcatggtggtgcatgcctgtaatcccagctacttgggaggctgaggcaggagaattgcttgagtctgggaggcggaggttgcagtcagctgagattgtgcygttgcactccagcctgggcaacaagagcgaaactccatgtcaaaaaaaaaaaaacaacaaaaaacacgaatatctttttttgtcagctccatgagggcac

SEQ ID NO: 8697 - DNA, 201 bp, Homo sapiens
gggaggctgaggcaggtggatcatgaggtcaggagttcgagaccagcctgaccaacatggagaaaccccgtctctactaaaaatacaaaattagccgggcrtggtggtgcatgcctgtaatcccagctacttgggaggctgaggcaggagaattgcttgagtctgggaggcggaggttgcagtcagctgagattgtgccgt

SEQ ID NO: 8698 - DNA, 201 bp, Homo sapiens
cccttgctggctgcagttgatttgttacttaccgtgaggttatcatagctttgcagagactttgtgatggggctgtcaacagagagagagagagagaaagraaagaaagaagtgccaccagtccattttgttccactcaaatgtagatcgtaatttttaggtttgtaattactgatgagaagaatgcctgagccagaactt

SEQ ID NO: 8699 - DNA, 201 bp, Homo sapiens
gggcagatgcagccattcagttgacttcctgtggacaccagagatgacaggcccctgtccccagcttaccatccagcatataaggcatatatgcccctttscatgaagtataatctaatgagaacagttggagaaggtcaggcaaaggggacaggacaggaactcaggaggaggggatatttagacttacagacctgccct

SEQ ID NO: 8700 - DNA, 201 bp, Homo sapiens
ctgtcttcattcaacaaatatatttcggtctctgttagatacagtgtatctctgttagatacagagcattctgttagatacagagaatctctggtagatayaaagtattctgctattctgatcttcctgttagaagatcagatttacagaagtctacatttgctctcaagggaccttcagtctgtttggagcaatctcttt

SEQ ID NO: 8701 - DNA, 201 bp, Homo sapiens
aagtggatttaaaattactttttactgctaatggggcatctgtcttcattcaacaaatatatttcggtctctgttagatacagtgtatctctgttagatasagagcattctgttagatacagagaatctctggtagatacaaagtattctgctattctgatcttcctgttagaagatcagatttacagaagtctacatttg

SEQ ID NO: 8702 - DNA, 201 bp, Homo sapiens
cgaatcacagttgtaattcacatttttctccaccaattctgataacttgcattaagaaattgactgtgtaagttaaattttagatcaataatgcaaattgsaagacctagtacaggccaaggcctcattatatctgagtagggctttaagaaagcaagaaagaatcgcttgaacctgggaagcggaggttgcagtgagttg

SEQ ID NO: 8703 - DNA, 201 bp, Homo sapiens
tatatatatatatatatagttataatgtggtgggttctcgaatcacagttgtaattcacatttttctccaccaattctgataacttgcattaagaaattgmctgtgtaagttaaattttagatcaataatgcaaattggaagacctagtacaggccaaggcctcattatatctgagtagggctttaagaaagcaagaaaga

SEQ ID NO: 8704 - DNA, 201 bp, Homo sapiens
gtatgtgggcccatttgccatgtgtgtgtgtgtgtctgtctatctatctatctatgtatatatatatatatatatatatatatatatatatatatatatasttataatgtggtgggttctcgaatcacagttgtaattcacatttttctccaccaattctgataacttgcattaagaaattgactgtgtaagttaaatttt

SEQ ID NO: 8705 - DNA, 201 bp, Homo sapiens
cagattggtatcatgctttatgtgtgttcattctagtcctgcacgtgtagaaatgtaagattttaatgtatggtaaggtagatagatagatacatacatasatacatacatacatacatacatacatacatataaaattaggtaagaggatacttttaatgtatggtaagctatgattgcaccactgcattctagcctagg

SEQ ID NO: 8706 - DNA, 201 bp, Homo sapiens
gcatagaatgtttatatggtggccaaaaaagcagattggtatcatgctttatgtgtgttcattctagtcctgcacgtgtagaaatgtaagattttaatgtrtggtaaggtagatagatagatacatacatacatacatacatacatacatacatacatacatataaaattaggtaagaggatacttttaatgtatggtaag

SEQ ID NO: 8707 - DNA, 201 bp, Homo sapiens
aaaaaaaaaattagttatctctgccctttgggaggctgaggcaggtggatcacttgaggtcaggagtttgaacctagcctgggcaacatggtgaaaccccrtctgtagcaaacatacaaaaattagctgggtgtggtggcgtgcctgtaatcccagctattggggaggctgaggcaggagaatcactcgaacccgggaggt

SEQ ID NO: 8708 - DNA, 201 bp, Homo sapiens
aacagaatatcctaatcttgcaagtggcatatcatgttccttcttttttaagagagaaggagaaattcctgcagatcatcagggactgaggctaactgaarctttggaatggatacagtgctactctcagctgaaagcacaaatcacttccatcacgtatatgagattcctacttgcagcactgcagaggggtgataagca

SEQ ID NO: 8709 - DNA, 201 bp, Homo sapiens
ggggttgccagagaacttacacaggagcgtttctgctggaatcagctcgatgcctcttgaggacagagactcccagaggaaggagcgggcagccatccttrctgtgctgcagcctccacaggtgacacctcctggtgtgggagggacccaggtgaacagggtctggagtagacccccagcaaactacagcagtgttactgg

SEQ ID NO: 8710 - DNA, 201 bp, Homo sapiens
ccatgctcaggagatgtcagccttttccattgtctccccgcccccaccgccagccctgcttaaattatcccctctttttaaacagaatatcctaatcttgsaagtggcatatcatgttccttcttttttaagagagaaggagaaattcctgcagatcatcagggactgaggctaactgaaactttggaatggatacagtgc

SEQ ID NO: 8711 - DNA, 201 bp, Homo sapiens
ctttaaaaatacagcctgcttgccatctcacgacttttcccttaatgcaacaaagaaatatgtgtttggctgtgaaatctttttttttttttttttttttkttttttgctgtggagcgcaaaatgttcatttatctctggatggtttgtttctggccacctgccctaagtgtatctgaatattgtaacggtgatcacttct

SEQ ID NO: 8712 - DNA, 201 bp, Homo sapiens
aggtggatcacaaggtaaggggtttgagaccagcctggccaacatggtgaaaccccatctctattaaaaatacataaattagtcgggcatggtggcatgtrcctgtagtcccagctgctcaggaggctgaggcaggagaatcactcgaacccgggaggcagaggttgcagtgagcctagactgcaccattgtactccatcc

SEQ ID NO: 8713 - DNA, 201 bp, Homo sapiens
cactttgagaggctgaggtaggtggatcacaaggtaaggggtttgagaccagcctggccaacatggtgaaaccccatctctattaaaaatacataaattastcgggcatggtggcatgtgcctgtagtcccagctgctcaggaggctgaggcaggagaatcactcgaacccgggaggcagaggttgcagtgagcctagact

SEQ ID NO: 8714 - DNA, 201 bp, Homo sapiens
cctgtaatctcataatctcagcactttgagaggctgaggtaggtggatcacaaggtaaggggtttgagaccagcctggccaacatggtgaaaccccatctstattaaaaatacataaattagtcgggcatggtggcatgtgcctgtagtcccagctgctcaggaggctgaggcaggagaatcactcgaacccgggaggcag

SEQ ID NO: 8715 - DNA, 201 bp, Homo sapiens
aagttcaaagaaaggagtaaatcacgaccaggcacagtggctcgcgcctgtaatctcataatctcagcactttgagaggctgaggtaggtggatcacaagstaaggggtttgagaccagcctggccaacatggtgaaaccccatctctattaaaaatacataaattagtcgggcatggtggcatgtgcctgtagtcccagc

SEQ ID NO: 8716 - DNA, 201 bp, Homo sapiens
aagtgctccgtaaatgtcagcatctattattatcatttgtgtttttttttccccttctctgccttcctttctctccctccttggtctgcttcctcctgttrctatcagagcctgcctgcctcatccttgttccagccttgatggtgatgatgattgtggttgctgttgctatttgtttttttggtttgtttgtttgttttg

SEQ ID NO: 8717 - DNA, 201 bp, Homo sapiens
aaagacaaaacagaaaaaggaggagaggacacagaggagaaggctctgtgaagtcagaggcagagattggagtgatgcgtctacaagccaagagatgccayggtcatgggcagcccccagaaacgaggagagaaacctggcacggtttccacaaggagtcacccctgccaacaccttggtttcagacttctggtctcctga

SEQ ID NO: 8718 - DNA, 201 bp, Homo sapiens
tgggccctaaatccaatgacggttatcctcatgagaagaggaaagcagggggcacagtggtgggtgtgcctgcaatcccagctactcgggaggctgcggarggggcatcacttgagcccaggagttcattgccagcctgggcaatatagcaagaccccatctcttaaaaaaaaaataacaccaaaagacaaaacagaaaaa

SEQ ID NO: 8719 - DNA, 201 bp, Homo sapiens
ggcagagatggggaaggtgctgttcccttcctcctgggaagggcaaagaaagcagggtggtcctcccatccccgtgaggaaggaagagcctcattcatgcygagaccctgatggagaactgggtccagggataatgttttgtgttcctgctcatgggactggtgtgttattgtcaagggatcttacaggccttgcttccca

SEQ ID NO: 8720 - DNA, 201 bp, Homo sapiens
tgcctgattccaggatgctctaacctggccacgcatcccccgtggattctcagctgttgtgtgtttcctcctcaggtggccactgtgtctggtgctcaccyacattttggttcatcctgactttgcctcagcctccccattctgcatttctcccacggcttctcccagccctggcccagtgacactgtaatgtggactgtg

SEQ ID NO: 8721 - DNA, 201 bp, Homo sapiens
tatgcagtatatgtgctaaattactttttttgttgttgttgagatggagtttcgctcttgttgcccaggctggagtgcagtggtgtgatcttggcttgccrtgatctctacctcccaggttcaagcgattctcctgccgcagcctcccgagtagctgggattacagacatgtgccaccacacccggctaattttgtatttt

SEQ ID NO: 8722 - DNA, 201 bp, Homo sapiens
gttcagaggctgcaggaatgattcaaagtctgactgatttatgtgcattgggcattttgttgatgtcattcagattaatgatggcactgaaaatgtgtaayggaaatgagaagtttgtatcctgcctgctataccatgattccaatttaagagggggtaaaaatattgcactttttaatctattgttttttgaaagagact

SEQ ID NO: 8723 - DNA, 201 bp, Homo sapiens
gtgttcttgcctggcttattgagctccatggtaaatgttcagaggctgcaggaatgattcaaagtctgactgatttatgtgcattgggcattttgttgatrtcattcagattaatgatggcactgaaaatgtgtaatggaaatgagaagtttgtatcctgcctgctataccatgattccaatttaagagggggtaaaaata

SEQ ID NO: 8724 - DNA, 201 bp, Homo sapiens
gtctcaaaaaaaaaaaaaaaaaaaaaaatctgtgttcttgcctggcttattgagctccatggtaaatgttcagaggctgcaggaatgattcaaagtctgaytgatttatgtgcattgggcattttgttgatgtcattcagattaatgatggcactgaaaatgtgtaatggaaatgagaagtttgtatcctgcctgctatac

SEQ ID NO: 8725 - DNA, 201 bp, Homo sapiens
cccctaacaacctctacctggcaatcttcatttaactccaaactcaggacctcaatcctctgtttggcctgtgttccacgggacaggcatggggcacagakgtctgttatatataagggacaaatctctgggttggtcactcctggattccccagcccggaccacacattcaggtgcatctcccacacaggatcattctaa

SEQ ID NO: 8726 - DNA, 201 bp, Homo sapiens
tccaaggatgtacctgtgaataaggcaagttcctttttatcattgtctttgcagtctattaggggctacacaatttaaacagagaatatatataaaatggkagaaagtacaagtaagtataccttatttttttaaaaaaaatgaatgtggtatttcacccacagcctcaagaatcactttccttaaaattgccagagtagg

SEQ ID NO: 8727 - DNA, 201 bp, Homo sapiens
taatcattcagtaagtcttgactgcctgctatggaggttaagccctttactaagttccaaggatgtacctgtgaataaggcaagttcctttttatcattgkctttgcagtctattaggggctacacaatttaaacagagaatatatataaaatggtagaaagtacaagtaagtataccttatttttttaaaaaaaatgaat

SEQ ID NO: 8728 - DNA, 201 bp, Homo sapiens
tcacaccaatgatatatattttccacacatttagattctccatgccactccttatctctttagtgcagaaaacggagaggaggttcagtattcttaagaamctcccatgattgctttgaggcaatggatttaacaggtatctttatcccttatttacgcactgactgtggtactgagtcatccctggtgtttctggatttt

SEQ ID NO: 8729 - DNA, 201 bp, Homo sapiens
agcaggggaggcatgatctggaagataaagcagctaggagtatagactagggggctgatggaggggaacacctatcacaatatgtgttctcacaccaatgrtatatattttccacacatttagattctccatgccactccttatctctttagtgcagaaaacggagaggaggttcagtattcttaagaaactcccatgatt

SEQ ID NO: 8730 - DNA, 201 bp, Homo sapiens
agcatttgactgttgcatcctttgattgggccatgttcatgcagccagcctgggaaagcaattagtagttttaagcatgggaaatcatataaaagtaaacyaaaattgcatttgaattaattgatgaacatgtttgcttgaccatatcctgctgttaggcgtcttcaagttaacttaagtggttgataaaactttccaaaa

SEQ ID NO: 8731 - DNA, 201 bp, Homo sapiens
tttagacatttagattttttctgttttatctctctctctctatatgtatatctatatatatatttatctatatctatatagagatatatatatatatatawaataatgaatgaaatggactgtttgcaacctcagatgtatttctaggacttagagtgattagcttgaggcgatggtagtttctgtttttggagtctctgt

SEQ ID NO: 8732 - DNA, 201 bp, Homo sapiens
ttaacttatatctggtcctttagacatttagattttttctgttttatctctctctctctatatgtatatctatatatatatttatctatatctatatagakatatatatatatatatataataatgaatgaaatggactgtttgcaacctcagatgtatttctaggacttagagtgattagcttgaggcgatggtagtttc

SEQ ID NO: 8733 - DNA, 201 bp, Homo sapiens
tgttgtcatcgttttatgattaacttatatctggtcctttagacatttagattttttctgttttatctctctctctctatatgtatatctatatatatatwtatctatatctatatagagatatatatatatatatataataatgaatgaaatggactgtttgcaacctcagatgtatttctaggacttagagtgattagc

SEQ ID NO: 8734 - DNA, 201 bp, Homo sapiens
ctttctagctgtgtaactttaggcaaataatgtaacctccatctgcctttgttttttcctctgtaatagaaggaacaacaacgaacaacattttttttttkgcaagattaagtgagatcttccatttgacatgcctggctaattggcagtgcccaacagatagaaactattggtattgtaaggactgcttattgggtacat

SEQ ID NO: 8735 - DNA, 201 bp, Homo sapiens
ggtacagtgaaaatatggtattataatctgatgggatcggcattgtgtacatagttcgttattgactgaaatgttggtatgaggtgtatgactatgttttytcatgacctctgctttttttgtctttaagtttttaatttttgttttacttttgtcttttaattttaattctattgcaaccaaatctatcagcctgtcttc

SEQ ID NO: 8736 - DNA, 201 bp, Homo sapiens
tgataacacacgtatatattatctctttaaaaattaaaaaaaaaaaagccagccaaaaaaagaaaatggaagtgttcaagaaactgccttttttcatgtartagtatttctgtgtcactaaatccttcaacagcattatttttaatagctgcccaatgtcctaatggatgggtgagtcatgatttacttaaccaatcccct

SEQ ID NO: 8737 - DNA, 201 bp, Homo sapiens
ccattctcctgcctcagcctcccaagtagctgggactacaggcacccgccaccaagcccagctaattttttgtaattttagtagagatggggtttcaccaygttagccaggatggtctctatctcctgacctcgtgatccgcctgcctcggcctcccaaagtgctgggattacaggtgtgagccaccacgtccggcctgtt

SEQ ID NO: 8738 - DNA, 201 bp, Homo sapiens
ctcagaaagtaataaagccctgcagtaatcagagggctgaggccaggtccccagtgagcggctgaacacacagtgattcaaacccactccagacctgtgtwcttaatcattaccttcacctggagggacagacctggccttgggcaagccacccccactccctggctctgtgaccttggcagctgactggccctctccaag

SEQ ID NO: 8739 - DNA, 201 bp, Homo sapiens
ccaagtggaaggtggtgtaggcaaagagaaggatgcataggcacattggacggtggaaggcaggggctgctgaatgatgtggcaggaaacatgcaaagtgytcagcgtccctgggcggtgcagagtcttgggaagcaagaggatggagccatcctttcagtttccagcctgggtttcccaaaggagagggtgtttgagttc

SEQ ID NO: 8740 - DNA, 201 bp, Homo sapiens
aaacatcctgtggaattcgcctcagatgcccctccatttgcactggtatatggaggatgtttgaaaaccaccagaacctattgtgtactttggaacaatgrcattttcctgcttgattgtgaagatggccgctggaaaagaagccaactcccagggggcacgaggggctaagctgtctcctgggaagtttgagggaggcca

SEQ ID NO: 8741 - DNA, 201 bp, Homo sapiens
ttcaggagcagcctgggctgagtttttaatgtggcagcagcctcggctggtttcagcatgcaggtgagaaggccgttcatctggaacttgggctacccaasagtgcaagtggggagatcagagcatggaaaatgtttttgtataaacttaggtggaccaaaatgatcatttcaacaacatttcggacttgattttttgtat

SEQ ID NO: 8742 - DNA, 201 bp, Homo sapiens
agcaccactggccaaagcgaggatagctgattgcactcctactttcctgctggtggaaacagcatgtatataggtacaactctggtgtggggaaaatgctraagatataaagtagaaatagcctttgtgtgatgtgagcagcagaacaaaaatcgagggtgccaaataatcgtatgaagtggtgaactgcctaagatggaa

SEQ ID NO: 8743 - DNA, 201 bp, Homo sapiens
ttcagggattaggacctggacatctttggttgggaaatgggcatcattttgtctaccacaacgtgagagcccattgccctgcatccacagtcataaaagtstgttcccttcctccctgattcttcctaacttctcctgcctgccttgcaggatatgtggagttatcagttcctagcaccactggccaaagcgaggatagct

SEQ ID NO: 8744 - DNA, 201 bp, Homo sapiens
cctctccctatttatttttattttatttgtgagacagagctttgctttgttgcccagactggagtgcagtggcttgatcttggctcactgcaacttccgcytccagggttcaagcgattctcctgcctcagcctcctgagtacctgggaccacaggcacatgccaccatgccagctaatttttagtagagatggggtttca

SEQ ID NO: 8745 - DNA, 201 bp, Homo sapiens
cagtgtttcctctttgttaatcctcatgatgattggtatggtttggctgtgtccccacccaaatctcattttgaactgtaatctccataatccctacgtgycaggtagggacctggtaggaggtgattggcccgtggtggcagtttccctcatgctgttctcgtgatagcacgtgagttctcgtgagatctgatagtttta

SEQ ID NO: 8746 - DNA, 201 bp, Homo sapiens
gaggcaggtggattgcttgagctcagtcgtttgagaccatcctgcacaatacggtgaaacctcatctctactaaaatacaaaaatgtagccaggcgtggcrgcacatacctgtagtcacagctactcaggaggctgaggcaggagaattgcttgaacccgggaggtggaggttgcagtgaggtgagatcgcaccactgtac

SEQ ID NO: 8747 - DNA, 201 bp, Homo sapiens
gtgcggtggcacactctgtaatcccagcactttgggaggccgaggcaggtggattgcttgagctcagtcgtttgagaccatcctgcacaatacggtgaaamctcatctctactaaaatacaaaaatgtagccaggcgtggcggcacatacctgtagtcacagctactcaggaggctgaggcaggagaattgcttgaacccg

SEQ ID NO: 8748 - DNA, 201 bp, Homo sapiens
gatctcaggagagccaactcaccacacagcatacgtgctaaaccatgcatgagaaatctgtccgcatgatctaatcaccttccaccaggccccacctccarcgttagggattacatttggacatgaaggctgggtgcggtggcacactctgtaatcccagcactttgggaggccgaggcaggtggattgcttgagctcagt

SEQ ID NO: 8749 - DNA, 201 bp, Homo sapiens
gagcaagggggcaggtgcaaaacacttttcaacaaccagatctcaggagagccaactcaccacacagcatacgtgctaaaccatgcatgagaaatctgtcygcatgatctaatcaccttccaccaggccccacctccaacgttagggattacatttggacatgaaggctgggtgcggtggcacactctgtaatcccagcac

SEQ ID NO: 8750 - DNA, 201 bp, Homo sapiens
ctgtacaggaagcatgatgctagcatctgcttggcttctggggaggcctcaggaaacttacaatcatggtggaaggcaaaggggaaggaaagcatctcacrtggtgcaaacaggagcaagagagggagcaagggggcaggtgcaaaacacttttcaacaaccagatctcaggagagccaactcaccacacagcatacgtgc

SEQ ID NO: 8751 - DNA, 201 bp, Homo sapiens
tcattcttgcactgctataaagaaatacctgagactgggtaatttatttaaaagacacctttaattggctcacagttccacaggctgtacaggaagcatgmtgctagcatctgcttggcttctggggaggcctcaggaaacttacaatcatggtggaaggcaaaggggaaggaaagcatctcacatggtgcaaacaggagc

SEQ ID NO: 8752 - DNA, 201 bp, Homo sapiens
ttcattcttgcactgctataaagaaatacctgagactgggtaatttatttaaaagacacctttaattggctcacagttccacaggctgtacaggaagcatratgctagcatctgcttggcttctggggaggcctcaggaaacttacaatcatggtggaaggcaaaggggaaggaaagcatctcacatggtgcaaacaggag

SEQ ID NO: 8753 - DNA, 201 bp, Homo sapiens
gcagggagtaatgtgtatatgaatcatcagctatgcaacataatgctgatgctaagtactaacattgatggagtgttggcatgagctgggcagagtgctcyatcctctatgtgtgtattagttcattcttgcactgctataaagaaatacctgagactgggtaatttatttaaaagacacctttaattggctcacagttcc

SEQ ID NO: 8754 - DNA, 201 bp, Homo sapiens
attcatttaagataatgaagctcctgtccttgacccaatctccactctaccgtttgatgtccagtgtggactgcccctctgaaagcccttcactgcggctyagcctgtggtggaaggtgtccaaggtggctggaacacctcctgctgggggtgtcagtcttggctctcctgttttctgcctgtgcaatggtgggtaggtcc

SEQ ID NO: 8755 - DNA, 201 bp, Homo sapiens
tccagcctgagtgacaagagcaacactccatctcaaaaaaaaaaaaaaaaaaaaaaggacagggaaaatgtccaggaaggatgtggcttagctgaagatcwgcttcagcttgatcccacgggaagctctggagggtgaattgtacagcagagttggtcctgactgagaccagggcctggctgacctatggcagtcagcgat

SEQ ID NO: 8756 - DNA, 201 bp, Homo sapiens
gccactctcttgcataggattttcttttctttctagaaacaggaactgagtatgtttccaatatttttttatttctcctaaaaaacatcagagactatatrtataaaatctcacaaactttgtttcccagaaaaacaactatatttaaatgcagctcatactgtatgtaagtatgatgtaggaaaatctgttaattgtgtg

SEQ ID NO: 8757 - DNA, 201 bp, Homo sapiens
cttcgcaaagggaaataactcttctgctaaccctcctgcccaacctgagatgaagtatcaggggatgcagtatggatgtattttcctgacgattggtcctkctgtcctgggacccaggtgtgagtgcatagggaaaagggaggagaaatttaatcctgtaactatctccttatggaaaacaggaaaccacaaatgaatcaa

SEQ ID NO: 8758 - DNA, 201 bp, Homo sapiens
gagtgacaagccctggagacctgagggcttctggggcccccagggcggtttcaggaggctgtctccagacctgtccggggtgtgagcatgtcacgctgtgrcccgcgcctcccctgtacagctgcctctgctcttctaagcactgaaatgagaggtgtaacctgtgttccagagtctgcgcctcccagccactggggcagg

SEQ ID NO: 8759 - DNA, 201 bp, Homo sapiens
agctaattcctacctgtgcgatcactagccaagtactgaacctctctgaacttcaattatctcatctgtaaaaggtggttggtttgtaattgttcctaccycttagggcttttgtgagagtttagatgataaaccaccaagcaacagtggctggcattctgtgcacaatcgaagtctgctgctgtcagctctgtggtcgct

SEQ ID NO: 8760 - DNA, 201 bp, Homo sapiens
aggtggttggtttgtaattgttcctacctcttagggcttttgtgagagtttagatgataaaccaccaagcaacagtggctggcattctgtgcacaatcgawgtctgctgctgtcagctctgtggtcgctgtctgcactcccacccctgtcatcctccaagtctgatctcctcccgaagtctcttcctggacctcagccctc

SEQ ID NO: 8761 - DNA, 201 bp, Homo sapiens
gtgagatctgatagttttataaatggaagtttcccctggccttcattctctttcctgctgctttgcgaagaaggtgcttgcttctgctttgccttctgccrtgattgtaagtttcctgaggcctccctagccatgcggaactgtgagtcaataaacctctttcctttatacattacccagtctcgggtagtatcttcatag

SEQ ID NO: 8762 - DNA, 201 bp, Homo sapiens
tgagatattgggactgttcttattcccatttcacagatgagccactaactggctcctggcaggacagtgaataaggggcacaacagagacacaaacacatsgctaaccaatggtctcatccgtcagccacactgcctgtctcagcatgggccctgtgtggaccattccatctcaatttgtttctgattcttgtcaattaaa

SEQ ID NO: 8763 - DNA, 201 bp, Homo sapiens
cttgggctaaaatgtagttgttggcatttctttctggaggctctgggggaaggtcgttccttggccttttcccatgacgtagaggctgacacattcctctkctatggcctcttcatttttcaaagccagcaagattgcatctctctgtctttcttttgtggtcacattttaccaggactcttctcctgcttttttttttct

SEQ ID NO: 8764 - DNA, 201 bp, Homo sapiens
gcagcctgtaactcccagactgaagcgatcctcctgcctcagcctcccgagtagcttgtactgcagatgtgtgtcaccatacctggctgatttatacttayatttatgtatgtgcatgtgtgtttatatatatatatttgtagaaatgggattttgccatgtttcccaggctgggctcaaactcctgggtttaagcagtcc

SEQ ID NO: 8765 - DNA, 201 bp, Homo sapiens
caaagtagggaaagcacgactttggggccagggccctttctggttcagaatgtccctggccagtgtgcgccgtgcagtgtggaagcacgcttcggtgcgcrtgtaagtttacgtgctatctgtagggacagtgatttttattcattagagtttttgagtctaattgtttttaaactgccacttttgtttgttaaagataca

SEQ ID NO: 8766 - DNA, 201 bp, Homo sapiens
aaaaaaaaaaatcactggatttgaagttggcctatgttagattactccaaggaagttagttaatatgttaatatgaatctagatgaacattgagtgttttrctcttcttgttaatttgcgccatctactaatctctggacaatggagaaaaagtcgtaggttatgagttttttatttatggacattaagcaatatctttaa

SEQ ID NO: 8767 - DNA, 201 bp, Homo sapiens
tctggacaatggagaaaaagtcgtaggttatgagttttttatttatggacattaagcaatatctttaaaatgtaaaatgaagccgacaaaatgcacagccrgataacaacaacaaatctaatctaaagtgacaggaagagactctcccagacatttttctctttaatgtaacatgactttaaattgatgcaaccccacagt

SEQ ID NO: 8768 - DNA, 201 bp, Homo sapiens
aattgtgatgttcagcagtttataccttgggagctggaagcgtttctccatggtgaatttgtaatattaattggccatgtcagttcatgacaaatgtagtracatctatttcaagtatttcagttttatggtgctgaagaagtgacacgcgctccagataagtaatctcacaaaagatcttcccgctcgctgtggagcgcc

SEQ ID NO: 8769 - DNA, 201 bp, Homo sapiens
aacagcagcacaacaaaatagccatttacatgtcaagactatattcatagaatccatatgtctaaggtggggaagttgtcattattcctgttttatagatraggaaacagaggcccagatggagtaagtgactgctgaagtacacatgatttgtcagtagaaaggaagagaccaaaggtggcatcaactttatctttcctt

SEQ ID NO: 8770 - DNA, 201 bp, Homo sapiens
taagtttttaatttttgttttacttttgtcttttaattttaattctattgcaaccaaatctatcagcctgtcttctatgatctctgcttttaattgttacsctttaaaaatccttctccatggtaacattatattgactcatatgtcttactggttgaacgtgcctatgtttgactttgaaatcattaaattcattgagga

SEQ ID NO: 8771 - DNA, 201 bp, Homo sapiens
atgaaatattaggttaacatggaaaaaacatggcatcccatgttttagtattttttccttatttccaagcagcacctctctttgaattatattctgttctstgtttttataatttgactcccttctattctacatctaaatagtgcattgtctgttttcactcaggactttaaaaatagttctagtactaattgtattttt

SEQ ID NO: 8772 - DNA, 201 bp, Homo sapiens
cactggataggtaatagacgccggcatggctatgctgtggttcctgctgatgggcacactattacaggtgcatgataagtgtgtcgtacgcaggaagtacrtttcccccagccttccctacctgctgagggctgctcccagcctaaggatttcatccagatagattcatagcgcttccagtaaatgcaccccttgcctttc

SEQ ID NO: 8773 - DNA, 201 bp, Homo sapiens
cctgctgatgggcacactattacaggtgcatgataagtgtgtcgtacgcaggaagtacgtttcccccagccttccctacctgctgagggctgctcccagcstaaggatttcatccagatagattcatagcgcttccagtaaatgcaccccttgcctttcaaagttgaaaaagaaattactttggacacaaagaggtgtttc

SEQ ID NO: 8774 - DNA, 201 bp, Homo sapiens
tcatgtgttacctgagactctccgcccataggatgtagttcctttccattggaacacatggggaccgagggaataaagaatgttttcatctctgaaaatayctctcattcttccaatcaatgctgctcttttcttgcatactgtatactgggaagcatttgtttcgatttgtggttaaatgtatgtgtccactggacttca

SEQ ID NO: 8775 - DNA, 201 bp, Homo sapiens
cgatttgtggttaaatgtatgtgtccactggacttcagtatccaccctttgaaggaccgcaggagaagttgttcaggtagaaacatacaagggccggatgyggtggctcacacctgtaatcccagcactttgggaggcctaggcgggtggatcacttgaggcctggagtttgagaccagcctggccaacatggtgaaaccc

SEQ ID NO: 8776 - DNA, 201 bp, Homo sapiens
tgcggtggcgcaaacctgtaatcccagctacttgggaggctgaggcaggagaatcgcttgaactcgggaggcggaggttgcagtgagtcgagtcgtgtcartgcactccagcctgggtgacagagcgaaactctgtctcaaaaaacaaacaaaaagaaacataccgggagatctggttctattgaaccccagtgcagccat

SEQ ID NO: 8777 - DNA, 201 bp, Homo sapiens
cagtggtgtgatctcagctcactgcagccttgacctcctgggttcaagagatcctcccacctcagcctcctgagcagctgggaccacaggtgcttgccacyatgcccaactaacttttgtattttttgtagagacagggtttcaccacattgcccaggcaggtctcaaactcccgggctcaagcgatcctcccaccttggc

SEQ ID NO: 8778 - DNA, 201 bp, Homo sapiens
atcatattctcttcactgaaacatttcagatgacttaaaaattcaccttgtagaacttttaaaattgaaactttctggtgaacatcattagttgacagatrtgtcattgaagtttcatccttcttcatttcagagtctgctggaagacccttcatttaccactctctccttcctggaggtgtggaaatactctacctgggt

SEQ ID NO: 8779 - DNA, 201 bp, Homo sapiens
catattctcttcactgaaacatttcagatgacttaaaaattcaccttgtagaacttttaaaattgaaactttctggtgaacatcattagttgacagatatrtcattgaagtttcatccttcttcatttcagagtctgctggaagacccttcatttaccactctctccttcctggaggtgtggaaatactctacctgggtga

SEQ ID NO: 8780 - DNA, 201 bp, Homo sapiens
ttcaccttgtagaacttttaaaattgaaactttctggtgaacatcattagttgacagatatgtcattgaagtttcatccttcttcatttcagagtctgctrgaagacccttcatttaccactctctccttcctggaggtgtggaaatactctacctgggtgaggctctcgtggctttttgtgccaagtgtccgtaaacttc

SEQ ID NO: 8781 - DNA, 201 bp, Homo sapiens
tctgtagcttcttccagcatgtgatcatacatctacctaacctctcccattggttgaatttaatatactagtgaattttccattgcaaagatgaggttacraatcatagtgttcatactcagaaggactttataaatattttgcctttttgaagtatatacaagaaatgaaaaaaaaaacaggaataaataaaaagaataa

SEQ ID NO: 8782 - DNA, 201 bp, Homo sapiens
cccaggctggagtgcagtggcatgaccatggctcactgcagcctcgacctctggggctcaagcgatccttctgcaacagcctccctagtagctgggactayaggtgcatgccaccacacccagctaatttttatattttttgtagagatggggttttaccatgttgcctaggctggtctcgatctcctgggctctagcaat

SEQ ID NO: 8783 - DNA, 201 bp, Homo sapiens
tcgacctctggggctcaagcgatccttctgcaacagcctccctagtagctgggactacaggtgcatgccaccacacccagctaatttttatattttttgtrgagatggggttttaccatgttgcctaggctggtctcgatctcctgggctctagcaatcctcccacctcggcctcccaaagtgttgggattacaggcgtga

SEQ ID NO: 8784 - DNA, 201 bp, Homo sapiens
cccggccttacgtttcagcatctttcaatccatctaatacgcagtgccagggaaggtttgtgaaaacatttgaatcacagagtcacaaacagtgagaatakctgcagttatgtttgtgatgctctaatgaacttacaaaaggccaggcctagtatttcagctgtgtccatgatgtctctgatggaaatggacaggtaacat

SEQ ID NO: 8785 - DNA, 201 bp, Homo sapiens
attctccatgccactccttatctctttagtgcagaaaacggagaggaggttcagtattcttaagaaactcccatgattgctttgaggcaatggatttaacrggtatctttatcccttatttacgcactgactgtggtactgagtcatccctggtgtttctggattttattggcaatgccaagagagcaggaagactgggac

SEQ ID NO: 8786 - DNA, 201 bp, Homo sapiens
aatgagggcattggaaatccgctctcaggtggccatcgaaaatagtcagcctgagtgttgctacctgttttccataattgtgtagctttgcctttccttarttaatctgttcaataaactcctctgcagaatccaaatgcttaaattcagtttctttttgtctttatggtgtttttcattgttaacgtggcatcggagtag

SEQ ID NO: 8787 - DNA, 201 bp, Homo sapiens
taattgtgtagctttgcctttccttagttaatctgttcaataaactcctctgcagaatccaaatgcttaaattcagtttctttttgtctttatggtgtttwtcattgttaacgtggcatcggagtagctcgacttttgcatcatgataaattcataacccaagagaaggcagaaaacataattattatcaattgcctctct

SEQ ID NO: 8788 - DNA, 201 bp, Homo sapiens
ttgtctttatggtgtttttcattgttaacgtggcatcggagtagctcgacttttgcatcatgataaattcataacccaagagaaggcagaaaacataattrttatcaattgcctctctcctggaattgccattggctgagtggaacaaaatacgaacttaaggagtagctgattcagagaaatccagggtaggaacgggtc

SEQ ID NO: 8789 - DNA, 201 bp, Homo sapiens
tctttatggtgtttttcattgttaacgtggcatcggagtagctcgacttttgcatcatgataaattcataacccaagagaaggcagaaaacataattattrtcaattgcctctctcctggaattgccattggctgagtggaacaaaatacgaacttaaggagtagctgattcagagaaatccagggtaggaacgggtccca

SEQ ID NO: 8790 - DNA, 201 bp, Homo sapiens
gcccttttgaagatcaaatgggatctgtaaaaactctttgaaaaatgtagactgcttcttatgtgattcttactggtctattatttatcaagaaattaaamaggaatgaatatctgtagctgtttttctttttctttcttttcttttcttttctttttttttaagatggagtctcgctctgtcaccgggctggagtgcagt

SEQ ID NO: 8791 - DNA, 201 bp, Homo sapiens
ttcttttcttttcttttctttttttttaagatggagtctcgctctgtcaccgggctggagtgcagtggtgctatttcggctaactgcaatctctgcctccygggttcaagcaattctcctgcctcagcctcccaagttgctgggactacaggcgtgcgccaccatgcccagctaatttgtaattgtttgtttctaaaagga

SEQ ID NO: 8792 - DNA, 201 bp, Homo sapiens
tctgtcaccgggctggagtgcagtggtgctatttcggctaactgcaatctctgcctcccgggttcaagcaattctcctgcctcagcctcccaagttgctgrgactacaggcgtgcgccaccatgcccagctaatttgtaattgtttgtttctaaaaggatattcagtgcttccactgtcttttagaagtctgtagaaggaa

SEQ ID NO: 8793 - DNA, 201 bp, Homo sapiens
cctcccgggttcatgccattcttctgcctcagcctcccgagtagctgggactacaggcgcctgccactacacctggctaatttttttgtagttttagtagrgatggggtttcaccgtgttagccaggatggtctagatctcctgacctggtgatccgcctgtcttggcctcccaaagtgctaggattacaggcgtgagcca

SEQ ID NO: 8794 - DNA, 201 bp, Homo sapiens
gatccgcctgtcttggcctcccaaagtgctaggattacaggcgtgagccaccgtgcctggcctgatgattcagtttttaccccaagatgcagtatgcctcmgtctcactaaaatatgccaatatgttcttcttcttgaggatcagggctgatttcttctactgggaaaatgtatcccctgtgtttggccccagaggcatca

SEQ ID NO: 8795 - DNA, 201 bp, Homo sapiens
ggtggggaggagttcatattcttttttttttttgagtctggattttagaataaattcactgtgtacatagctattccatctttaaaaacctttgtgaatgytaatatacagcctttataaatttgaggtataatgttcaaaatgctctaatccctaaattttccagtctaggttattatacttttatgactattcattttg

SEQ ID NO: 8796 - DNA, 201 bp, Homo sapiens
tttttttctaactgagggattaaggatataaacccaacttcaaatttctttctgggtggtcttgaaaacttaacagtaggtcctgtaaagaggtgggggaraggaaaaagaaatcctttactctcatctgctggttttaaaatgagaaaaatacacacacacacgtaatgatgttcgtgatgttaatggagggaaatatca

SEQ ID NO: 8797 - DNA, 201 bp, Homo sapiens
tgggagatagtttgagatttgaggcctctgaagaataggtgtttttgtgatgattttggcttttcagtttgacagttggctttgcttttttgacagacacmttaagagcttcaagggtcatttcatggtttgtcctttccatgtcagggacacctttcacgtggccattttaagcacaggaattgccttcaagtagtttac

SEQ ID NO: 8798 - DNA, 201 bp, Homo sapiens
tagtaaccatgaacctgtatatcaaaaagcgtgactagagtttcatagttaaacatgtgctgaaatccacagtggacaccagagagggtcatggaatctgrgaatggatgacttgtcccatgatgataatatctgtgttcctacggctgggcccggtggctcacacctgtaatcccagcactttgggaggccgagatggga

SEQ ID NO: 8799 - DNA, 201 bp, Homo sapiens
gcccggtggctcacacctgtaatcccagcactttgggaggccgagatgggaggatcacgaggtcaggagttgaagaccaccttgatcaatatggtgaaacsctatctctactaaaaatacaaaagttagccggtgtggtggtgcatgcctgtaatcccagctactcaggaggctgaggcaggagaatcacttgaacccagg

SEQ ID NO: 8800 - DNA, 201 bp, Homo sapiens
ccagcactttgggaggccgagatgggaggatcacgaggtcaggagttgaagaccaccttgatcaatatggtgaaaccctatctctactaaaaatacaaaarttagccggtgtggtggtgcatgcctgtaatcccagctactcaggaggctgaggcaggagaatcacttgaacccaggaggcggaggttgcagtgagccgag

SEQ ID NO: 8801 - DNA, 201 bp, Homo sapiens
ttttttgaaagagactgtttaaaacacgtaattttgctaagttatggctcatatcgtatttgttattttggttttgaaaaattgagtaggaagcaattgcrttcttaaatgacttgaacatcaaaggcaagtagtgtcttgttttaggagcagccaggctcctatccctctgatccagccaagtgctttcacttggtccca

SEQ ID NO: 8802 - DNA, 201 bp, Homo sapiens
ccctggttgacctggaatgacctagaccagcagtcacaagctcctgcccatggacaaaatacagccggtacctctttggctatggcctgcaggctcagaayagttcttacattttcaatcatctgcaaaaaagaataaagaggagaatattatttcttgaaggaggaaaatgatatggaattctgatttcagtgtcataaa

SEQ ID NO: 8803 - DNA, 201 bp, Homo sapiens
acccaaagagatctgaaaagcaaaaacaaatttattgtatatttatagcaaatttatttggtggtgaaatttgacttcagctttagcgtccctgtttctcstttctagtgtgaatgttcattttgttttgtttgtttttttgaggcaaggtctcacttcatcacccaggctggagtgcagtagtgtgttcacagctcagag

SEQ ID NO: 8804 - DNA, 201 bp, Homo sapiens
gtaatatgcagtatatgtgctaaattactttttttgttgttgttgagatggagtttcgctcttgttgcccaggctggagtgcagtggtgtgatcttggctygccgtgatctctacctcccaggttcaagcgattctcctgccgcagcctcccgagtagctgggattacagacatgtgccaccacacccggctaattttgta

SEQ ID NO: 8805 - DNA, 201 bp, Homo sapiens
tatataagacagtgccctttagaagatccctgtctcattgagaagcgttgagtaaatgggtctctctggtcattctctccagaacatgaagccaaagggcygagagggagagactccaagaatgaattagtgtccagcaaggtatcgcttgtctcaggatgacaacttgcaatttggggatctctcaacgtcctgacctcc

SEQ ID NO: 8806 - DNA, 201 bp, Homo sapiens
tctctgccttcctttctctccctccttggtctgcttcctcctgttgctatcagagcctgcctgcctcatccttgttccagccttgatggtgatgatgattrtggttgctgttgctatttgtttttttggtttgtttgtttgttttgagagggagttttactcttgtcacccaggctggagtgcagtggcgccatctcggct

SEQ ID NO: 8807 - DNA, 201 bp, Homo sapiens
ccatgcctggctaattctttgtagttttagtagagatggggtttcagcatgttgtccaggctggtcttgaactcctcagctcaaatgatctgcccacctcrgcttcccaaagtgttgggattacaggcgtgaaccaccacgcccctcacgcgcagccactgttgctattgatgattattatgacatcattgctcagattca

SEQ ID NO: 8808 - DNA, 201 bp, Homo sapiens
ttaacacaacttctccgtgtgtgggctaaataaatattcgggcaacactgattgagcactgccttgggtaaataattctctctccacacatttcctagttyataatgaggagttttcttcgtggtctgaccaaatgtaacattccattgaaaatgagacataaatccttgagtgagggagacgtggaaccagggtttgagg

SEQ ID NO: 8809 - DNA, 201 bp, Homo sapiens
gcccctctgaaagcccttcactgcggctcagcctgtggtggaaggtgtccaaggtggctggaacacctcctgctgggggtgtcagtcttggctctcctgtkttctgcctgtgcaatggtgggtaggtcccttgatacctcgtaacctcagcatccctgtgggtgataaggagatgataatagtctcttcccgatgggggtt

SEQ ID NO: 8810 - DNA, 201 bp, Homo sapiens
agcctcaaactagaacgtggcttttgaacggtgaacattccacaaacatttaatacagagatggctgtggggtgggggctgggggctgggggcctggaagrggagaaggggcaccagaaggagaaatgggaggaaagggcgagtgagatagcaaagagaactcagaaagtaataaagccctgcagtaatcagagggctgag

SEQ ID NO: 8811 - DNA, 201 bp, Homo sapiens
ctgggtgggtggaggttcagggatatctgggaaggactaagaatagctttttcttttagtagatcaggagtttcctcttacacacaaaaagctccaaattyaaactagcttaagaggaaagggtcattactggctgacaaaatgcgaagttttgtgcaagagtcagcaaagtttctctgtgatgggatatttaataaatat

SEQ ID NO: 8812 - DNA, 201 bp, Homo sapiens
cagtaagtattcttggggcaaatgggaaaagggttaaaatgaccagatctccagagatctcactcactgtggtgaagacagcgccaagccatgagggctcygccccagtgattcaaatacctcccattacggacatgtttcaacatgagatttgagcggggacaaatatccaaactatatcaggatcccagcagactgggt

SEQ ID NO: 8813 - DNA, 201 bp, Homo sapiens
acaagggaatatgtgaggtagggtaggacattttggtagcagtcacacagcccaaagagcatggtgaatttaattagtctgccacacctgtatggccttaygttttccgggataacttaacaagcattgtgtgcagccaggtcaggcagatggaggttctaatccaggctgcacacctcatcagccaggagactacagata

SEQ ID NO: 8814 - DNA, 201 bp, Homo sapiens
ggaatgccatttgacagttacaggctcccgtgaggcggtgcaggctcctccgagccagggatggagctggggattgagtgacacaagactctttgggtatstctcaaacaatataaatcaccagcaaaatctcactcctacaaggagaacctgcagggagctccgtgggaggcactgctgtttactctcctcattccccac

SEQ ID NO: 8815 - DNA, 201 bp, Homo sapiens
atggccgctggaaaagaagccaactcccagggggcacgaggggctaagctgtctcctgggaagtttgagggaggccaagtgttttccagttcatttccaaygcgtatttcttcagggccaagggcccagctgtgcctcattaggggtgagagtttggctgtgacacgacttaatagaaaaaaaaaaaaaaaaaggagaagt

SEQ ID NO: 8816 - DNA, 201 bp, Homo sapiens
ttttggtctttataatccccagagcctggcttaattattttaaagtaaatcaacactttgaacacttgcaggttagaaaaccagtggactgatggatgcgwtacagccattgtttccaagtgtattagtttctgctggccgctgtaacacattatcaccagtgtagcacctaaacaacacaaatgtattgtctttcagttc

SEQ ID NO: 8817 - DNA, 201 bp, Homo sapiens
agtgggccagattcagcccgtgggccataggttgccagcctctgactctggtgttcagatcacagactttggatgtctcatatctgaatctttctaatctygtgatagggcaaggtaattaaaatgttaatacgttagttttctcactgtcaatgtgttctatgacatcatttatgcaaagcatacaaagctgagaataaa

SEQ ID NO: 8818 - DNA, 201 bp, Homo sapiens
ttgtaaaatgatatgctgtcttttttgacccagttactttataaagctacattctttggcaaacattaacacaacttctccgtgtgtgggctaaataaatwttcgggcaacactgattgagcactgccttgggtaaataattctctctccacacatttcctagtttataatgaggagttttcttcgtggtctgaccaaatg

SEQ ID NO: 8819 - DNA, 201 bp, Homo sapiens
ctcagaagagaaatctattgaaagttactaggtgccaggtgtctcggaaagtgtttaacacatgcctgagacgttaaaggcaagattcatgcattctttcrgcagacagtttcttcacttaccggggaagggggtgtaatatatgggggtatagggataaataattctgtgtgctgtgcaggccgtggagactcatcttct

SEQ ID NO: 8820 - DNA, 201 bp, Homo sapiens
agagttaaaaaaaaaaaatcactggatttgaagttggcctatgttagattactccaaggaagttagttaatatgttaatatgaatctagatgaacattgartgttttgctcttcttgttaatttgcgccatctactaatctctggacaatggagaaaaagtcgtaggttatgagttttttatttatggacattaagcaata

SEQ ID NO: 8821 - DNA, 201 bp, Homo sapiens
tcacgcctgtaatcccagcactttgggaggctgaggcaggtggatcacctgaggtcaggagtttgagaccagcctggccaacatggtgaaaccccgtctcyatgaaaaatacaaaaattacccgggcatggtggcgggcacctgtaatcccagctactagggaggctgaggcaggaaaatggcttgaacctcggaagcgga

SEQ ID NO: 8822 - DNA, 201 bp, Homo sapiens
ctccatgaaaaatacaaaaattacccgggcatggtggcgggcacctgtaatcccagctactagggaggctgaggcaggaaaatggcttgaacctcggaagyggaggtggccgttagccgagatcacgccactgcactccagcctgggcaacagagcaagactctgccttaaaaaaaaaaaaaagaaagaaaagtaaaagga

SEQ ID NO: 8823 - DNA, 201 bp, Homo sapiens
agggcctctcggaggacgtgaatccacattaagactttggggataagtaggagcgccttaggcatggggacccatggatgcgaggcctgtaggacacagasaggatggcatgaaggcctgtgcaactggaggggtggggatggggacactaagagatggctggaagtgtgggggtggggacactaagagatgactggagaa

SEQ ID NO: 8824 - DNA, 201 bp, Homo sapiens
ctgcagtaggagtgaggggatcagaggagagctttggaagccccctggatgcgggacaggaagggagataccagtgtctaggaggccagtgaggcagccasaggctccaccaggatcagggctgcgagggtcatgaggaggaaaccaatttgaaggagtccaggggaataggacttggaaatgaccgatgggacatttggg

SEQ ID NO: 8825 - DNA, 201 bp, Homo sapiens
ggtcatgaggaggaaaccaatttgaaggagtccaggggaataggacttggaaatgaccgatgggacatttgggaagaggaagacagaagagcgcagtcccrgcttctggctttagcagttgggcaaggggagatggggagatgtgcccatgggttgagggttgaggacattaggagggagccggtatggcaggaagagctg

SEQ ID NO: 8826 - DNA, 201 bp, Homo sapiens
gtaatctgttgaaatatatatcttgctcattggtgagctcctgctccttcctcgttgctcttgcagatttatcacttctcgtaaggctgcgcttgtacttsgggattttctctgtgccacactgggaaacatagggtggttgcatgctgcagtcctgagcacttatttcactcacatctttacacgaagatttggtgggtg

SEQ ID NO: 8827 - DNA, 201 bp, Homo sapiens
ctagcagagctcctcggagcgtgtggctaggtgcctggtaatgcaagccccctgtcctccaccctctgttgtactgagtcacagtctccggggtgaagccyagcagtctgcgttgacaggccccaggggatgccgctacttcctgaattctgaattctggaaactgagccggagttcagggcctggctcccattaccaggg

SEQ ID NO: 8828 - DNA, 201 bp, Homo sapiens; identical to SEQ ID NO: 1302

SEQ ID NO: 8829 - DNA, 201 bp, Homo sapiens
cgagattgcgccattgcactccagcctgggggcaacaagagcaaaactctgtctggaaaaaaaagaaaggagcagcttggcaaaccccaccttgtcgcttytgtgagtgcctctgaccctttggctgccaggacgggcgtattttatggaaatgctaagcaccaacagagtaaagtggtttggtttttcacagtggtggga

SEQ ID NO: 8830 - DNA, 201 bp, Homo sapiens
tggcacatactggtgcccaatcctcccttctgggtgcttcttccaaggccttgtgatggaagtgagtaccctcttcgacatcagacccagcttcaaatccyggctctgctatgtattggctgcgtggctttagacaagtcttttaaccttgctgtgcttctgatttctcagctgaaaaatggagatgatgatagtggtttc

SEQ ID NO: 8831 - DNA, 201 bp, Homo sapiens
ccaatcctcccttctgggtgcttcttccaaggccttgtgatggaagtgagtaccctcttcgacatcagacccagcttcaaatcctggctctgctatgtatyggctgcgtggctttagacaagtcttttaaccttgctgtgcttctgatttctcagctgaaaaatggagatgatgatagtggtttctgtaaggccttatggt

SEQ ID NO: 8832 - DNA, 201 bp, Homo sapiens
caaatcctggctctgctatgtattggctgcgtggctttagacaagtcttttaaccttgctgtgcttctgatttctcagctgaaaaatggagatgatgatartggtttctgtaaggccttatggtgaagcacctagctcagggcctggaaggcaggtgtaaccagtggttcagttgttataaaccaacactaaccctcgcct

SEQ ID NO: 8833 - DNA, 201 bp, Homo sapiens
cattgaataaagtaaaagacacaggtagaattaatttcattgagcccaatatatccaaaataatatcattttcacatctattcaatataaaaatttactamtgagatatttcatactaagccactgaaatccagtttgtatcttacacatctcagttttgacgagccacatttcaagggcgtgatagccacatgtggctcc

SEQ ID NO: 8834 - DNA, 201 bp, Homo sapiens; identical to SEQ ID NO: 1288

SEQ ID NO: 8835 - DNA, 201 bp, Homo sapiens
tggcatcttccatccatccttcaacttaagcaagttcctccgacagggtctctgcaaatgcctcccggccaatgtccaccagctcatctccggcaaaatakgcatctctcttaccagagtgtctgatggggaaaacgttctggtgtctgactttcggtccaaagacgaagtcgtggatgtaagcagtttgcttatctggac

SEQ ID NO: 8836 - DNA, 201 bp, Homo sapiens
gtcaggtgtgggtccaagcccactagacaagtttgctcttcccagagcacatttctgccttcaagtcatcctggcttgtcagggctgggggagttctgctstagaaatattagagtggaaggaaaaagatgtgttgggagctatttttctttaatactaaaagttggttgatgaatttgtcgttggccaagaccaaggaga

SEQ ID NO: 8837 - DNA, 201 bp, Homo sapiens
ctagaagaagctgtgtctctggctgtgacggcaccctagagtgtgtgtggtgccctctactggccggcaatgtgggtccaccgtagctcagactgcacacygcagcagcgggaacggcctctaagccaacttcctccatgtgtttcaggtcccaaatgccagtgagcagccaacaggcctccccatgcacacctgagcagg

SEQ ID NO: 8838 - DNA, 201 bp, Homo sapiens
tctctcttaccagagtgtctgatggggaaaacgttctggtgtctgactttcggtccaaagacgaagtcgtggatgtaagcagtttgcttatctggacgttrtcaagttagaaaagctgttttgggatgggtgtggtggctcatgcctgtcatcccggcactttgggaggccgaagcgggtgggttgcttgagcccaggagc

SEQ ID NO: 8839 - DNA, 201 bp, Homo sapiens
ctgtcatcccggcactttgggaggccgaagcgggtgggttgcttgagcccaggagctcgagaccaacatgatgaaacccagtctctacaaaaattacagaraaattagctaggcatggtgttgtgggcccatagtcccagctactagggaggctgaggcaggagaattgcttgagcctgggaggtggaggttgcagtaagt

SEQ ID NO: 8840 - DNA, 201 bp, Homo sapiens
catcttccataatgaagatgccttctcactggaaaccctacaagggtgggaacgtgccttatttgcctgtatcctcagggtctagcagagagaagataatytgtaataccaaaacaccattaaattcagctgatgctttcataagcgctccttggaggaaggactccatttacttgacagatctgtgcaagacagcagcct

SEQ ID NO: 8841 - DNA, 201 bp, Homo sapiens
cagccagttgcatcctctgtttaaccttgtttgcggaagctttctctaaacagccagcacttgtctgttcccacatgggtccgttctcccagtgaatcacygtggtgcctgctgactgctctgtagcacagtgcttcgcaaagtgtgatcctgggaccagcagagcagcagctcctttgagcttattggaatggcagaccc

SEQ ID NO: 8842 - DNA, 201 bp, Homo sapiens
tccttcagaggcgtggtaagtcggctttctctgctagcgctgagtcctgggggcctctgaagtgtgctcacacatctcctgcctgcagggcactggtgtcrggcacctcagggtctgtcccatggtggagccccatgcctcactgcctttcagacagagtagccacagctggccctatttccaggctacccgggcagcaaa

SEQ ID NO: 8843 - DNA, 201 bp, Homo sapiens
ctagccttttagggtaatttttgaactcacaagagcagcagcggaacctttgatgcaatcctgtatgtagcaccagcagagccacgtggcagagggactcrcattaggagcctcccattacagactacgtgctcctgtgcgttatcttatagggtccccacaaccaaggggagatgtgattattcatcctgtgtggctgtg

SEQ ID NO: 8844 - DNA, 201 bp, Homo sapiens
cagaacagggcatgtcttggttcactgcagggcggctcttctcattctctgtagtttggggtccaggatagtggtccacggagccactggagtgcccagcyactgagtgaccaaagcatattttggatttccgacattgccacagcatggttgggcatcagcaggaccccaaccccttgttatgctggtggctttatgtgg

SEQ ID NO: 8845 - DNA, 201 bp, Homo sapiens
ccagggggatggagaagccgaagcaggagtgtttgttctgcaggctctggagtaggcattgggtctgtgccggctcacttgctagtcttgcatccttcccyaaccccctctggggatgtctggccacatcagaagacagtttgggttgtcagaactgggggagtaccaggccgaggtgggtggatcatgaggtcaggagat

SEQ ID NO: 8846 - DNA, 201 bp, Homo sapiens
atgctgtgtcatcacccgttgagtgcgctcataggcatcttcctgacaattagaacccattattcttcaaattcaatgcaagcaaattcaaagcattactrtgtacataccgcatgctaatcaattgcaccactggagctcctaaattcaaaacattactataaaaaagttcaaaatgcatggaaaagttgtacatggcag

SEQ ID NO: 8847 - DNA, 201 bp, Homo sapiens
acccgttgagtgcgctcataggcatcttcctgacaattagaacccattattcttcaaattcaatgcaagcaaattcaaagcattactgtgtacataccgcrtgctaatcaattgcaccactggagctcctaaattcaaaacattactataaaaaagttcaaaatgcatggaaaagttgtacatggcaggagaatatttggg

SEQ ID NO: 8848 - DNA, 201 bp, Homo sapiens
attactgtgtacataccgcatgctaatcaattgcaccactggagctcctaaattcaaaacattactataaaaaagttcaaaatgcatggaaaagttgtacrtggcaggagaatatttgggcttctgactaccccttgaatgaagatgatccaccagccgccttcctccttggtcttcactccagattcctagcatttcatt

SEQ ID NO: 8849 - DNA, 201 bp, Homo sapiens
ttcctccgtgtggaagggcgggctggggagagcctcccagctggaatcttttggatgcctttctctgtgggtatctgatggctggctctgatggctggctstgatggctgtggctggaaatcattgttgacatgagtttcacagatgcaggctctgtccaaattgtagcaaaagctgcctgccccagccgagctatgggca

SEQ ID NO: 8850 - DNA, 201 bp, Homo sapiens
ctctgtgggtatctgatggctggctctgatggctggctctgatggctgtggctggaaatcattgttgacatgagtttcacagatgcaggctctgtccaaaytgtagcaaaagctgcctgccccagccgagctatgggcaataaggtggtttaaggatatagatgaaggaaaactcacccttagaataatttatccaaaatg

SEQ ID NO: 8851 - DNA, 201 bp, Homo sapiens
ggacattttctgaggtcccaggttcattgtttcatttaagtctcaaaagtccctccaggtgttggttctaattgtcaaagcatggggggagatgggctcawgggttaaaggtcttatcccagatttctgtatcctccttgcaagcagcaaaggggtctggatttgaatccatgaccatgtttctcctttgggtttccatca

SEQ ID NO: 8852 - DNA, 201 bp, Homo sapiens
ggtgagggggcaggtgttctggggtgcagctcttctttgcctccctgattgccaggagctaccagttactgtctgcacaatcaaacagaaatagacctgtycttgatggttaacggaaataaaaggcgcttgtcccagaagctcaggtgaggcaccaccctgattatgggaatcacctgggaacatatacccagacctaaa

SEQ ID NO: 8853 - DNA, 201 bp, Homo sapiens
taaaaggcgcttgtcccagaagctcaggtgaggcaccaccctgattatgggaatcacctgggaacatatacccagacctaaaactcagatccacttcccargctgtggttatatagtcaggggggtgcagtatgggtattaggattttttattttttagttataaagatttttttttggtttgtttttgagacagggtctt

SEQ ID NO: 8854 - DNA, 201 bp, Homo sapiens
taaaactcagatccacttcccaggctgtggttatatagtcaggggggtgcagtatgggtattaggattttttattttttagttataaagatttttttttgrtttgtttttgagacagggtcttgctctgccgcttaggctggagtgcagtggtgcaatcatagctcactgaagcctcagactcctgggttcaagcagtcct

SEQ ID NO: 8855 - DNA, 201 bp, Homo sapiens
aaatggagatgatgatagtggtttctgtaaggccttatggtgaagcacctagctcagggcctggaaggcaggtgtaaccagtggttcagttgttataaacsaacactaaccctcgcctttgcacctcatgaatccagatatgtagatggagcccacaaagctagcaggagccaagctcacgtgtgtcctgctttaaagccc

SEQ ID NO: 8856 - DNA, 201 bp, Homo sapiens
acacctgtgctcgttctcttcccttcccctcttccccttgcatttggctaataacaggccagctgcctgcctccctgcagtttggtagatgggtgggtaaygaccaccactcccacgttcgcctgatgggcttgttttccgtgcccttcacaggcatctgcaacaggccccagccaggcctgaagtcatcctcagaaggga

SEQ ID NO: 8857 - DNA, 201 bp, Homo sapiens
cgttctcttcccttcccctcttccccttgcatttggctaataacaggccagctgcctgcctccctgcagtttggtagatgggtgggtaacgaccaccactcccacgttcgcctgatgggcttgttttccgtgcccttcacaggcatctgcaacaggccccagccaggcctgaagtcatcctcagaagggatggatcctgag

SEQ ID NO: 8858 - DNA, 201 bp, Homo sapiens
agctgctagaccacctgcgtctcagcatcctgccctgggatgagagcatcctggacaccctctcgcccaggctcgctacaggtacccactcctcggggtgrgcacgggcagcaccttgttttctttcttgtgcattatggaggaagatggtactgccacatgggagcgatagggtgaggcaaccatgacaggtggttggga

SEQ ID NO: 8859 - DNA, 201 bp, Homo sapiens
ggaacatctccttccatgtgtacagcctgggctgctgccatcactcccagcacagcccccaacccccccaatcctggaaccttgccaagtctcccttcccrtggggtcatgaccaggaggaaaacaaactccagctgagccccttggggttccccatataggctcctgcctgtggcagctgggccctctgtacccctttcc

SEQ ID NO: 8860 - DNA, 201 bp, Homo sapiens
tgaccaggaggaaaacaaactccagctgagccccttggggttccccatataggctcctgcctgtggcagctgggccctctgtacccctttccaactctgtstccctaacatggcacctgagctcctgccatcctggatttcatggaccccaaggatgggggtcctgcatctgggacttggcctattactcggagctccttt

SEQ ID NO: 8861 - DNA, 201 bp, Homo sapiens
ccacctgtccacccacctcaaggctcctttcttgagacctctcctaatttctcccttcccctaaacccacaattttgaacctccatcgaatggtgctgtaktttataatgtcatcaaatatcaaatggagacagtgctatggtccaaatgattgtgtaccccccagaatttgtcttttgaaatcctaacccccaacatgat

SEQ ID NO: 8862 - DNA, 201 bp, Homo sapiens
tccagtgtttgggacccttcctgggggctggagtgcatccctggacaccccccaatcccatcctcttctctagtttccactgacctaggcccaccctcccstctccggctcagtactcctggaaatgagattccgtacatttgaatcttgtcctaatgaaatatttgtccatgtgggtacctgtgtgtgtgtggtgggggt

SEQ ID NO: 8863 - DNA, 201 bp, Homo sapiens
ctgtcatgaatgggattggtgcccttattaaacagacccaagagaggtcccttgtcccttctactgtgtgaggactcagaaggtggtgtctatgaagaagsaggccctcaccagacaccaacatgtctgctgccccttgatctgggaccttgcagcctctagaactctgaaaaatcgatgtttgttgttttataagccact

SEQ ID NO: 8864 - DNA, 201 bp, Homo sapiens
cttattaaacagacccaagagaggtcccttgtcccttctactgtgtgaggactcagaaggtggtgtctatgaagaagcaggccctcaccagacaccaacaygtctgctgccccttgatctgggaccttgcagcctctagaactctgaaaaatcgatgtttgttgttttataagccactcagttggtggcattttgttagag

SEQ ID NO: 8865 - DNA, 201 bp, Homo sapiens
aggtgaacgggaagcatgcacatcccatgactggagcaggagtgagagagagagggaaatagagggaaggtgccatacacttttaaacaaccagatctcaygagaacacattcactatcaagagaacagcaccagtggggaaatccgcccccatgatccaatcacctcccatcaggctccgcctccaacactgggaattac

SEQ ID NO: 8866 - DNA, 201 bp, Homo sapiens
gaagcatgcacatcccatgactggagcaggagtgagagagagagggaaatagagggaaggtgccatacacttttaaacaaccagatctcatgagaacacaytcactatcaagagaacagcaccagtggggaaatccgcccccatgatccaatcacctcccatcaggctccgcctccaacactgggaattacaatttgacat

SEQ ID NO: 8867 - DNA, 201 bp, Homo sapiens
gggaaatagagggaaggtgccatacacttttaaacaaccagatctcatgagaacacattcactatcaagagaacagcaccagtggggaaatccgcccccaygatccaatcacctcccatcaggctccgcctccaacactgggaattacaatttgacatgagatgtgggcagggacacagatccaaaccatatgaccagatt

SEQ ID NO: 8868 - DNA, 201 bp, Homo sapiens
tggtgcctgagaagtacctaggagaacatagatgctgtgacgtttgatgtagctgttttttgttttgtgttttggtttttgagacagagtctcactctgtygcccaggctggagtgtgcagtggcgtgatcttggctcactggagcctccatctcccaggttcaaatgatcctcatgcctcagcctcctgagttgctggga

SEQ ID NO: 8869 - DNA, 201 bp, Homo sapiens
ggagctgggagtggggaccctatgctccgtaagcactctcttagctgttcttggctgtgctccccgcttcagcttcacactgcccttgctgtgaagggagmagcctgggccgggcgcggtggcttacacctgtaatcctagcactttgggaggccgaggtgggtggatcacctgaggtcaggagttcaagaccagcctggc

SEQ ID NO: 8870 - DNA, 201 bp, Homo sapiens
gtggggaccctatgctccgtaagcactctcttagctgttcttggctgtgctccccgcttcagcttcacactgcccttgctgtgaagggagcagcctgggcygggcgcggtggcttacacctgtaatcctagcactttgggaggccgaggtgggtggatcacctgaggtcaggagttcaagaccagcctggccaacatggtg

SEQ ID NO: 8871 - DNA, 201 bp, Homo sapiens
ttcttggctgtgctccccgcttcagcttcacactgcccttgctgtgaagggagcagcctgggccgggcgcggtggcttacacctgtaatcctagcactttkggaggccgaggtgggtggatcacctgaggtcaggagttcaagaccagcctggccaacatggtgaaactccatctctactaaaaatacaaaaaattagctg

SEQ ID NO: 8872 - DNA, 201 bp, Homo sapiens
gtccagaggtgagcattttaggtggctccgtgtcttcctcacagggttgatatgaggatgaaacaagatgatagatcatggtggcatgtagtctgggaccyggattgtcgtgccacagatcacagctcacagtctatgtgcaatgcccctgaatgttgcccacctgtcctcaagccacacatgcacctgtaactcagtgca

SEQ ID NO: 8873 - DNA, 201 bp, Homo sapiens
tccccgtggggactcctagagctgtcagtggcctcacatagcagctggtccagtctcttgtgattgcccaaggaaactgaggcctggagagcttggggtcrctgctctgaggccatagagatgcctagtagaagggccaggcctagaagcaggatccttgctgcccctctgagctgtttccatttaaaatcacatgaaggc

SEQ ID NO: 8874 - DNA, 201 bp, Homo sapiens
aaatcacatgaaggccggcgccgtggctcacggctgtaatcccagcattttgggaggccaaggtgggtggatcatgtgaggtcaggagtttgagaccagcytggccaacatggtgaaatgccatctgtactaaaaatacaaaaattagtggagcatggtggcacgtgcctgtactcccagctacttggaaggctggggcag

SEQ ID NO: 8875 - DNA, 201 bp, Homo sapiens
cagtctctccttcaaaagccggctcctttctctccctcgccttcctagattccttctccactccccaggatcagcctcctcctccccaccccaccactgcyggggggatgtctgtggtcaggcatttatcagagaccctgaggtgggggtcctttatgtgtctgggggatggagagtctagaggaggtagcgttcagacct

SEQ ID NO: 8876 - DNA, 201 bp, Homo sapiens
tgtctcatgggaggcagctgagtcagtcagaggtcctggcacacctgctgagagctgccacccaggccaacctgaaccggagcctgggaagacttcccgtyggatgagtctctttgagggcagcattgatggtggaagagcagagaggccccagataagcagggaaaggtgcttcagacagagtggctgggatgaggactg

SEQ ID NO: 8877 - DNA, 201 bp, Homo sapiens
tgagtcagtcagaggtcctggcacacctgctgagagctgccacccaggccaacctgaaccggagcctgggaagacttcccgttggatgagtctctttgagkgcagcattgatggtggaagagcagagaggccccagataagcagggaaaggtgcttcagacagagtggctgggatgaggactggggagtgtcagatagcgc

SEQ ID NO: 8878 - DNA, 201 bp, Homo sapiens
tgctagggaagagggcagtagtggccaagtagagggtggatcctgggccctggctggcagcaggcagcaaggggggctgccagggcccaggcagggacgayctgtagaccgagaggcttcctaaggctcttggacaggaggaggtgtcggttccaagcctaaggagtggggcagccctggtgactggtggtcagtggtgcc

SEQ ID NO: 8879 - DNA, 201 bp, Homo sapiens
caggcagcaaggggggctgccagggcccaggcagggacgatctgtagaccgagaggcttcctaaggctcttggacaggaggaggtgtcggttccaagcctraggagtggggcagccctggtgactggtggtcagtggtgccaggcggtgggtggtaggacaccctggcaggcaagtaggtttgtgtgggggaaactgatag

SEQ ID NO: 8880 - DNA, 201 bp, Homo sapiens
gcaaggggggctgccagggcccaggcagggacgatctgtagaccgagaggcttcctaaggctcttggacaggaggaggtgtcggttccaagcctaaggagyggggcagccctggtgactggtggtcagtggtgccaggcggtgggtggtaggacaccctggcaggcaagtaggtttgtgtgggggaaactgataggcccct

SEQ ID NO: 8881 - DNA, 201 bp, Homo sapiens
ttcctccatgtgtttcaggtcccaaatgccagtgagcagccaacaggcctccccatgcacacctgagcaggactggccctgctggactccctgctcccccragggctgtccagcagagaccaaagcagaggccaccccgcggtccatcctcaggtccagcctgaacttcttcttgggcaataaagtacctgctggtgctga

SEQ ID NO: 8882 - DNA, 201 bp, Homo sapiens; identical to SEQ ID NO: 1299

SEQ ID NO: 8883 - DNA, 201 bp, Homo sapiens; identical to SEQ ID NO: 1301

SEQ ID NO: 8884 - DNA, 201 bp, Homo sapiens
cttcagacagtgccagtcctttttccccttctttaaaagcgatatgtggatggaggagtgagtgacaacgtacccttcattgatgccaaaacaaccatcaycgtgtcccccttctatggggagtacgacatctgccctaaagtcaagtccacgaactttcttcatgtggacatcaccaagctcagtctacgcctctgcaca

SEQ ID NO: 8885 - DNA, 201 bp, Homo sapiens
cagtcctttttccccttctttaaaagcgatatgtggatggaggagtgagtgacaacgtacccttcattgatgccaaaacaaccatcaccgtgtcccccttytatggggagtacgacatctgccctaaagtcaagtccacgaactttcttcatgtggacatcaccaagctcagtctacgcctctgcacagggaacctctacc

SEQ ID NO: 8886 - DNA, 201 bp, Homo sapiens
caccgtgtcccccttctatggggagtacgacatctgccctaaagtcaagtccacgaactttcttcatgtggacatcaccaagctcagtctacgcctctgcmcagggaacctctaccttctctcgagagcttttgtccccccggatctcaaggtgagttggtggtgagggggcaggtgttctggggtgcagctcttctttgc

SEQ ID NO: 8887 - DNA, 201 bp, Homo sapiens
gggtgtggtggctcatgcctgtcatcccggcactttgggaggccgaagcgggtgggttgcttgagcccaggagctcgagaccaacatgatgaaacccagtmtctacaaaaattacagagaaattagctaggcatggtgttgtgggcccatagtcccagctactagggaggctgaggcaggagaattgcttgagcctgggag

SEQ ID NO: 8888 - DNA, 201 bp, Homo sapiens
ccttatccctccttccttcagaggcgtggtaagtcggctttctctgctagcgctgagtcctgggggcctctgaagtgtgctcacacatctcctgcctgcarggcactggtgtcgggcacctcagggtctgtcccatggtggagccccatgcctcactgcctttcagacagagtagccacagctggccctatttccaggcta

SEQ ID NO: 8889 - DNA, 201 bp, Homo sapiens; identical to SEQ ID NO: 1291

SEQ ID NO: 8890 - DNA, 201 bp, Homo sapiens
agctgtgtctctggctgtgacggcaccctagagtgtgtgtggtgccctctactggccggcaatgtgggtccaccgtagctcagactgcacactgcagcagygggaacggcctctaagccaacttcctccatgtgtttcaggtcccaaatgccagtgagcagccaacaggcctccccatgcacacctgagcaggactggccc

SEQ ID NO: 8891 - DNA, 201 bp, Homo sapiens
gcaaggagaggaagttgaagttcactgacagggttgttaaggggattatgcaatagatgagacccatgggcctgaagtccgagggtgtatgttagttcccygttcttttgacccatggattaacctactctgtgcaaagggcattttcaagtttgttgccctgctcacttggagaaagcttatgaaggatcaggaaaatta

SEQ ID NO: 8892 - DNA, 201 bp, Homo sapiens
tgtcctccctccatatcagcctgtttgtggctctgagaagctctgcccacatgtgaaagcttgttaagcacttaagcactaacccagagcttcagacagtrccagtcctttttccccttctttaaaagcgatatgtggatggaggagtgagtgacaacgtacccttcattgatgccaaaacaaccatcaccgtgtccccct

SEQ ID NO: 8893 - DNA, 201 bp, Homo sapiens; identical to SEQ ID NO: 1293

SEQ ID NO: 8894 - DNA, 201 bp, Homo sapiens
tggaaggtggagctttactcttagggggaactataacagtcatatatatatatttttttcttttcttttttttttttttgagatggagtctggctctgtckcccaggctggagtgcagtggtgcaatctcggctcactgcaacctccacttcacaggttcaggcaattctcctgcctcaacctcccgagtagctgggatta

SEQ ID NO: 8895 - DNA, 201 bp, Homo sapiens; identical to SEQ ID NO: 1300

SEQ ID NO: 8896 - DNA, 201 bp, Homo sapiens
tgaggcaggaaaatggcttgaacctcggaagcggaggtggccgttagccgagatcacgccactgcactccagcctgggcaacagagcaagactctgccttaaaaaaaaaaaaaagaaagaaaagtaaaaggaaaaaaaagaggctctggcctgctggggtgcctgcaaagtctccgtggaagggtgacattcaagccgaga

SEQ ID NO: 8897 - DNA, 201 bp, Homo sapiens
ggcttgaacctcggaagcggaggtggccgttagccgagatcacgccactgcactccagcctgggcaacagagcaagactctgccttaaaaaaaaaaaaaaraaagaaaagtaaaaggaaaaaaaagaggctctggcctgctggggtgcctgcaaagtctccgtggaagggtgacattcaagccgagacctccagggaactg

SEQ ID NO: 8898 - DNA, 201 bp, Homo sapiens
catcctctgtttaaccttgtttgcggaagctttctctaaacagccagcacttgtctgttcccacatgggtccgttctcccagtgaatcaccgtggtgcctrctgactgctctgtagcacagtgcttcgcaaagtgtgatcctgggaccagcagagcagcagctcctttgagcttattggaatggcagaccctcaggtccca

SEQ ID NO: 8899 - DNA, 201 bp, Homo sapiens
tggaccactcttaggtcctcctgccccacttccatctgggtgtgtgccctgggctgtccaccacacagctacatcctgccatcttccctcctggagccacygtgccatgcatggatctgtagcttcatttttcttggcttttccctggtttttctggagcagagtctctagtaaactcccaaggaagaaaacgtttgactt

SEQ ID NO: 8900 - DNA, 201 bp, Homo sapiens
tcagaaggtggtgtctatgaagaagcaggccctcaccagacaccaacatgtctgctgccccttgatctgggaccttgcagcctctagaactctgaaaaatygatgtttgttgttttataagccactcagttggtggcattttgttagagtagcctgaacacggactaagtcaaacagaagaacccacaaaccagctacaga

SEQ ID NO: 8901 - DNA, 201 bp, Homo sapiens
gtctgcgttgacaggccccaggggatgccgctacttcctgaattctgaattctggaaactgagccggagttcagggcctggctcccattaccagggttggrcgttatcctgaaaatcataggccttggtttcctcacttggctaacaggggtgatccccatcccctcaatgggtttccgtgagctcctgagagcccgtagc

SEQ ID NO: 8902 - DNA, 201 bp, Homo sapiens
ccttatggtgaagcacctagctcagggcctggaaggcaggtgtaaccagtggttcagttgttataaaccaacactaaccctcgcctttgcacctcatgaawccagatatgtagatggagcccacaaagctagcaggagccaagctcacgtgtgtcctgctttaaagccccatacccctttctccgggtgacaaacacctgt

SEQ ID NO: 8903 - DNA, 201 bp, Homo sapiens
tggggagcaaggagaggaagttgaagttcactgacagggttgttaaggggattatgcaatagatgagacccatgggcctgaagtccgagggtgtatgttarttccccgttcttttgacccatggattaacctactctgtgcaaagggcattttcaagtttgttgccctgctcacttggagaaagcttatgaaggatcagga

SEQ ID NO: 8904 - DNA, 201 bp, Homo sapiens
tgcctctttgccaggcacttttgtgcagtgcacacactgtacaacagtagacggcaaccctgagagccagagtagagcctgtcctagcaccggaatgctcsgtaaggatttgtcgcaggagtgattccaaagccaatgtcctccctccatatcagcctgtttgtggctctgagaagctctgcccacatgtgaaagcttgtt

SEQ ID NO: 8905 - DNA, 201 bp, Homo sapiens
cagataaaaggtatgggcattaggccagggcactgcaatttctaagctgtgtgacctcaggcaagttactcgacttctctgagcctcagcggtttcatccrcaatatatggataggaaaaccgacctcagtgggttgtctgacagtggagggcacttgattaaaaaaaaaaaaattaccctggtctgaatattaccctgga

SEQ ID NO: 8906 - DNA, 201 bp, Homo sapiens
atctttcgttctaggcatagtttgttaatatgattcagagccagcagttaggagaacacagtgtgactctcctagaacttcttgattgggcttcctctgaktgggtttcctctgattgggcttcctctgaaagtgggggggatggggggtggggagcagaatggtcagagcttggctcagcagtcagactgctcttcttca

SEQ ID NO: 8907 - DNA, 201 bp, Homo sapiens
gttccagggcagtttcttttcttcactttttatctcttttttttgggtgggggggcggggtacagagtcttgctctgtctcccaggctggagtgcagtggygcaatctcaacctcccgaggagctgggactacaggcacaggccatcacaccttgctaatgtttgtactttttgtagagacggggttttgccctgttgccc

SEQ ID NO: 8908 - DNA, 201 bp, Homo sapiens; identical to SEQ ID NO: 1298

SEQ ID NO: 8909 - DNA, 201 bp, Homo sapiens
ctagtttttctgtttcttcatctttctcttttatgctacttattctgggcgtgttcttggtgggttttttcccatatagcaacagaggacttggagctcarggagaaaagggtaggtgcatcacctggcagagctcccagacagtgacaggcaggctgcgggaaggatgtctacttggcggtgctaccgctttcctagaaa

SEQ ID NO: 8910 - DNA, 201 bp, Homo sapiens
gacttggagctcagggagaaaagggtaggtgcatcacctggcagagctcccagacagtgacaggcaggctgcgggaaggatgtctacttggcggtgctacygctttcctagaaaccctttccctggagctggttgaactgttgggttttgccctggtggtgaacgctggctccccgtgctctgcctgtttcatcaccagcc

SEQ ID NO: 8911 - DNA, 201 bp, Homo sapiens
tagtttccactgacctaggcccaccctcccctctccggctcagtactcctggaaatgagattccgtacatttgaatcttgtcctaatgaaatatttgtccrtgtgggtacctgtgtgtgtgtggtgggggtgcagacggagggtttgtttctcactagctggaactactggggtgtggtatgcttcctgggaatttgtgtg

SEQ ID NO: 8912 - DNA, 201 bp, Homo sapiens
ccagcctgggcaacaaagcgagactccgtctcacaaaaaaaacaaaacaaaacaaaacaaaatctgggggagtgccactggcatctgatgtatagaggccygagatgctgtgtcatcacccgttgagtgcgctcataggcatcttcctgacaattagaacccattattcttcaaattcaatgcaagcaaattcaaagcatt

SEQ ID NO: 8913 - DNA, 201 bp, Homo sapiens; identical to SEQ ID NO: 1306

SEQ ID NO: 8914 - DNA, 201 bp, Homo sapiens
atacaaaaattagtggagcatggtggcacgtgcctgtactcccagctacttggaaggctggggcagaagaatcgcttgagcctgggaggcagaggttgtastgagccaagattgtaccactgcactccagcctgggtgacaggagagaaaccctatctcaaaataaaatgaaaggtaatgaaatgaataaaataataaatc

SEQ ID NO: 8915 - DNA, 201 bp, Homo sapiens
tcctgacaattagaacccattattcttcaaattcaatgcaagcaaattcaaagcattactgtgtacataccgcatgctaatcaattgcaccactggagctyctaaattcaaaacattactataaaaaagttcaaaatgcatggaaaagttgtacatggcaggagaatatttgggcttctgactaccccttgaatgaagatg

SEQ ID NO: 8916 - DNA, 201 bp, Homo sapiens
ctggctctgatggctgtggctggaaatcattgttgacatgagtttcacagatgcaggctctgtccaaattgtagcaaaagctgcctgccccagccgagctrtgggcaataaggtggtttaaggatatagatgaaggaaaactcacccttagaataatttatccaaaatgctgctgtgttgtgggttagaggacattttctg

SEQ ID NO: 8917 - DNA, 201 bp, Homo sapiens
tgggaagttctggtcttgccatttgtccctggaccactcttaggtcctcctgccccacttccatctgggtgtgtgccctgggctgtccaccacacagctayatcctgccatcttccctcctggagccactgtgccatgcatggatctgtagcttcatttttcttggcttttccctggtttttctggagcagagtctctagt

SEQ ID NO: 8918 - DNA, 201 bp, Homo sapiens
tgcttctgaaagggagggaatgagccagcccatccccagttgctttttaagatcattgggaagttctggtcttgccatttgtccctggaccactcttaggycctcctgccccacttccatctgggtgtgtgccctgggctgtccaccacacagctacatcctgccatcttccctcctggagccactgtgccatgcatggat

SEQ ID NO: 8919 - DNA, 201 bp, Homo sapiens
gaagagggggtcaggagtggtgaaaaatgggagaggagggcaggctgggccttttggatacagggggattgcatcctgcagtggtagggagccactgaggrctgctgcagtaggagtgaggggatcagaggagagctttggaagccccctggatgcgggacaggaagggagataccagtgtctaggaggccagtgaggcag

SEQ ID NO: 8920 - DNA, 201 bp, Homo sapiens
tgtatttttagtagagacagggtttcatcatattggccaggctggtctccaactcctgacctcaggtgatccgcccgccttggcctcccaaagtgctgagrttacaggcgtgagccatggtgcccggccaacaatcacatgtgttgtaaacaacaacaaaaatctgtcagcctggtctaacctagatttgtgctttgtttt

SEQ ID NO: 8921 - DNA, 201 bp, Homo sapiens
gcgtgagccatggtgcccggccaacaatcacatgtgttgtaaacaacaacaaaaatctgtcagcctggtctaacctagatttgtgctttgttttgttttgmcactttgtgatgcacaggaggaagtttaggctgtaaaatactagccttttagggtaatttttgaactcacaagagcagcagcggaacctttgatgcaatc

SEQ ID NO: 8922 - DNA, 201 bp, Homo sapiens
caggagaatggtgtgaacccggggggcggagcttgcagtgagctgagatcctgccactgcactccagcctgggcaacaaagcgagactccgtctcacaaamaaaacaaaacaaaacaaaacaaaatctgggggagtgccactggcatctgatgtatagaggcccgagatgctgtgtcatcacccgttgagtgcgctcatag

SEQ ID NO: 8923 - DNA, 201 bp, Homo sapiens
agttgctgggattacaggtgcacaccaccacgcctggctaatttttgtgttttcagtagagacagggtttcaccatgttggccaggctggtcttgaactcytgacctcaagtgatccaacaacttcagcctcccaaagtgctgggatgacaggcatgagccaccatgcccagcctgatgtagctgtttctgtgcacattat

SEQ ID NO: 8924 - DNA, 201 bp, Homo sapiens
atggtgaaaccatgtctctactaaaaatacaaaaattagctgggcatggtggtgcatgcctgtaatcccagctactccggaggctaaggcaggagaattgmttgaagcaggacctaggaggcggaggttggttgcagtgagccgagatcatgccactgcactctagcctgggctacagagcgaaactccgactcaaaaaaa

SEQ ID NO: 8925 - DNA, 201 bp, Homo sapiens
atatttttttcttttcttttttttttttttgagatggagtctggctctgtcgcccaggctggagtgcagtggtgcaatctcggctcactgcaacctccacytcacaggttcaggcaattctcctgcctcaacctcccgagtagctgggattacaggtgcctgccgttacgccaagctaatttttgtatttttagtagagac

SEQ ID NO: 8926 - DNA, 201 bp, Homo sapiens
cagtggtgcaatctcggctcactgcaacctccacttcacaggttcaggcaattctcctgcctcaacctcccgagtagctgggattacaggtgcctgccgtyacgccaagctaatttttgtatttttagtagagacagggtttcatcatattggccaggctggtctccaactcctgacctcaggtgatccgcccgccttggc

SEQ ID NO: 8927 - DNA, 201 bp, Homo sapiens
tggagtctctctgtgtcctccaggctggagtgcaatgtcgcgatctcagctcactgcaacctccacctcctgggctcaagagattctcctgcttcagtctsctgagtagctgggattacaggcatgtgccaccacacctggctaatttttgtatttttagtagaggtggggtttggcatgttggccagcctggtctcaaac

SEQ ID NO: 8928 - DNA, 201 bp, Homo sapiens
tttaaaaaacaaaataatctagtgtgcagggcattcacctcagccccccaggcaggagccaagcacagcaggagcttccgcctcctctccactggagcacrcaacttgaacctggcttattttctgcagggaccagccccacatggtcagtgagtttctccccatgtgtggcgatgagagagtgtagaaataaagacacaa

SEQ ID NO: 8929 - DNA, 201 bp, Homo sapiens
cttgaacctcggaagcggaggtggccgttagccgagatcacgccactgcactccagcctgggcaacagagcaagactctgccttaaaaaaaaaaaaaagaragaaaagtaaaaggaaaaaaaagaggctctggcctgctggggtgcctgcaaagtctccgtggaagggtgacattcaagccgagacctccagggaactgtc

SEQ ID NO: 8930 - DNA, 201 bp, Homo sapiens
caacctactcatgagcccaggagataggaaatctccgtcccattgtacagatggggaaacagaattttggaaaggagagccaagcagcacacacccctccmtgaggggcagagccgagatttgaactgggatgtcatgactccagggccctctccctccccagggtccccttatctgaaggcggtttttctttccagctcg

SEQ ID NO: 8931 - DNA, 201 bp, Homo sapiens
agggggtcaggagtggtgaaaaatgggagaggagggcaggctgggccttttggatacagggggattgcatcctgcagtggtagggagccactgagggctgytgcagtaggagtgaggggatcagaggagagctttggaagccccctggatgcgggacaggaagggagataccagtgtctaggaggccagtgaggcagccag

SEQ ID NO: 8932 - DNA, 201 bp, Homo sapiens
attgcatcctgcagtggtagggagccactgagggctgctgcagtaggagtgaggggatcagaggagagctttggaagccccctggatgcgggacaggaagsgagataccagtgtctaggaggccagtgaggcagccagaggctccaccaggatcagggctgcgagggtcatgaggaggaaaccaatttgaaggagtccagg

SEQ ID NO: 8933 - DNA, 201 bp, Homo sapiens
aacccagtctctacaaaaattacagagaaattagctaggcatggtgttgtgggcccatagtcccagctactagggaggctgaggcaggagaattgcttgarcctgggaggtggaggttgcagtaagtcatgatcatgccactgtactccagcccgggtgacagtgagatgctgtctggaaaaaaaaaaaaaagaaagactg

SEQ ID NO: 8934 - DNA, 201 bp, Homo sapiens
aggtaataatgatgatcgtaaaattagagacagataaaaggtatgggcattaggccagggcactgcaatttctaagctgtgtgacctcaggcaagttactygacttctctgagcctcagcggtttcatccgcaatatatggataggaaaaccgacctcagtgggttgtctgacagtggagggcacttgattaaaaaaaaaa

SEQ ID NO: 8935 - DNA, 201 bp, Homo sapiens
gggcaacagagcaagactctgccttaaaaaaaaaaaaaagaaagaaaagtaaaaggaaaaaaaagaggctctggcctgctggggtgcctgcaaagtctccrtggaagggtgacattcaagccgagacctccagggaactgtctcctgggagcacagagccctttgctcagcccccaggtggctcagtgcccccagccagca

SEQ ID NO: 8936 - DNA, 201 bp, Homo sapiens
ctcatcccatagtaagcatccagctagagatgttgatttctattttcaggtaataatgatgatcgtaaaattagagacagataaaaggtatgggcattagrccagggcactgcaatttctaagctgtgtgacctcaggcaagttactcgacttctctgagcctcagcggtttcatccgcaatatatggataggaaaaccga

SEQ ID NO: 8937 - DNA, 201 bp, Homo sapiens
agaaagcttatgaaggatcaggaaaattaaaagggtgctctcgcctataacttctctctcctttgctttcacaggccttggtatgttcctgcttcatcccyttctacagtggccttatccctccttccttcagaggcgtggtaagtcggctttctctgctagcgctgagtcctgggggcctctgaagtgtgctcacacatc

SEQ ID NO: 8938 - DNA, 201 bp, Homo sapiens
tggagaaagcttatgaaggatcaggaaaattaaaagggtgctctcgcctataacttctctctcctttgctttcacaggccttggtatgttcctgcttcatscccttctacagtggccttatccctccttccttcagaggcgtggtaagtcggctttctctgctagcgctgagtcctgggggcctctgaagtgtgctcacac

SEQ ID NO: 8939 - DNA, 201 bp, Homo sapiens
aatgaagatgccttctcactggaaaccctacaagggtgggaacgtgccttatttgcctgtatcctcagggtctagcagagagaagataatctgtaataccraaacaccattaaattcagctgatgctttcataagcgctccttggaggaaggactccatttacttgacagatctgtgcaagacagcagcctggcgcgtcta

SEQ ID NO: 8940 - DNA, 201 bp, Homo sapiens
ccttggaggaaggactccatttacttgacagatctgtgcaagacagcagcctggcgcgtctaacctgcagccagttgcatcctctgtttaaccttgtttgyggaagctttctctaaacagccagcacttgtctgttcccacatgggtccgttctcccagtgaatcaccgtggtgcctgctgactgctctgtagcacagtgc

SEQ ID NO: 8941 - DNA, 201 bp, Homo sapiens
attaacctactctgtgcaaagggcattttcaagtttgttgccctgctcacttggagaaagcttatgaaggatcaggaaaattaaaagggtgctctcgcctrtaacttctctctcctttgctttcacaggccttggtatgttcctgcttcatccccttctacagtggccttatccctccttccttcagaggcgtggtaagtc

SEQ ID NO: 8942 - DNA, 201 bp, Homo sapiens
tggacatgtcttttcaaggaaaataaaagcaggctttctggaatggcgacttccaaacatatttgtcaatttaaaggagctgggagtggggaccctatgcyccgtaagcactctcttagctgttcttggctgtgctccccgcttcagcttcacactgcccttgctgtgaagggagcagcctgggccgggcgcggtggctta

SEQ ID NO: 8943 - DNA, 201 bp, Homo sapiens
gcgttatcctgaaaatcataggccttggtttcctcacttggctaacaggggtgatccccatcccctcaatgggtttccgtgagctcctgagagcccgtagmatggtacttggcacatgctgggcatcaggaggtatggcctctcttgctattgttgttattggtagacacagaaggatttaaaagtaggggaatgcaaaga

SEQ ID NO: 8944 - DNA, 201 bp, Homo sapiens
ctgcgttgacaggccccaggggatgccgctacttcctgaattctgaattctggaaactgagccggagttcagggcctggctcccattaccagggttgggcrttatcctgaaaatcataggccttggtttcctcacttggctaacaggggtgatccccatcccctcaatgggtttccgtgagctcctgagagcccgtagcat

SEQ ID NO: 8945 - DNA, 201 bp, Homo sapiens
gtacccctttccaactctgtctccctaacatggcacctgagctcctgccatcctggatttcatggaccccaaggatgggggtcctgcatctgggacttggmctattactcggagctccttttcagccgcctccctccacctgtccacccacctcaaggctcctttcttgagacctctcctaatttctcccttcccctaaac

SEQ ID NO: 8946 - DNA, 201 bp, Homo sapiens
aaaaattagctgagtgtggtggcacacacctgtagtcccagctactcgggaggctggggcaggagaatcacttgaacctgggaggccgaggttgcagtgakccgagatcacgctgctgcactccagcttggggacagagcgagactgcatctcaaaaaaaaaaaaacatacaaaaaaggtatatatgactatagccctttt

SEQ ID NO: 8947 - DNA, 201 bp, Homo sapiens
attccattcatctctgaagtgtatgcagtaatggcctcattcggctgagatttcccagcagcaaaaaatgtgcttggcagaacagttgctctaaatacctkggacatacattctttctaggattaaacaaataatacttgctgccctttgtataaaaagatcacttttctggtgcaccattagtgtacatttgatttgatt

SEQ ID NO: 8948 - DNA, 201 bp, Homo sapiens
aggatctttgttacacatttttatttttctcaattttggattttttgagggtgcgaatttacttagctgagaaatttagaagtcctttattcagtctagtmtaaagtgtccagataaaaacataccttagagatattgtgggtgcagttccagaccaccacaataaagcagataccacaataaagcaagcatataaattgt

SEQ ID NO: 8949 - DNA, 201 bp, Homo sapiens
agcatgtctcatctaacactccaggatctttgttacacatttttatttttctcaattttggattttttgagggtgcgaatttacttagctgagaaatttaraagtcctttattcagtctagtataaagtgtccagataaaaacataccttagagatattgtgggtgcagttccagaccaccacaataaagcagataccaca

SEQ ID NO: 8950 - DNA, 201 bp, Homo sapiens
aacatcagtgttcaaaatcccaaaatattattctcatcagcaaaatattgctcctacacacaaggtacctcttctccttttttcacttgctaataataatrgcaagtattaatataaggtatttgttgagcaattattaaatatgtcatctctaacacaacagtccaaaaagacaggcctaagttcttctactttatagat

SEQ ID NO: 8951 - DNA, 201 bp, Homo sapiens
tcccaaaatattattctcatcagcaaaatattgctcctacacacaaggtacctcttctccttttttcacttgctaataataatggcaagtattaatataargtatttgttgagcaattattaaatatgtcatctctaacacaacagtccaaaaagacaggcctaagttcttctactttatagatattgagactcatagagg

SEQ ID NO: 8952 - DNA, 201 bp, Homo sapiens
gtttcatttcttttttgaaaagtaaaaagaaaatttacaaaactataaaacaagttatatatatgtatatataaaactagcatattaacaaatatatatgrgtaattatataaaattatttatacatatataattacccatatatatttttcataattacccatatatatgtatatgtatatatatataattacccatata

SEQ ID NO: 8953 - DNA, 201 bp, Homo sapiens
atatatatgtatatgtatatatatataattacccatatatatgtatgtgtgtatatatatataattacccatatatatgtgtgtgtgtgtgtgtgtgtgtrtatataattacccagaattaaacacctttaggtgtaattagagtacattaaaatttggcatactttcctttagttcttttctaaattataaaagtaacat

SEQ ID NO: 8954 - DNA, 201 bp, Homo sapiens
cacatgggtcattaaagtccgtctgtaaagtctcagggactttctcatcattttccctaaacctaatgcaagatattcacatttctttttgtgcaaagaasaatcttaattcagctgataatcggggcctcccttaccttcccactgctcactataacagagaacaagtactagctcataactttttatgactttgtattg

SEQ ID NO: 8955 - DNA, 201 bp, Homo sapiens
gatgaacagagggagagattcaacaccaaatgcgtccctcttctgaatcccatctctcgaatcagacagcacttctgtgtacttcccaatatccatacaartaccaggaaacttattttacttgcctctggccttggtttgcaggtttggggaaacacaggagtcaaacagaatttttttgggtgaacccacagatttcac

SEQ ID NO: 8956 - DNA, 201 bp, Homo sapiens
gaaaacccttcaccagaagcaaatagatacccctgcaaatatctggtaatttcggccgggcgtggtggctcacacctgtagtcccagcactttgggaggcygagatgggcggatcacgagctcaggagatcaagaccatcctggctaacacgttgaaactccacctctactaaaaatacaaaaaattagccgggcatggtg

SEQ ID NO: 8957 - DNA, 201 bp, Homo sapiens
ccatcggcaccagctttgggggcatggagaggcagcggagagatgggggacgggttgtcagtcttggatgaacagtggagcggtcgggttggcgtctgggyattgtgtgtgcttgtgtctctgtgtgtgtgtgaaattttttcatcccaccaccaatctccccctccatcctcccccaattctgccatgatcttgccttct

SEQ ID NO: 8958 - DNA, 201 bp, Homo sapiens
tcactgcactccagcctgggtgacagagcaagactctgtctcaaaaaaaaaaaaaaaaaaaaaaaaaaaaagaatacaagagagtgtgacccatagttcaractactcaagtctatgtgggtctgcttcctgaacagctggtaaacagtggagaaagccatactcaaatgaatttcctttcaatttcagtgcgtcctttca

SEQ ID NO: 8959 - DNA, 201 bp, Homo sapiens
gaaattgccaccggaatgtaccctctctacttccctaactcctctctttacttctttggcccgttctttctgccacaacctaccactaaagatcctgcttwgaatgaaccaaggtcccaggggattgttgcataggcataagggttgttcttggaagcctctgggtttgttgatacagaggatccctatggctccttgatg

SEQ ID NO: 8960 - DNA, 201 bp, Homo sapiens
attgatagtcctctccaattagggtacaaaaagattatttttttcttcagaaattgagtggatggtctgctgctgtaggtttcattctcaacatcattttrtcccttcctaaaaatatccatttttaaactgctgatttattttggccatcgtccccacaaactttttgtaaagcatcagtgattttaccattctctcacc

SEQ ID NO: 8961 - DNA, 201 bp, Homo sapiens
tgcagtgatggatccaaaaggtggtagctgtgctgttgtcaactctgctctctgtggcatgtcctcttgaaagagatctcagtggtgcacttccatggctrccctcataggggagggccaggccacccagagagcaatgaggcatttgctgaaacacagcgagaggggagggagagcaaaacatatttttccagacccggg

SEQ ID NO: 8962 - DNA, 201 bp, Homo sapiens
tccagagcagtaacagacagctgtgcccagcactttcttctaaaagttggagatgctggatggaaaatttgtcattgtttacatagcacccacacacacamaaaaaatcctgactcactagcttctgtgttgtcattttttggtccatggttctattgctgcctaattttcatacgggaccctcacagtggttagtctgca

SEQ ID NO: 8963 - DNA, 201 bp, Homo sapiens
ggtatagggcagaacagtggttctcaatttagctgcatgttaagattgtcttgggggaatttaaactccagaccacaccccaggctaattaaatcagaatmtcttggcatgggatccaagcatttgtatgtttttaaagctctccacataattcctgtgcacaatcaaggttaaggactaactagtacaagatcaagggag

SEQ ID NO: 8964 - DNA, 201 bp, Homo sapiens
gacatgcaagaatcttattgagggagatgcctatgtaggattaaaggggagggagcaggaaggagggagagtgttcagaccttgatgcacacctgactccrgtgaaaggagacagcaaggaaagattgagtaggaagagcctcctctgcagcccagctctgagaaagtctcagccaggctgatgggaagtccccaagcaag

SEQ ID NO: 8965 - DNA, 201 bp, Homo sapiens
aaaagttggagatgctggatggaaaatttgtcattgtttacatagcacccacacacacaaaaaaaatcctgactcactagcttctgtgttgtcattttttkgtccatggttctattgctgcctaattttcatacgggaccctcacagtggttagtctgcacagtaaggagtcaactgtgacatcctcatccttgaatgcta

SEQ ID NO: 8966 - DNA, 201 bp, Homo sapiens
atggaaaattcaaccttgtttctctgttttcatacaaagtggggttcttggaattcttagaaaatggggaggaccctttgcacaggctgaagttgtgtgaraagtctggacagagtttccagctttcaaaatttagtaggggaaaactaaatagaggctttctcccttgtctcaaaactggattttaatttgcacactgct

SEQ ID NO: 8967 - DNA, 201 bp, Homo sapiens
cttgttggaggttattttatgggattcatttttggtgttccatggcttttcagaggaggctcagtgtccactgatagtctctgggaagactacgtaggcayaggtccgaccattgctatattttcttatatctatgaaatcctaagttaacattttaaactacagtctactgtgtgtcaagtgttgtcctaggctcttatt

SEQ ID NO: 8968 - DNA, 201 bp, Homo sapiens
aatgcgctacttattaaactttattttcccactgaagaaagaaaatcctaccttcagggaataaaatagagattcattttctgacctcctagtataatgcyaaaggaaaagcatacaatctctttggggagggagctgttaggaaggccagaggcagctgtcttggaaacatacagaaaggtgctattgggacagagcata

SEQ ID NO: 8969 - DNA, 201 bp, Homo sapiens
gttaaactttataaccacaccaagatcattgagctagtaagtggcaggcttgggatttaagaaagcttgtaatgatgttacatttgatggtttaaactgtsctgtgggaagggaatccaagaagataatcccatgtttctgcttcttgtgatgtttgcaaatctgtgttctggagtaagtctttgagttgactcttggagc

SEQ ID NO: 8970 - DNA, 201 bp, Homo sapiens
aagggaaaattcttatttcggagtcactgttcagaatgaaaatgtgagactaagtatttgttttgcaaagcgcaacagaatagagaagaaaagttgggcawtctgtagggcgacccatttggaaaaataaatcctaccccttttgaaggggagaaattaatgagatgagtgtcagtccctccctccccacccactgacctc

SEQ ID NO: 8971 - DNA, 201 bp, Homo sapiens
tttgattaaatattttctatttagagagggtaaataattctcttttgggactccagggggcctagccaactggctgttttattcattcatttgacttgtgmttctttagtgctttctacaagctaactcctgggttaggctttagaaatacaatgttgaacaagacaggtacatcgctgtttttatggagcttgctgccta

SEQ ID NO: 8972 - DNA, 201 bp, Homo sapiens
gggttggcttttctgcataattccaaagctaggctgacggcagagatagcaatattgcccttaggaagagctggatgggttctttgcagagggcagatggrtggcagattgcagccctggctattttattgcccagtaggaatctttactggttgtctgaaatctgatcagaaccaagagccttcaaattaaatgtgctcg

SEQ ID NO: 8973 - DNA, 201 bp, Homo sapiens
atccataactgtaccatatttcctttctgtatgttgagagatacacatggtcaaatttcctaaaacctgaatctaactcaatctaaattatatgatttccrtttctacacagtggaacaagtgtgtgtgaaataaaatcaccagcccagaggcattcacccaaataaatcttggagattttctgcaacatttcatccctct

SEQ ID NO: 8974 - DNA, 201 bp, Homo sapiens
gatgagcattttcttttacattctggacacacacataaaaaaacttttctatcattaacctgccacagccttatggaaattctgagaagtccagttcagcytcataacgcgtgaacgttatttatcttgaatgctgcaaatttggcatattggtggggggtgacaaggttaggtagatttattagcatcctgtcaggaaat

SEQ ID NO: 8975 - DNA, 201 bp, Homo sapiens
aactgctccaagaagcctttctcgagctcatgctccccttcaccaaactgccacaacaacctgtgtgaatcttgatcaccaagcttacagtgctgtttgarataattatctgctcaagtttctggtgttcccattagactgtcagtgcctcatcgatgtgctcagcctctagctgtgaatggtgcacaggtgaccccagtg

SEQ ID NO: 8976 - DNA, 201 bp, Homo sapiens
tctgtatagatattggcactgcccttgttttccagattatctctggagtgctctgagggatcagttggttggccaacaaataccatttgtgcctcaggctytttgtaaaacctaggggaatgtctgaatttcccttgattgagacatctcccttccctgtcaagtcctgaaggagctgtaaactcaaggaataatgccaaa

SEQ ID NO: 8977 - DNA, 201 bp, Homo sapiens
aatcaatatctaacggtattctttaagaccctgaatccagccacacttgaaccatttttctaaaggaatgtgaattcatagtgtttttcttttatcttggktctatgttatttgattttaaaatatattaaaatctagcaatgttattttatatgtggctgatacattatatatccatagtcaaggagatagcactaatca

SEQ ID NO: 8978 - DNA, 201 bp, Homo sapiens
agcttgtctgaactatggagggaaaaatagagaatcaatatctaacggtattctttaagaccctgaatccagccacacttgaaccatttttctaaaggaaygtgaattcatagtgtttttcttttatcttgggtctatgttatttgattttaaaatatattaaaatctagcaatgttattttatatgtggctgatacatta

SEQ ID NO: 8979 - DNA, 201 bp, Homo sapiens
tattcctttcagatagactctagtatataatatcattctgctattcatcaggaagtggctgaataatttattatacaacttgtctatagatcagagtagaygaataataaaatctttagtatgtaaaaaccttacaagaaagttgagacttatggtagcaaaggatccagaaggattgggtcattttgtagttattagtaa

SEQ ID NO: 8980 - DNA, 201 bp, Homo sapiens
gagatttcactaataggagggcaggagttgagcacagatccaatagaggaaaaatactgtcttcaggcagataggggatgtgccactggggccgagatgaygagtttcgtgaaaaacagagttcaaaagaggaggctcttgagtgtaaagataatttgaggggaaaagaaaaaaatagaatgtgactggaaggaacggaat

SEQ ID NO: 8981 - DNA, 201 bp, Homo sapiens
tacaataaaatgtgactaatatgtttttttctaaaacccagtcccatataggtgtcggatccacagaagtaatttaagaatggtttatttgaagatctctwtgtataatttatagatttctcagtgtgattaagaaatgaagttattacatttttttctctaattagtaatgcacgtatgcctccttttaatgatattatg

SEQ ID NO: 8982 - DNA, 201 bp, Homo sapiens
ataaataaccaaacatgagaggaatgagaggagatggggatggggagtgggaggaagagggtagatagaaataaaaggaagaacaacattacagagaagcrgagatgacacagagggtggacacgtgggaaggcctggatcacaggggaaagagtgagccccaaaataacactgtggcttttgcagcaaggaggaaataag

SEQ ID NO: 8983 - DNA, 201 bp, Homo sapiens
ttgaggttcagagaggttgctacttatatggtagcaaaagtatttcccttccctacttaccctactatacaaaacaaacaaacaaacaaacaaacaaaaamccagaaaacttgatgataaatgtcaatcaacactcagcctctgcatctgatgagcaacagaaattagcggggactgtggtgaattggaaaacctgtgcct

SEQ ID NO: 8984 - DNA, 201 bp, Homo sapiens
gtatttagaatacagtatattttgattttggtgttgaaaaaggtgtggaggtatgcagggaaaaatctcacatgcttttacctacacacacacacattcaygcaacacaaagtgcacgcacatattggtcttgaaattccccaaggaccaaaatggacccatgtgatgagtctgtgttataacagggaatctaccgtaggt

SEQ ID NO: 8985 - DNA, 201 bp, Homo sapiens
ttcaggtcacctatgtataaagtgagaaataaaggctggctaggagtcagccatgggaaggggatagaataagttgaacattcatggtaaagagaatactrtattcaagatcctaaagcataatatgtttggaaaacagaaaatacagtatggccagaaggcagaactcaaaggagaatgagagccagcggatgcggtagg

SEQ ID NO: 8986 - DNA, 201 bp, Homo sapiens
acagctgtctctctttttctggctggcctgcctgcatgcctagataactgaatggcttttttcagaatgaggtatggtctaaggattttgctacttcaacrtcagtttcctggatcttttcttctactccagcttgccatatgtcccttttatattttcttggccactctcttacaaatagggccatagatcagagatggt

SEQ ID NO: 8987 - DNA, 201 bp, Homo sapiens
gcttgcactcatggctctgtgattcatgagggcagaaaaactgactggcttacagctgtctctctttttctggctggcctgcctgcatgcctagataactraatggcttttttcagaatgaggtatggtctaaggattttgctacttcaacgtcagtttcctggatcttttcttctactccagcttgccatatgtcccttt

SEQ ID NO: 8988 - DNA, 201 bp, Homo sapiens
ctttcctgactaccctgtacaaataaaaacaagaataagcctccaccctatcctagcactccttcttccgtttagcttgtccatcaccatctaacatgccrtaaattcacttctttatttgccccatccccttagattttaaagttcatgaaagtaaaactgcatctgtgtcatctactttggaacagttcctggcactta

SEQ ID NO: 8989 - DNA, 201 bp, Homo sapiens
cccggccatgtcacagttttataggcctttcctgactaccctgtacaaataaaaacaagaataagcctccaccctatcctagcactccttcttccgtttarcttgtccatcaccatctaacatgccgtaaattcacttctttatttgccccatccccttagattttaaagttcatgaaagtaaaactgcatctgtgtcatc

SEQ ID NO: 8990 - DNA, 201 bp, Homo sapiens
agatcgggtgctcttataaaacatcagtacttataattgtatcctgcagtggaaaattgtgcaataatctttttctgaaggcatggccatgaattgtactrtattactccatctatcttcttttaacactaaacaaaatgaagagaatacattgtgcatggcccctagaaatttaccttcaaatagaaacaaagctgctaa

SEQ ID NO: 8991 - DNA, 201 bp, Homo sapiens
agccttgggaaattccaggtgagaggggaggactctggagctttttaaaaagaccctagagttcattttacccaacaattttatttcataaatgagaaaaytgaggcctagagaagtatggcttaccaaggttacaaactaaattatggcagttttagctcatggcttatgttagctagactgctggttcgatttttcagt

SEQ ID NO: 8992 - DNA, 201 bp, Homo sapiens
agcaactcttaaatttctctccatttcctatttctagtaattagctcagtgtcacagctaaggttttcttactgacttcagcatggagacttagcagttayggaaaggagaggctagagctttccaccaactgcatgtcactggtgactccaagagagaatccaacaaatcaactactaataatccttactatttaaaccg

SEQ ID NO: 8993 - DNA, 201 bp, Homo sapiens
ttttacagcccacaaagagaagttaattgcctgtggtcacgcagctagtaagtggttgagctgagatcagatcccaggaagtctgagttcagagcttgctstagctgctatacagtgtaataaagcagcaataatgatgacttgcattctcatagtactttttttcttaaaactttatccctattttacaggtgtggaaac

SEQ ID NO: 8994 - DNA, 201 bp, Homo sapiens
gccaaggtttacctctgagaagtatcaagctgttcagcattggctagaacaagctcttctgaccctgtcgacccaacagtgaaaaagtgtcagtgtagggragcggaagatgttaagcatgtgcatgaggaaggaaatagtttctttccagcaggtgagaagcccagagagttttggtggcctgggcaagctcctatgcct

SEQ ID NO: 8995 - DNA, 201 bp, Homo sapiens
gggagtaggacttcaacatatgaattttgaggggacataattctgtccataatgtaagaccaggtataaagaagcctattgcaagccacaaacacagaatytgactaagatgtatttattcaaattcccactatgtgttttactagctgtatgtctttcagcagctcacttaacctaactgcaattctaattagtcatgta

SEQ ID NO: 8996 - DNA, 201 bp, Homo sapiens
tactgagtgagttttgctctgcatcagtggaggctataaaatgcagtatttatctgtatatgagttctataccaatgtgatctatctctctaattagatartcaactatttttaaagagctgcaaataagccttacaagaatgtcataaatgcattccatttagaaacatcttgcagataaattgtatttttattcttcct

SEQ ID NO: 8997 - DNA, 201 bp, Homo sapiens
gagcgcttatacctcccctcctccaaccttccactgcccggtacattattttggaaatttgagcagagttgtctttggaatgacggcgcctcatcaatacrgaatttgtgataatctggtccttgggtgggcttgagtttatccacataatggaggtggagtggggagacagaagtatgttaattaagactaaaggcccac

SEQ ID NO: 8998 - DNA, 201 bp, Homo sapiens
gagtagttgtgttaaagactgtatagaccacaaagcctaatctgctttgctgcctcctgatctagaagatttagactaggaattcaagtagacagaaaacyggtgttacaaggtttagaccttacttcttggcacaccccactcattccaagtgggattttagctgttcgctccaactttttgcatctcgcctttacctta

SEQ ID NO: 8999 - DNA, 201 bp, Homo sapiens
ggcctaacctgatttgggcctgctccagccttcagtgcctattcccatcaggatattagctgggaaatgtggaatgagtgtcagcaatttgggagcccttycttcctttccgagtccccatttatcttcttccacaatttctcccacatgttcattttaaagtagctctctatctaaatgctttaggataaatctggattg

SEQ ID NO: 9000 - DNA, 201 bp, Homo sapiens
ttcatggggaggcctaacctgatttgggcctgctccagccttcagtgcctattcccatcaggatattagctgggaaatgtggaatgagtgtcagcaatttkggagccctttcttcctttccgagtccccatttatcttcttccacaatttctcccacatgttcattttaaagtagctctctatctaaatgctttaggataa

SEQ ID NO: 9001 - DNA, 201 bp, Homo sapiens
actttctgtaaattaaaaattgttagtgatcagttttgaagcgttgagagcctatcagggaccacatgcctggaatgagcatttaccatgtggtgcctttrgaagctaatattgattctcattattttaaatgattacaaacattgcaggtgttttgtaataatctccattgtctaattagaacatgcgtgaaatgagctc

SEQ ID NO: 9002 - DNA, 201 bp, Homo sapiens
tcattttgttttaatgctaacttaataatcatgtcttagtgtaactaagcttttcttcatcaagaacattataagctcattgatgcacaggctaaatcttkatgcttatttggtgctttttaatctgtctagcacagaatagggcacaacacaggtcttcagtgtgcctttgctgaattgaaatacaaaaaaatagcacat

SEQ ID NO: 9003 - DNA, 201 bp, Homo sapiens
attactacatatccaaaaactgaaacttactcaacagggaaatagctaggtcttatattttccaaaataaggtactaaatccatcatgtgtaaaaaagttwatcatatgtaggcatgacttgtaaggctctaaaaatgtctgcattttagggtattcctttttcctagcattggttcttttatgacctttgtgtttttctt

SEQ ID NO: 9004 - DNA, 201 bp, Homo sapiens
tcctctgaggtgttttgatactgttaacatgagcatcaaagtaataccaactcttaaaacacacataattacttaactatcagtgtatttctaagaacccwgtcatatgcacccttcttattttatgctcatgttgtaaatagacatacatgatgctgtgctgtcatagagaaaccatccatgttcactgcttaaagaagt

SEQ ID NO: 9005 - DNA, 201 bp, Homo sapiens
ataatttggtcactgttcattagtgagattaaatttggctactgagagtaggtcatgcaaatcatctttctggttaaaaaaaggcctgtagctactgggtsaaatttgctttgaattatttttcataatcacaagtaattgggcatgtcgtactcagttataaataaatatacaaaagtacactgatctactttccttaat

SEQ ID NO: 9006 - DNA, 201 bp, Homo sapiens
taacgacttttgttagcatcaattatactgtaatttctagtgtctgtgttattcttttgggggggatgctattttattttattcactttaaatgagggcayttaaagtaggactgatttgctcggggaacaagatcagaatttccatcaaataagtgccattttgcaggtttggtacatctaagcagggaggaggctgagt

SEQ ID NO: 9007 - DNA, 201 bp, Homo sapiens
aacaactaatgataaatatttgagatgatggatatgctaatcaccctgatctgatcaatatatattatatgtatcaaaacatcactatgtaccctgtaaawatgtacaattatttttcagttaaaaaaggaaaagaaacaaaaaaataaatattctgagaagatgaccttaagagagatgttggaagagagggagggttgg

SEQ ID NO: 9008 - DNA, 201 bp, Homo sapiens
taatgtaattgaggaagacttctgggagaaaggtgcacttgaatagagattgaatgaagtgaggaaaagaattatgtccgtgctcgggtggaagcaatgcwcttgataggtacaggaaaggaaactccaaaaggtgtagaagaattacagcatcctagtgacacagaggcccatggagtggagttttgcaaggaggaaagt

SEQ ID NO: 9009 - DNA, 201 bp, Homo sapiens
gatggtcagtgaccctttgatcttgagtttcctcgtgatgttgataaactcctgtgttgggatgactggtctagagggtgagatgaggatatgcatagaakatgcctattccaacacctggtgcttattgagggctccattaaaggcaactgctcttattatttgcatatatcttatgccatgctctagattgtaaattca

SEQ ID NO: 9010 - DNA, 201 bp, Homo sapiens
ctcttttctcttaaagggcactctaaagtgccttcccagtgtgtaggaacaggactgaaagggccgtttttcttggctgctggtgactttccaaagcaagygtctttcccttctcaccttgtccatggccccttgtgccctttatttgctctttctgcctgatgtagcagccacaagctgagagggctttctgtgaagtgg

SEQ ID NO: 9011 - DNA, 201 bp, Homo sapiens
ttcagtcaactcatttaagttcgcttttccaggagtcactggggaccaggaatgagtcctggtgcatggtaatcccatgcagagttcccagccatccctcygtcagcccagcacctgtgtcttcccacatccactgtcaatgccttccctctgagatttgctcagagtgcgcctgtcttcgcaatgtccccatctcttggt

SEQ ID NO: 9012 - DNA, 201 bp, Homo sapiens
attagactgactttgctttccctttaataattcaggtaattattatatttacagaatttgcctattttttgaaatcaacactttgttaatcaccagacccrtgacaatctataagtagccactttacgtggcttatagatctaaagtgaatgttggttttcacacattcattcataactattatttttactgatatattag

SEQ ID NO: 9013 - DNA, 201 bp, Homo sapiens
aatataataatgacttacaccttagactgtaaccattgtgaatttattctatgtgtatctatctctggttttctttgttggagtggcaagatttaaagcargccaattttatgcctcattctatgtgcaccaaaactacttacatgatattggttttcagtgcctgctacaacaaaaacaatatcccagtaacagcccact

SEQ ID NO: 9014 - DNA, 201 bp, Homo sapiens
ccatcatttgggctatatctatctgcatatcatacataatatccttgcaggaattaatccagcatccatatgagtgtaactcatacctaggctgataacaraatctgaaaggtttttcactgaaatatatcaggtgactaaagaatttcacaacccaaaagaggagggtatatcgatcctagtggaattctatttcatgga

SEQ ID NO: 9015 - DNA, 201 bp, Homo sapiens
aggctggtcttgaactcctgacctcgtgatccgccctcctcagcctcccaaagtgctgggattacagggaagtacacatcttagttgtggagtgtgataartatatagaattgagacatataggatgtgactgtgaagtttgaatataaacttttaatgaaatccaaccaaatatagcagaatggtagattgtttaaaatt

SEQ ID NO: 9016 - DNA, 201 bp, Homo sapiens
gactatatgtctccataggcctttttgtaagaagtattcagtgatataatttcccctatagcagacctacaatgaactgcttagtttcatgtcactgctgytcatattgtcctttgctaaaagctgagaatatgacactaaaacgagattcaaggaaagaaaatctgtaaaggatggaaaacgcagatagtatgttcaaaa

SEQ ID NO: 9017 - DNA, 201 bp, Homo sapiens
agatggtaactgggtggaataagacttctaagcccacataagacaggatggtgtgatctttctgggagggtgccacgtctgtccaatattgatacaatagygcaccagtggcagcttcttggttgggccaagtaagccttctcaatgtatttactccttcagtatttataacaatcaggaagctgtaattattgtccatat

SEQ ID NO: 9018 - DNA, 201 bp, Homo sapiens
gcagtcctctccctcagcactcttaattccttcttatctactttattattttttcctgagtacttgtcaccattgggcatactatttgttatatttatgtrtttgtttattatctgtctctctccactagaatttaagagccacaaaggcaagtattttaatctgtttacactgatgtgtcaccagcacctagaacattgc

SEQ ID NO: 9019 - DNA, 201 bp, Homo sapiens
ctagagagggtggtgtggctccagaatgctggggcagacttcaacgcaaaaactgcacaaagagggcaggggtaggagaggccctgggaggtgttaaccamtgagcttgaaccttcgcatttttctctttcttaaaagaagttaccattaaccagtactttcaatttcttctcaacctacccaacgccttctaccttcctg

SEQ ID NO: 9020 - DNA, 201 bp, Homo sapiens
ggcctcccctaaacttgaacagggttacattgtagaataacataacaggaaatgaaaagagaaatgtgatgctcttcaacaattggtttatggggcctttwaaaaagtgtgtatagagtcaatgatgaattaagatgcagtgtgaaagaaaatgacacaggacagatattcagagatcatttgttcagttttaaaatcaga

SEQ ID NO: 9021 - DNA, 201 bp, Homo sapiens
tcatgatagtcgcacaggaaacttgacagtgacagcaggggaacagcacagtatcctacttggccactggtaggaggatgcaatttaaatcctggcatgcrtagaatagcctcacttatctgtggattgttattgtaatctacatagtaagtttcaatcagaactcagttttgtgcagttgatttccaattcccgactctg

SEQ ID NO: 9022 - DNA, 201 bp, Homo sapiens
ggctagttggtttgtttacttgtttgtttacacttactcattactagctttccctataaagcaagggaaaacactctgtccccaggggccagctgcataayatgaatagatgaaatagaccagaccagatgcaatctgcagtcatgggaactctgaactgaagagaacctgccctcatttaaaggcatccaaatgaaacat

SEQ ID NO: 9023 - DNA, 201 bp, Homo sapiens
ttactctctttaacatctttcacattagaaatctatggagaagaaatatgaaagactcatatataaacatggggcaaaccatgaagctaaatcttaatgtrtcccaaaccccagagggagcataaggttaactttgggtggccagggtgcttagtgataacattatgagctttctacattagcagggccccctggtgtggt

SEQ ID NO: 9024 - DNA, 201 bp, Homo sapiens
tgtgttcagccctctcccttctgtgtataactgttgatagtttgtggctaagtgtgtatttccgtcatcttttgtatatactgagttcttgttgcatgagrttgagttgacaattttggtggtgtgtcttcaaatgtttgggggcatgagaatggtaaattcaggtgatttccttgaatctaatttttaacatttcttctc

SEQ ID NO: 9025 - DNA, 201 bp, Homo sapiens
gggaaaatgggagatgtctgagaaataccctagaggaaatttgaaatagaaaaacagagctgaggaaagaaataaagatgaatcaaaaattaaattggagytatatgatggttcagggagcaacacatgtgtagagaaggaaatgagaggctggaactttggggaatcccagagttaagtaatagacaggggaagaggcag

SEQ ID NO: 9026 - DNA, 201 bp, Homo sapiens
ccaaacctattttgctgtcatttgaaagcatgttattttctgcatgttcacatttcaccttgcttcccagagtgtttacagcaacttgccacagtaacacrtactaaaataatggtatgatacacaagtaagaataaaaaatgtgatctagagaaaaataagagttaaacacaagaccctagggtggaggatggtctgaga

SEQ ID NO: 9027 - DNA, 201 bp, Homo sapiens
gtgacttgaacttacacatgaatgagaagtagctagtcacaagaatatctataacaagattgttataaatagcaaagatagatagatagatagatagataratagatagatagatggaaaaagccctaaagtatgaatgagcttggcagatttgaaaaatagattgactagtagagagtggatatttgcgaagatttatta

SEQ ID NO: 9028 - DNA, 201 bp, Homo sapiens
tattctctctgtgaagcttggccgtgatttccctcaactcctgctctccacaagtttccactttgtactgagctcttacattgccttggtcattccctttmtcttctccctacctatgttctgaggaaataaacaatgaagtttcatcttctttttttttttttttttctgagacagagtcttgatctttcacccaggttg

SEQ ID NO: 9029 - DNA, 201 bp, Homo sapiens
ttgtatgaagtatgtgaatccatgcaactcgatctctcttgatttttatttgcaagcttatgttgtataactttctgacaacacaagaaattggccaggakacaaaagaaattctgtagaaatatagaggcttttttggagcttgtgtgcacatcagatgtttcttcagatacctttttggttcctgtgtctcattgtttc

SEQ ID NO: 9030 - DNA, 201 bp, Homo sapiens
catcaaaaccaaaagcaataccttgtttgcaaggcctgcctaatattccattataacgctgtgccatctgctattgatggtcatttaggttgtttctggtrttttactaagggtgcttcagtaaatcactttgtatgaagtatgtgaatccatgcaactcgatctctcttgatttttatttgcaagcttatgttgtataac

SEQ ID NO: 9031 - DNA, 201 bp, Homo sapiens
agtttattactacatatccaaaaactgaaacttactcaacagggaaatagctaggtcttatattttccaaaataaggtactaaatccatcatgtgtaaaamagttaatcatatgtaggcatgacttgtaaggctctaaaaatgtctgcattttagggtattcctttttcctagcattggttcttttatgacctttgtgttt

SEQ ID NO: 9032 - DNA, 201 bp, Homo sapiens
gggaggtgaagttcctggtctacgtgcctggagcataaatttgcattctgaaatgaacattttaaaagagatgtacaaatggttacactatttagcgcccrcagccaacctgaattaattattcaagaactgtatgaactgttggtgcatctggatcctgcaaaggataagtcacacatctgttgctcactcctctgggct

SEQ ID NO: 9033 - DNA, 201 bp, Homo sapiens
tgatgagagattgtcttaggaacactgaagtacactggcaaattttgggaagcagagataaattatgttgctaaaagccaaggaaggctgggcgcggtggytcacacctgtaatcccattactttgagaggccgaggcaggtggatcacctgagatcaggagttcgagaccagtccggccaacgtggcaaaaccctgtctc

SEQ ID NO: 9034 - DNA, 201 bp, Homo sapiens
atgtaatattgcaattagatgatgagagattgtcttaggaacactgaagtacactggcaaattttgggaagcagagataaattatgttgctaaaagccaargaaggctgggcgcggtggctcacacctgtaatcccattactttgagaggccgaggcaggtggatcacctgagatcaggagttcgagaccagtccggccaa

SEQ ID NO: 9035 - DNA, 201 bp, Homo sapiens
gaaaagcctaggttattaacagcggaaacagtagctaacaccacagacatctcaactggttcagcctacacaattcttactgaaaaatttaagttgagcamactttctagttgatgggtgccaaaaccgtcgtacctagatcagctgcagacaaaagcagaactttcaatgaaaattttaaacaagcgggatcaaaatcct

SEQ ID NO: 9036 - DNA, 201 bp, Homo sapiens
catgtgtgtgttatctccatcccaataaatgctattgggaatatataaggctgacattatcattttagttgattaaaataaaatatctaagttactcgtakcatgcttaaaatatttttataagtaaggtaaataggcttgacaaactggtgatatcttaatttgcttctcatatccatttttatggatatgataaaggta

SEQ ID NO: 9037 - DNA, 201 bp, Homo sapiens
cctgatgtgattattacacatcatatgcctgtatcaaaatatttcatatactcaataaatatatacacctactatgtacccataaaaattaaaaatataamagtaaaaatcggatccatcttttccctaactagtggttgttcaaagagacatttaaggcacaagtgttgtttgtgcagtattgttttgcacatatcaaat

SEQ ID NO: 9038 - DNA, 201 bp, Homo sapiens
tttctaataacaattcatgtccaattatctgactgccagcacagttatctgctatggttgttagaaactttagaaagaagtaaatcctccaaaattgtcastcttaaaatctgagagaaaacagaatgaatagataagagatgcttcaaggcagttcagctctgtgatggttccgttgagatagaacacacatatacaaag

SEQ ID NO: 9039 - DNA, 201 bp, Homo sapiens
ctaccaaatcctaaaagatttaactaactggctcactaaccaatgcacacacatacttacttatttcacccagtatgtgttgactaccttttgcccaccargagctaggcaggttcacagtgcctagctcccaggcacaaagataaatcagaaaccattctgtctaagtcaacctttcattttagcttagcaggaaacaca

SEQ ID NO: 9040 - DNA, 201 bp, Homo sapiens
tgagaggtgacaacgtgctagcagccctcgctcgctcttggcgcctcctcggcctcagcgtctgctctggctgcgctggaagagcccttcagtccgccgckgcgctgtgggggcccctctctggggctggccaaggcctgccctctgctggcggggaggtgtggagagacaggcagaggtgggagtcggggctgcactggg

SEQ ID NO: 9041 - DNA, 201 bp, Homo sapiens
gacagatcatactttaattggtaaattatagtcaattgccaacagcagtaagtgctagagaggaaaggaccagaataagggtaggaggtacttttgagagktgacaacgtgctagcagccctcgctcgctcttggcgcctcctcggcctcagcgtctgctctggctgcgctggaagagcccttcagtccgccgcggcgctg

SEQ ID NO: 9042 - DNA, 201 bp, Homo sapiens
tgggctagaatactgaattagggctgaggaacatcatcacattctccacgctgtcccagtatactgttggatgatgtcagagcaacgtgaaaggattttgrgttatggtttagctcatagtccatgcagaagaggccataattagcacagggtaccatggcacttctcatctgagacatgtgacatggatttgcacagatg

SEQ ID NO: 9043 - DNA, 201 bp, Homo sapiens
aagttttcacttccttctgaccttaatcactccctcaatgaacccataagtatcactgaacatgggtgtcaccagttagcaacagtaagataaccgctaamttctgaaacatggaagctctagcattgcttggatgatgtcttccctgactgcctgtgagcctctggccaggatccggggtaagtgcctcacaaatcactg

SEQ ID NO: 9044 - DNA, 201 bp, Homo sapiens
acctcgcctggctaattcttctgtatttttagtagagattgagtttcaccatgttggtcaggctaatctggaaatcctgacctcgtgatttgcccacctcrgcctcccaaagtgctgggattacaggcatgagccaccgcgctcggcctcttctttactatagagtaaaagttgcatggtcgttttcttgcatttgggtca

SEQ ID NO: 9045 - DNA, 201 bp, Homo sapiens
agaaagtggaaagttctttgaataccttaaagcattgcatgaataataattgtacctgcaggtgtattgtctggattatctaccacccgtatacattttargaccattttttatcttgactttctacaatgaagtttacttatgaaaggtgagaataggggactaagagattttccatcttgctttctcatccttcatgga

SEQ ID NO: 9046 - DNA, 201 bp, Homo sapiens
cataagaactcactcactatcacgagaacaggaccaagggaatggtactaaaacgttcatgagaaattgtccccatgatccaatcacctcccaccaggccycatctccaacactggagattacaactgaacaggagatttgggtggggacacatccacaccatatcaccgtcttcactgccatagtgttactcttatctaa

SEQ ID NO: 9047 - DNA, 201 bp, Homo sapiens
atcacttgggattcacagaaatattagatgcagtgttattagtgaaaccttagttccctttatagatatgtcttatgtcccatttgtaatattattattgwtgttaccatacgcaaactttatttcttagtttggatgcttggtctcaaccagacccattacctccttatcttcctatctcttagggtcacttcatgctta

SEQ ID NO: 9048 - DNA, 201 bp, Homo sapiens
taataacctcagttagaacaaataattgttttactagttcagatacacttaacattataatagatgccctcataaggtgctatgtataaatcctttttttraaaaaaagcttgaatcatcatgtaaatgttttagggcaactcattgcttagagaaatcctttgaagttttcttttataatgcaaaaactcctactgcctt

SEQ ID NO: 9049 - DNA, 201 bp, Homo sapiens
aaaaaaaaaggaatcaaataaggaagagatagatagtaaaagagaagtggatgtaagcaatttagaatatattttatcaaaaattgctttttaagtggcaytttctcttgctgcagaagacattattgaacaaaaaaaaagcccaatgcaattcaatttaaatttatcactctattattttaatatatttactcagggtta

SEQ ID NO: 9050 - DNA, 201 bp, Homo sapiens
gccaaaataaataaataaataaacaacaaaccaaccaaataaataaataaagcagataaaccgtggttctttgcttaaaaaaagttgcagcaaagaaaagmtttagagtaatttctagttagaagtggctgtgagattcactgtcttctggtgatatttgaaatatactatattcatgcaaatgtttctgattatttaaac

SEQ ID NO: 9051 - DNA, 201 bp, Homo sapiens
agagactagagggcaggcatagccctctatggagatgggccgttcaagttttaataaatgtgttgcatttgtcatcttagtatggcatgacaaatgatctmttttatattaggagctgcccaaagatgttgggttaattttagtcaaagtgattttatgcccacaacatctggatgagtttggtcaaaggaaagaagttta

SEQ ID NO: 9052 - DNA, 201 bp, Homo sapiens
agaaaaatcagaccttggcaaatatcttgagcagtaggctataaataactcccacatgcttagtgttccaataatggaacactaggcataagtggctacayacattatctcaactgccccaaaaagtagctcaaatacacagggaaaggctgagtgactgtacaccatggttgctagtaaggggattcctgcactgagtta

SEQ ID NO: 9053 - DNA, 201 bp, Homo sapiens
tccaagaacatgtaaaatagaaatgaatgacagagctggaatttgagcccaggcattctgtctcttaacccatttatgctggaggttgtgattttttaaaytgatgtatgacagaaaaatcagaccttggcaaatatcttgagcagtaggctataaataactcccacatgcttagtgttccaataatggaacactaggcat

SEQ ID NO: 9054 - DNA, 201 bp, Homo sapiens
cttcttgctttaagaacctggttattacagaggtgaaaaatcccatcaaaatgctagagaatttggcacaattattgcttatatttctcctattgctgctyttactgctgtagctgcctcctgaactgctgctgctgctaccatggcttctagatgcttctttgacaatttatttattttccagtggaacccatctgtgag

SEQ ID NO: 9055 - DNA, 201 bp, Homo sapiens
ttatgcaaatctgatgtcatttcatgggagggtcttgaacatctgaagatttttgtgtctgtgggaggtcctgaaaccaacccctgtggatactgaaggayaactgttactcaaaagagggattgctggatcatataaagttattttcttaatgcattcatgtatgcactagtgtgtgtatgcctctatacacccatgcct

SEQ ID NO: 9056 - DNA, 201 bp, Homo sapiens
catctgcacggacactcaggttgatataatgtcttggcttttgtgaataatgctgcaatgaatgtaagagtgcagatatctattcaaggtactgatttcayattttttggatacataattggtcctccatatccatggattttacatttatgaattcaaccaactgtggatcaaaaatatttgaaaaaaatgtgtctgtac

SEQ ID NO: 9057 - DNA, 201 bp, Homo sapiens
tttctagattattttactctgcataatgtcctctaggtttatccatgtttttgcaaatatcagaatacccttctttgtcacaggatgaataatatttctayatatatgtgtgtttatacatgcatacatatctctctcacacattttctttgtccattcatctgcacggacactcaggttgatataatgtcttggcttttg

SEQ ID NO: 9058 - DNA, 201 bp, Homo sapiens
taccgtgtgtgtgtgtttgtgtgtgttaagaatatttcaggttcactcttagcacattttaagtatacaatacattatcattaactatagtctccatactmtatattaggtctccagaatgtattcatcttataacctaagtttgtactatttgacccacacctccccatttcccctatttcctgacccctggtaaccaca

SEQ ID NO: 9059 - DNA, 201 bp, Homo sapiens
tcacctcacatagctaccgtgtgtgtgtgtttgtgtgtgttaagaatatttcaggttcactcttagcacattttaagtatacaatacattatcattaactrtagtctccatactatatattaggtctccagaatgtattcatcttataacctaagtttgtactatttgacccacacctccccatttcccctatttcctgac

SEQ ID NO: 9060 - DNA, 201 bp, Homo sapiens
tcgtagcaaaaaatgtagagagtatttctttccccatccccaactttactgagatataattgacgaataatatcatatgtattcagggagtacaacataaygtttgatgtatatatacattgtaaaatgattaccacaatcaagctaattaacatatccatcacctcacatagctaccgtgtgtgtgtgtttgtgtgtgtt

SEQ ID NO: 9061 - DNA, 201 bp, Homo sapiens
gttttgttggagtgatcatgccagaactgggactttctaatcttgaattcaaatcatgagagttaagcctgtcatgaactgtgagtgcaagctgacccagsaaccatgtggttctcaaaaaaaaaaaaaaaaaaaaaaaagcttatggctctttttgtgccacaatggcagaattgagtcattgctacaggcagtgcatgg

SEQ ID NO: 9062 - DNA, 201 bp, Homo sapiens
ctcatttatcaatcctttgttgagtctcaaccactgtcctaggtaatgctgatacaatcttatgttttgaagctcgccacaaaatttgatcaccactagakccaagatttaacacattatttcatttaatagctattttgagtcttcagggtacaatttacagttttgggggggaagatgtagggaaatatgactcgtcag

SEQ ID NO: 9063 - DNA, 201 bp, Homo sapiens
tctgttgttcccattgagccagctctgctgtccccactggtcacgaaccggatcagtacatggagattcctgagcatatgcagggcagcggcatgagagcrtctaaaatagagtcattcccattgccccagcacatccttccttcctacattcctgggagaaaagagcagaaacaaaggcttttctttcttctctcttttg

SEQ ID NO: 9064 - DNA, 201 bp, Homo sapiens
ctacttccttgaatttggcaaagtaagcacgatcattggagttactgcttttgggattatttatttatcacatcacctctgccatcattacttcccactcrtctttgtttggcttactttctactgtgcttctctctatcaaatctttgcacctccttaggaagatctggaagtcacctctctgtaaatctgagaagttat

SEQ ID NO: 9065 - DNA, 201 bp, Homo sapiens
tggttactgtgtgggtcctgttcacaatcttgatcatgattgtattccaacttctatgtcagagtttgcaagcatgtggcttataaactcaagatggctgrtacaatgttgttcaatatttaatggaggggtattaccaagatctagttttctaggttttcttgagaaattagaaaatctggcaacactaagtttgtaata

SEQ ID NO: 9066 - DNA, 201 bp, Homo sapiens
gatggggtttcaccatgttgcccagctggtctagatctcctaggctcaagcaattcaccctcctcggcctcctaaagtgctgggattacaggcatcagccrctacttctggcctgtgtttttcttttttaaagataagacctaaagaggattttgactattttgaaaatatattcatatctgtgtatttttggttattcac

SEQ ID NO: 9067 - DNA, 201 bp, Homo sapiens
ctggctaatttttttttctcttttgtagagatggggtttcaccatgttgcccagctggtctagatctcctaggctcaagcaattcaccctcctcggcctcytaaagtgctgggattacaggcatcagccactacttctggcctgtgtttttcttttttaaagataagacctaaagaggattttgactattttgaaaatata

SEQ ID NO: 9068 - DNA, 201 bp, Homo sapiens
ctcaaactcaagattctttttcctctacacttcactactttaactctcccgattattttgtggactgatgaataagtacgtgtaaactgattttagttttyctggtaatgaaaaaaaaaaaaaacaatgagtattgttactcttgtaataatcacatcattttttgtctttctttctttttctcattttatttttagacag

SEQ ID NO: 9069 - DNA, 201 bp, Homo sapiens
tctaatatttatttttggtggtagtggttttagcaaaataaaagtaataaatacataaatggactggtcccacgagcttactatctatggtttttttcaarttaattctaacccattcatctctctgagcctgctaggggcaggaggtgcttagagtctatggaagaaaaacgtcatgtttcagagctctggtaacaggaa

SEQ ID NO: 9070 - DNA, 201 bp, Homo sapiens
tatcaccccaggctcaatgtcttaaaatagcacctcgtaggctctcaataacagaagatggcaccaaattaatacactgaaaatgccacaagattttagayaaatgtaaaaacattcaggctttgattatttggtgaacattttgaggcattacgtgagttggagcaaaactcttgaggttaaataatatttgaatgggct

SEQ ID NO: 9071 - DNA, 201 bp, Homo sapiens
ataagtatttgaatgttttccaatctgcctgaacccgtttcaacccaaggagatagtaaataaaaggagcagactgatgaaacactcacacttgatatgtstttttttttgaatgaatgaatcaatgaataaatgattgagtgaggttccacatgatcaaatctcttgcactaggaaaggagggatgctagtttataaaag

SEQ ID NO: 9072 - DNA, 201 bp, Homo sapiens
aaattcattaaggctaagagtgccccttaaattatgttctgctgtatcctggaggaacacctgaagaagttaataataaaccctagagattaggcaagtgraaagaattatgaaataaaacaaagcaaagaaattgtgtaaacaaattaattaattgtctgaaagtgaaagcatgtttgtaattttgcccttgtcaaagaa

SEQ ID NO: 9073 - DNA, 201 bp, Homo sapiens
gagagaattctggcttccattagatgcttgaacgtgtcctttagagtaagattttctttacaaatccaggcttcaaatatggctatgtaataagatgggtkttttccatagtacatgagctcttaaatctgtattattgttattattattattattaatattatcagacctgtctttgtggcttaaaattaagaaacatca

SEQ ID NO: 9074 - DNA, 201 bp, Homo sapiens
gaggggtattaccaagatctagttttctaggttttcttgagaaattagaaaatctggcaacactaagtttgtaataataccagggacaactagccaaactsccctattttgttgaatcatgtgctgtctaagtcctcacagtccttgccacccccaaccctgcaatcatcctacatgtagtgtttctatttatcattgtat

SEQ ID NO: 9075 - DNA, 201 bp, Homo sapiens
tcatcatcattggtcgttagagaaatgcaaatcaaaaccacaatgagataccatctcatgccagttaggatggggatcattaaaaagtcaggaaatggccrggtgtggtggctcatgcctgtaatcccagcattttgggaggccgaggcaggcagatcatgaggtcaggagatcgagaccagcctggctaacatgatgaaa

SEQ ID NO: 9076 - DNA, 201 bp, Homo sapiens
tatctctgaaggccgatgttccttgaaagactgtgtgaaatattgaactatatgatctctgaaagttcttgaattctccattatcatcagaatacctggcmcttccaagcccttgaccttcgtctgtggagtattgactctagctgccttccagacattgtcatctatgcttcttttcctctgaggacgatgaaccccggc

SEQ ID NO: 9077 - DNA, 201 bp, Homo sapiens
tctacaaattgtgtgtcacttccttgacccattacctccccaatgtatatatcatgtgaatatcaaacaattgaatgttttgttggtacaattggattcaytcacacggaaacgtggagtctatttcttccttcaaatcctcatcctccaattaattagctgaaaaactgactgcatctctgattctctaagaagcatgga

SEQ ID NO: 9078 - DNA, 201 bp, Homo sapiens
ggactatttggtcaaatgttctgcaattcagttccactgcttgactgtaattcacctataaacccagaaaaatactgctggagttcagaggccctgactgytattagacagagaaaacctatagcacactggaacaatcacatttaaaagatttgcctcaagctttctatggtcactattactctttaatttatgctttta

SEQ ID NO: 9079 - DNA, 201 bp, Homo sapiens
gggacagaaaattctgactgatcatttcttgagctagaagcagctataatattcctgttctccatcctttataattactttctcataaatactaaactacwcccccctgagcatctagaagatttaaacactgatcaaaggcaggtttagctgtatcctcaggacaagctgattcaatgaagaaaagctcaggctcttgga

SEQ ID NO: 9080 - DNA, 201 bp, Homo sapiens
tattttataggtctattttcttgactatcataataacttatgccaaagccataagccaggttttctcttttcccctcagacagaagcagcataatgtaccmgagtggcacactgtgatgttataaagcccacaatccaacttcagtgcagtcacgctgagatgggaagaatgcagctttcatttaaacacaccttaataat

SEQ ID NO: 9081 - DNA, 201 bp, Homo sapiens
tttgaacatcaaattaagcaaagccatgaagtttggaatttttcttggcattttcttcccgtaccctgcaaatattaaatcaattgtcaatcaattgtcarttttacctttaaccatttctcttcttcatgtctttctccacacgatcactgatctagggtgagctcttactatctttacttataataggctagtttattc

SEQ ID NO: 9082 - DNA, 201 bp, Homo sapiens
ggttactcatgacctcatatttccccttatatgatgagccgtgctgagcagctgcgtgacagcatgtaatttgggcaatgcctgattgaggccaagtaagrtatctaccatattgaatatttggttttcttgaactcacccaagaaagctgaatattctgtgtggaaacaggttacacccaaaaaatatacttgagggtgc

SEQ ID NO: 9083 - DNA, 201 bp, Homo sapiens
ttgaaaattcatatagaataccttcattttcttcacactttggtctgtaaacagtgtggaagtagtgaagaagacacaaagtcactttagacatgtttatyactctcacttttatcctctcccctccatcagtgaagactcctacttgccatctttcctctaaagatccttagtccctgagaagcaagagctactgaagat

SEQ ID NO: 9084 - DNA, 201 bp, Homo sapiens
gcctgactggctcataccaaagacaattacggtagattttgcagggcctgtagatgaggagcagtgaagggaaggatcatctctatcatgagctagtgtcrataatcataagatgctccatttgagacccagactttgtggtgccatttagtcggatgcagttgaaggtgcagatgccagagagagactctaaaaggacaa

SEQ ID NO: 9085 - DNA, 201 bp, Homo sapiens
cagggctgtctagcatcagtggacttgaatggacgcctgccagacctcatcaatgatgctcttcatcggagcggacagatcgagcgtggctgtgaaggtamaacctatttttttcttgttaagctacagccttgttgcaagcaccaagcctctttgctgcctctgccactgcctccttcctcagttgaccagtcctgtctc

SEQ ID NO: 9086 - DNA, 201 bp, Homo sapiens
ttccagaggcaaaccacaggttcagagtgccatgcatttttgatacatcatccatatcctgttttaacaatgttgaattatcctgtaatgcaattttttcygtttttacttagactactcatcaagaaatggttcattttctctgataacctcgggaatgtcatgctgtgggggctgagagatgacaggatgagtgtcaaa

SEQ ID NO: 9087 - DNA, 201 bp, Homo sapiens
gcattgtagaaattttggttcatgtgaaacatagtttgaagggaaatcaagttactgtttcatttacctctttgaataaatagaaagatgttcaggtaaarccaagtgattatgatacagatctcaccccctccctccccaacctccacccaagcaaaagtttccaatggttccccatacacttttggaaacagagctttg

SEQ ID NO: 9088 - DNA, 201 bp, Homo sapiens
gcctttctaaagagggtaattttcatatattttatgcattgtagaaattttggttcatgtgaaacatagtttgaagggaaatcaagttactgtttcatttmcctctttgaataaatagaaagatgttcaggtaaaaccaagtgattatgatacagatctcaccccctccctccccaacctccacccaagcaaaagtttcca

SEQ ID NO: 9089 - DNA, 201 bp, Homo sapiens
agccatttggaggtgaggaagagggaagagtagtgggttagagcacagggaacaattctgggacctctgggtgtgagacccttcttctcccctcccccagygcttctccctcctgcctggaggggctgtttatggtgctccaatgacagcctctctcctccgaagggataatttctcaggctctgcctgctgattagacct

SEQ ID NO: 9090 - DNA, 201 bp, Homo sapiens
cctgatagttggaagactttcgtgcacttttttgtttgtttcgtctgtttagtggacagagacaggtctgttctccctggagatgagcagctgcattcccrtttactggcttttctgttggttcttgcttgacagtttgttttggagatccagcactacttctttcttagaaatggtttatcttgtctgaaataatcctcc

SEQ ID NO: 9091 - DNA, 201 bp, Homo sapiens
gacaacggtggtggttgtacaacattacgaatgtacttaatactactgaactgtacacttaaagatggttatgatggtacatttcatgttatgtgtatttyatcacaattcaagaaaactgggaaaacaaaactagcaccagggcttctgactccaaactgaggtttctttcccacaccccgtatcaccatcccctacaga

SEQ ID NO: 9092 - DNA, 201 bp, Homo sapiens
cccctcgttagtatttctggagtgaataaacgaatgatatagcactctgttgtttacaaagcacttacatatttgtggcctcattcaaacctcacagcaayctggtcatgtacttactgtcattattcccagtagttggggatatggaaaatgaagctcacagaggctcagttggcaaaagtcacacagctagtaggaagc

SEQ ID NO: 9093 - DNA, 201 bp, Homo sapiens
ttcaattaacatagtctaaaattacatttgattatctggcagccacaaatgcttttatatatatatatatatatatatatatatatgtgtatatatatatrtatgtgtgtgtgtgtgtgtctttttgtcaatttaatttctcaattcttgtttactatatagttacaaattgtaccttccatccttatgggttgtttatat

SEQ ID NO: 9094 - DNA, 201 bp, Homo sapiens
aaggattctgaagctccctctgggctcaacattatggtaccatgattaattaatgattgattagtgaagtgtgctgtgaacacgtgtagggaagattcatrtattttgccaccttatctaacatatcccagaagcagtggtataatactaatcagtgtgatatatgacagaaatatgggacttattcagaagcttgaattt

SEQ ID NO: 9095 - DNA, 201 bp, Homo sapiens
actactccagaggtgggagtgactttcaaagtccttgtttgcccagcctccttgtcttgcattagaagagaccaagcatcaggaggccagtgacttccccrtgtttacatggcaaggggcgccagagctggggctcacaccttggtttctcgattctgactcgagtgcactctttgctgtggggggccttgcgtggtcacg

SEQ ID NO: 9096 - DNA, 201 bp, Homo sapiens
cctctcatgctgctttcctcttgctgatcttggcactgccagaacttctgaccatgtctaaagtacccaagtcttggtaaacaggctggcaagagtgggtrtaagctcccttgcttccttcctggtggagcagtattgggtgggacattcttagctccccacatcttgatggaaggagctgggttgaccctgacatgcccc

SEQ ID NO: 9097 - DNA, 201 bp, Homo sapiens
gttcgcacagatgtcatcatccctcttctagtccctgcaggagcctcatgggagatcacgtgaccagtatttcacagctctttcccccagcacagaaatayctgccgtgttgagaggcctgtccatctcctagtccctgctagagcctcatggacaatcacgtgaacagtatttcccagctccttctcccagcacaggaac

SEQ ID NO: 9098 - DNA, 201 bp, Homo sapiens
ggtggtcatgcacagaagcagaaagaaaattcctctgtggttgttaacgtgaaggttttccaggggcttggggcactggttaaggaaacagattaatgagyagcaaacaggaattgatgggagtcctctgacattttgaggatatccctacacatcactgcaggctgagggaagcttggctgaaagaaactggccagaggc

SEQ ID NO: 9099 - DNA, 201 bp, Homo sapiens
atcgcaccgtggcactccagcctgggtgatagagagactccatctcaaaaaaaaaaaaaaaagtttattagcaagtataaatgtatcagaacttaacaggkcaatttcttgtattattgtgagactaaaaaaaattgggaaaaaaggaaagctttgaagagaaaaaaatgggtagccatcagaatcattttgtgaaaggaa

SEQ ID NO: 9100 - DNA, 201 bp, Homo sapiens
aaagtgtcctctgcagactttgttgccactaaactagaaataatccatagtttctcctgtttccttttccgttaatgaccaactttatatacactcaaaaygaataagtgatacggtttgttcttctcctctacttctctgtttcccaaagtaatttgcaagttagaagaggaaatccattaggagaagctgaatggatta

SEQ ID NO: 9101 - DNA, 201 bp, Homo sapiens
acattcgttcatgttctttgaaacagggcacacttgcctttcccagaaatttttcaaccaaacaggactaggacatagatcaaggtctgtcagcctatgcycaaagtgtcctctgcagactttgttgccactaaactagaaataatccatagtttctcctgtttccttttccgttaatgaccaactttatatacactcaaa

SEQ ID NO: 9102 - DNA, 201 bp, Homo sapiens
ctgtccagagttaaatttatagtcacaaagcaagagaaaagtctttgtttccaagccaatgggctgggtttccagaggcataaatcctaggaattagtaayatcccatataaaatcactgaaggttggtgcctatggttatgtcagtggcctctatgatactccctaaaggcgtaatttattccacagtccctagacacat

SEQ ID NO: 9103 - DNA, 201 bp, Homo sapiens
ttattgggcaggcactctacataaattatttcttttcattcctatgagatgggtactttatgaggaaagagagaggttcagagaaggcatgtcagttttcyaagatcacacagctcattgttgactgagccttgacatgaaactacagctatgtttaaaaccagtgctatttctagtgtactatcctgcttccttgtaatt

SEQ ID NO: 9104 - DNA, 201 bp, Homo sapiens
gcaggtgacattagtcagactttattcttatctatgaaagttcataagtaagtgagcttttgtgtttttctgcttaactctcattactacctgttatctcyttgaagacaagggatatgtaaaggtacatatatgtgtatagattgtgtatgtgtttgagtatgtatgtatgctttaagccttgttccaagattggtttat

SEQ ID NO: 9105 - DNA, 201 bp, Homo sapiens
ttacagtgtctactatactaacattttttgttgaagatttcccatgaagatattgattattgtctttttcagtttttaatcagatgcattggctaataccwgtttgtagctgaagctaagtctatcctcttaggccatggtgtgaattgtgtgtttccctttcttccttcatctctggcttagctcctttcattaccttca

SEQ ID NO: 9106 - DNA, 201 bp, Homo sapiens
gtaagtctttagttgcagggtgagctgggcagcacattacagtgtctactatactaacattttttgttgaagatttcccatgaagatattgattattgtckttttcagtttttaatcagatgcattggctaatacctgtttgtagctgaagctaagtctatcctcttaggccatggtgtgaattgtgtgtttccctttctt

SEQ ID NO: 9107 - DNA, 201 bp, Homo sapiens
ttttaaattttgatcacattttgaagtaatattttgaatatattgggttaagttaaatatattattaaagttaattatacctatttctccttttttggggyggctgctagaaaatttaaaattatatatttgctttgcattatattcctcttggactgtgttggcctagatcgtttattagcttaggcaacataatgcaaa

SEQ ID NO: 9108 - DNA, 201 bp, Homo sapiens
ccttctcctgaattagtcttagcccagtaacatcttgtgctgatgtcagtcttctggttgaccaagtaaacgtattttttcatttcctctttttttgctcrtctttttcatctctcgctgatgattgtcaactgcaatgacaccgtacttttatacactgcatgatgtatacttactcagaatttttcttattgccaaata

SEQ ID NO: 9109 - DNA, 201 bp, Homo sapiens
ttattcaagaaaacactgcagttcaggctaatgtttttgtatatttgttttgtacattttgtacatgtttttgtaatgtgtttatacatatgtacatagawggctttacatttggtgatcagcatttaaattatttacgtacttaaactattacaaatacactacttggcacactctttccccagatcttcatctggctgt

SEQ ID NO: 9110 - DNA, 201 bp, Homo sapiens
tggagattacgcttaaagtgggagtactgtatacatgaataagcagagcaggccaggtaagcaaagttgtggttggggaaagatgcattccagacagccaraatgttttgcctcattggaagattgtttttctcacccttagcaccctctgcttattcgtctctttgtttttaaccatttctaagttgtatcttaagactc

SEQ ID NO: 9111 - DNA, 201 bp, Homo sapiens
gtcagtatactataaatatcagtgaatattcagaatagaagctgatagaaaaatcaaaccatagaaaagcagggagagtgtgagaatatattcaccatgtrtacatatatgcccctaaacaaaagcctgaaagtatctactctaaaattgatttatcctcctcactatcctttttaaattttttatattattcaccttttc

SEQ ID NO: 9112 - DNA, 201 bp, Homo sapiens
cataccttttatacttaaacttaaatctatagtaaattatgagtttggttcattttatcattatatctctatgtgtttttgtattttctgaggattatatkagattaataccaatgaatctattaaatagttgttgcttctctaatatgaatcaaatctaagctgctgatcaggctgaggtgttgtttttaaatcattaaa

SEQ ID NO: 9113 - DNA, 201 bp, Homo sapiens
agtagtgatagcagtgaataaggaaagctatctgtttgaatttgcttgtgcaaagaggcagaaccatttcaaagatacagggtgcagattttagtgaagawgttagagctgacccctgctgggactgtggcatttcagtagaggaatggtgaatcccttcccagtggggaacacacatcatccacatacatgagggaaaaa

SEQ ID NO: 9114 - DNA, 201 bp, Homo sapiens
agggtttcaccatgttggtcaggctgatctagaactcctgaccccaagtgatccatctgcctcggcctccccaagtgctgggattacagacatgagccacygcgcccagccaaatgtgttcattttaagtcactcactttgtgccaatttgttatagcagccacaggaaactaatacaatacttgtgccaacttaagtaac

SEQ ID NO: 9115 - DNA, 201 bp, Homo sapiens
cctctaagtgcacaggaatatggtgagtgacactgggacttataactggagaagatggcagaattcatcttcgttgcctgcagctttccaatcctgagccyttttccactttcatcgtgtttccatctccatcattcctttcattcagggttttcatgatcttattctatcagagaagatagaactacacatccctctcct

SEQ ID NO: 9116 - DNA, 201 bp, Homo sapiens
ctaacccagtgattctcgagctcaggtgcatggcagaatgcctggagggtttattaaaaacactgattcctaagctccacctaagaccgattgaatcaggwtcttttagtgtagggtgcaggaatttttttttataacaacttccccaggcgatttttctgccagtctatagaatggcctttggggatctctttatctttt

SEQ ID NO: 9117 - DNA, 201 bp, Homo sapiens
ggtcagtcttgaacaggcaaagagcactttgtggagtgaatgatggcaactggaatgaaggagactcatcatctctagccagtgtaattcagctttgcatyttcagttttctctgatcctctttttatttgtaagcactggcataataacaccactggagagataagatgagaactattatagaggttatcattgtgaagt

SEQ ID NO: 9118 - DNA, 201 bp, Homo sapiens
agttcttcacattcttcatagggaatgaatagtgatggttttttctgttattcactaacccctgtttatctgagagataaattaatcagagtaagggatgkcaggacacgaagagtgctctactgttcctttactgattgctagctttgccattaaccacctaatccaaggtacagggagctaggagagggttttactaca

SEQ ID NO: 9119 - DNA, 201 bp, Homo sapiens
aagcaggagggagagaggaaaggagggaagtggagggaggctaaatatacaaaatcagtgtctattataaaatatcggtgctcaaaagtctacaaatgttrtaccactatattataattacctctatttcctttgacatttgagtttccttatttttaaaaatgtggaacaaatctggaaagatagtgatataaaagctta

SEQ ID NO: 9120 - DNA, 201 bp, Homo sapiens
gaccttttgccaggcactgttcaagcactttctacgtcactacatatttcttttaatttttacaacaactcattaaacaggtactattactatccttattktacaggcgaggaagcacgtgagaattggctaaagccatatagttagtaagccatagagttaggatttaaacttgggtccaaatcctgtatgcttaaccat

SEQ ID NO: 9121 - DNA, 201 bp, Homo sapiens
taaaagatcatgataaaagataaaggatgatgacctgagatcttctttattttttattactaatttgtttgaagaatagtccatcatttccagtaactttktgaccaaaaaaatggctatgtggttgttgccatcaaggccagtaatagagaagagggacaaagagagaggtgctccattggtatcctcaacctgtgtgta

SEQ ID NO: 9122 - DNA, 201 bp, Homo sapiens
gcgcccggcccgtctctaagttattttctaagctaaaagtcatgctactgcaaccaacggatatccccccttttttggagatacttggtaatgtagaaackatttcagagagtcaaaattctacagatagagtttagaatgcacaaaatctagacatggcattgaggcatctagatattgcctttacctatttcctgtagg

SEQ ID NO: 9123 - DNA, 201 bp, Homo sapiens
tcccaaagtgcttggattacaggcatgagccaccgcgcccggcccgtctctaagttattttctaagctaaaagtcatgctactgcaaccaacggatatccycccttttttggagatacttggtaatgtagaaactatttcagagagtcaaaattctacagatagagtttagaatgcacaaaatctagacatggcattgagg

SEQ ID NO: 9124 - DNA, 201 bp, Homo sapiens
ccgcgcctggcctcaggccctattctaataaaacttccaggtagatgcttgttgtccttctctgtgagtccaaacaaggtctctagttattgattctcatrttattgcagcttctacaaatttcaccctcaagtcagctttttggcttttctgactcaagtcacaagataaccatccttttgtttcatttttgtaaattct

SEQ ID NO: 9125 - DNA, 201 bp, Homo sapiens
agaaaagttgagattcccaatgacattgtttttctttatggaaactgattccttagtggagactcttttgagtatcttttgttcatttttcctgcaggaarttgacatatattgaagccctagtgtgttccaggcactatgtttgaggttggaaatgcaacaaacaaaaaatccaaaacagaaacaccaacttgacacggc

SEQ ID NO: 9126 - DNA, 201 bp, Homo sapiens
gatcactctcagattttgtggggatagagtgttggtagcaggaagcggcagaggaattcaactccttcttgagcttcttgtgttttataatcctccctatktcccacctgttttgtctcagaggggataagtcaatagagctgctgctgttcacaaagccatgcaggtaagagacatgtaccccttgcttcaaagtcttag

SEQ ID NO: 9127 - DNA, 201 bp, Homo sapiens
cattctttgcttctctttttcctcatcaccatggaaaccgattgtgacatcacagatgctgcattatgtgattattttgtaggataaacttcactgtgcargaatttatgcaacaatacacccttcagtaattggcaagagtcatgttgcatggagaaattatgacaagaaaggaaaaggcaaattgatttttcctgaaga

SEQ ID NO: 9128 - DNA, 201 bp, Homo sapiens
tcacaactctcataaagtttgtgatttttgtagactatactgaacatttagtgactcccagggaggatcattttaatcagcatacaatagtttgctcttcstcttcccttccattttcttctttccctttctccccccttctctagttttttaatctcacctcctctccctgcccttttctatcctcctcccctctcattt

SEQ ID NO: 9129 - DNA, 201 bp, Homo sapiens
cttacaggatatatgaactaataatagttatacgactgcttcggatttgtcgcgctccccttggataagtttaatatgattttgtacacattaattaattmtcttaataacagacaaaatagaaggaagccactaccgtcctttccagtgcatcagatgaatcaaaatgaatcaaagggctgggcatggtggcccacactt

SEQ ID NO: 9130 - DNA, 201 bp, Homo sapiens
agctgcttttgttcccatttcactgatgaggaaatcgaggtttaaagagattcagcatctcacctaagatcacccagccctggctgggtgcggtggctcaygcctgtaatcccagaactttgggaggccgaggtgggtggatcacaaggtcaggagatcaagaccatcctgcccaacatggtgaaaccccgtctctactaa

SEQ ID NO: 9131 - DNA, 201 bp, Homo sapiens
cattagaattgctatttgtcataaggacccccgtgtactgcagttgacttcattttaaactaaaggcaatcttcccacttcttgagaagccaggaaagagrggttaggaaagcttctaccactttgttgtctaaaaatcagcataatttgggctcagattttcccaacagagggtatcatttatcatttttatcgctgcta

SEQ ID NO: 9132 - DNA, 201 bp, Homo sapiens
ggtttggtctggttggctgaggcctagggccggagtctagtctaaaacaatggcctcccctaaacttgaacagggttacattgtagaataacataacaggraatgaaaagagaaatgtgatgctcttcaacaattggtttatggggcctttaaaaaagtgtgtatagagtcaatgatgaattaagatgcagtgtgaaagaa

SEQ ID NO: 9133 - DNA, 201 bp, Homo sapiens
gttctataaaatagtatgttctgatgagctgggcaaggtgttgtctgactttatggacagaaaaggactgaagaaagcagaaacaaaatgagaagtagacrggttgtttcaacatttccttctttctaggctttaagcagagggtactttcttatgctggatcaggtaaagggccccttctgcttggttgctatgaatctc

SEQ ID NO: 9134 - DNA, 201 bp, Homo sapiens
ctttcaagtatctcaggtggtattgatagtaaaacagtcttggcattaatgagtgtctgactggagagtgaaatgtaaataagagttgaatagagcacagscaaagcctacaaattaccgctgacaaataacagggcagacaaagagtatttcagccttaccaaacacctctgctacaatcagctaagaacacctgggaat

SEQ ID NO: 9135 - DNA, 201 bp, Homo sapiens
tgaaaaaagtactagagaattgcatattgtcattacagaattgtttgtaaatacaatcaagtaaaagctgtattgaaagaggtaggccttgttcagagccrtgttactaatctcaagtctaggggtttgctctgagtgtcttggtgtcttggtggccacatggatgttcctttactctgcttattttcaacacaagaaagg

SEQ ID NO: 9136 - DNA, 201 bp, Homo sapiens
actatgcaaccaacccagaaaaaattgtcagtagagccctttgctcagaggactcaaaccgtgcagaaatgtgagatattcacagagaattgtcttccaamagggactcttaggtgtgaagtgaggggcttagacaacattagagacttgaaaaatgtggaatgtgtgtaccaccactctccaaatctatgcccaaggcag

SEQ ID NO: 9137 - DNA, 201 bp, Homo sapiens
gacctagagagagacactctatttcatttccaagaatttttactatgcaaccaacccagaaaaaattgtcagtagagccctttgctcagaggactcaaacygtgcagaaatgtgagatattcacagagaattgtcttccaaaagggactcttaggtgtgaagtgaggggcttagacaacattagagacttgaaaaatgtgg

SEQ ID NO: 9138 - DNA, 201 bp, Homo sapiens
tctagaatatgagcaaatcttcagagaaaggagggagacctaactatcctggaatgtctctggggaaggagacagtctctatctttgttatactggtcagraaacaaatctgccttctgacctagagagagacactctatttcatttccaagaatttttactatgcaaccaacccagaaaaaattgtcagtagagcccttt

SEQ ID NO: 9139 - DNA, 201 bp, Homo sapiens
tgcaagccacgaggagtttggattctgccataggcttgtttgtgttgtccaggggcatagccatgaactctcaaggctgatttttgtttccttggccttgrtgctcacccaggtcgagagtagtatcttgcactttttctctttgaagacaaaagcccaaggagggtgtggcattttgatgcccagggctgtaggcccatc

SEQ ID NO: 9140 - DNA, 201 bp, Homo sapiens
aaagatgatggattcattttggacatgttgagttagaggggcccatgagacctccaggagaagaggtgagtctgaagcttgaagatggaataatttgaaakaaaatgaatttgtttctgaaagttgtatcctaacgttggcatattcagaacaccagtcacattgacttgccctgcagaatttccagatgggaattctagc

SEQ ID NO: 9141 - DNA, 201 bp, Homo sapiens
cataggtcagtaagccagtaaaaggcagagttgggatttgaacccaaggctacactctttccgtggccaggattttaaccggggtattcagtactggtgcsattatgggggaggaaaagatgatggattcattttggacatgttgagttagaggggcccatgagacctccaggagaagaggtgagtctgaagcttgaagat

SEQ ID NO: 9142 - DNA, 201 bp, Homo sapiens
aattcatgttcatatggaacaggggttggtacacagaggtctgtgcaaataaagttttattggaacacagtcatgttcatttgtttccatattttttctgrctacttttgctctacgatggtagagttgagtgatggcaataaagactgtggcctgcaaagccttaaatatttactatctaaccctttatagagttagctg

SEQ ID NO: 9143 - DNA, 201 bp, Homo sapiens
gtgacaattgttagaccacagcttaccctttgactcctgtgaaaatcaaggagggtgaggagcaactgaagaaaagtcctctgatttttattccttttttmcttctataaggagctctaaggtattagatttttttttttaactggcaaaacaaaagagcaaaaaaaagtcccattttcagtatctgactgtctccttaaa

SEQ ID NO: 9144 - DNA, 201 bp, Homo sapiens
aataagaactaatgttaattcatgtcagacacagtgccaaagatctttatttgcattattgttattattttttaaaaaataaatagactagcacgtagccyagcttacacacttctcattgtatagatgaggaaactgggaatcagttaaactttataaccacaccaagatcattgagctagtaagtggcaggcttgggat

SEQ ID NO: 9145 - DNA, 201 bp, Homo sapiens
ccttagtgcataaataagtccctagtccgtatccctaaatcatattaacaatactgcttactgggtgccaacaatatgtctggtactggactagatatatstgtatatattgtttagcccccatgacaacagtatgagggtaggtaccattatctccattatatagtaaagaagcaaggctagaaaaattggtgacttgca

SEQ ID NO: 9146 - DNA, 201 bp, Homo sapiens
tggtgagatgggtttttataagctcttcccatctcactttttgaagtgtttttaagctattttaaggctgttttataggtgccttttcttatgtttgtttwgtatgctagaaagtaagtaaagaggatccaggatatgagctattgatactaccaggcacactgaagtaagtattaagtcttttattgagctttctaaatg

SEQ ID NO: 9147 - DNA, 201 bp, Homo sapiens
gaaggcagaggttaatggttttctttttatttgcattattacttgatctctggctttcctggtgagatgggtttttataagctcttcccatctcacttttygaagtgtttttaagctattttaaggctgttttataggtgccttttcttatgtttgttttgtatgctagaaagtaagtaaagaggatccaggatatgagct

SEQ ID NO: 9148 - DNA, 201 bp, Homo sapiens
tcttcttaagaattctaataaggcatttagtttatacaaaggaggagtctgatctatgcagtggacatgagagacaaccaaagttttgttcctctttccartggcatagagaaaaaaataaaatttaggcagaattagaattcagaatgcctgggagttcctccagccttgggaaattccaggtgagaggggaggactctg

SEQ ID NO: 9149 - DNA, 201 bp, Homo sapiens
agcatgacttctcaaaatacaatattgttttagaatgaaaatttgtttcatgaccaatgcaaatcagttctgaaattccaaactccctcagccttgactarctttaaaatgcaaatgctacccataaggaacaaatgtcttttcaattattaaaattgaatttcaagatttggtttcttatgataaaaatgtttgaatata

SEQ ID NO: 9150 - DNA, 201 bp, Homo sapiens
gggagcatgacttctcaaaatacaatattgttttagaatgaaaatttgtttcatgaccaatgcaaatcagttctgaaattccaaactccctcagccttgamtagctttaaaatgcaaatgctacccataaggaacaaatgtcttttcaattattaaaattgaatttcaagatttggtttcttatgataaaaatgtttgaat

SEQ ID NO: 9151 - DNA, 201 bp, Homo sapiens
atatttatttgtaccttgtttgtaactgaagataagcacctctgaaatcaggcctgttggcatatgtctaaatactctttaactgagagacatatattcamagaaacgtttttatatgtccataaactgacacatagattgtcaaatccctaataacaaggttcaaattagaatcctgacactaatgttttcaaatgttct

SEQ ID NO: 9152 - DNA, 201 bp, Homo sapiens
ctgaagataattcagcagtttaccagaggagtacccattctgcctgctccttccctctctaacttcctttctccctccctccacaaatatttatttgtacyttgtttgtaactgaagataagcacctctgaaatcaggcctgttggcatatgtctaaatactctttaactgagagacatatattcacagaaacgtttttat

SEQ ID NO: 9153 - DNA, 201 bp, Homo sapiens
actgaatcactctaggaaaaacgtgtcggaagtcagttgagcccaggtgtgcatggcatcaaagctcatgtttttcaccacaccaggtcctctgtgttttytcagatacagaactattcattaccgtcacctgggaacagcttggaaatgctaattcttggctcagcctacacctatgcattcagaggctacggttaacaa

SEQ ID NO: 9154 - DNA, 201 bp, Homo sapiens
agaatttgtagtccaagacatgggtaatttgaaaaagcctcctagggcaatgcttttcagactctcatgtgtgcaggaatcacctggagattctggtttakaagtttggggtagggcccaagattttccctttctaacaagctcccaggtgatgcccatgctggtccatggaatacaatatgagtaacaagaagctaggtc

SEQ ID NO: 9155 - DNA, 201 bp, Homo sapiens
catttcaaaaaaccctgtggaaaaaatatttcttttagcaaatctcagacattatcttgacttatatgtaagatgtacctctctctttaaatccaagtgcrttgaaacttctggctcataaggtaatttttttttttaaataattaactaaacccttaaaactacatagaagtctactttgttttataaattaaccccatt

SEQ ID NO: 9156 - DNA, 201 bp, Homo sapiens
ttaataacaaagcctggctccacaggtgagagggaagatgtaacttaatctactggaagtcaccaacatagccctctaaaatgagtcattattttgactcraaaatgaacagattaaaaaatgtttcagctaatcctcttagctatttgatgtacatcaagcatccagatgttcacaacatccaagctgcaattttttgtg

SEQ ID NO: 9157 - DNA, 201 bp, Homo sapiens
cagttaagtcaattgcactctcaatattatcagactattttaactaatatgctatagacaaataattcttcagaatggtgtttgctttgtgtgtgtcatargagattcttgtctttagagaattagggaataatattaaaatgaataaatagtaaaggtgggaatatttttaatattattaaaataaataaatgattaaag

SEQ ID NO: 9158 - DNA, 201 bp, Homo sapiens
ataatgactcttcaactaggtttctattcatttccaagtcttccctaccactgagatacttcaaggagatatgagtggatcatgaataaatatcctaaaamtaaagacagttaagtcaattgcactctcaatattatcagactattttaactaatatgctatagacaaataattcttcagaatggtgtttgctttgtgtgt

SEQ ID NO: 9159 - DNA, 201 bp, Homo sapiens
gtctatgttttcatttccaaatagaaaataacccttatcattgctaatggtattcccttaaggaagttacttaatctttctatttctcaatttcttatttktagaatagaatggattatattccctacatcctaggatgggtgtgagatttaaacaaagaatgcatgtaagatgttcagcacagtgtagtaagacgttaat

SEQ ID NO: 9160 - DNA, 201 bp, Homo sapiens
accctcccctatttataattttaaatattttgcctacatgtagttagaaccatgtcacacagtgttataatttttatttcaatcatcagacagaatttagraggctcaaaggagaagaaaagtctatttgtccacatttttgcttactgtgttgttcttcctgatgttttgatttctcttttaaaaagtcattttctttgt

SEQ ID NO: 9161 - DNA, 201 bp, Homo sapiens
gatttagtttctaacactgttaatctagatggaattctttcatccctagctcattactacatttacccttcaacaaacatgtggtgggagtcaactgtgcrcaacgtgctgaatatgaaaagttaaatggggctcagggttcactgggaaagtgctggtaagttcattcacatgcactccagtacaacttggtatgcccag

SEQ ID NO: 9162 - DNA, 201 bp, Homo sapiens
taggacattgtaagacaattaagtctgtagaagaatgagaaggaatcttttatttgaggtctagaggtgtcataactgtgaatcacaaagttgtggcacartgcattcacctcagaaaattttcttcatgaaattaaagtttcattttgtcttaaagaaaaggttccactctcatgcgattttgtgtgttctcatcaaagc

SEQ ID NO: 9163 - DNA, 201 bp, Homo sapiens
atttgtaagatagatacttggagaagtttatactcacttcctaatcccagactatagaaacttctgcattctagaatttcagagaatgtgtctctgtcaaytgtattctgaagataagatacatttgacatttgattgcttcaatcaacattctccaatgcagatcactaggcagaaacatcttgacacggcatatatttg

SEQ ID NO: 9164 - DNA, 201 bp, Homo sapiens
aataccataatttgccttgaaggtagggaagaaagagagtgaagtggggaaaatttcaaaattctgtcttccagggagcatattcctactcatctgtgacrtctaatgtaatagattttgaagaattatttgtaagatagatacttggagaagtttatactcacttcctaatcccagactatagaaacttctgcattctag

SEQ ID NO: 9165 - DNA, 201 bp, Homo sapiens
actctcataataagcaggtgttattgttctttggccctccataaagtcaatgagcaaaatgtcttgaacatcccccaaaactgttgccatgacctttgttsttgactaatctgcttttgctttgatttgaccacttctacctcttggtagccattgctttgattgtgctttgtttttagaatcatagtgatgaagccatgt

SEQ ID NO: 9166 - DNA, 201 bp, Homo sapiens
gacaagcatttcctctttttatttgagagagagaaagagagagaaagaaactcctaggcaatcagagcagaacattcctaaccttacatttgatccacccrttgagctactgaataaatgcttaatatgtcagtgagcccacaagtttcttgtcctgggccctttaaactgatatatctcaatcacctttactgaaatgtt

SEQ ID NO: 9167 - DNA, 201 bp, Homo sapiens
tctattgagaatctcagccatcaaaatatccataagaccatatgatgaagtacatataaagtactgtgtgagcacaatgaaaaagcaatgagattcttttkgggggttcacggaaagcccccaagtgagggtgccatttgaattgagtataaaatgatgaatagagatttgtccattgaaaagggcagacaggccaggcac

SEQ ID NO: 9168 - DNA, 201 bp, Homo sapiens
gccagatatccctgtattttattcttgcctttgttacttagtaaagtgtaggactttgagcaagatgctacatctatctgagattccattttctcatctgyaaagtgaatacactaatcttaacattcagatttgctatgagaattgcatatggttatctttgtaaataaagtgcctggcacacagtaggtgctcagaaaa

SEQ ID NO: 9169 - DNA, 201 bp, Homo sapiens
ttagtaaacttatagagaaaatatgatttgattgcctaacaatatatttataatttacataccaaataagtgaaacgtaaggaaaaaactgctttgagctmccgagaatgctagttgatagcaaacaaggaaggtgctttggtaagaaggttgtttgctttgagcttccatggatgagaagaaatcaagtaatcaaagagg

SEQ ID NO: 9170 - DNA, 201 bp, Homo sapiens
ctaatatttaattataaaattaaaaggaaacaagtttggacttccgtatgaaaagtcttatacttgatctgtaactacaagatgttagatgttcttcatgsagatgacaggcaaaggttacttttacagttctatgaaagtaaaaagcttttaaaacatttgaatgggaattggtaaaagaagcagttcttaattatgtca

SEQ ID NO: 9171 - DNA, 201 bp, Homo sapiens
tgcctcctgcttttgggattatgcctggcacctgcttgagtctagagggttcctggttaaacttgggaaacctggtttcctcttttatctgcagctgttcrttttctgggatggaatcctaagcacttatttgaattgtatttgttgaagtcactgggttatacagtaaaaataaggagtcatgttggtttttgttcgaag

SEQ ID NO: 9172 - DNA, 201 bp, Homo sapiens
ccatatcatagtggtaatttcctcaattcctatatcctacaagagcttgatgaatgaaaagaaggaagcctgtgacaattattttattcaagcctccaaarcagagttttgccaaatgcttgtcctacttctccgtgcgcttgccatggtctttgttttgcctctttttcttttggcagttaccccaactataactggaat

SEQ ID NO: 9173 - DNA, 201 bp, Homo sapiens
acagtgaatggaagtctaaataacgtactccagtgaagaattattagatgttgcccgtctcagctggattttcagttatactattcaagctggtgggaggyttcaggggaagaacaggggagaagacaaagcagaaacagccttaggcagtataaattctgaatacctttaatttgattaacatgttaatactagcaggag

SEQ ID NO: 9174 - DNA, 201 bp, Homo sapiens
atgctcaggccttgttggtctctctgtaccagtgtctatcgtgggacataataattcatgatgaacagtcaggcatctacttagtggcttatacgtagaastggctctcctttcagaagccagaaattaataaatggtctacagtcagaaggagatccttaattgattaattaattcaataagaatttattaagtaccttc

SEQ ID NO: 9175 - DNA, 201 bp, Homo sapiens
agaatccctgagatatatatatatatttttaatattagaatgagagattcttgcactgggtaggactttgacctgagtgaactttgaggttcctcctaatyccaagattctttgattctagacatgagaaaacaaagctagtccctatgctgttgtcataactgtcatggtatgtgatatggtttaactctgtgtccccac

SEQ ID NO: 9176 - DNA, 201 bp, Homo sapiens
agcagctaaggacagataaattggtagcagattgtggtttatgataacgacagtcccgaaggaacttggctttcttggtgacgttgaagtaaattgcattwctcaagatgtatactaagaaggatagataatgaggtgtatgggggaaaggcatgatgactatttttatagtattgttgactaccaaaatgaatggaaggg

SEQ ID NO: 9177 - DNA, 201 bp, Homo sapiens
ctgcatggcaggttagatgcccctcttaaatgcagggttaacctctatcgtacatttcacaccttgtatttacttgtttgcttccctattcttccttctamaatgcatacactttgagggcagaaactcagctctgtttgtctttgcagctctgtcacctggcacagtacctggttcattctctgcagaatgaggaaacct

SEQ ID NO: 9178 - DNA, 201 bp, Homo sapiens
tgcaaatctgcacacatacatgcacatctgcacaagcaatagacacatgttcatatgtgtacacatgtgcacacacatgaatagattcatgtgtacacatrtgcacataaatacccatgcctgcacatgcacagatgtgcacatttcatccagtaattccaactaattcctcagattctcatctgaaacgtttttgttatc

SEQ ID NO: 9179 - DNA, 201 bp, Homo sapiens
gcatgtgttcacaccaacacacatgtgcaaatctgcacacatacatgcacatctgcacaagcaatagacacatgttcatatgtgtacacatgtgcacacayatgaatagattcatgtgtacacatatgcacataaatacccatgcctgcacatgcacagatgtgcacatttcatccagtaattccaactaattcctcagat

SEQ ID NO: 9180 - DNA, 201 bp, Homo sapiens
gtaaggttctttgtttgagtaatgatttgaggatggtgccattaccccaaggtgaattagagacaggaacaacacgttcttgggaaaagataatgagttcrtttttagcttctttaagttttaagcgcctggtagaagatgtccagcagaacattctaaattttggcctggagttcgggagggaagttggggccagagatc

SEQ ID NO: 9181 - DNA, 201 bp, Homo sapiens
caatatttagtcttgctttttcttgttggcacggtgtgccctttaccaaatgatccatccaggtgattgatactaaaacatctcattgatttcaagtttaygtgtctagatattagatcctagaaatgagttgttaataaatatcagctttacatcaagagtttaacagaaacatattcctgaacaaatttccattgcctt

SEQ ID NO: 9182 - DNA, 201 bp, Homo sapiens
gtctgtatgtatctgaaagaatgagaggcataagacacctacacatgttcacatctagggtagtattttcaaaaaatggagttactttgaatccccgatcrtctctttcttttactcaatttcaagttaatatctaatgtaaaacttttataaatagcaaagagacttatacttctctagctttgcaatatttagtcttgc

SEQ ID NO: 9183 - DNA, 201 bp, Homo sapiens
tgacagtctgtatgtatctgaaagaatgagaggcataagacacctacacatgttcacatctagggtagtattttcaaaaaatggagttactttgaatcccygatcgtctctttcttttactcaatttcaagttaatatctaatgtaaaacttttataaatagcaaagagacttatacttctctagctttgcaatatttagt

SEQ ID NO: 9184 - DNA, 201 bp, Homo sapiens
attgatacagttctaagggattagtatcttctgacggcagtctgttcaatatatttgtattttttacccttgaaggaatatgggactgttagggttttaaragaagtctgagtttttgtttgtttgtttgttttgttttgaatgacagtaaatatccattaaaaagctgtagatttgcagccttgatgattagctctctct

SEQ ID NO: 9185 - DNA, 201 bp, Homo sapiens
ctgggctttgcagatcctagagttgcgggttatgagtgtgtccagagaaccagagtatgtcatctggattcactcactcattcacacattcatttattcayactcaacaaatatttataccattattcatagggcagacagtgaacattaaaaatgtgaaacaataacatacagtccattcattgtcaaaggatactacag

SEQ ID NO: 9186 - DNA, 201 bp, Homo sapiens
cgtagaactgaatgtgatttctactgatctagaaaaaaataaagttattattaaaaaggaaatctaaaggatgataaattagctgcatatttttctgttcrtctattgttttctattttctctatcttaaggttgtttataatagacagttctacatcaaacttgagatgaaattaaagttgtgaaagatttatgatgtgt

SEQ ID NO: 9187 - DNA, 201 bp, Homo sapiens
tcattgctgtgtttaattatagcccattcatttctggtgtccttggctagttacttacttaaggtgacggcaataatccacttagagcctattgcttcacrgaagacaatttttgtattaccatgttagtcacatacaggtgcaattccaacatatttttcaacatggacataatttcctatagttatttccacatctaaa

SEQ ID NO: 9188 - DNA, 201 bp, Homo sapiens
taagagaatatgatgatataaagtgtcagtttttagtttttgttctttcttggtagtagagaaatacagttagccaatgttagtttccaaaattgctttaratatattagaggtaaataaactctgttaatctgaagatgactgttgcagatgttagcttcgtttcctttaggagtaaagtatttgtatgattttatccac

SEQ ID NO: 9189 - DNA, 201 bp, Homo sapiens
tgcagccctggacatggggtgtcctctgggtataatctcacttaactttactctgcaaatgcaatgttggtcttgccatccctgtgttgtgttcagtcttrtttgatctcactctccctgttacccatctgtataatcccctgggaagaatgagatctaaacaaaaacaaaggagaaaatgcttaagaaatataatctgac

SEQ ID NO: 9190 - DNA, 201 bp, Homo sapiens
tccactccccaacacctgtcccacaaaggaccaagacttgtgtctttgccctctctgtcactcattctacacaagctcagtactagggccagagtcgtacytaatgaatgcttacaaaattaagtaatggtttaactgaactaaacaactgattttagatatggggggaggggagatagacaggattagattttcaacact

SEQ ID NO: 9191 - DNA, 201 bp, Homo sapiens
atcacccctgccagctcccccatctccaaaagtcccaaagtcactctgcttgcatccacactgcattctcctgcctttggacttttgctaaagctctattytctttcttaaatgtccttgaacatgcttctccctcttatccttgaagatccaagcctcctaagtctgccagactttgtgctgtgttataaggtacctatg

SEQ ID NO: 9192 - DNA, 201 bp, Homo sapiens
ttgctaagtgcttttgcgtatgttagttctttataatgcttacatcagtcctaccaggcaagtagactgtccccattttacagatggggaggttagggctsgaagagattggctaacatgcctgagctcatgtgtgcaagagccaggattgtcatccaagtctacctgactctagaacctgcctcttaacctctatcctat

SEQ ID NO: 9193 - DNA, 201 bp, Homo sapiens
cagagagcggtcccctcacggctcattgagagtttgtcagcaccttgaaatgagtttaaacttgtttatttttaaaacattcttggttatgaatgtgcctrtattgaattactgaacaaccttatggttgtgaagaattgatttggtgctaaggtgtataaatttcaggaccagtgtctctgaagagttcatttagcatga

SEQ ID NO: 9194 - DNA, 201 bp, Homo sapiens
aatctcttggaaacaatctgacagaccttagaattgtgtagtaagatgaggacataaaggaacagagggtcaaggtagtatcttagctcctttctcccaamgtgttgatactggttaagatacacaaaagggaaaacccacctaagaaactgccaggaattcttttttttttttttcattttgttttaatgctaacttaat

SEQ ID NO: 9195 - DNA, 201 bp, Homo sapiens
caaagtgaatattacaacaaagcaagtcacatgaatttcttggtttcccagtgcatataaaagtatgtttataccatactgtgctttgttatatgtgaaayagcactatatcttttaaaaaaatactttgataaaaaatactttactgctaacaaaaatgctagtgatcaacagtattcagcgaatgtttttgctggtaga

SEQ ID NO: 9196 - DNA, 201 bp, Homo sapiens
agaggatgtttgcaagaaatggcgagttttattgtaagagaacttaccggccctatagagaggagaaaacaggttggaatgtccagctgctaccacccaaygggatcccagcacaaagaaaacagtcaaaattatgttcatcatgacagagcaaatgagcttttggggaaaacagaagcaaaataaacctttttgaataat

SEQ ID NO: 9197 - DNA, 201 bp, Homo sapiens
aagtatgaaaacaccttggtggtattgattttatgaaccctgtacattccctgcaatgaagacagattttagggtaaaagaggatgtttgcaagaaatggygagttttattgtaagagaacttaccggccctatagagaggagaaaacaggttggaatgtccagctgctaccacccaatgggatcccagcacaaagaaaac

SEQ ID NO: 9198 - DNA, 201 bp, Homo sapiens
aataagcttatgatgtgtgtctcatccacccaagtacatctgcagggctcctctattgtaaatcagctgcctaaggctcaagttagacacagtcaaagccstgtatatttagggtacataatcttgatgtcaagtgctggagtcttgggcaaacttttcatctttttatgtaaaactgatttccattaagtatgaaaacac

SEQ ID NO: 9199 - DNA, 201 bp, Homo sapiens
acaaagaagagaagcagaacataattcaattcaattcaacatactttgttgatcacccaatctggtatgtgccagaaaagtgagcaaagttgaatgagatrtgttctccacaggcgagatctcctgtaagggaaggagaaagggacatatgcagatttgcattcttggagcagatctgttcggttccagactagagatgca

SEQ ID NO: 9200 - DNA, 201 bp, Homo sapiens
aaacattctttcttatctgttctgcttttttaaaattgcttttacttttcttcctttttttgttattcctaccaggttttgttgttattttttttcttcartgatgtctaattgcaggttaccatttcatctgctactttattttttatgcctcaacatttggtcttctcacctctggttcacttctcatgggattttctt

SEQ ID NO: 9201 - DNA, 201 bp, Homo sapiens
ttgtcaaaggatactacagatcaaggaaagaggcaacttcaagaaagtatgattagtacattgaccagccaaatgtagaagcttctgtgtcagacttgacrgggtgagggaaagcttcctggacaagaagacatctaattggaatatggaaggatgcttagaatctagccaggtgtggggacttaaagggtaaagcaagtg

SEQ ID NO: 9202 - DNA, 201 bp, Homo sapiens
attacgctcagtaagataaggccttcttttgaggtagactttcaacatctatctctgattctttttgagaaaacatgttgcattttaatcttttagtgacygattgtccccaaatgtaaaatagaaagttgagggaggcagtagttatatgcacatattttttgagccagagttccctgagtttgagttaaggtgtcctga

SEQ ID NO: 9203 - DNA, 201 bp, Homo sapiens
ccactgactttttgtcttccacctaattacgctcagtaagataaggccttcttttgaggtagactttcaacatctatctctgattctttttgagaaaacaygttgcattttaatcttttagtgaccgattgtccccaaatgtaaaatagaaagttgagggaggcagtagttatatgcacatattttttgagccagagttcc

SEQ ID NO: 9204 - DNA, 201 bp, Homo sapiens
ttagattagaatagcgactgagaaacaataaccacagcagcaaaccatttcaggcaatatttttgttgtaagggcttcagttcttcatgaattaaatcacsttatcttattgaatttaactccaaattggttaataattttgagactctccccttttgcattgcctagaattttgaggctatttaaagggtatagctgttt

SEQ ID NO: 9205 - DNA, 201 bp, Homo sapiens
gggggtgatgagagaattttaagaaaaacgcttgctttatcaccagctgtgtcattttgttcaaagggacaggaaacttaatactctctctgaagcttaayagaactgcagacctattgccacagttttctcttttgcataatcttgtttagtcacttaagagctagtgagtgacagatttcacatgagaattggtcacgt

SEQ ID NO: 9206 - DNA, 201 bp, Homo sapiens
accttgttctattgtctaccttctctctcactgactccatcaaggcagacttgctcggtaaactattcaggtgactttgtgaacttttatttggtgcaagsctctgttaatagctgtaagtcagctgtttttggtcctccctctcattctcttcacactgattgatgaaatgggaaacaggttgaagaagctcactttttt

SEQ ID NO: 9207 - DNA, 201 bp, Homo sapiens
ttccaaacaaacaaacaaacaaacaaacaaaaaaaccaaaaaagccaccctaggataaatataactagaaggccaagatcagtttagaagtctacttaaaraaagacagaaacttctaaggactgtgtggaaagataattcatgcctataaaaaagtctctgtgctaactctagatttttttcactgtaagccttgtaaca

SEQ ID NO: 9208 - DNA, 201 bp, Homo sapiens
tattttattgaggtcccaggaagttactagtttaagcatccgtcacttagataacaagcattaaggtaatttttaatttcagttaaaaaaatagattaaargcacaaaatagatttccaaacaaacaaacaaacaaacaaacaaaaaaaccaaaaaagccaccctaggataaatataactagaaggccaagatcagtttag

SEQ ID NO: 9209 - DNA, 201 bp, Homo sapiens
tatagcattcttaatcagcaaaataaaggttggcaatggtatgtcagtccttccctacagtttttctttgaagtttttttctcaggcattgaaaacaaacrtccgaaaaagcaaaaaaacaagagttttaaagttttaaagtgttctctatgttgccacattagattgagtagatttcaaagactgaaggcctttttacat

SEQ ID NO: 9210 - DNA, 201 bp, Homo sapiens
cattgacccacttagggctcaaatatacaactctgtattattttagtcacaaagggaactaagagattatagacaagttgtgaagcagttagtggggactrgaagtctcctgtggcacagactcaaatatatgctctagtgatgtgttctcagtcatgttatctgcccacacagaggacagattaagcaacctagagtact

SEQ ID NO: 9211 - DNA, 201 bp, Homo sapiens
gggcaccatatctaggactcctgcctgcattgcgagcaaaagcatgtatttatatcttagccctctgaatgttagaggtagcagattatacagtatggtgyaggaaggagcatcctatgtcctgaggtgaataacgtgttctaccacctggcagcagattagaccagatcaggctatgagaatacaggttcacagccagat

SEQ ID NO: 9212 - DNA, 201 bp, Homo sapiens
tgagctccccacctctgctaggtgtgggctgcattcacccccaattttagacctctttggcagtagcttccttgatctcccgcccacatactgtgtcataycccagtaattcttccccaaaccttggctatgggttattgagctgacaaatgtctaaatgactgagatacgatttcacaacctgctgagagcctcttcttt

SEQ ID NO: 9213 - DNA, 201 bp, Homo sapiens
taaaccagggtcatctccacccagcttgtacactacatatttgggtaggagcttaacgtcttgcccttcgctttgccagtgtgtcttctgagctccccacstctgctaggtgtgggctgcattcacccccaattttagacctctttggcagtagcttccttgatctcccgcccacatactgtgtcatatcccagtaattct

SEQ ID NO: 9214 - DNA, 201 bp, Homo sapiens
ggacatttcccacctttgttttagatatgccactatctcagacatgaaacacaataacaaactaaaccagggtcatctccacccagcttgtacactacatmtttgggtaggagcttaacgtcttgcccttcgctttgccagtgtgtcttctgagctccccacctctgctaggtgtgggctgcattcacccccaattttaga

SEQ ID NO: 9215 - DNA, 201 bp, Homo sapiens
tcatagtttaccccaatctagagaagtcccataggttaaaaatgtgtagtctttttttttgtttttaatagataagaccttcttgcccattttatagtcgwtcccaacatttgttgagttctccactaagtacatgagaccacataggatacaacaggacattaaaagcttttttttttttttttttttgagacggagtct

SEQ ID NO: 9216 - DNA, 201 bp, Homo sapiens
ggtcatagtttaccccaatctagagaagtcccataggttaaaaatgtgtagtctttttttttgtttttaatagataagaccttcttgcccattttatagtygttcccaacatttgttgagttctccactaagtacatgagaccacataggatacaacaggacattaaaagcttttttttttttttttttttgagacggagt

SEQ ID NO: 9217 - DNA, 201 bp, Homo sapiens
gaaaggggagttagactttcatctgaaagacttggttatgtgtctggtagagaaaaaaagaaaagttaaaaatttaggagagagataataactgacagcayggtcttgaagaaggcaggaactgatggtttggtcttaagaaaagaagtgataccaccacatgcagggtaaagagggaaatactggatatggataaggcta

SEQ ID NO: 9218 - DNA, 201 bp, Homo sapiens
ctcaaaaaaaaaaaaaaaaaaaaaaaaaaaaaaagagagagcaagaagagtgaaagttataaatgaaaacaataaaaaaaaatccaagaaactcaaggaayctttgatgggaaaactgggtttttctctgacctcactactttcccttaaccatcatagccctgccacttctacatgcattggaggaagtgatttctccac

SEQ ID NO: 9219 - DNA, 201 bp, Homo sapiens
gtcttggttctctctagtggatctctacagggcttccttaaagtcagaggctggctttgccttaagattcttgagcatgagtagaactcccaacccaaagkaaagagagcaaaatccagagaaggacttttctccattctaaggcccgcctcccaagtccttaatttctgttttaaggtctggctcatctcaagaagaatg

SEQ ID NO: 9220 - DNA, 201 bp, Homo sapiens
tgttgattatactaaattagaatagtgatggctataatcatttgatccctgaggcattaatgaaaaatcagcattattttgtgtggaatatgtattattayccttgagcttaggaatgattattagtaagtctgattaaatctggaagcagtgacacaagctatctttaacccaccaatgacagggctatattgtaaattt

SEQ ID NO: 9221 - DNA, 201 bp, Homo sapiens
ctgaaaaagtgccaacaaatcctaagtaattttgtgttgattatactaaattagaatagtgatggctataatcatttgatccctgaggcattaatgaaaawtcagcattattttgtgtggaatatgtattattatccttgagcttaggaatgattattagtaagtctgattaaatctggaagcagtgacacaagctatctt

SEQ ID NO: 9222 - DNA, 201 bp, Homo sapiens
acagacaaagattaagagatggctgaaagatagtgtatccaaggtcacgttggcacagattactgaagtgagtggggtggcctggaagaacattaagtggrcatttaagatggaacagctaataagacaaaggtaaaatgagtctagaagaatgactagactgagaagagaggaaaggaaagaggcagaaatagtagaatg

SEQ ID NO: 9223 - DNA, 201 bp, Homo sapiens
tcgatcctagtggaattctatttcatggattttgttctgcctttattgacacagttagacattaaagagaataagtataataacaaaatttataagaaatrcttatggaatattttctaattttagctacaatgatgggttgtttatattctgtggtttgatttttatatcaatctttatgcagctattatcattacccaa

SEQ ID NO: 9224 - DNA, 201 bp, Homo sapiens
aaatgcctgtggttggtccacttccttcagccttggagtaaaataaaggcttcttttgcaagatcacgaaataattcagcaaatactgtgggactataagrtattcctgtgttgtcaccttttcttttgaagaatatagagaatatgcttttcttcctctaattcaaatacatagattccttatgcttgtataatgaaaga

SEQ ID NO: 9225 - DNA, 201 bp, Homo sapiens
aacaatgggagggcttcacctgtgattgttctatgacctcttattctggaaaccagtgcaatgatcgtaagtacaacaacctttcatactggaactttgtsaagatgtttggagatttggagaatcttaaaggacaatatgtaaaaggatggctcttctgaaagattcataagtaattctctcctccagaaacttgggaaa

SEQ ID NO: 9226 - DNA, 201 bp, Homo sapiens
actggtatttaatatattttattactatataaatgaatgaactacgtttcccaaacatctttctacgtgtgaagcaaaaaaaaaaaaaaaaaaaaaaaaamaccacacagaaaaaaaacaagcaagcaaacaaaaacagagggaacaagagtttagagaagtcaaagaaatagtattcaattttctgtttagtaccattta

SEQ ID NO: 9227 - DNA, 201 bp, Homo sapiens
cactggtatttaatatattttattactatataaatgaatgaactacgtttcccaaacatctttctacgtgtgaagcaaaaaaaaaaaaaaaaaaaaaaaamaaccacacagaaaaaaaacaagcaagcaaacaaaaacagagggaacaagagtttagagaagtcaaagaaatagtattcaattttctgtttagtaccattt

SEQ ID NO: 9228 - DNA, 201 bp, Homo sapiens
gaagggagtgctgtgttggtatcagcacaagaacggggcagtgcccctgcggtgtgttctctttggtatttgcataggtctgactcttgccagacaagtgmtgattgctttcctcttttcttttcctatagctcgagaggagaatgtggccactttccgaggctcagagtatctgtgctacgacctgtctcagaacccgat

SEQ ID NO: 9229 - DNA, 201 bp, Homo sapiens
tgtacatgaagatcatcatgcccatggtcatgcatactgaggcagaggatgtgtccttccgcttcatgtcccagcgagcttatgggctgctggtggctacracctccagggactctgccgacaccctgcgtctggagctggatggggggcgtgtcaagctcatggttaacttaggtatcgtatgaagtaccctctgccact

SEQ ID NO: 9230 - DNA, 201 bp, Homo sapiens; identical to SEQ ID NO: 1317

SEQ ID NO: 9231 - DNA, 201 bp, Homo sapiens
ttgtcttttccattgtcttgtaacatctaattctcttgcttacattgttctctcctggccagccaatggctgggctcagcactcacctgttaggtttcttwcatttggttaagcaactggcagactcacctgagatctgtcttcccaccccaggtactatatcagtgaacagcaggcgcacgccattcaccgccagtgggg

SEQ ID NO: 9232 - DNA, 201 bp, Homo sapiens
ccagagagttggtagttacataaacaggtcccacggctaccaataatattaacacggtattcttagcccttaagaaacaaaacacagaaatttctaatacygggagtttaaagtgccacaatggaaaagcaaactcaattacaaatgctggattccacctggagcctattctttttcattttcttacttctgtttctgcca

SEQ ID NO: 9233 - DNA, 201 bp, Homo sapiens
acatactcaggttttttaaaatttaaagatccagattggtagctcagccatatagctaaattgaataattatgcaaatgctgcacagtatttaattggacmttttggaatgaaaataacccaggtgtgcacaattctttgcaatctggagcaaccattctaatatatatctgcaagtgacaacatcttgtatgtaaacagg

SEQ ID NO: 9234 - DNA, 201 bp, Homo sapiens
gggttcattttactggtgctgatgaatatcaaactacacaatatctacgcacattatattagaataaaacatgttttacattgaaggcaaattttagattygactcttaataatggtcttttatattaactcagataactagagatagtaaaagaatgaattaaaattccagtgagccaaactacaacattgataatagta

SEQ ID NO: 9235 - DNA, 201 bp, Homo sapiens
gtgttgagcatcatggccgcttcctttacaatggcctggcatggacggttggagaaggccattgttaccatataaatgactgtctatttgcctctggcatsacttgtccagacaagttgcatcattttaaaatgaatgaagttctagggagcatttttaactatagtaccttagttgtaactttgagagtttttaataagc

SEQ ID NO: 9236 - DNA, 201 bp, Homo sapiens
acacacttggagcatttgaaagactagtgatgaaatccattcatgctgtgaaaatgtgttgagcatcatggccgcttcctttacaatggcctggcatggamggttggagaaggccattgttaccatataaatgactgtctatttgcctctggcatgacttgtccagacaagttgcatcattttaaaatgaatgaagttcta

SEQ ID NO: 9237 - DNA, 201 bp, Homo sapiens
ctaagtcatgttttgattgctaacagcattccagtactgggttggaacatatgtattccttctatcaactgaggaacagcaggttttctgttattgcccaygcatggtcactctctgcttataaaaattcatcacttctgctgattgcattgtgtaggattcctactgattaccatttagatttgttaagtgacatagcac

SEQ ID NO: 9238 - DNA, 201 bp, Homo sapiens
aatttacatataacggatgcataaagatttgctttcttattctaagaatgttcttatttgataacatctatgcatagtccagaagattgacatggaaaacwgataatgtacttaggtattaccaatcctataacccaatttgtgaaaaggtcaggcactcctactaaagaacaaacgtttgtatttgtagcatttaaaaat

SEQ ID NO: 9239 - DNA, 201 bp, Homo sapiens
tggtccaagtgcaatgcctggagcatatctattcaaacaaggttgtttaaagataaaagcacccacttctaaatatcagcattagtagtgatttcctcacrtatatttaagagatggaagagcttgtgaagactttttgatttctattttgttttctgagacttctttaactcttttggttttgttagtatttgaatttat

SEQ ID NO: 9240 - DNA, 201 bp, Homo sapiens
ctgtctcaaaaaatgaaacagaacaacaacaaaaatcgatgcagagcatgtattacatttgtaatcagagagaagggatatctgttatttcttaaaatatrgaagagtatactaggagaccagcaagggaaatgttttaatatttagatacggaagcttcgccagacccgtaattttttaaaaatagtgaatcctttttcc

SEQ ID NO: 9241 - DNA, 201 bp, Homo sapiens
aaatattacactaaatttagcctaataaaaattcatgccaaatttactgagtatttattggaaatcagagacttaaggtcctgaatcaggtgtaagaattrtattatcaataacagacttaacagtgattatctctaggtggtgaccgatattttgataatcatactccaaaacatctatgtagaaattgggcatggtggc

SEQ ID NO: 9242 - DNA, 201 bp, Homo sapiens
aaatattgaaaatattacactaaatttagcctaataaaaattcatgccaaatttactgagtatttattggaaatcagagacttaaggtcctgaatcaggtrtaagaattgtattatcaataacagacttaacagtgattatctctaggtggtgaccgatattttgataatcatactccaaaacatctatgtagaaattggg

SEQ ID NO: 9243 - DNA, 201 bp, Homo sapiens
attaaaaaggaaagtgttgcagctttttagtccttctaatttgacaagatagataatttgattgggtttctgatagtgcagtattttgctttaatttggtrtgaagtttagttgcccccataattattattatttttttttggtcactctgtcacccatgctggaatttagtggcatgatctcagctcactacaacctcca

SEQ ID NO: 9244 - DNA, 201 bp, Homo sapiens
gggaattaaaaaggaaagtgttgcagctttttagtccttctaatttgacaagatagataatttgattgggtttctgatagtgcagtattttgctttaattyggtgtgaagtttagttgcccccataattattattatttttttttggtcactctgtcacccatgctggaatttagtggcatgatctcagctcactacaacc

SEQ ID NO: 9245 - DNA, 201 bp, Homo sapiens
catagttaggttttataacttttaaactctaatgaattttatttagttacagtatgtaatgcatgttaattaaccaactgcacagtgaaatatgtcaatgycctttgcttccacattttctaatagagtaagctagtatattaacatttaaaacagcatgagaaccatagtactgcagaaagcaactgcagtttttaaaaa

SEQ ID NO: 9246 - DNA, 201 bp, Homo sapiens
aatgaacaggatatttcttaggttttcatattctgtcccttgagctttggaaagactatcccagatacattttctgagcacatagaatctatagcatgatyccattacatagttaggttttataacttttaaactctaatgaattttatttagttacagtatgtaatgcatgttaattaaccaactgcacagtgaaatatg

SEQ ID NO: 9247 - DNA, 201 bp, Homo sapiens
tttgttgtatcttttatttctgtctggacaagcccaggatcattgtgtggcatgccgtgacaagttttgtagcgcatcaactaaccatggcctccatcacmagtgcatgacaccatcttgtgtttcatccaagtgacacatctaggctaacccagcaagtccagtgtatgagttgtgggaattacattcttttgtagttat

SEQ ID NO: 9248 - DNA, 201 bp, Homo sapiens
caaacaaggcaaaaaaatcttttcttgccatcctaatctcaaattcctcccctttcagcatatccctccagtatttatctcaaaacaaaacaaaccccaaygaaatccaagaaagttgtgtacaaaagaatgaatactgtgttttcctcttcctccttctatgcatatttttccttttaatttccgtttctttccttttga

SEQ ID NO: 9249 - DNA, 201 bp, Homo sapiens
gcttctaataatcaatgtgaattctactctcagtagaagggggttaatacattgttcttaccacccaaagaaagcctggcctctttgcctgaactttttcrccaccgtgtttaaagccttgaaagtattggtaggctctatttggtatcttaaaattgtttccagccagtgggaggcctgtaccctagaagaaaatgagtt

SEQ ID NO: 9250 - DNA, 201 bp, Homo sapiens
tgttatttgctctccttctcccagcttactttggctacgaagttgattttattttctactatataattttgaagactatattttttatttcatttgtgtckatttgctgaattttcactgttatgttttgtgctgaattgcttctaataatcaatgtgaattctactctcagtagaagggggttaatacattgttcttacc

SEQ ID NO: 9251 - DNA, 201 bp, Homo sapiens
gcttctatttttaatttgcttttactttttctttccattcttattatattgtgaatgcctcaatgttatttgctctccttctcccagcttactttggctaygaagttgattttattttctactatataattttgaagactatattttttatttcatttgtgtcgatttgctgaattttcactgttatgttttgtgctgaat

SEQ ID NO: 9252 - DNA, 201 bp, Homo sapiens; identical to SEQ ID NO: 1328

SEQ ID NO: 9253 - DNA, 201 bp, Homo sapiens
attctactgtcatcattgtgctctgtcactttgactaagcccaagaaccctcccacagagcaatgttaattataacccctctatgcccgtaaaatatgccwtctaaaggctttgaataaatttgggataaatttcctgaagcagaactcatgaacccatatgtattttgattccaattcctgtcaatacaggttctagttc

SEQ ID NO: 9254 - DNA, 201 bp, Homo sapiens
ctcagtagaagccttagagaacccaaattgctgatgtatctttttcgaaatgcctctcattatccaggagaatgtgtgtattggaagtatcttattctttmagtctcacacttagaccggttatgtttcctacttttaaaaattgtagaactttattctacagatgtcatttgatgccttttgagaccgaccatatatgca

SEQ ID NO: 9255 - DNA, 201 bp, Homo sapiens
tggtgtcctacttgtaagagttttaaaacaggcaattttggaataggtaaattactcagtagaagccttagagaacccaaattgctgatgtatctttttcraaatgcctctcattatccaggagaatgtgtgtattggaagtatcttattctttaagtctcacacttagaccggttatgtttcctacttttaaaaattgta

SEQ ID NO: 9256 - DNA, 201 bp, Homo sapiens
gcaaatgaattaatataattagttgcttatattttaccccccacactagcctatagctttaaagttgtggtgactacaatgtctagtcacttaacctcacmgggcagatttgctcaactaataagattttgaatgagaaagtgcttaaaaattctaaaagtgcttctctaatatttgttactattgtgttcaaagactgtt

SEQ ID NO: 9257 - DNA, 201 bp, Homo sapiens
aataatttgcttggccctttccttcctactgcctgaagaaaatcaatgtttggcagctctaggttgaattactgtttattttatctttagcctacacaacygcaaaaggaaagcctgagttttccagtgcatattccaatacctgtttatggaagtgagaacgagtcagatagtgatgtattttttcagagagtttcttaa

SEQ ID NO: 9258 - DNA, 201 bp, Homo sapiens
attatgttcatcatgacagagcaaatgagcttttggggaaaacagaagcaaaataaacctttttgaataatttattattctataaacacaatcataaagcrtaatggtatcagttcaggagaaaggtcccactgctcctgtgttctacgtcagtggctgcagggccacagcaggcagagataaccaagcacgctttcactg

SEQ ID NO: 9259 - DNA, 201 bp, Homo sapiens
ctctgtcctcatatttgctagaaaaacactatgtcaaccatttgatcatactcatttgtttctaagcatatatcttaactaatctagagacccatattcaytgagcttttggaatgactggaaaatttctcaaagcttcctcccttatctacggtttagtttacaaaaattaaataagcttatgatgtgtgtctcatccac

SEQ ID NO: 9260 - DNA, 201 bp, Homo sapiens
tattgaaaatgactgtagtctggctgaggagatattaagtgaccagatggcctctggcacttctgttttcaaagctgccttatagcgcctttctcactttrtgataccaagctgctgccatgctagtgtccaccctcgaacaccatgccactcagacatggtgggattcgtgtttctgaaggggcacagtaggaagctcat

SEQ ID NO: 9261 - DNA, 201 bp, Homo sapiens
tagtgttggagaccatattgaaaatgactgtagtctggctgaggagatattaagtgaccagatggcctctggcacttctgttttcaaagctgccttatagygcctttctcactttgtgataccaagctgctgccatgctagtgtccaccctcgaacaccatgccactcagacatggtgggattcgtgtttctgaaggggca

SEQ ID NO: 9262 - DNA, 201 bp, Homo sapiens
aacgttttaattttttatcccttaaaaatgttattttttggctaacagcattgaaataagcgttactatagattaatactatgaaacaggaacaaaactghtgagcagacattctcccagggaaggactgtgtgtgaacacattaaacttacgcataaaagtggagactgtaagtgggttccagggtttccccacgctgac

SEQ ID NO: 9263 - DNA, 201 bp, Homo sapiens
acccgttagccagttccacagggcatattgggaaataccttttattttcaatatttatatttgtcttatagatatttgtcctttcaagtaggacaaagtgktaatgacctgcctctatcaaaaaattctacctagtaatccaagataagcagtgtgttcctagtgagttgcttacataaaagccaatatattttgtactga

SEQ ID NO: 9264 - DNA, 201 bp, Homo sapiens
agaagtccctcttcagaacctgtcctatgcagctgtcactcacttggctttgtaagcctgcagacagtgtcatttaaaatattttcctctgtaccataacrcttttccttttaatgatatataagaataatatttctctctaaatagttatttctttaactttgaaataattcagcatctcatgattttgatttccatttc

SEQ ID NO: 9265 - DNA, 201 bp, Homo sapiens
aacttttgcagtctccaaaaagaagtcaggtcatgtgatatttgtctgtgcgtggtccatttcacttagcataatagggggactaagttcaagagatctaytgcacaacatggtgaccatagcaaataataacatcttgtattttgaaaatcactaagggagtagattttaagtgttcttagcagaaaagaaaatacaatg

SEQ ID NO: 9266 - DNA, 201 bp, Homo sapiens
accctaatagcctctcataaccaccgttctactctacttctatgagttcaacttttgcagtctccaaaaagaagtcaggtcatgtgatatttgtctgtgcrtggtccatttcacttagcataatagggggactaagttcaagagatctactgcacaacatggtgaccatagcaaataataacatcttgtattttgaaaatc

SEQ ID NO: 9267 - DNA, 201 bp, Homo sapiens
tgccacaatggaaaagcaaactcaattacaaatgctggattccacctggagcctattctttttcattttcttacttctgtttctgccaccttcccttcttmcgataacagattttcaagtactgctcttagaattgctaaatgtgttcagagaatgtgtgataagatctgattctcctggaaggccaggttattttaatct

SEQ ID NO: 9268 - DNA, 201 bp, Homo sapiens
cttaaacgcatgttaataaattcttaagttaagcacacaatgtgtgcgtgtacccacacatgccaattttgatagccagccagtatttataacagtatcaytgactgaatgtcatcagcccataagcagatcctggaaagaacatatatagttgaattttatctaaataattacttgagagtatctttaaaaaatctaagc

SEQ ID NO: 9269 - DNA, 201 bp, Homo sapiens
tgcctgaactttttcaccaccgtgtttaaagccttgaaagtattggtaggctctatttggtatcttaaaattgtttccagccagtgggaggcctgtacccyagaagaaaatgagttgagttagctccaagtagtaccagtggtatttgcatctttttaaaattccttaaaaagcatttaggaaattagttcttttccttca

SEQ ID NO: 9270 - DNA, 201 bp, Homo sapiens
ggtggctgtagcactggaagaatatttgcagccccacaaactaatgtctgaattacttaggatacatccctctgtctagagccagcccaaaaaaatatgtkattcctgccctgattcagatagagatatctccaggctacttactatatgtatttattatgaagtacatgaataaatcgccacccaaatacagtaaatgca

SEQ ID NO: 9271 - DNA, 201 bp, Homo sapiens
caaatgaaagagatgcagagtgggaggtaggtggggaggggtttggcgcttccacgccctctccagcacaccaccctccaggaacctcgacatgtccagcygtctggaagatctctgaaccctgtcttttggggtttttgtggaggcttcattacataggcataattgattacatcattgccattggggatcaactcaatc

SEQ ID NO: 9272 - DNA, 201 bp, Homo sapiens
tcactgcaacctctgcctcccggtttcaagcaattctcctgcctcagcctcctgagtagctgggattacaggtgtgcgctaccgcacctggctaatttttktatttttagtagagatggggtttcaccatgttggccaggctcgtttcgaattcctgaccttgtgatctgcctgccttggcctcccaaagtgttgggatta

SEQ ID NO: 9273 - DNA, 201 bp, Homo sapiens
aggtgactactgaatgcgtaacactttcacaccatcgtaaagctgaaaaattgtcagtcaaatcttcccaagtcagggaccgtctgtattggcaagattgrttccttctgagggttgtgagggagggatctgttccaggcctctctttggcttgtagatagatgactgtcttcatatttgtatggtgttttccttgtccaa

SEQ ID NO: 9274 - DNA, 201 bp, Homo sapiens
attgcttactttcataaaatgaagttttatttagatacccaagatgtaaaacatgaaaaatgtagacccactataactgggggagttcttgagggtggaargagagaaccctgctcagccttcctattctgccccctccccagattcccttgcctttgctactggctttcccagccttggaagctactggggtacgttaag

SEQ ID NO: 9275 - DNA, 201 bp, Homo sapiens
attggttgagcctgtcacgtgtctatgccttggctgcttgagcttgggaaaggaagattcttcccaattatgcttctatagcatactcatactccaagatraggagaggctggaatgttggataaccatccccaacccccaatgacagtcatccactaagctctgcattaattagctgtgtgaccatggataaatcatttc

SEQ ID NO: 9276 - DNA, 201 bp, Homo sapiens
ctagatccatcccctagaaagtaactgtgtccagttatcaatgggcagggcttgctgggcgttaagcacaggtaacctctagtcttttactatgtttctgygacagtggcataaaacagctttttaatgagacctactgagatgcactgacagatctcttcctttccttttgtgtctagcccatccaccttcatgtaaatg

SEQ ID NO: 9277 - DNA, 201 bp, Homo sapiens
cctagtctgtgattccaaatctcaagcaccacctgcaattgtccatatttttcacccacaggatgctcatgttaccaggaacttaaaagagtaaacgtggktgctgacattttagcgttcgtgggccagttttctgagatcaacactaggcaaggtactggggagtgtcttctaacacttttcagactttgaacagctaac

SEQ ID NO: 9278 - DNA, 201 bp, Homo sapiens
acagataaaagaaacatacataaaaaagtaaatactatgattttctttctccctggattgctcctttaacacaataattttacagaaacctttttccattstaagtattattatattgctcaattttccagtgccaatcccttcctttatttggaggagcctctgaatgccagtggggagatagttttcctcttactggtc

SEQ ID NO: 9279 - DNA, 201 bp, Homo sapiens
ttttctgtattaaatcacttattcaaacaatgatttattcaacagaaagcattgaacactgtatttcttttctgacaaccacttctccaattctctgacascaactgggtgcccaacaattttattcaattctgatactacctggagttagcacagatcccccaggttaaggactcagtctcacaagacttctgctactct

SEQ ID NO: 9280 - DNA, 201 bp, Homo sapiens
aattcctcaccctttacacctccttgcactagacacactcatttacaaactctatacttctactgtattcctatgactggagggtgtttatgagaaaagcrggtgagccttagagtaccagtatatcaatttttttccacagtaggttaagggattcatggagggaccccccctgccccccaaattgatttgccttttgca

SEQ ID NO: 9281 - DNA, 201 bp, Homo sapiens
taagcccctcttcttattgactccatgtcagatttcatagcttgacctgttacaggatctcacattgtctctgtaataggtgtgccggtccttactcttayctgattttcaactgtgagagtatttgcaccctgggtttgagggagaggaggttttccctgagccttacctcttgctgctatttcaatagaagtcataggg

SEQ ID NO: 9282 - DNA, 201 bp, Homo sapiens
acacacacatttaaaaaattgtcataaggacacacagcaaatggaaaaacatttattcaagacatctattaaataccagttagaaaaatgagaggtgtgayatttaaactgtaaccagctgccatccgctagctcacccctgctccttgttttggaagccaaaaggacaagagctttcttacctgccagttatcagtctag

SEQ ID NO: 9283 - DNA, 201 bp, Homo sapiens
acagggtctcactctgtcacctaggctagagtgcagtagcacaatcatagctcactgcagcctccaggaatcgagacctgttgatattttagtcatgtttrtgtactcagcatatttttttaaaataatatgataaaataccataattaaatgattactcaaaagtggtctactatattaggttttgtgtatattacttaa

SEQ ID NO: 9284 - DNA, 201 bp, Homo sapiens
ccacctctttcaagggtggtgtatctgaatgtcaaggtgattggcataacactaatgcataataaccagaaatcgagtttatcttccaagatcttaatagwggatcctcctcaagagaaaacctttcagacatatcagccttacaactggaatctatttacttttcatttgtttttcaccctatttatgtcattttccttt

SEQ ID NO: 9285 - DNA, 201 bp, Homo sapiens
aattccacctctttcaagggtggtgtatctgaatgtcaaggtgattggcataacactaatgcataataaccagaaatcgagtttatcttccaagatcttamtagaggatcctcctcaagagaaaacctttcagacatatcagccttacaactggaatctatttacttttcatttgtttttcaccctatttatgtcattttc

SEQ ID NO: 9286 - DNA, 201 bp, Homo sapiens
aaaatctaaaaaaaaaattaaaaataatcatttgaggaactctgttaaattttttaaaaagtgcattaggtttagatgtgatgaagcaacaaatgcaacaratgttgcaatgccaatcagatacttgactaagacaaaagtttaatgccaaactgcttcaccagaaatagcttcctacctgacagaggacactgaattgtg

SEQ ID NO: 9287 - DNA, 201 bp, Homo sapiens
cattttaaaatgaaaaaatatatatatatgtaatttatttgaagaaagtctattcatttacgtaacacttatcattgagcacttcgtaggtacctggcgtygttctagacactggaaacagaccactgattctgatgctcaagggccctgttggtggcattgcctttggtgcatccttttctttcacctcttatactttcg

SEQ ID NO: 9288 - DNA, 201 bp, Homo sapiens
tctgaaagaattggaacccgcaattcaaaacaatttaaactgttctggagacaaagctaactctctggtggggtttctttcttctgatgataaatttgggrgtcacttaatccaggacagttcctgcatttatggaaaatgagcatatcgaggtaggattaaagaagtgaattcattcattaggctctatgccatcatggt

SEQ ID NO: 9289 - DNA, 201 bp, Homo sapiens
caaagatacgggtcaaacatttaaggccgttaacaagaagttaaatcagcaacaacatttatatagaggcattaattcagggtgaacgcaaaatgtgttgyagcatcgattctggcatttttctctgctcctaatagctctgagcatttgatctatatgttatatggacctaaatgaagggaaataaacatctggacagat

SEQ ID NO: 9290 - DNA, 201 bp, Homo sapiens
gcataccttaagcactcagtaaattatagccattctattttattccattccatgttaatggttcaacatgaaatagaattgcatccaaacaaatcgtgacrtcaagggtgttacctgaaaaaaaaaggtgtttcttacttaaatatattaagtaaatatagggttgtgtacaaattttaaaattttgctttactgtgggac

SEQ ID NO: 9291 - DNA, 201 bp, Homo sapiens
ttatttttttataaagtgacctcagaaaatgtgcacagggtggggcatctcatgtgaaaagcatctcaatcattgattccagccacatgccatcataagckctttaaggagagatcctatattttatattaccctcattaaatcttactccccaccataggtttctctctgtcctaaatatctgcttttagaaggagtaaa

SEQ ID NO: 9292 - DNA, 201 bp, Homo sapiens
gctgggcacggtggctcacgcctgtaatcccagcactttgggaggccaaggcaggcggatcgcttgaagacaggagttcaagacaagcctggccaacatgrtgaaaacccgtctctactaaaaacacaaaaattagccgggcggatgagggttcctataatcccagctacttgggaggctgaaacacgagaatcgcttgaa

SEQ ID NO: 9293 - DNA, 201 bp, Homo sapiens
tacatggaaatttaatcacttccaaagctgttatcacaatttagtggagagatggaaagtgtttttttggcaaatggtagaaagataaccaaccatccatwtagaagaaaataatgttggtgcctatctcacatcataaacagaaataaattccaagtgaattgaagacttaaagtttaaaaaattattaaaaatattgga

SEQ ID NO: 9294 - DNA, 201 bp, Homo sapiens
atagtcctctccaattagggtacaaaaagattatttttttcttcagaaattgagtggatggtctgctgctgtaggtttcattctcaacatcattttgtccyttcctaaaaatatccatttttaaactgctgatttattttggccatcgtccccacaaactttttgtaaagcatcagtgattttaccattctctcacccaag

SEQ ID NO: 9295 - DNA, 201 bp, Homo sapiens
atgttgatctcacttgtttaaaattttcatttaaagctctggtcttgtcttcagcttatctgagcacagtggtcttgacactgattgagtgaaaagtttgytcaactttaatttttcagtaagcattgttagtgaaccaattgaggtgtctatggcgttggctattgttcatgctgctaattgatagtcctctccaattag

SEQ ID NO: 9296 - DNA, 201 bp, Homo sapiens
tataaatattaaattaataaataaaatattatcctatcatacttagtaacaaaggtataaggctacaatattacacctgtcctgtaacttcacagatatcwaatgaatatctagaaaacatctctgacttgctgcgagtgtgtcactaaagccctacattgaccatatatgtctttattctctatctgataatgttgcaac

SEQ ID NO: 9297 - DNA, 201 bp, Homo sapiens
caagccaatgggctgggtttccagaggcataaatcctaggaattagtaatatcccatataaaatcactgaaggttggtgcctatggttatgtcagtggccyctatgatactccctaaaggcgtaatttattccacagtccctagacacattcgttcatgttctttgaaacagggcacacttgcctttcccagaaatttttc

SEQ ID NO: 9298 - DNA, 201 bp, Homo sapiens
cttcctttgctccagctgcattcatcagcttccatcagggttcacagcaatgaaattaattgacaagaagctcaatcttaagagcactctgaactgtataytcttgccatccacccgctaactccaatcctacatgaatgaatgcaagtgtagttttttgagaaggggccatggctcaagcagtgccatatatgtgccttc

SEQ ID NO: 9299 - DNA, 201 bp, Homo sapiens
tcagcagtctgatttcagtttacagatgcagtcttaaaaaaggaccctgagatcatctataacacttccctgtcttcctttgctccagctgcattcatcarcttccatcagggttcacagcaatgaaattaattgacaagaagctcaatcttaagagcactctgaactgtatactcttgccatccacccgctaactccaat

SEQ ID NO: 9300 - DNA, 201 bp, Homo sapiens
atttatttttagtagcaacaagctctcactatgttgcccaggatggtcttgaacttctgggctcaagtaatcctcttgtcttagtcttccaaagtgctggmattacaggcatgagccaccatgcctgccctaatggtgtttttaaaggaggaattagctgtggtcagtacagatttatttggaagaaatggaatctgtgct

SEQ ID NO: 9301 - DNA, 201 bp, Homo sapiens
tggtggcccacacttgcaatcccattactttgggaggctgacaccagtaaatcacttgaggccaagagttcaaaaccagcctcagcaatatagtgagaacscatcactacaaattcctttttttaaattagctggacatggtgacccatgcctgtagtcccagctacttgggtggctgagtcaggagggttgcttgagcgc

SEQ ID NO: 9302 - DNA, 201 bp, Homo sapiens
ttgtccacgctgcacacagttgccaaattcaactttctgtgttgcaaaccttgttgtggctccccctgtgtaaaaaccttttagtgtttctcatctccatraatcactaatccatggtgcttagtagcatgtcaaaggcccttccgaatctatctctagcctacctctgtggaccttatctcttggctctcccacctgccc

SEQ ID NO: 9303 - DNA, 201 bp, Homo sapiens
aagacaaatattcattaaaacaaatattaattcctcaaagtttaattcttaacaaatattaattctacaaagagctaaaaggctctatgtaggtagataayggcattcagatttacctcctaatctttacagtaattggttttaagggttggagaaagaagtaaaggaggtaaaagaatgtacatagacaataataattat

SEQ ID NO: 9304 - DNA, 201 bp, Homo sapiens
actgctaggtgctgtgtgctatgctaggtgctgctgatacagttatgagcaagacagactcagaatcttataaatctttttgtacaaaagacaaacaattrtttcagtgagttgattaaatttaatattaatatttaataaagcagaagtaattatacctgcaaaggaaaaataaagtgtgtttttagcacctataatttg

SEQ ID NO: 9305 - DNA, 201 bp, Homo sapiens
tgcattcatcagcttccatcagggttcacagcaatgaaattaattgacaagaagctcaatcttaagagcactctgaactgtatactcttgccatccacccsctaactccaatcctacatgaatgaatgcaagtgtagttttttgagaaggggccatggctcaagcagtgccatatatgtgccttctatacaactggcttgg

SEQ ID NO: 9306 - DNA, 201 bp, Homo sapiens
gaattatcccctctgggtccttccaccttttccctgctgccaccagcttgagagaaatgagataaggaatctacacagttttcatctccttgcttttaccrctagacaacagagcctccgggggaagtttatttttaggatcagggctcaactaatattgattaacagccttacataatgtgaggctccagggtttgttct

SEQ ID NO: 9307 - DNA, 201 bp, Homo sapiens
tagagactatggcacccaggagaacccagaccgaagagggcagccactgctcagctgctgccagtcatcacagcacaggagcaatggaccaatattatgawtttatcttcttttgaaagacaatccagaagtcgagacttttataaaaagtctgaattcattacctgtattaaattttctttgatttaaaacactgatcag

SEQ ID NO: 9308 - DNA, 201 bp, Homo sapiens
ggggccaggtggaggtaataggatcatgggggcagtttcccccatactgttctcatggtagtgaataagtctcatgagatctgatggttttataaatgggrgttcccctgcacgagctatcttgcctgctgccatgactttgctcctcattcaccttccatcatgatagtgaggcctcccaagccttgtggaactgtgagt

SEQ ID NO: 9309 - DNA, 201 bp, Homo sapiens
agtggtgctgaaagtgtatatttcatctcaatgacaatctcaaaaaattataatgcaagcatattctgaatgatcttgttgaccacctaataaccaggtayttttatagaattttaatgcttgtgttgagttgtgttcatggggaacaaacctgtcataccttatttggtaaggactattgagaaaagagcagagccaggt

SEQ ID NO: 9310 - DNA, 201 bp, Homo sapiens
gaattagtcatacaataattatttaaagaaagaaatgtttcctccatgttgtgctggagatacaatggtggagaggaagtggagatcaactattgatcgayttataatttacacaattccacactttggagaaaacacattccttcttcctcaccatcaccctcaccattataattattatcaattaacttgttcaatatg

SEQ ID NO: 9311 - DNA, 201 bp, Homo sapiens
tcaacttaatgaagggtagaacattgagatatatacctgttaatagtagaataatatgacatggcacagtatccaggtatggaaaaggtgaatagggatartgttatgagatttttagagtacgttaattttataaagcatgcttatgggaaaagccaaacattgatgacatttcgcagaaaatgttatgttcaggtttgg

SEQ ID NO: 9312 - DNA, 201 bp, Homo sapiens
tgcagacacagtatacctgctgtcctagagtttagactctaatgagggagagagataataaacaaggaaataagtgtatgtaacaatgtacagctagaaaygctgggaaagaaacgaacgtgagagacacttattggaatttaaatgcaagccactccactatatctactaggtgtgtgtgttacaaaatacaaaaaaaga

SEQ ID NO: 9313 - DNA, 201 bp, Homo sapiens
acagtaggtttagaaatcatcaagggtttagtctcactactcacttattactaatgtttaaacagtaaagacatacagagtagctcctatagaagatttaygttaagttatctcacttggagaacatgctctcggggaattgttcctgcctacaaggtctgaatgagtcagctgtgcaccgggatgaatgggtcatctcca

SEQ ID NO: 9314 - DNA, 201 bp, Homo sapiens
ttcctttatctctgtgcctgaacaagccccccttgctataatcttcatgctgacccctcattctctagagtatatgctgttttctgcagcagactacacgkccagtgcccttgcttggagcagatctagacatcatatcgccacggtcttcattctgaagtaaccttagaagtcactttcagttcataacattaaagcaca

SEQ ID NO: 9315 - DNA, 201 bp, Homo sapiens
gttcctttatctctgtgcctgaacaagccccccttgctataatcttcatgctgacccctcattctctagagtatatgctgttttctgcagcagactacackgccagtgcccttgcttggagcagatctagacatcatatcgccacggtcttcattctgaagtaaccttagaagtcactttcagttcataacattaaagcac

SEQ ID NO: 9316 - DNA, 201 bp, Homo sapiens
tttgtcaatattttccacagcatcacaattgtcagaaaacacagtgaagcttaagttaaaacaaatctgcaaagaaaaagtcaaaaagaaaactcttccayagattttcagagagatgatttattagtccaaatttgagcattgaaactagcctatattctaagtttaagaaaactgtaattttcatgtttctttcagttc

SEQ ID NO: 9317 - DNA, 201 bp, Homo sapiens
acctttctttcttttgttaaaaaaaaaaaaaaaaaaaaaaaattatgatagtgctagtcaatactgagttgactgtcaaaaataagcacactttacattasccagttacttctgggacactgttgaagagtatgtcacatgtacccacaaattagtcaaacatctttaggcatcacatgatatctaaattagtctttttct

SEQ ID NO: 9318 - DNA, 201 bp, Homo sapiens
accatgattgtgaggcctccccagcgatgtggaactgtaagtccattaaacctttctttcttttgttaaaaaaaaaaaaaaaaaaaaaaaattatgatagkgctagtcaatactgagttgactgtcaaaaataagcacactttacattagccagttacttctgggacactgttgaagagtatgtcacatgtacccacaaat

SEQ ID NO: 9319 - DNA, 201 bp, Homo sapiens
atgtaatccaatttgaacactgcctcaaacccagtgcccttcatgtggtaagtattcaatacatacctaatattttaactttatttatttttacctcctcygatacaaaaaaatgtaaataaccctcaatgatctgtaaaaaatcacttagttggaacactttgttcatcctctagcaatgtctgataagttagttatcat

SEQ ID NO: 9320 - DNA, 201 bp, Homo sapiens
tctaataacaattcatgtccaattatctgactgccagcacagttatctgctatggttgttagaaactttagaaagaagtaaatcctccaaaattgtcactyttaaaatctgagagaaaacagaatgaatagataagagatgcttcaaggcagttcagctctgtgatggttccgttgagatagaacacacatatacaaagtg

SEQ ID NO: 9321 - DNA, 201 bp, Homo sapiens
attttctaatatcattgatatataaagctgagtataccagacacttgtaaagaaatgatcttttccaatgaaaacacaggtgttaaacagaacctttcttytggcctacaaatcactcttctaacacttggaaaaaattaaagaaatattcagcaatgtgtagaatttcaatcccagagagacaggaagagactgtatagc

SEQ ID NO: 9322 - DNA, 201 bp, Homo sapiens
gtaagtttcacgtgaatgttttcctatgtgtatgtgtgcatgcttatttgcatttgtgtgcacttgtgggtatgtgtatttgtcctgtgtcacaataaaakgtatctatttctggactttgcagtcaaaaacattggaaaactgtctatgtaggtaatggacacaatagaatttagaaagcaacttttacaaacattgcag

SEQ ID NO: 9323 - DNA, 201 bp, Homo sapiens
caggtacttattgagcatctattacgtgccatagaatattctgattattaaggatgtcaaggtatataatccagagtcacggttttcaaggaactcagtcrataattacaagctaatacatgggtaccactgttctaggcacagcgtggcagaaaagaatagcgtggacacacattcaggggatttaactaggagaaaaca

SEQ ID NO: 9324 - DNA, 201 bp, Homo sapiens
tagagtaatttctagttagaagtggctgtgagattcactgtcttctggtgatatttgaaatatactatattcatgcaaatgtttctgattatttaaacacrttatctgtatctataattatcagtagctgctggcattatgtgagcatgcaaaagtgggaacagcagcagtaacctgactcatttcaaccaggatggacca

SEQ ID NO: 9325 - DNA, 201 bp, Homo sapiens
gttttgttacctccggataaatcttcatgatgaaatgtgcagccggtccacctcttcaatcttctctcttcttcttcctcagtggaagctcaattaccatkaaggccaaaataaataaataaataaacaacaaaccaaccaaataaataaataaagcagataaaccgtggttctttgcttaaaaaaagttgcagcaaagaa

SEQ ID NO: 9326 - DNA, 201 bp, Homo sapiens
attagctaatgaggctctctttgtttgaggattggaaagcctccaaaaacccactcaggagggaaattaacaaatgtctgttttgttacctccggataaaycttcatgatgaaatgtgcagccggtccacctcttcaatcttctctcttcttcttcctcagtggaagctcaattaccatgaaggccaaaataaataaataa

SEQ ID NO: 9327 - DNA, 201 bp, Homo sapiens
ggccgatactgcagttttgatggccatcactggtacaacaccctgcgtatgccaagactgtcatgccttgtcagctataataaaaagcaggagacaaatgrccttttgttacctgaaatgatggatcagtatgtatgtgcaaggatgcacgctgtcaagttcttgtgggttaatcatgccaggctgatggaggggctccac

SEQ ID NO: 9328 - DNA, 201 bp, Homo sapiens
gatcacacactattttcatcagaaattttaataaaattatttttttctcagatgacttcccgcatactactaagtgatctgggagaaggagtcttagggtstggatgggattctgccttgggcatattttgctctactgggccctggagtctttgcagatgctgtcaagatactgcacttttttttcttttttgagacaga

SEQ ID NO: 9329 - DNA, 201 bp, Homo sapiens
tttctactctgtgttactatgtatttgactgtttattagtgtcgacttaggagtgagatcaaactctttcactctctctttctttcccgtttttttttttktttgtttttgtttttttttaaacaagatctcacactgttgcccaggctggagtacagtcacatgattccagctcactgcagcctcaacttcccaggctcc

SEQ ID NO: 9330 - DNA, 201 bp, Homo sapiens
atttttttaatattctagaaaccatgaaagaaatcactgagtccttagctcctgttttttttttttttttttttggttgttgttaaattgtagaatattaraatgtttcagttttactgattgtatttgttaatcattcttcttccactaccgttgtcttttcccatcctcttggaagggtgttagagaagactctatatc

SEQ ID NO: 9331 - DNA, 201 bp, Homo sapiens
ctctgtgatggttccgttgagatagaacacacatatacaaagtgtttgaagtaagaatttccttcgaggagaagcacaaagggaatagaagacccagcatytgttactggccttagataagcttactgttcacttatttatcaatgtaaaaacgcccagttagtttttagctcaaggaagagaggacatggccaaagatgg

SEQ ID NO: 9332 - DNA, 201 bp, Homo sapiens
tttctgcttggtgcattaatcgagagttatttggacagaactgaattgccaggggaggaacaagcaaggtggtaactcacccttccctgccctttcatctstctgtaatacggttctatgtcatgggcctccttcacatacacactcccccagttgtccattactcccaccctctccgtcttacccacacctagagatatg

SEQ ID NO: 9333 - DNA, 201 bp, Homo sapiens
tattaactgagtgcctcttctgggctgagataagaaaatcattgtgaaaccaaataagaacaagcattgcaggccccagatatttagagactccagtgacrtttgggcttttcctgaactttagtgtgcaatgtcattttaaaaagtattttaggggaaatgataaattatagccagtttcataaaagaggtatacattat

SEQ ID NO: 9334 - DNA, 201 bp, Homo sapiens
tgagcacagcagtcaataaaaataaggtaacacaaagcagctctcttgaaaacaaaatcagagcctatactcttaagaagttcatagccgtcacaaaaggrccctcgtggcagtagaagctaaatggccaagaatgctggaaatggggctgcaagtcataaatggagaaagtctaaactaagagggtaaacagcaggtgac

SEQ ID NO: 9335 - DNA, 201 bp, Homo sapiens
attagtctgataaaaagtcacatcagagaaggtttacctccaaatgattttggtggcaaagaagcctgtgcatcaacacctgcccttgagcacagcagtcmataaaaataaggtaacacaaagcagctctcttgaaaacaaaatcagagcctatactcttaagaagttcatagccgtcacaaaagggccctcgtggcagta

SEQ ID NO: 9336 - DNA, 201 bp, Homo sapiens
gaaaccgtgtttgatctgacgttttggctcttgtatgaggcagctttaaatagctgtcagatttggtttcattttagtgaagggttaagtaattttaaggsgttaaaaccatgggcaataaataaccatccacagtcatcgaaggaagttgcttcttagacaagagaatgaagctagagctgctagggacattagtctgat

SEQ ID NO: 9337 - DNA, 201 bp, Homo sapiens
tttactgctgtagctgcctcctgaactgctgctgctgctaccatggcttctagatgcttctttgacaatttatttattttccagtggaacccatctgtgargaagcccttcatagcagtaatatcctggggctgggcactactacaataatgatgctttcgttaatcaccccatgtaattttagtttttgctgataaatac

SEQ ID NO: 9338 - DNA, 201 bp, Homo sapiens
ggtcagtattcagttgaaaggtcatcaaccagaaatatggttagccattttttagaagaaaacaaattagaaaaaagtatggataacaactttggacaccraagaatatttctataatatttcctgctcagtctgtagtggaaggcagtagagaatagaacttacaaacatagccttggagtgagaaagatctggaaacta

SEQ ID NO: 9339 - DNA, 201 bp, Homo sapiens
atgcaaacaataccatgtaaatgaagaacattaacgtggcagatgacattttcctgagaataaagctctacttgcaacataaatacaacacaattgctatrttttaggttctttagaatttggcacattttactgctgtatgccttgtgatttctcagttctgttattatttgtctctgtttgaacccatgcaaaaccttc

SEQ ID NO: 9340 - DNA, 201 bp, Homo sapiens
acaaatcaaatgcaaacaataccatgtaaatgaagaacattaacgtggcagatgacattttcctgagaataaagctctacttgcaacataaatacaacacrattgctatgttttaggttctttagaatttggcacattttactgctgtatgccttgtgatttctcagttctgttattatttgtctctgtttgaacccatgc

SEQ ID NO: 9341 - DNA, 201 bp, Homo sapiens
ggatactgaaggataactgttactcaaaagagggattgctggatcatataaagttattttcttaatgcattcatgtatgcactagtgtgtgtatgcctctrtacacccatgcctgtcactctatgacctgttgtcatatctgtacattcatgtaacaatcgccatgtttaagaaatgtagcattgagcctatgtcttaact

SEQ ID NO: 9342 - DNA, 201 bp, Homo sapiens
agcaagttgactattcaaaccaaaaggcctccagttgaagttgtgttttaatttaagcactagtagggcccagcaaatcaaatattgaaagatgctaaaawtagtctgattactttgtgagtcatcaaattgatttgactgtccttgcccttcatataatgtcccaatagacacttaacctgactctacttccttgaattt

SEQ ID NO: 9343 - DNA, 201 bp, Homo sapiens
ggaaggattgctagacaaaggaataaatttttaatatctgaacatcttaaaataggcaaatacccagccaatgtagaaattttatattgttaaatatcagsttaatagaggcagtatatagactcatataactgtttatcaatcacaatttgaactgctgtattatgttaaattagtgtacatggtttagatatataaagt

SEQ ID NO: 9344 - DNA, 201 bp, Homo sapiens
ggtacttttctctgatccttttggaaagagcaagtgtcctttgagaaatacttgttcttggttgttccctgctccccacccccatgcctgtccctgccacytctagagcaggtggaagtcgcctgtgggttcttctggtctcaggctttgactgttcccctccacaaatttgttcttaattcgattttgtattgaagcaca

SEQ ID NO: 9345 - DNA, 201 bp, Homo sapiens
cctagatcacaactggtataattaggatttgaagacaggctgtttgacacctaagctgatacttccaaagactattccaatagcacaaaattcaattgctstggggacatggttctcagaacctggtcttcttgaatcactagaccgatcctcctcagaatttaagacctgggtggaaagggaaagaccatccagctcacc

SEQ ID NO: 9346 - DNA, 201 bp, Homo sapiens
gtctcactctgtcacctaggctagagtgcagtagcacaatcatagctcactgcagcctccaggaatcgagacctgttgatattttagtcatgtttatgtastcagcatatttttttaaaataatatgataaaataccataattaaatgattactcaaaagtggtctactatattaggttttgtgtatattacttaaaataa

SEQ ID NO: 9347 - DNA, 201 bp, Homo sapiens
ctgctagtctgggggatcacaaatcaagagccatgccttgattattctcttcttgagtgcttcagttgacttttacaataccatagtttcctgatcttgaygcttaatgacatttgtagtcacattttctggtttcttctaccctttttctctaaaacagggcaatgttgcccctcagagaacattggtcaatgtctggag

SEQ ID NO: 9348 - DNA, 201 bp, Homo sapiens
agcattcctggttgagaatcattgtactagaccaaggaatggatcatattgaccagaaggaagttgtatattattaaaaaaaattatccaactccagaagwagtatactggggcagtctaacttggggaccttttgaatgtctccaccatgggaacaaaggctaagtaaagcagtggcccattgctcagtccaacagcact

SEQ ID NO: 9349 - DNA, 201 bp, Homo sapiens
cactccagcctgggtgatagagagactccatctcaaaaaaaaaaaaaaaagtttattagcaagtataaatgtatcagaacttaacaggtcaatttcttgtrttattgtgagactaaaaaaaattgggaaaaaaggaaagctttgaagagaaaaaaatgggtagccatcagaatcattttgtgaaaggaacaaatactaata

SEQ ID NO: 9350 - DNA, 201 bp, Homo sapiens
ttgctaagtcccggcctgctcctctcacaatggggccaaggtctgtgcagcatgctggtgtgcctggtgaaaggagaaaatgagcttcataaatacaaackttagagtcaatcttatgttccccagggactgccagtactttacttggcaagaatagaaaaggaattcttaaggatataaaggcaaaaacgaacactgtaa

SEQ ID NO: 9351 - DNA, 201 bp, Homo sapiens
tggattaaaagataataggatttggagaacaggacccagtgaatcacaaattcattacattcacagctgacaattgctaagtcccggcctgctcctctcayaatggggccaaggtctgtgcagcatgctggtgtgcctggtgaaaggagaaaatgagcttcataaatacaaacgttagagtcaatcttatgttccccaggg

SEQ ID NO: 9352 - DNA, 201 bp, Homo sapiens
tttatatacactcaaaatgaataagtgatacggtttgttcttctcctctacttctctgtttcccaaagtaatttgcaagttagaagaggaaatccattagragaagctgaatggattaaaagataataggatttggagaacaggacccagtgaatcacaaattcattacattcacagctgacaattgctaagtcccggcct

SEQ ID NO: 9353 - DNA, 201 bp, Homo sapiens
atttttcaaccaaacaggactaggacatagatcaaggtctgtcagcctatgctcaaagtgtcctctgcagactttgttgccactaaactagaaataatccrtagtttctcctgtttccttttccgttaatgaccaactttatatacactcaaaatgaataagtgatacggtttgttcttctcctctacttctctgtttccc

SEQ ID NO: 9354 - DNA, 201 bp, Homo sapiens
ctcctaaagagttttgaaaaataaacacatagatatgaagaaagatggcccaatataaaccaacagtggtcctactatccctgtcctctatgggcttgctragcaataccccaaggtaactttcaagctgactttgatgtgaatgcccaggttcacgtataggagtaacatagaccactaagaggggtttcttgacaatcc

SEQ ID NO: 9355 - DNA, 201 bp, Homo sapiens
cagcagcgacttgaactctgtgttgcttgtgtccagaaaattccaggcactttgtcaatttttttcttcattttcaaattatccttttgaggaaaatataraggagtaatcccattatctctattttagagataattcagctgagtttcaagaggtttgttgtcttgcttcaagttgtccattagcagaacgaagaacaaa

SEQ ID NO: 9356 - DNA, 201 bp, Homo sapiens
gttaaaagaaagaacaaaggcatgtcaatgttttggactgaggctagccgaggactttcactggcactctttttagagctagaccattggggaagttgcartgttacataatgctatgcttctcattgccatagagaagcagcagctgctttgagactttagaaaatcagcagcgacttgaactctgtgttgcttgtgtcc

SEQ ID NO: 9357 - DNA, 201 bp, Homo sapiens
aagagactatcttctaaatatatccttagttcttcaggcagcaatttaatttcagttaaaagaaagaacaaaggcatgtcaatgttttggactgaggctarccgaggactttcactggcactctttttagagctagaccattggggaagttgcagtgttacataatgctatgcttctcattgccatagagaagcagcagct

SEQ ID NO: 9358 - DNA, 201 bp, Homo sapiens
aaagctaagaaagattaagactttatttttccctatagtctgcctttctgtgttcccaattctttacactgctgtgtaatgttatggaatatgattctcarttaggaaacttgaacgaagacaaaaaaaatggtaagagactatcttctaaatatatccttagttcttcaggcagcaatttaatttcagttaaaagaaaga

SEQ ID NO: 9359 - DNA, 201 bp, Homo sapiens
cttcatctctggcttagctcctttcattaccttcatggcccctctagaagtttatgttaggtttttaaggccagaccagactgacttgagcccagccgtarttggagaccagattcaaggctctctcttggtggcaggtgacattagtcagactttattcttatctatgaaagttcataagtaagtgagcttttgtgtttt

SEQ ID NO: 9360 - DNA, 201 bp, Homo sapiens
ttttttgttgaagatttcccatgaagatattgattattgtctttttcagtttttaatcagatgcattggctaatacctgtttgtagctgaagctaagtctrtcctcttaggccatggtgtgaattgtgtgtttccctttcttccttcatctctggcttagctcctttcattaccttcatggcccctctagaagtttatgtt

SEQ ID NO: 9361 - DNA, 201 bp, Homo sapiens
tggacagcactctttgcagctcaggtcaggcagtaagtctttagttgcagggtgagctgggcagcacattacagtgtctactatactaacattttttgttraagatttcccatgaagatattgattattgtctttttcagtttttaatcagatgcattggctaatacctgtttgtagctgaagctaagtctatcctcttag

SEQ ID NO: 9362 - DNA, 201 bp, Homo sapiens
aataataaaagcaaaacaaaacaagaaaccaccaggtgctaatagtcacaggctgagttccctaggaacagactctgagattgagtttagcatgccacatratttttaaggagttccctggggaaggaagtaggattgagcagagagaagttgagctgcgatgcaggcccaacaatgggctcagctaaccccacgaggagc

SEQ ID NO: 9363 - DNA, 201 bp, Homo sapiens
gggcttggggcactggttaaggaaacagattaatgagcagcaaacaggaattgatgggagtcctctgacattttgaggatatccctacacatcactgcagsctgagggaagcttggctgaaagaaactggccagaggcatgttctgactttggctgacttggaaagaatggcagtgctattaacaatgtacacatagtggg

SEQ ID NO: 9364 - DNA, 201 bp, Homo sapiens
gttagaaggctggagttatgaaccaaaccatagtaactaaaattcatgcatattacaaccaagcaaaatgcagactacctgtgtgtatatgtacatttagyatttttttgtttgtttgtttttaactttgtagcttcagcacaccatgccacaaactttgtgccttataataccttggctgaatatcttctcagaggatga

SEQ ID NO: 9365 - DNA, 201 bp, Homo sapiens
aaacttttaaaacccaaattttgtttttaaaactttataaaagatggtaaattcctcttcaaaatttaaacttcaactccaaatttagtatgggtgatttytcataacatttcaaataccttttaaaatacataccttttatacttaaacttaaatctatagtaaattatgagtttggttcattttatcattatatctcta

SEQ ID NO: 9366 - DNA, 201 bp, Homo sapiens
acatgcaggcaagcctcaagcccgcccacagtagacaaacatatacctttattgttataaaccattttggacttgtttgttactgcagcataatctggctsttatagtggacacatttggttagatacaagtgtaagaagttttattttccttgatgaatagtgggaaagtgtgtatataatattgtaaacctttttcagc

SEQ ID NO: 9367 - DNA, 201 bp, Homo sapiens
atttcataaaagatctcaacatataaatattgcttttagcctgtgatattgtctccatggagggaaggactcagatggaaataaggtatcacagaagggtrcagagtgccttttcttttaaagtaattgcaaaaataggagttatattggttatcagaacatgtttgtatttcattattaagctggtaaaaagaaccatgg

SEQ ID NO: 9368 - DNA, 201 bp, Homo sapiens
catttttattagtgacagggttttgctctgtcacccaggctgaagtatagtagcatggtaatagctcactgcagccttgaccttccaggctcatgatcctwacgcctcatcctcctgagtagctgggaccacaggcatgtgccaccatgcctggctaatgccttttaagtttggtatggacaaggtctcactgtattgccc

SEQ ID NO: 9369 - DNA, 201 bp, Homo sapiens
ggaatcaaacttggatatattgtattttcatcttattttatttcatttttattagtgacagggttttgctctgtcacccaggctgaagtatagtagcatgrtaatagctcactgcagccttgaccttccaggctcatgatcctaacgcctcatcctcctgagtagctgggaccacaggcatgtgccaccatgcctggctaa

SEQ ID NO: 9370 - DNA, 201 bp, Homo sapiens
atattaaaatccagccacttgtaaagagtgagtaataaaataagtttagggttatataaattgagtctaataaaataattcagattcctatggtacattasagttttatagtagtgcctttattttctcttgttcttctacaaatgcctttttgaatatttattcattacccatttcctggataaagatagtaaggcttag

SEQ ID NO: 9371 - DNA, 201 bp, Homo sapiens
tttctatatgtcctggattctgcatgctgcctgctcggagaggagagccttacactggagtttgcaggcatttgctgctgtctcaataggtagatcttcarttaggtcccagcttcatgccatctgttatttctaaagtattttggccttcagctggaggaaggtgacaggagagtgttctgttcctgcagaaaatttgct

SEQ ID NO: 9372 - DNA, 201 bp, Homo sapiens
aaaggcaaaaacgaacactgtaaaacacaaaccacaacaatggaaaactatagagccttgcttccaaagcttagtcatccatacttttctgaaatgccagraattgggatatggaaaagagctcagaaaactacaggaggcatccatggaacaaccacagaattctcattctggaaagctttggcagggctatgttctcat

SEQ ID NO: 9373 - DNA, 201 bp, Homo sapiens
gtatgctctctgaattgaaccttaccttttaacatgaaatttctaattgaaacaaagctgtgatgcctccagctttgttcttttggcttaggattgacttrgcgatgcaggctcttttttggttccatatgaactttaaagtagttttttccaattctgtgaagaaagtcattggtagcttgatggggatggcattgaatc

SEQ ID NO: 9374 - DNA, 201 bp, Homo sapiens
aaggtttgaaaaaggaaagataagaaaagcagcattggatgacccataacttctagaagccagggtgggtgcagtgtgctaaatgtgagaagaatggggcrtggttatgtagaattcaataggtttagaacagctcatactgtcattacctattcactcgagttagaaacctcaaagtgagatgtgatctttctttctcat

SEQ ID NO: 9375 - DNA, 201 bp, Homo sapiens
agtttgttctgtctctgccatttactagttaatctctctatgcctcaatttccccatttgtaaaatggatttaataatggctgtctaccttataaggttgmtatgaggtgccagtgtgataataaacgtaaaagtactttgaatattgcaaaacactgtatgaatgtcaggaattaggcaggcaacaactatttcttgggg

SEQ ID NO: 9376 - DNA, 201 bp, Homo sapiens
gatgctgtatcttgcctgcatccaacagactgggattattctgagctctcaagcaaaacatggttaaatcctgacaacaaaatgaagtgacatttatgctyacatatatccttccttgttttctgcattttcatttgaaaagtaaacatctagtccattttgtttatgtgtctaataatcattttattttactttaatttc

SEQ ID NO: 9377 - DNA, 201 bp, Homo sapiens
ccatatcaaatatcatagaagaaaaaataaacatatgggaacatataagtgagaaaataagtttgtgaattatcaaaaagtggaaatagtaatatctaggmaggttagcatacataagtgatgttctagtggttctcaatctttgtggcagaatataatcatctacagaattcaaatcaaaacaaaacaaaaaaaactctg

SEQ ID NO: 9378 - DNA, 201 bp, Homo sapiens
aaggttttgcaggccagatctggaagtagctatatcacttctgctcatattctattggctagaactcagtcatgagctcattctcaactgcagggaaagcygggacatgttgaccggctatgagtccagtaggtaaagaaaaactgtttggagaacaatttgccagtcttgatcagagtggaagatgaaaaaaatgtggag

SEQ ID NO: 9379 - DNA, 201 bp, Homo sapiens
aaaacagatacaaatttctaccaagaatcttatgtttgagagggtaccccgaatgaaagaggagcaaccaagagtggagaaaagcgtaaaatataatgttygggaaagttgctttgatttgaaccaagtggcttaaaactatgaactcagacagatctggctttatatactggttttgatagtcacctaattgctgtgtga

SEQ ID NO: 9380 - DNA, 201 bp, Homo sapiens
taaaaattccatgggtgtggccacatgctatggatttagacaatattaaactgttgtgaattcttaagtctgtaagaatggatttatgaggttttaagggstcctaagaaagacttacaatatggtcatgagaggtcacatcctgaccactagaactcctagtttagctgagaggcagggttgccgagtgaacaccatttg

SEQ ID NO: 9381 - DNA, 201 bp, Homo sapiens
ttatctacctgtgaaatgaaattgctaaggtttactctatgaacctcagaaggattttaagcatcagtcttcatctccattttataaatgagaaaaataasgctcagagagattaaatcatatatccaatgcaagtggtggaaataccagatgcagtagtgctttgccaataaaggtttttgcaaaaaaaaaaaaagatgc

SEQ ID NO: 9382 - DNA, 201 bp, Homo sapiens
gattttccaagagcttatatgtatctgggaagcaatatttaccaaaatgatgaatacttgtgatatgggtaggaggcagggaaatactgggtagaagaggrcagttccccagccaaggccccactctcaaacctggaaactgctgccctaaatgagaacagttatccccgttttccttcccaaatgctacctttttggcct

SEQ ID NO: 9383 - DNA, 201 bp, Homo sapiens
aaaatgatgaatacttgtgatatgggtaggaggcagggaaatactgggtagaagagggcagttccccagccaaggccccactctcaaacctggaaactgcygccctaaatgagaacagttatccccgttttccttcccaaatgctacctttttggcctgccctgcctcctatcctgtgcccctataaaccccagacctcag

SEQ ID NO: 9384 - DNA, 201 bp, Homo sapiens
ccaaggctgtgaggtggggatgatgtgacaatttataataaattaaggtccccagcttttccccttctcatgactcccaaggaaccctaaaaaggataaayctacatggttcagtgttagtgaaaattctttttttaaaaatttttgctggttcaacttcttcctccttgatacacacacacacacacacacacacacaca

SEQ ID NO: 9385 - DNA, 201 bp, Homo sapiens
aaaaggataaacctacatggttcagtgttagtgaaaattctttttttaaaaatttttgctggttcaacttcttcctccttgatacacacacacacacacayacacacacacacacactcattctcctaaagataatatcatctctgctagatccattctttgagatttgtgatacagcactgaaagactgagaagaaagag

SEQ ID NO: 9386 - DNA, 201 bp, Homo sapiens
agcagatctaggaatagaaaggccagtaaagctttataaaccatgaggggctggggtctggttagaataattaagaagagaaataattttttgtttttcayatatatgacctggggaacaaatataaatcctacaaaactatctttctttccatttaaatattgtctagttctttcatcagagacaggtgtaatatttaag

SEQ ID NO: 9387 - DNA, 201 bp, Homo sapiens
caagccctgttctttattaactctggataatttgctttctttgtttgatccctggcctttaagtgaatgtcaatctcttgcttttttcctgaagacctatraggcttgctgactaaatttcatggaaattctttgagattcttagctagaagaggctgtaaaggccaagtgctataggtactaacgtctcattgctaacac

SEQ ID NO: 9388 - DNA, 201 bp, Homo sapiens
attagaggtgtgagccactgtggttggcctaagtaatacagccacacaatttaaaaccttgaactgtgcctagatatcccctttggggaaaaggcatcacyttagttgctagagtgctggctgatggctgttggctaaatccttcacgaagaactgcctttgactattgaagccaccttgcccaaccaaggtcaagcccct

SEQ ID NO: 9389 - DNA, 201 bp, Homo sapiens
atcgcatttcgattaaataaatgttcagagtttgttattatgactttgtaatatcgcctattgaaaacaatgtaagatcatacatgaactgacttgttccrcaactattcaccagctgcatagaatgtgccagacactgttctagagactgaggatacagcagtgaaaaacaacagactatatttctacctctgacaaaac

SEQ ID NO: 9390 - DNA, 201 bp, Homo sapiens
gtacacaattccaataggaattatatatacacacactgaaaatagaatttgattaaataattacactaggtacaagctacattttacttccattgaaggasagctaagtggaaactagtgtgagacaatcatgaatagaaaagtgcagaaggaatttgatgaggatgttcccagggctatttctagccagaaaacgaagct

SEQ ID NO: 9391 - DNA, 201 bp, Homo sapiens
taaagataggtcattccaagagtgagcctcccattattatgactcatgacaaaggggtgtgggactggttggaaaagagtttccaaagctggactgcatcrcatggtcatgtggaatgggctgcctgctctcccagtctgaaccctacctctgtgctatgccaaaggtgcagatccccttagtgaaaattggagacatgaa

SEQ ID NO: 9392 - DNA, 201 bp, Homo sapiens
ctatcatatgttgtaatatcaagaaaccttttagcatgtacatttgtctaggtttctggactttacagccttctggtatttcacttgcttgtgtctttcaytgaacactaataaccagaaatcagcaacgtgaaaatttgattcttcttcctatttttctcatgccttcctttggtctttctttctgcttggtggaaactg

SEQ ID NO: 9393 - DNA, 201 bp, Homo sapiens
ccttctggtatttcacttgcttgtgtctttcactgaacactaataaccagaaatcagcaacgtgaaaatttgattcttcttcctatttttctcatgccttmctttggtctttctttctgcttggtggaaactgtggagttcagtggaagttttcctgcagtctaattagcccctctgtttaattttgtaataaaaacgctg

SEQ ID NO: 9394 - DNA, 201 bp, Homo sapiens
tgaacactaataaccagaaatcagcaacgtgaaaatttgattcttcttcctatttttctcatgccttcctttggtctttctttctgcttggtggaaactgyggagttcagtggaagttttcctgcagtctaattagcccctctgtttaattttgtaataaaaacgctgaaccagaagctggagataatgtgcccaattcaa

SEQ ID NO: 9395 - DNA, 201 bp, Homo sapiens
caaatatcctgaattttatactctcactgattttactttctaaacaaggaatatatacgtattgtagaaaaaaatcactgtgaagtaaattccacccgtgmtccaaccctccagagaaaatcgtgcataaaaggtcccgcagattcccacctgtctttctttccttccttatctaccaatattttttcacatgcatgcaac

SEQ ID NO: 9396 - DNA, 201 bp, Homo sapiens
cattatgcagttcctaaagagaatgcattccacagcattcattaattatgccagcctgtagatgcacaactaccacggcatacacttgagaccacacaccrtaaggattgaaactctctcaaagccacaatgtatgtctgtgttgctttgcactcttacattgcccatcctttacaacagcccttctcctgtccttctgat

SEQ ID NO: 9397 - DNA, 201 bp, Homo sapiens
tcctcaaagattcctcaagggaccctgtggaaaaatgaaaacaagagaggctatcaaggggtgcaagtaagaggtgcagtgttgagttataataatctaartgtccttcctaaatggctgaaagtatattgcagtagaaaagtattaaaatgtgtatgtgtcccaaaaaagaggcaaaatgtaatggagatcatgtcctct

SEQ ID NO: 9398 - DNA, 201 bp, Homo sapiens
attgaaaataagtaagtcaaaaccaaaaccaggaaagtttgcattcattcccaatcatactttaacagaacttgcagctgccacagattcagacatcttcrtcttcctgtggagcatttgtcttttcatagcagaggacaatctctgtgactttcttatatcactgagaccatcttgtacagtttatttcaacagcaagag

SEQ ID NO: 9399 - DNA, 201 bp, Homo sapiens
atttgtcttttcatagcagaggacaatctctgtgactttcttatatcactgagaccatcttgtacagtttatttcaacagcaagagtgttctttttcgttycatgccaccagtgacaatacgaaaccagatctaactgaaacttcactcaacacattcccgacccgccaccccaaccctaatagcctctcataaccaccgt

SEQ ID NO: 9400 - DNA, 201 bp, Homo sapiens
caaactcacccaggtggtgatggctgccatttgccgaacatttatgacatactccccacttcatgggcagcatcctacttagtcttgaaaccacccattargacagcgttggtcttattcccatttttttagattaggaacagtctatgggagtgtagcttagtttgggaaatgctggtattcaacccagaaccatctgac

SEQ ID NO: 9401 - DNA, 201 bp, Homo sapiens
ggagcttggactaatgctaaaattaaacataaccacccagaagacaaagagaccagatagaaatacataaaacatttgaggtggtgggaacacatggacayagggcacatagaaacttgcccccaaaacattaggttaatacatagctcaaggttatttataaaggaattaacatacacaaaggagctttttataattata

SEQ ID NO: 9402 - DNA, 201 bp, Homo sapiens
tttagataggccctgttgatacgaccaagctaaccttcatcctgaaatcaattcatactcaggatgacaggaaatgagttgtcattaaggctcatattctrtttttgagtccttagttaacctcttataattcagtttatttttcctcctccatttctgtaaaatggcaggtaatttaatgacatagattattacttccta

SEQ ID NO: 9403 - DNA, 201 bp, Homo sapiens
catcttacattgataccattactatcactttccgctaatattgattgacaaaataccaggtaccagacactgtgcaagaactttgtttacactgtcttatratgagctcatgaccactcagtgaggtagtcactattaatatcctcattttataattggggcaactaaagtttgaagaagctaaagcattttcccaagata

SEQ ID NO: 9404 - DNA, 201 bp, Homo sapiens
atcccccaacctgctccttacagagtgatccttgtctcagtaattccaacatccatcagttgtgtgatccaaaaacttagaactcatacctccctttcctyatgcccacagtttgttcatacaaagttctatagaatctacctcccgaatacattcaaaattagaccacttctcactgcaactcaataccatgctcctcac

SEQ ID NO: 9405 - DNA, 201 bp, Homo sapiens
cttgtctcagtaattccaacatccatcagttgtgtgatccaaaaacttagaactcatacctccctttcctcatgcccacagtttgttcatacaaagttctrtagaatctacctcccgaatacattcaaaattagaccacttctcactgcaactcaataccatgctcctcacttccatctctactactcgaagccactcgag

SEQ ID NO: 9406 - DNA, 201 bp, Homo sapiens
gttttgaccagcacatcaagagtggctttacctcccaggcattgatccagcattagtcaagctacaagacactgatgtagaaaaccataatgtcagtttamtaatgtagaataagaaataaaatctcagaagacctgagctctcctgtcagcatgacttgcacttgtacttttcctttttgtagagaagctaaattataat

SEQ ID NO: 9407 - DNA, 201 bp, Homo sapiens
aggcctggcacagataagcactgagcaaatgttagttttctttcacatgggtcattaaagtccgtctgtaaagtctcagggactttctcatcattttcccyaaacctaatgcaagatattcacatttctttttgtgcaaagaacaatcttaattcagctgataatcggggcctcccttaccttcccactgctcactataac

SEQ ID NO: 9408 - DNA, 201 bp, Homo sapiens
tgtaaagtctcagggactttctcatcattttccctaaacctaatgcaagatattcacatttctttttgtgcaaagaacaatcttaattcagctgataatcrgggcctcccttaccttcccactgctcactataacagagaacaagtactagctcataactttttatgactttgtattgaattaaaattataatgctttatt

SEQ ID NO: 9409 - DNA, 201 bp, Homo sapiens
taaaaacaagcagatacacacagtaatatcgtatagtcatagaactatgaaatgttaaagcaaggaaacacaatagtgactataagggtcaaacaccattrtagagaggaaaatcagggaggaccacttgggttgggtgatatttaagctgagatttgaatgaagaatggaagccattcttgtgaaagatctgggtgattg

SEQ ID NO: 9410 - DNA, 201 bp, Homo sapiens
catccctgatagtgatacgaattattgcttttttaaattgtgccagctgagaagtgtaaagtgatatttcattgttattttaatttgcatttctcggactrttagtgaatctgagcatttttgcatttgtttgtaggccatttagctgagcacttctgtaaatgggctattcatgacttcttgtttctacaatggagatat

SEQ ID NO: 9411 - DNA, 201 bp, Homo sapiens
gaattattgcttttttaaattgtgccagctgagaagtgtaaagtgatatttcattgttattttaatttgcatttctcggactattagtgaatctgagcatytttgcatttgtttgtaggccatttagctgagcacttctgtaaatgggctattcatgacttcttgtttctacaatggagatatttgtctttttcttgtctt

SEQ ID NO: 9412 - DNA, 201 bp, Homo sapiens
ggtcacagaggaggtcaagtggtgaatgtgggatttgaactctgggaatctggcactgaaatccactcttattatagttcctcttatttgttaggccaggmctatttatgaaaaaagccactcttttcccactgaattacattacttttcttgtcatttattaaattctcacatataccagagtttatttctcgattgtct

SEQ ID NO: 9413 - DNA, 201 bp, Homo sapiens
ggatttgaactctgggaatctggcactgaaatccactcttattatagttcctcttatttgttaggccaggactatttatgaaaaaagccactcttttcccmctgaattacattacttttcttgtcatttattaaattctcacatataccagagtttatttctcgattgtctgtctgctccctgatcttttcatctattcct

SEQ ID NO: 9414 - DNA, 201 bp, Homo sapiens
gtcactgctgtaagatccctgagcatggtccagtaaaggcttttcaggtcctatctaggcttcctgggacatgcagactgatacacagcttcaatctttgyatgtcagggggtgctgaggagagcagggcataccaactcagttcaagtgctcttcacagaattcctcttcttcagtctttaaaatgcacacggatgacct

SEQ ID NO: 9415 - DNA, 201 bp, Homo sapiens
atgcctccaacaccctgcaatgctatgtctttccaagagcttaagagaggctgattatatttgaatagtaaggttacatttatttcatgtctcattgtgamtactagttccaacttttagtcataaccaattattagagaagagtcagagttttaatagcattattatgtatgctttgtgttttagtgcacttcccaggag

SEQ ID NO: 9416 - DNA, 201 bp, Homo sapiens
ggacaataatattagctatgggcatgaaaagtacaaaaagaacccataatcaggttcatttatatatgcatgcatattttaaagctaggtgcttttcctastgcagagatgtagatagcggtttcaacaaacagatttacgaaatcatgagtgtgtttagtcacaattttgggaggtacctggaactcttttcccagagaa

SEQ ID NO: 9417 - DNA, 201 bp, Homo sapiens
cagtggttgacaacaaatgagagaactctcgtgggtctcacaccagcaactaaatgcatggctcaggaatgatactcaatttatcagttaacactgttctyttggcccaacccatcacaacgagacccaaaagtcctctcttactacaaccctataatggaggagaactaggaaagtgtggtaaacagtgccgctcattat

SEQ ID NO: 9418 - DNA, 201 bp, Homo sapiens
agcctcaaacacttggtgctataaagcaaccaagctttgtttctcagccatctgcatgtccgtagcaagttggcttattgccatcctcactcaatgacccrgaatgacaaagaagccgctaccaggagtttgctgggtgcagtggttgacaacaaatgagagaactctcgtgggtctcacaccagcaactaaatgcatggc

SEQ ID NO: 9419 - DNA, 201 bp, Homo sapiens
ttaaaatactcacaattaggctaagtggacagataagttaggcctacataaaatatgtaatatgtaacacatgtatttctgttatagaaataactcaattrtaacatgtaaaagctgtgattgtcgaaaatgcatggattttagagtcagacctggattctatttttccataagtctcttattgtgtgaattctcttgtaa

SEQ ID NO: 9420 - DNA, 201 bp, Homo sapiens
taaaccagcatgacattggggtctgtgaatgagaagtggatgttccgagtagatttgaaggacgtgatgactcaggatgccagttgtgactggtgacttasagccgtggtagctttgacttgcatcttatttacttgcatcggctgtcttgtccttccttgcttctcgccttttcaggtcatggttcctgatgtcctaagc

SEQ ID NO: 9421 - DNA, 201 bp, Homo sapiens
atcaaatatttaaaaattcacacgtgcgtgctcatggctgtgcactcatgtgcatgtgtgcctgttgtgtgcgtgcatatataccatacagaaaagtactstctggagaatacattagactatgcatgtaaatgtgtgtagaatgtttttcttttttttcatgcaatacatgctctatggatatttgttaagtgactgaag

SEQ ID NO: 9422 - DNA, 201 bp, Homo sapiens
acgtgtgtaaagttgttttcagctctgtacacctgtgcacactggccaggaaagctggaccttctgcagagaaaactgtcttctccagataggaaagtgtrcctcattgagctttgggctaggccagagctagaagatctttcctgtgtttgggtcattcctagatcagtgatccctaatgaccagttccattccctaaag

SEQ ID NO: 9423 - DNA, 201 bp, Homo sapiens
tgaggttcagagaggttgctacttatatggtagcaaaagtatttcccttccctacttaccctactatacaaaacaaacaaacaaacaaacaaacaaaaaamcagaaaacttgatgataaatgtcaatcaacactcagcctctgcatctgatgagcaacagaaattagcggggactgtggtgaattggaaaacctgtgcctt

SEQ ID NO: 9424 - DNA, 201 bp, Homo sapiens
aaaatttaaagagatattggacagattagcaattatgacttttttaaacttttattttaggttcatgtgaagttttgatatataggtaaactcatgtcacygggctttgctctacagatattttatcacctgtgtatgtaagccttgtacccaatagttatttttttctgctcctctccttcctcctaccctctaccctca

SEQ ID NO: 9425 - DNA, 201 bp, Homo sapiens
actaagctacttattggaaggtgggtgattaggatgtagcataggggtaagactgtgtaaccagctgacactgctttaaatgataaagcattgagttgttytgttttaatggtacacaagtcaaaattgttcaaggattgagagtggagccagaaagcctgggtgtaaatcctggctccttcacttacaagctgcgtgatt

SEQ ID NO: 9426 - DNA, 201 bp, Homo sapiens
ttcactagtgagaaagctaaagctcagaaaggataaatgacttgactaagctacttattggaaggtgggtgattaggatgtagcataggggtaagactgtrtaaccagctgacactgctttaaatgataaagcattgagttgttctgttttaatggtacacaagtcaaaattgttcaaggattgagagtggagccagaaag

SEQ ID NO: 9427 - DNA, 201 bp, Homo sapiens
gggatgagccaactggcctgttttaacctatattacttgagttttggctaccaaaactctaagcattcacatgggcccccacgaagctctgccatctgacmctttcagcaccttcaactctatccagtctcactcctgctgtactaacaaacattccataaacacaaaaccaaaaccacttaaaaaaaaaaatcttaggct

SEQ ID NO: 9428 - DNA, 201 bp, Homo sapiens
tgatgtcaccactgggtggacctctatggcacctgtctcactctgccttggttccagttatttttgtatatgcttcattgattatttctactcacttcccrgaaatgttccctttccctgagaaatggagttgtatctccctcattgatgcatcctctgtaacatctagctgtttaatgtgtcactcagaataagtgctca

SEQ ID NO: 9429 - DNA, 201 bp, Homo sapiens
agggaattcaggacagagggagcagaaggctctaacgtggaaacaagaaggccagagtacccagagcagaatgagaaggggattcctaatcaggaaggaaycatatgtggttgttcactgagagcaatcattgacagtctcacccatgttctacaaaatttcacttcatgattaaaacaaattatatctctgtctttgcct

SEQ ID NO: 9430 - DNA, 201 bp, Homo sapiens
cttgctaaaaattacaaagtgtttatggcagttctggcaaatatcctctagatcaccagataatgccaagtcagcaatattatcaataatgagttgcctaytaagaaccaggggaatgggggcatggactgaaactttaccatagacatctttgctattctggactgttggtttgcttcctagtgtacttctgcttatcct

SEQ ID NO: 9431 - DNA, 201 bp, Homo sapiens
gccttagttaaatcctctatcaatatgacaggttaaaaaaaagacatatgagttagttaaaagcacctctcccttggtaactctaagtgttttagtttttmagatggcaatttgtgactttctatagctttttcttgagatgaatttgtggaccagttgaatagtgatagaaatacaggacttgctaaaaattacaaagtg

SEQ ID NO: 9432 - DNA, 201 bp, Homo sapiens
tacagtattatttctatcccaatcatgtttaaggattattattttacatagaaataaataaagaaaggggaaccaatacaaagtgttagaaagacagctaygattaatatattggactggcccattatcagaccctctagattttacaggtagctttctgatcagaaatctcgggtgagaaatagtaagaatgatggcctt

SEQ ID NO: 9433 - DNA, 201 bp, Homo sapiens
agcagcatatgaacacatgtttaccctccttggccacactttgtcttactctatgttttctaggaacacattttggggtggaaatgcctttattccatttmtatttagtcaattatctggtttagcttccattcttacaacctaattaaattcagcccatcaactcagtttaaggcatagcagctgtagacacttcgttta

SEQ ID NO: 9434 - DNA, 201 bp, Homo sapiens
tttgagaagtgtccgttcatattctttgcctatttttaatggagttatttgatttttgtgttgaattgtttaagtttcttacggattctagatattaggtrtattttaaatgcatagtttacaaatattttctcccattctctaggttatctgcttactctattgatagtttcttttgctgtgcaaaaagtctttagttta

SEQ ID NO: 9435 - DNA, 201 bp, Homo sapiens
ggctgcatgtatgtcttcttttgagaagtgtccgttcatattctttgcctatttttaatggagttatttgatttttgtgttgaattgtttaagtttcttayggattctagatattaggtgtattttaaatgcatagtttacaaatattttctcccattctctaggttatctgcttactctattgatagtttcttttgctgt

SEQ ID NO: 9436 - DNA, 201 bp, Homo sapiens
tgatcactttttcatgtaattgttggctgcatgtatgtcttcttttgagaagtgtccgttcatattctttgcctatttttaatggagttatttgatttttktgttgaattgtttaagtttcttacggattctagatattaggtgtattttaaatgcatagtttacaaatattttctcccattctctaggttatctgcttac

SEQ ID NO: 9437 - DNA, 201 bp, Homo sapiens
ctaatgtacattctcaccaacagtgtagctttccctttcctctgcaacctttccaacatctgtttttttgtttgtttgtttttcactttttagtaatagcygttctgactggtgtgagatgatatctcattgcagttttggtttgcatttctctaactagtgatattgatcactttttcatgtaattgttggctgcatgta

SEQ ID NO: 9438 - DNA, 201 bp, Homo sapiens
ctgatgagtctttccctaacgagaatgtgactaaaaccagttgagtttgcgaaagggatgtagaaagagacaattaggtaaaggtgaaaaatgagactgaygaagtgacgttggtcaatctcctgtttactgagtgcaggttaggaaataacatcaactaggttttctggaatttgagaactgagtattataaaaacactg

SEQ ID NO: 9439 - DNA, 201 bp, Homo sapiens
aagtcaacctttcattttagcttagcaggaaacacactaaaccacggctgaaatatgccaggaagttggtagctggtgatgcctctaccacaccgcagtgyggttaatccagcattcgacttagtcgaaatcacttttttcttccaatactggcatttttatggatggatggatggatagatgaatatcagtatcaaaagg

SEQ ID NO: 9440 - DNA, 201 bp, Homo sapiens
gaagtctcagatgaaatttctgaatcagccttaaactataatgcttaaactgtttaaatgtgaagggataaaatttggggcatttatgccactattttatkttatcgttgttacagtgagtacaatttttaattggtatgtgtgtaagatttgctcagatctcaatcaatggttctaagaggaaaaagcttaattccaagc

SEQ ID NO: 9441 - DNA, 201 bp, Homo sapiens
agttgtgtgagattgggaaagttgcacttgtttaatctgtaaaatggaaaatatctgaggattaaattaaaatatagctggatcatgcatagcataatacwtggaatatactaagtcatgaataaatagtactgttgtcatttctttgacattaattattaaggcaattaggaaattttccatctagttaacatatagcaa

SEQ ID NO: 9442 - DNA, 201 bp, Homo sapiens
tcattacttgttagaaagtaatgtgaagcacttaataaacttcaggtggtggtattaggtaattaacatgtgaaattcctcatatggttatttaaatttcrtggtagtatttaacagttttcatgtttatggccttttcctgcaactaagttgtaaaatccttaagggaaaggatgaggaaaggaagacaagagagaaact

SEQ ID NO: 9443 - DNA, 201 bp, Homo sapiens
tccaaaagcggtaggattacaggcatgagccactgctcccggactttttttttttttaatccttctactttactcatactctccaaagttaattcacacamaacctccccaataaaatggaagtgaggtttaaaatcagaccataatttaaccagctgaccaaatgccattttgtataagaagataaaaagctaccattgt

SEQ ID NO: 9444 - DNA, 201 bp, Homo sapiens
tacgtgcccacacaatctctttactgtggtatttggtagctaatacatctttcaagcctcatctacttcatcgcctcctgcaccccaagctggaattacaygtgtcttattgccctgtccctgcatatcttctggccttatagacctctgtgcctttatctatgtcgttccttctacctcaacaggtttctgtcctaccat

SEQ ID NO: 9445 - DNA, 201 bp, Homo sapiens
cgagacttttataaaaagtctgaattcattacctgtattaaattttctttgatttaaaacactgatcaggctaaatacaacatacctgtaagatattacayacctactgcaagaaccctgcctctgcatataaaggagaaagataagcacagttgattctcttcacaagccctgtgtcatgcaaacaggattaatagccca

SEQ ID NO: 9446 - DNA, 201 bp, Homo sapiens
cacggtcttcattctgaagtaaccttagaagtcactttcagttcataacattaaagcacaggttacaactcatatgactacatgggccatataaaataaaygagtcaatgtgccgaagatcaggaaagtgatagctcaggcaagactgacactaattcttggcctctctgtctaagagacagaagagagtgctagagacta

SEQ ID NO: 9447 - DNA, 201 bp, Homo sapiens
tactttggctagaagcctaagcagaatctcttctacttccctcaaaatctatttcttagcaccagcaagactgggtctgtccagtgggttgtgggtttggrgagaagcagaggaaagattgacatcatgtggaatctggaagagacagaacacatctcttggtgcttttgaaggtacagtgactccatctagtagtaaaag

SEQ ID NO: 9448 - DNA, 201 bp, Homo sapiens
actatcgtctttgcagtatagtatcgttggtgcagaggatttgggatagaaatccagtctgggggccgagatgtgatcattatgtgcaatatcatcttcaraaagtcaggtcatggttatcagtttgctacaaagaacatcttagtctcatttcctgtccaaggcaggaattttcccctgaacattcctgacagaagataa

SEQ ID NO: 9449 - DNA, 201 bp, Homo sapiens
aagtgtgacactgatttcagtacaatacatctagagggaataatttttctctaaattcccaggtggctaaaaagagggctctgtggatagatgtggaaagsgtgagacagatgcttctctgagcctcgggtttctcatcttaaaatagagataattacagtacctacctcacaaggttgtggggatttgttgggaggatct

SEQ ID NO: 9450 - DNA, 201 bp, Homo sapiens
aggaatgaccaaattgaataactcaagttttctttcttttgtcattacaatcagtgtgctatcactttttattttaaatgttggtttaagcaaatgtgtaygtatgtgtgagatatatatatatttcatatatatatatatatataatatatatataatttcagcattaaggagacattgtgcccacataaagtgataatg

SEQ ID NO: 9451 - DNA, 201 bp, Homo sapiens
tgagtcctgaggatggttatattatcatgacaaatcttgcttattgtttttaattagacaaaattttcaaataactgtgagttattacatatctcttttaktatagtgttctatagattgtattttgtttcattacccacactacacacacaaaccacatatacacatgcacaacacacacacattctttctatacttcat

SEQ ID NO: 9452 - DNA, 201 bp, Homo sapiens
taacccattttatcagttgtgctgtcttccactgctgttctctatattccatcagaggaaacaaatggcttctattgtgcataagaatgccatttagtccmaagcaccatttgaaatggaaatgaggagtaacagtaacagaagaacattggctaataattgtgctctgaatagccatttggccatgtgggcagggtaaag

SEQ ID NO: 9453 - DNA, 201 bp, Homo sapiens
tttcaattcttcataaaacatggaaaaaactttggagactgaataagatctatggtaatccacaatagatgaggccctgaacacaacatagggaaaacatrtaacccacccccaataagctcaacttactgtaaactcttgaggagtaattagggacttcagcagtctctctgaaaaagccaacgcattgtaaaacccttt

SEQ ID NO: 9454 - DNA, 201 bp, Homo sapiens
tcccaggttcaagggattctcctgcctcagcctcccgaatagctgggactacatgcacaccccaccacaccaagctaatttttttattttttagtagagaygaggtttcaccatattggccaggatggtcttgatctcttgacctcatgatccacccgcctcagccttccaaagtgctgggattacaggcatgagccacca

SEQ ID NO: 9455 - DNA, 201 bp, Homo sapiens
gtaaaatggggggaattcctgaaggacagtgttaggatgaaatcacattacttataatgtcgaattcctctgtcaatgcttatatgcttctcattcattawttctaagtcaagcatttttaaagcatttaacatgcaattattcatttttgtttataaagtgaccctgtgaacttatccctattttacagttgatgaatct

SEQ ID NO: 9456 - DNA, 201 bp, Homo sapiens
ggattatggaaggttttgtctaccatgcaaagaagctaggattttattctgaaggtgaaggtgaagggtctatattaagacagttagatttgcattttttmaacaatttaaaaaagatttatgtttcagaaaaatcaccctggtaacaatgtagaggtggaaacatgaggcagggagctcattaatgacctgtatgagaag

SEQ ID NO: 9457 - DNA, 201 bp, Homo sapiens
actgcagcctggacaacaagagcggaacttcatctcaaaaaaaaaaaaaaattgttagaaaagggttctctgggaggctggagaaagagccctgaatgcargctaggatgaccaggaaagattgctgagcccaatgctgaaggacaaatagtaaggggagggggaaagggcacccccacaaaagcatgtaggagttggggc

SEQ ID NO: 9458 - DNA, 201 bp, Homo sapiens
tactgagcactaattatggcatggggaaagtgccttaggacacctagctcctgccaacttgaagctccaaatctccctagggagaaggcagttagagagtrgtatggtaactattgaaattgttagaagagggatggggcatggtggctcacgcctgtaatcccaatactttgggaagctgaggcaggtggatcacctgat

SEQ ID NO: 9459 - DNA, 201 bp, Homo sapiens
aaggctgcgtatcattctttggggccatgcttctcaaagtgtggtccccggaccaacagcatctgtatcacttgggaacctactggaaatgcagaatctcrggccagcaccctagacctgttgaattagaaactctgggggcggaatccacctctctgtgttttcatgagctctgtgggtgactgtagcaccacgacttta

SEQ ID NO: 9460 - DNA, 201 bp, Homo sapiens
aatcaggagtccttggttgtattttgagagctgctgcaggctggctgtgtacttagtatatcagaagctcgtgatttcctcaccattgaaagggagataarattgcccaacctccctggctcaaaaggttggataataagaagtgagagaagggaaatacaaagaagagtggagtcgttgcagaagggtttgtggaggggg

SEQ ID NO: 9461 - DNA, 201 bp, Homo sapiens
gagagccttgcactgtagagaattgtgttgggagggtatgaatcaggtaagtcaggagaaaagggaattgtgagatgtctagggaatgggataagggaggrcatgcacatgcgcatgtgtgtgtgtacatgtgtgtgcctgtgtgtgggtacatgcctgtggcccacacttggggggcagctgttacatttgctgcttagg

SEQ ID NO: 9462 - DNA, 201 bp, Homo sapiens
tgggcatgcccactgactcacaacacatgctcattaatacagctgagcaggcatcctcccttcctcctgcacgtgaggcacatacacagaaagccgggctrccactggcattcaggatgggggagctgctgctctgacgtggctgctttcgtttgagacttcttgggggcactttgataaccaaatctgaaatggacactg

SEQ ID NO: 9463 - DNA, 201 bp, Homo sapiens
aggtctctctcacacatccagggccttagtgttgactggaggctgagacccttggttctcctccatgtggcttctcgtcttccagggtctcttcttgcggytcctcaaaccagaaagatggcctgggtttcctgatagcatgttggctgggttctaaaagaatgaaaatagaaattgttaggcttcttcagggcaagacct

SEQ ID NO: 9464 - DNA, 201 bp, Homo sapiens
aaatatctttaggcagccatgttgaccccagaaattagtgccagggactttcttaaagaggattctaagattttctggaattcctgaagaaaagtagatgrggagcactgagaagaagaagtacgtctcaggtcacccagttaaatttgaatttcagtgctccttctccttttcagtgacacaaagggagacagaaagaga

SEQ ID NO: 9465 - DNA, 201 bp, Homo sapiens
tatatactccacaggtcttaagtggacatcctctgctcattgtttgatagatgaggagagtaagtgcctctagaggttgagtgactcatctgagatgattsttagtaacagaggtgcaatgggtggggtgtcttttcagctcccagcatgttcaaagggtcagtatccacatatgaccacccccagggttccctcttatct

SEQ ID NO: 9466 - DNA, 201 bp, Homo sapiens
tgtgatataattttctggacctaggttctggccctactgtgtatcagtctcttgagctatggggggcctctccctggttccagggctcagcttcttcatcygtgaaatgaggctggatttggagctcttgaaggtccctcctcggggtgacactccatggttctcagagatgtcccaaggaaaggccatggttacatcatg

SEQ ID NO: 9467 - DNA, 201 bp, Homo sapiens
gagaaggattagacattctagacaagtatgaatgtgtgttttttttttcaggggtggggtggggccagagaaaattggattctgagaagcaaggaagtctyacctttagccaagaccttgaagcagagcatgaatgcatttctgcatgaccttgagatggtgtagccagacgccctggtgtggggagacagtgtctgttta

SEQ ID NO: 9468 - DNA, 201 bp, Homo sapiens
gtttgtcgattggaggaaagaaccacatgggtttagtgttggagttttcttctctagcacttggggcctgtcttctgggaagggtggactttgcctctggytgtcttagccctgcctgaatgtctagatctgctggaggaattgcaacatgctcaacttcagtagtttagtagaaagggcttctctatccctggctcagat

SEQ ID NO: 9469 - DNA, 201 bp, Homo sapiens
tctagtgaaataataatttaaaaaaaattgcttcttgagaagaggagggggcagaaattaaagggattctagattttgagagacagctacgtctttgcttstctggtagttccctattattaattattggggttttgacggcgttctggcctccgtttttgttgatttcattttagtgctgcgtttctcctgactatgttg

SEQ ID NO: 9470 - DNA, 201 bp, Homo sapiens
agccaggctttctgcccagcagcaggaaggctggggtgtccatgtttgttgcatgtcccagggtatgtgcatgtggagtctgacatgtgagcaagcgtgcrgcccctgtcactcctttttccactcaaggattaagattgtattgcatttgggattttaactttgtcttctttctttttttccttacccttccccactcct

SEQ ID NO: 9471 - DNA, 201 bp, Homo sapiens
aggctttctgcccagcagcaggaaggctggggtgtccatgtttgttgcatgtcccagggtatgtgcatgtggagtctgacatgtgagcaagcgtgcggccyctgtcactcctttttccactcaaggattaagattgtattgcatttgggattttaactttgtcttctttctttttttccttacccttccccactcctcttc

SEQ ID NO: 9472 - DNA, 201 bp, Homo sapiens; identical to SEQ ID NO: 1316

SEQ ID NO: 9473 - DNA, 201 bp, Homo sapiens; identical to SEQ ID NO: 1318

SEQ ID NO: 9474 - DNA, 201 bp, Homo sapiens
ccaccccacctgtgactgttctaccactggctatggtggcaagctctgctcagaaggtaagaccctctccctctcttgctagagacccacccacgggatgrctgaggctggggctcctgatacaaaccagttctatatggatgcatatctttagctgcatgttagatcactgggccccttgccctaaggaggcagtggaaa

SEQ ID NO: 9475 - DNA, 201 bp, Homo sapiens; identical to SEQ ID NO: 1326

SEQ ID NO: 9476 - DNA, 201 bp, Homo sapiens
tcacttttcagtggtgatttttctcatgactgtcaccaaattccagaacactgagtgaagtacacattcatgatttttttgtatgagaagataagtcatcyctttaggacttgatccagtatagggagcttctggagactttaccaactatgcactggacactttttgtcaacctttgactgatacagcctgactggctca

SEQ ID NO: 9477 - DNA, 201 bp, Homo sapiens
atcttctccattcttctttggcagaggcatccatcctgagctatgatggtagcatgtacatgaagatcatcatgcccatggtcatgcatactgaggcagargatgtgtccttccgcttcatgtcccagcgagcttatgggctgctggtggctacgacctccagggactctgccgacaccctgcgtctggagctggatgggg

SEQ ID NO: 9478 - DNA, 201 bp, Homo sapiens
tagtggtgatggcaatgacttcattgcagtcgagcttgtcaaggggtaagtagaagggatcacgacttatgttggacacctttaatctactgaagctctaygtaaaatatggacataaaaataacttgtctattctactccctaccctccattcctgacacattctcgcatcttccttgattaaatggatccataaaatta

SEQ ID NO: 9479 - DNA, 201 bp, Homo sapiens
ccaatattaaaatcaatggaagtgttcggctggttggagaagtcccatcaattttgggaacaacacagacgacctccatgccaccagaaatgtctactacygtcatggaaaccactactacaatggcgactaccacaacccgtaagaatcgctctacagccagcattcaggtaggcctttttccaagtattaattgcgtct

SEQ ID NO: 9480 - DNA, 201 bp, Homo sapiens
cttacattgttctctcctggccagccaatggctgggctcagcactcacctgttaggtttctttcatttggttaagcaactggcagactcacctgagatctrtcttcccaccccaggtactatatcagtgaacagcaggcgcacgccattcaccgccagtggggagagcgagatcctggacctggaaggagacatgtacctg

SEQ ID NO: 9481 - DNA, 201 bp, Homo sapiens
tttgggcttgtcttccctttcttttctgattttcattggtttgattgaattctttgtttgtttcttgaaagttagctgctcacctcttgtttaacagaccyaggataaaacccaacagcagcgatcaccttctccttgtttctgcatgaggttttgatgtcaatttctggtttctgacagtggtgatttctttactagatt

SEQ ID NO: 9482 - DNA, 201 bp, Homo sapiens
ccaggacttggtgacttcctccagcttcacatagtgagtacagggccttggcctggattttcttatgttactggtggtctgagttagtgattcaggtagaygcagcagaacattctagatcaatatggcaaaggtgcacatgcttataaaaattgttttcagatgtgaaccatcatatttacagggttcctgggggaaaaa

SEQ ID NO: 9483 - DNA, 201 bp, Homo sapiens
aaaacaatacatacatatatgtgattatacatgtgttttatatatagattatagtgtgttaatgtgtgtatatttttatatctatatatgtataagtatayatatataaatattatatcaatgaaagcatcaaatcccatggaaagagcaataagatcctacaaaaattaagtcagtctcttgatagctaacaaaaaatca

SEQ ID NO: 9484 - DNA, 201 bp, Homo sapiens
ctttcttttttcttttgcaaaaaacaatacatacatatatgtgattatacatgtgttttatatatagattatagtgtgttaatgtgtgtatatttttatayctatatatgtataagtatacatatataaatattatatcaatgaaagcatcaaatcccatggaaagagcaataagatcctacaaaaattaagtcagtctct

SEQ ID NO: 9485 - DNA, 201 bp, Homo sapiens
ctggggctaagaagatggggggctgggtgagggtgaagggctgagtgtggttttgggtgtggtttctgaagtgagggcaggtcctctcttctttccttgcmtttgctctatatgaagaaaagaaggcaagggcacatgaataatgaaataatgaaaaatcaagttgaaatgatgatttattgtttttgggaggtaactctg

SEQ ID NO: 9486 - DNA, 201 bp, Homo sapiens
tatgagctgttttttatttgaattattttttcttttaacaatggagtgggggggacctggggctaagaagatggggggctgggtgagggtgaagggctgaktgtggttttgggtgtggtttctgaagtgagggcaggtcctctcttctttccttgcatttgctctatatgaagaaaagaaggcaagggcacatgaataatg

SEQ ID NO: 9487 - DNA, 201 bp, Homo sapiens
atgatcttgtttcatctgctgaatgttcaagtgatgatgaagactttgttgaatgtgagccgagtacaggtaggtcaggtcagtcttattttgcttgcttkcttttttcttttgcaaaaaacaatacatacatatatgtgattatacatgtgttttatatatagattatagtgtgttaatgtgtgtatatttttatatcta

SEQ ID NO: 9488 - DNA, 201 bp, Homo sapiens; identical to SEQ ID NO: 1319

SEQ ID NO: 9489 - DNA, 201 bp, Homo sapiens
atgagcactactttcagaattgattctaactttggcacttactaccatccttaggcaaaggaccagagaccttgtatgcagggcagaagctcaatgacaaygagtggcacaccgttcgggtggtgcggagaggaaaaagccttaagttaaccgtggatgatgatgtggctgagggtgagtatgactatggtgaaattcgtc

SEQ ID NO: 9490 - DNA, 201 bp, Homo sapiens
aacgtcagtactgaggttttgttgtctattttttcctccccttcaattgctcaaggaagcctgttatgatgcctggtccattcagaccaggtaaggcaaasaaggaaaacgtatgagaataataatgtttcctccacccaacccactaggccggcagttaaccatcttcaacactcaggcgcaaatagccattggtggaaa

SEQ ID NO: 9491 - DNA, 201 bp, Homo sapiens
cagcatgtaatttgggcaatgcctgattgaggccaagtaaggtatctaccatattgaatatttggttttcttgaactcacccaagaaagctgaatattctktgtggaaacaggttacacccaaaaaatatacttgagggtgctgtgataaatgatggtaacttttctgtttgtacctcatttacaattttcacaggtacaa

SEQ ID NO: 9492 - DNA, 201 bp, Homo sapiens
cagagctgtttctgtttgggaagtcaaggttacattgagtatagtcagtttataagccggtgtagcttctggtagagaagagggtctcactttgctgcagrgcttaattaaatgttattaatgatgtaatgagactgggtcaaagaagaagaatgtgtaagcaaaagccaaagacactgtggaaaaagtgaaactcaataa

SEQ ID NO: 9493 - DNA, 201 bp, Homo sapiens
tttttaatctttatgaaattgatttttgcataaagtactaaacaaaattacttatatttgctttccaaagtataaacttttccagcataagtaattcatcwtatccctcactgattttcaaggattcctgtattacacaagcttttgtatatatgaggttctctactatgttcagttaatctttcactgatgcttgtgtca

SEQ ID NO: 9494 - DNA, 201 bp, Homo sapiens
ggtgggagcaaagaaatgacaggttcaatccaaaatatctttgagttgttcagctaaccgtgggattgggtgaaggatttaggaaggctatgttttggatytgaaataaggggatttcaagactcctgtatttactacagaatattccaaacttttgcagctaccttgaaactatgaatcagccaataggaagaaggggcc

SEQ ID NO: 9495 - DNA, 201 bp, Homo sapiens
gtcaaattgatctagagttgtcagatgggataatttaaccctcaaatgaaggtgatttatcctatgtattgtaatcaaatagtcatctaagtcactccccrtgagctctggtaaatcacttttagtacatattgaaagtgaccgtattgtattttattgcagaattgcgtcttatagtaataactaatgcatgccattggc

SEQ ID NO: 9496 - DNA, 201 bp, Homo sapiens
ttagttgggaagttgggaccacaataagagtgctattgtaacacgtgtctactgataaaatggcaaattcattagcctagacaaggagtactatgatctgrtttcaaaaatgctgtatacttccacagtccagtttatgagggcatgagatatataactgaggtgcccccatgttacttcaattttagtttgactttgaat

SEQ ID NO: 9497 - DNA, 201 bp, Homo sapiens
tgctttcagataattttgatgagtctgattttacgcttttcagtttgtatgtctcatgatttgtccttaatagactgaagaagtcctagcccttataattraccagtgcctggtaggggaagggcagcagaaaaggactggattagaaccatctcaaatgcttctattctgattagtacttagggttggttggagagtaag

SEQ ID NO: 9498 - DNA, 201 bp, Homo sapiens
tttcagataattttgatgagtctgattttacgcttttcagtttgtatgtctcatgatttgtccttaatagactgaagaagtcctagcccttataattgacsagtgcctggtaggggaagggcagcagaaaaggactggattagaaccatctcaaatgcttctattctgattagtacttagggttggttggagagtaagaat

SEQ ID NO: 9499 - DNA, 201 bp, Homo sapiens
tacgcttttcagtttgtatgtctcatgatttgtccttaatagactgaagaagtcctagcccttataattgaccagtgcctggtaggggaagggcagcagaraaggactggattagaaccatctcaaatgcttctattctgattagtacttagggttggttggagagtaagaatagggactcagcctagttgaaggaaagcc

SEQ ID NO: 9500 - DNA, 201 bp, Homo sapiens
ggaaagcctgtatagtggtgagtctgagtgacaaaccagggagaagtaataagacaatttatttctatttttttatcctacacctgaaatgtaaacaaggrcacattaaatttttactggttagcattttttaagtaattatgtgctcaactatgtccttatatttgcattcttaccaatgtagactctgttatggaagta

SEQ ID NO: 9501 - DNA, 201 bp, Homo sapiens
cttagataggacagctaatctcttgcttctagagaaaggtatgaaaatatactgtgcttattatggggatgatggtatgctctctgaattgaaccttaccytttaacatgaaatttctaattgaaacaaagctgtgatgcctccagctttgttcttttggcttaggattgacttggcgatgcaggctcttttttggttcca

SEQ ID NO: 9502 - DNA, 201 bp, Homo sapiens
tgttgaattttgtcaaaggccttttctgcatctattgagataatcatgtggtttttgtctttggttctgtttatatgctggattacattgattgatttgcrtatattgaaccagccttgcatcccagggatgaagcccactcgatcatggtggataagctttttgatgcgctgctggattcggtttgccagtattttattg

SEQ ID NO: 9503 - DNA, 201 bp, Homo sapiens
atctgttttatctcatatatttatgtaatgttttattacttataaagtaccatcatgttcatcatattatatcatccttacaacagccctatgaagtacgwaatgctgatatcctgtccttatagtgtattatcaagaagtggcttcagaaaaatcaagtaatttgcccaaggtcagtcaggtctgacaccaaagccaatg

SEQ ID NO: 9504 - DNA, 201 bp, Homo sapiens
taccaatagtttcaatcttctaaacttctcccattcctctttactttctcaactgcatccacttaaatacatcttattgtttcagtcagccttggctgctrtaacagaatggcatagattgggtgacttaaaaacaacaaatatttattgctccccattctggagactaggaagtccaaggtcaaggtgccagtcaatttg

SEQ ID NO: 9505 - DNA, 201 bp, Homo sapiens
tatcttgatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacg

SEQ ID NO: 9506 - DNA, 201 bp, Homo sapiens
gatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacgcaaatc

SEQ ID NO: 9507 - DNA, 201 bp, Homo sapiens
tctggacttttctcacattcttctttttcttttcctccttctggttttcctccttctcttccttttacttcttcttgaataaaaaaataatagaagataasaaaggatcgtgaactagtactgtgactcagtcttgtagaatgtcagaattactactgatatggtttggctgtgttcccacgcaaatctcatcttgaatta

SEQ ID NO: 9508 - DNA, 201 bp, Homo sapiens
accaagggaatggtactaaaacgttcatgagaaattgtccccatgatccaatcacctcccaccaggccccatctccaacactggagattacaactgaacakgagatttgggtggggacacatccacaccatatcaccgtcttcactgccatagtgttactcttatctaattcattgcaatttcccttctgacaagtctttg

SEQ ID NO: 9509 - DNA, 201 bp, Homo sapiens
tgcctatttgtaggccaagactttgaatggcttgaaggctgttgtatctccacacctaactcagcattaattttctttaaaagcctatcagaagtatctgygctgttgggttgttccctaactgctagagtcccgctatatctgtttaagaattgtaagagcatctggaaacagcatgcaagacccccaaggtattgaggc

SEQ ID NO: 9510 - DNA, 201 bp, Homo sapiens
ttaaaagctgttcataggctcatagaaaaaaatcaatctctctctccatatgtgttatcattggccttgctagtgttgctgaagggtttgttgtgtttctrttaggaatttcaaagatttctaaattgatgttaaccacttgccttgagccaatatagaatctacaagtttgctgccagcaatgagcaggctctttaatgg

SEQ ID NO: 9511 - DNA, 201 bp, Homo sapiens
ggaggtagaactgaaaagcaacttctttctttgaacctgaaaatagaaaagctaagaaacaggagagggaaataaaagaagaatcagcccagagctatcayccaggcactgacaaatgttccttataaagtctctgattgttgtccctatacaatgcggtggtaggaacaagggagggggggtgaaaggtgacttgagtat

SEQ ID NO: 9512 - DNA, 201 bp, Homo sapiens
ccccatcagcgatctatatttttttaaattgttattagaaacatctcttatttaatctccatcatcacccaacaagctcagcaatgtgactttgtcttacrgatgaggaaactgggtgcagagtatttgtggctttccccaaaacctgcagtaagtgaacaactagaattatatccaagccttctgattcaaatgcagttg

SEQ ID NO: 9513 - DNA, 201 bp, Homo sapiens
aaatctctgcctggagtagtctagttagtaaggtttttcaacctattgacatttggggctggacacatctttgctgttggtgtgtaaggaagggggcgggktactgttttgcacattgcaggatgtttagcagcatccatgacttttaccccctggatgccactctcatgtttccacaagtgccaaataccctctggtcag

SEQ ID NO: 9514 - DNA, 201 bp, Homo sapiens
caggtggtgatggctgccatttgccgaacatttatgacatactccccacttcatgggcagcatcctacttagtcttgaaaccacccattaggacagcgttggtcttattcccatttttttagattaggaacagtctatgggagtgtagcttagtttgggaaatgctggtattcaacccagaaccatctgacttaagagtct

SEQ ID NO: 9515 - DNA, 201 bp, Homo sapiens
cttcaatttaaattttgcacaaggttgcagagtctctctagttatttaaagtctaaaaagaacactgagcttctttgagaaaggtggtacataaatatccwataataataatatatattcacatacagtatgtcatttatacttctataaagcagagaaggtaatgaaaggtgctctatactgtaaatcactcaatcgatt

SEQ ID NO: 9516 - DNA, 201 bp, Homo sapiens
tgatcatgggctagcaaaaaatttatattgcactttcaaacagcagaaacactgtaaaaacctttttactaactgctgttgcctttaatgtaatagaagtrttcccctatcctcatcaccggggtagctctgagtggagccatttctttatgcacttattcattcaccttcattcactattcaacaaacatttgttccaca

SEQ ID NO: 9517 - DNA, 201 bp, Homo sapiens
ctttattttttgaattgtcttatctgtttggaataaagagagcaagagtatctctaagtggatgggttaaatccctagagagacagagaatagtactaccrtgtagggtgacatagacctactggtgaggttaattcaggataaagaaataaagagatacaatatgtaagaaggacaggcactccatttacgtatagttaa

SEQ ID NO: 9518 - DNA, 201 bp, Homo sapiens
ggcactggatctctagaatcggtaaaaataaaggcaatatattgttctcagggagcaattgagctctcctagaggaggcaaaccaagtgaaatctaatagytttgcttcattctgtgactttcccccgctatgacctcagaattttgagctacaagtaggtctataaagggaattttggaatactcttaatagatctgttc

SEQ ID NO: 9519 - DNA, 201 bp, Homo sapiens
aaagtgtgcctcattgagctttgggctaggccagagctagaagatctttcctgtgtttgggtcattcctagatcagtgatccctaatgaccagttccattycctaaagctaatgttgactctagatctttctgacatttgattcatgctggaatccatagtttgttttgagtcaggtctataatagattcatattcctgag

SEQ ID NO: 9520 - DNA, 201 bp, Homo sapiens
ttcgctcagaaataattaacaggagccagtcagaatagaaaactagtctgggaaaagtgtcctaaattttacactgtataataggatggatctcttaaackcgggactgatatataaaacttctccagtgtttcatttgaccaaaaattggcacacatttagctagatttaaaaaagaatatggtgatggctgagaactaa

SEQ ID NO: 9521 - DNA, 201 bp, Homo sapiens
gggtcagtcttgaacaggcaaagagcactttgtggagtgaatgatggcaactggaatgaaggagactcatcatctctagccagtgtaattcagctttgcattttcagttttctctgatcctctttttatttgtaagcactggcataataacaccactggagagataagatgagaactattatagaggttatcattgtgaag

SEQ ID NO: 9522 - DNA, 201 bp, Homo sapiens
ttttcagaattaaatgtatgtgagctaggtaatggtaagtgtattatctgttgccttcctttttccttttccttgagcagaagtatccagacagctctttrcatggctccacagtaacaatttggagttatatatgctgacagtgtcataagggcaattttatcgttttcaaaaggcttctaaaaacctggttagcatagt

SEQ ID NO: 9523 - DNA, 201 bp, Homo sapiens
tagatgaggaggattcataaagttctgatctctgggagatacttcagaagtgagtggggaaaaaaaggtagggaagactggatttcatattcaccaggccyattattcacttttttatctatatgtgaaatcatacatagaacattttccaaatgataccactgttctgtcctcttttgctaaatttaataacattgtcaa

SEQ ID NO: 9524 - DNA, 201 bp, Homo sapiens
tgagaaaagaacacaaaccaggttggtccgaggctacctagagaactttcttccaataggtgaatgagcaggtatgttacaggttcctcatttgatcctcycaccctatttgagttattctgaccacttgtacatcaactattgattaaaatctgaaaaaagaaaatcataggtgaccttaaattaaacttaaattaaact

SEQ ID NO: 9525 - DNA, 201 bp, Homo sapiens
aaatttacctaaactgccattgctatagattaggtgtatgacacaccgcccccctttcaccgtttcacccctgaacatctgcttcttagagctaagtgatygtactcaacaaatagtgtggagaccagagcttggcgcctttgcagcctccattttacacttggccccctggcactccactctttatgcactcttaacctg

SEQ ID NO: 9526 - DNA, 201 bp, Homo sapiens
tctattctcattcgtttgtcgccaccggacttcgggtaccctacgggtggtgctgaggctggtccccaacattggtctaatggctgagtatattgtgtgarcaccatttattcatgtctgaaaccctataatttgactagccccatatttacccatttttagtgataatttgaaaaaacattgatgattgagagaaggaac

SEQ ID NO: 9527 - DNA, 201 bp, Homo sapiens
gctcatgactggagaagttcttaaaaccatgactctaggcagaccttcatttctagctgtagaattttggccagggtcctttgtggagctatgtttttttwttatctgaaatatggggatgatttccaacttcaagggtaggttaagataatataagtcaagggcttaaatgggtgcggctcaaagattattattgctgct

SEQ ID NO: 9528 - DNA, 201 bp, Homo sapiens
acagggacagttaaatgtaggaaacaatgaattagaagaagtaaaagaaaggagaagaagtaaaagaaaggaaaaattgagaaggagagaaagacagcagmgatgctctgtaattattgctataagaattacgtgcccatttcatggatttgtatggcttaggttgagagagatgaataaaatatctttgatataattaaa

SEQ ID NO: 9529 - DNA, 201 bp, Homo sapiens
gctgaaagctgttgggtgagacatcacaatgaccacttctatgtaaaaggtagattatagatggccctctgcatatgtgggattgcatctgcattcaacchactgtgaatcaaaaatatttttaaaaaattgtgtctgtactgaacatgtacagacttttttcttactattattccctaaacaatacagtataacaactat

SEQ ID NO: 9530 - DNA, 201 bp, Homo sapiens
tttcttttttttcttttcttttcttgagacggtgtctcactccgtcacccaggctggagggcagtggcgtgatcggggctcactgcaacctctgcctcccrggttcacgccattctcctgcctcagcctcctgagtagctgggactacaggtgcccaccaccgcacctggccaattttttgtatttttagtagagatgggg

SEQ ID NO: 9531 - DNA, 201 bp, Homo sapiens
ggactacaggtgcccaccaccgcacctggccaattttttgtatttttagtagagatggggtttcaccgtgttagccaggatggtctcgatctcctgacctygtgatccacccacctcagcctcccaaagagctgggattacaggcgtgagccaccgtgcccagcctcttaaatcctgttgtgtcctaaagagtccactaaa

SEQ ID NO: 9532 - DNA, 201 bp, Homo sapiens
atggggtttcaccgtgttagccaggatggtctcgatctcctgaccttgtgatccacccacctcagcctcccaaagagctgggattacaggcgtgagccacygtgcccagcctcttaaatcctgttgtgtcctaaagagtccactaaacgaggttgagggtatgatttgacaattgaacaaggcctcagccagctctcctag

SEQ ID NO: 9533 - DNA, 201 bp, Homo sapiens
acaattgaacaaggcctcagccagctctcctagactgccccaaaactccctgagcagagagacccaggtggtgatggaagtatttttcctctaaaagactrtggagattctggcaaacctatattttgggtttagctttcaaggaagaggtggcatttgaaaagccaggggcctttgtagccattttattcactacctaat

SEQ ID NO: 9534 - DNA, 201 bp, Homo sapiens
tagtgttgtcatctggggaagctttcttgtagaagcagtatagaagctgtcctgtgcaggatgagatattagattgcaaaagaggacaagggccagtgttsccgccaaaggaaatagcctatgctgaggccctgctgtagggatcatactgtatcgcgttcctctggctttggactacgcattgatgctaaagtctggaag

SEQ ID NO: 9535 - DNA, 200 bp, Homo sapiens
accagatggagaaaatggcataggacatgtgtattagacctgccactttctggctctgtgagcatgcatttcaaagtttatacctgcaaagtgggcatttacagagtaggggacagtcggagagcttatcgatacatacttattgctctccttgtgttctgtttgctggaacacaattttagatcaaatatttaaaaatt

SEQ ID NO: 9536 - DNA, 201 bp, Homo sapiens
tctgtgaagtctgggggaagaacatttacagcagagggaacggttagtgtaaaggcctttaggctggaacatgttgagcagtgtttgaaagatgatgaatrtggctgtagcagaagaaatctggtgtgaggtaagatctgagaagtggcagggactgaaacagacagggcctgtttggctgtggaaagcagtttaggtttt

SEQ ID NO: 9537 - DNA, 201 bp, Homo sapiens
tgtggtttgaactagtatagcagccaggcccccactacaggcccacccagcttgatggcctcaccctgcatcttgtcctgtctctgaactgctaaatctcaaaactttaaagccctaatatcttgctgattaaccataatttccaaatcttatgcttaagtccaggcagtttttaatttttttttattttttggcttcagc

SEQ ID NO: 9538 - DNA, 201 bp, Homo sapiens
ctttccttggagttttgagattaagaaatgcacttcgttgtcccgaataagcatagtcttgagtgggctttagtcagagttatttgtgtgcatttatgtcratactacccactccattctatcatattgggaaaataatgcaatctcgaaggaataggagtctaggaaacctaggatataagtgagcacataccggagaaa

SEQ ID NO: 9539 - DNA, 201 bp, Homo sapiens
ttagtcagagttatttgtgtgcatttatgtcgatactacccactccattctatcatattgggaaaataatgcaatctcgaaggaataggagtctaggaaamctaggatataagtgagcacataccggagaaaaatatgccaacatagtagcttggaggaaatacttggaaatatcttgcctttatagctagatatagaact

SEQ ID NO: 9540 - DNA, 201 bp, Homo sapiens
ggaaaaattccagatgagttaaaatgtgtttcctcatttcaaggactgtaatgtttgttgttagtgtgagcacagggcttaaggtttctttatgaagaccrctgggtggttcctcacagctgtggttgagatttagcggggaaaccggacgtttatgggagacgttcagtctgtactggattttagtcagcactgccctgc

SEQ ID NO: 9541 - DNA, 201 bp, Homo sapiens
tctccctgattgcttcctctcatgaggagaaggtcattggcgctcaccacttccagggcaaccctttatgcaagcagtgggtgcctttgaaaggcaaaccrcagcaggaagactttgaaggcaagaagagactttttcatctttgcaggccccagccagaacattggttctcagtgcagtacaagcagtttcaaagttatc

SEQ ID NO: 9542 - DNA, 201 bp, Homo sapiens
gattcctgtgctacagtagatcataatcccttgagggtcacagcttatttcaaaatccttgtcaccttgacaaaatgctcaagaccaccatggtgacatgkgtgccaccatcattattattatctaaagagttttaccaagtgtctgtatcattaatatttattgtaaaggctcaacttttataagaaagaatccttgtct

SEQ ID NO: 9543 - DNA, 201 bp, Homo sapiens
gtgtctgtatcattaatatttattgtaaaggctcaacttttataagaaagaatccttgtctcccacaccaccagtgcaaagtagattaacaaagttggcayttatttattttattttttctttaggggaaaatcaagaagttagtgatctagggctaatggggatattgtgttactcccaatatgtggttcccatatttgg

SEQ ID NO: 9544 - DNA, 201 bp, Homo sapiens
gttctcaggatcccactgtatgtctgataaactaagtcaagctaaggtcattattaccaataagtaatcaataaactcaatgtttaccctaagtttgatayggtaacttagttattttaagaggaaattttaagttcttgtgtgtgtgagtaagaaggagcatgagaatagggaaagggccgtttcacagaagcggtccta

SEQ ID NO: 9545 - DNA, 201 bp, Homo sapiens
tcccactgtatgtctgataaactaagtcaagctaaggtcattattaccaataagtaatcaataaactcaatgtttaccctaagtttgatacggtaacttakttattttaagaggaaattttaagttcttgtgtgtgtgagtaagaaggagcatgagaatagggaaagggccgtttcacagaagcggtcctatctggttggc

SEQ ID NO: 9546 - DNA, 201 bp, Homo sapiens
ctcaattaaaaaaagaaagcctgaggaaattaaatgatttctaaaatcacccagctaattagtggcagaaatgagaccagattccagtctcttgctttccygaataccttattctggaattcaattataagtacaaggcatcccactcttggcttcctttctgaataaatgcttgcaccaaatccccagtggcttcttgag

SEQ ID NO: 9547 - DNA, 201 bp, Homo sapiens
cagcaaaaaataaagctattttaaaatattttggaagcaagtcatggttgaagagaagcatcccttgaaaaattagacttaaagctgcaaacttcccgggrttgacattagcttgaacttgatgaaaaaggaaaaattttaggaggatttgttcagctgtcttctgagttatgaaagcaggaagaaatgagttttacatat

SEQ ID NO: 9548 - DNA, 201 bp, Homo sapiens
cccatcagaccaggatttcagttactaggtatcctaccttgttccattgatctgagaccctcattaataccctagctgacagtcttaactcagcactgtcytctattttctaccaaatagaatacaataatcagatacattttactctctcttctgaataaagatattaacaaaatttccatgagtacttataagggtgag

SEQ ID NO: 9549 - DNA, 201 bp, Homo sapiens
acttataagggtgagtttccagaccaacctagatgagttaccaggatatatagtttgaaatattaactttaaacatttcttgatttttctgaccccatcargtattttttggaaactggtattaggcttgtagaaatggacaaggagctctaccatgcttgaagatggtttaagccttcagcaaaataattgagagcttcc

SEQ ID NO: 9550 - DNA, 201 bp, Homo sapiens
aatattccgaatacacaggtctatcagttagtgtatcatgttatgtgtagatgtgtgttggggtgatcagatccaacaccaggtcgtgggggtgacaaagkccggcaattcaaaggaatgagaaaaagacagtttgagagagaaagtgggaccagggggccatcgcgagtgtggaggctgtgaaggccccaagttctggga

SEQ ID NO: 9551 - DNA, 201 bp, Homo sapiens
aatgagaaaaagacagtttgagagagaaagtgggaccagggggccatcgcgagtgtggaggctgtgaaggccccaagttctgggagcccatgttatttatkggtgctcaaacaggtggtgaggatgtcgagtgaatgagaaacatatggctgtttgacataatgggagtactagaagcaagaagccagcaagtctagcaga

SEQ ID NO: 9552 - DNA, 201 bp, Homo sapiens
ccttgagatgaggaaataatcctggattatctgagtgggccctaaatatcctcaaaagtgtccttataagagtgaggcagagggggcatttcccccgccamacacacacacacacacacacacacacacacacacacacagaggagaaggtgatggaggcagatactggagtgaagcagccacaagccaaggaatgctgac

SEQ ID NO: 9553 - DNA, 201 bp, Homo sapiens
tcttaagctcttttctttacaaattctgaaactatcattgcctgtgggttgggttgaaatgaaggcacgtgggtgtttcaagggtatgttctgtgacaaaragacagaatagaaaaatccaaagtcatagcctggagctaatacagtaatatgaatacataaaacaggaaggacaagaatataaaagtgaatttggggacc

SEQ ID NO: 9554 - DNA, 201 bp, Homo sapiens
ggtggctcacgcctgtaatctcagcattttgggaggctgaggcaggtggatcacctgaggtcaggagtttgagaccagcctggccaacatggtgaaacccrtctctactaaaagtacaaaaattagccaggcatggtggtgggcatctgtaacgccagctactcgggaggctgaggcaggagaatcactggaacccaggag

SEQ ID NO: 9555 - DNA, 201 bp, Homo sapiens
gagtttgagaccagcctggccaacatggtgaaacccgtctctactaaaagtacaaaaattagccaggcatggtggtgggcatctgtaacgccagctactcrggaggctgaggcaggagaatcactggaacccaggaggcggaggttgcagtgagctgagatcatgccactgcactgcactgcagcctgggtgacagaacga

SEQ ID NO: 9556 - DNA, 201 bp, Homo sapiens
caggagaatcactggaacccaggaggcggaggttgcagtgagctgagatcatgccactgcactgcactgcagcctgggtgacagaacgagactctgcctcaaaaaaaaaaaaaaaaaaaaaaaaaaaaaagaacccaggcctccaatggtgcgatcaggtgccaggtactcttgtctactgtgctgaccatatgctgttga

SEQ ID NO: 9557 - DNA, 201 bp, Homo sapiens
tatctccttacctttactcatattgtggtttaactatgtggttgtcttctccaccctgacaatagatacatctattgtccatcagcccaatttacaacttwtgcatctcttctgatttctatcctctgctaatgacacttattaactactgcctttccactggactttgcatttagttttatatatatatatatataacct

SEQ ID NO: 9558 - DNA, 201 bp, Homo sapiens
gcaatatagtgtggcagacagaaaaatgtatgaaattaattcttttggtttagaatgacattcctatcattgttagaacaagggattacattatacactacctctaaactcaaattttctgagcactttaactattaaatagcaataacagaaagcattgtaaatcttttggagttttgcatgataatgtacctcttgtta

SEQ ID NO: 9559 - DNA, 201 bp, Homo sapiens
cattctttatgctaatcctaatgcatagattggtaaattgagattaatgagattcttcctttactaccacctgtttttaaccaaatgcctacatgctgcakgagcaggaaatgaggtgactactgttgttggccacagagcttcaatatgtcgtgaacaagggttagatgtgaatgtcagaaaaaatgttatgatcaattt

SEQ ID NO: 9560 - DNA, 201 bp, Homo sapiens
tgactactgttgttggccacagagcttcaatatgtcgtgaacaagggttagatgtgaatgtcagaaaaaatgttatgatcaatttctgcctccaacaaggractacaaatatgggtcacaaaagttctactagtagccccaaatacattttttgaaaggagacaatataaataaagctgaaaagcagtcacaacgctttaa

SEQ ID NO: 9561 - DNA, 201 bp, Homo sapiens
ggaactacaaatatgggtcacaaaagttctactagtagccccaaatacattttttgaaaggagacaatataaataaagctgaaaagcagtcacaacgcttyaatgtgtcattctcttcttcacctttctatccacttagatgtttcctaccccccaaaaatgaacttatgtcacatcacacttgtgactcccactgacatc

SEQ ID NO: 9562 - DNA, 201 bp, Homo sapiens
ttttttgaaaggagacaatataaataaagctgaaaagcagtcacaacgctttaatgtgtcattctcttcttcacctttctatccacttagatgtttcctaccccccaaaaatgaacttatgtcacatcacacttgtgactcccactgacatctaaagtagtgtgagccacacagatagaagcacaggtaaatgcctcaaaa

SEQ ID NO: 9563 - DNA, 201 bp, Homo sapiens
ttttgtatgaaatctcatctacccataacaagtcttggaagctgctcttgtcatcctcatcacagacctgcagaaatggaggttaggtaagagtggggctkgaaatggagctaggtccaatctcaaaatacatactttttcaatcatactaactcatcatgttagtagtaagttaaagaatcttgaatcatatggtccact

SEQ ID NO: 9564 - DNA, 201 bp, Homo sapiens
ggagggagagcatcaggataaacagctaatgcatgtggggcttaatacctaggtgatgggttgatagctgcaacaaatcaccatggcacttgtttacctaygtaacaaaccttcacgtcctgcacatgtagcctggaacttaaaattaaattaagtcaaaaaaagctaaaagcaagctttatgccaaaaaaaattttaaaa

SEQ ID NO: 9565 - DNA, 201 bp, Homo sapiens
tgtctacttacgacgtacatccagactgcacgccctttttattttttcaaagcaaagccaaaaaataaagaaaacgtaaaattagtttttaaagaaaatgmacaatctgtttttaattttggctatcacgaaaaggggaattaaccagccaaaaaagcaaagcaaaaaaaacgtgtcccctgactgctctgtctgtgcctt

SEQ ID NO: 9566 - DNA, 201 bp, Homo sapiens
ttttttcaatttaataaattttttttcttaaaaggtaaaattgccaatgagttaaatgttgatgctctgatgttagcaagactgagttcatatgtccatcrcttattaactccattttcttatcaatatgtttggcttctgtaagtcttattttcttgtttgtgaaaggaagatctaataatagaactggccttatagaat

SEQ ID NO: 9567 - DNA, 201 bp, Homo sapiens
ttgttgaaaaatataatctgtagcctttccaaatcaaacctatttcagacaaaccctttgctggggtggaagggtggtggggaagcgagggagaatgcccyacctagaaattctcatcctgttaaaatacaagttaagcctctttgagacacttgagtttttctactgtcttctccccaggtacttgccctgtttgtccat

SEQ ID NO: 9568 - DNA, 201 bp, Homo sapiens
tggaagggtggtggggaagcgagggagaatgccctacctagaaattctcatcctgttaaaatacaagttaagcctctttgagacacttgagtttttctackgtcttctccccaggtacttgccctgtttgtccatgactattttttcccgaaggttgatagagagcaatttcatggttacaagctttatgatatttatgtg

SEQ ID NO: 9569 - DNA, 201 bp, Homo sapiens
gggatagcataggaaattaggattttgatggattacaggttttgtattactctgctcataaccctttatgactttgggttatttgcttccatgaatacttytgtaggcatgggacacatagttgatcactgacttcatgatctctgggaagtgaagaaaatattatcagctacttgaacatttctcagggtagtcactttt

SEQ ID NO: 9570 - DNA, 201 bp, Homo sapiens
aaatattatcagctacttgaacatttctcagggtagtcacttttgattaaaataaacaagaagctttgaatagcttcccaccaaactacttttttgtttgtttgcttgctttttgagacagagtctcgctctgtcgcccaggctggagtgcagtggcgtgatctcggctcactgcaagctctgcctcccaggttcacgcca

SEQ ID NO: 9571 - DNA, 201 bp, Homo sapiens
aatattatcagctacttgaacatttctcagggtagtcacttttgattaaaataaacaagaagctttgaatagcttcccaccaaactacttttttgtttgtttgcttgctttttgagacagagtctcgctctgtcgcccaggctggagtgcagtggcgtgatctcggctcactgcaagctctgcctcccaggttcacgccat

SEQ ID NO: 9572 - DNA, 201 bp, Homo sapiens
tattatcagctacttgaacatttctcagggtagtcacttttgattaaaataaacaagaagctttgaatagcttcccaccaaactacttttttgtttgtttgcttgctttttgagacagagtctcgctctgtcgcccaggctggagtgcagtggcgtgatctcggctcactgcaagctctgcctcccaggttcacgccattc

SEQ ID NO: 9573 - DNA, 201 bp, Homo sapiens
gcctcccaggttcacgccattctcctgcctcagcctccccagtagctgggactacaggtgccagccactatgcctggctaatttttttgtatttttagtascgatggggtttcaccgtgttagccaggatggtttcgatctcctgacctcatgatccgcctgcctcggcctcccaaagtgctgggattacaggcgtgagcc

SEQ ID NO: 9574 - DNA, 201 bp, Homo sapiens
cctcccaggttcacgccattctcctgcctcagcctccccagtagctgggactacaggtgccagccactatgcctggctaatttttttgtatttttagtagvgatggggtttcaccgtgttagccaggatggtttcgatctcctgacctcatgatccgcctgcctcggcctcccaaagtgctgggattacaggcgtgagcca

SEQ ID NO: 9575 - DNA, 201 bp, Homo sapiens
agtaaagtaattcaactgcagagtgaacagtttgtagattttgaaacaacaagtacactgtggaaactttagctggtattgaaaggagaaaaaacaaaccraaaaaacaaaaaggcaaatttaagactccggttgggtgtcacagatggtacactaaaattgcaaatgaatgccactctgtaatcatgaagatggtgatct

SEQ ID NO: 9576 - DNA, 201 bp, Homo sapiens
tgccactctgtaatcatgaagatggtgatcttaatcccacttaaagggacactagcctcttacccaacagtttgcctttatattcaaactatttgtaccagggctttgcctcctaagatatcagttattccttgtcctttaacctagtttcctctttgcttactctacatggggtagatttgtcattgccataaggaacaa

SEQ ID NO: 9577 - DNA, 201 bp, Homo sapiens
attaggtatttttcctaatgctatccctcccctagcctcccaccccctgacaggccctggtatgtgatgttcccccctccctgtgtccatgcgttctcatkgttcaactcccacttatgagtgagaacatacggtgtttggttttctgttcctgtgttagtttgctgaaaatgatggtttccagcttcatccatgtccctg

SEQ ID NO: 9578 - DNA, 201 bp, Homo sapiens; identical to SEQ ID NO: 1321

SEQ ID NO: 9579 - DNA, 201 bp, Homo sapiens; identical to SEQ ID NO: 1322

SEQ ID NO: 9580 - DNA, 201 bp, Homo sapiens; identical to SEQ ID NO: 1323

SEQ ID NO: 9581 - DNA, 201 bp, Homo sapiens
tatgaggtctctgccatcatgacctaatcacttccccaaaactccacctcctgataccattacactggtgattagctttcaatatataaatttgggtggcrgggtggggcacacacattcagatcatagcaatggcagctaggaggaagtaaattttgaatcctcatttccatgtaaagacttcatttgctttaaacaatt

SEQ ID NO: 9582 - DNA, 201 bp, Homo sapiens
tggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgca

SEQ ID NO: 9583 - DNA, 201 bp, Homo sapiens
ggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcag

SEQ ID NO: 9584 - DNA, 201 bp, Homo sapiens
gcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcagc

SEQ ID NO: 9585 - DNA, 201 bp, Homo sapiens
atctgccctcattttcaaccttatttctttagtaccaattgcagccatgttataatctttgttttcatccaggtaaagctgagggaagggaaggagaatcyactgagaaaaagattttccccaaagagtgactcagcctttgaaaagaaaatcagctatatgaaaagggaagagtatttaatcattcggagcaataattgc

SEQ ID NO: 9586 - DNA, 201 bp, Homo sapiens
tgcagggtcattctgtccaggaactcatcttctctggcggtgtgagaccatatgtttaacatgaccagtaaggaagtagaaggaatcttccactacttttyacattcttttttctttcaaaaagttttgtaaacttcaagtatgtaaaaaaacagttcttatatgttcatacagtttgctttcaacaataactccacacat

SEQ ID NO: 9587 - DNA, 201 bp, Homo sapiens
catgtaaagatgtttccagtataaagtagaaaaaaatgggttttaaacatcatatataaaattaatcaattttttaacatatagcatacctgtattcaggwacatgttctttggttattctcatttaaacagtcccctattgttgaatacttgatctgtttctattgtttcattttatatataatatatcctataccaaat

SEQ ID NO: 9588 - DNA, 201 bp, Homo sapiens
gaggagccaagatggctgaacaggaacagctctggtctacagctcccagcgggagcaacgcagaagatgggtgatttctgcatttccatctgaggtaccgrgttcatctcactagggagtgcaagacagtgggcgcaggtcactgggtgcatgcaccgtgcgcgagccaaagcagggtgaggaattgcctcactcgggaag

SEQ ID NO: 9589 - DNA, 201 bp, Homo sapiens
aagtggtgacagacggcacctggaaaattgggtcactcccacctgaatactgtgcttttccgacgggcttaaaaaatggcgcaccaggagattatatccckcacctggctcggagggtcctacgcccacggagtctccctgattgctagcacagcagtctgagatcaaactgcaaggcagcagccagactgggggaggggc

SEQ ID NO: 9590 - DNA, 201 bp, Homo sapiens
gagattatatccctcacctggctcggagggtcctacgcccacggagtctccctgattgctagcacagcagtctgagatcaaactgcaaggcagcagccagrctgggggaggggcgcctgccattgcccaggcttgcttaggtaaacaaagcagccaggaagctccaactgggtggagcccaccacagctcaaggaggcctg

SEQ ID NO: 9591 - DNA, 201 bp, Homo sapiens
ggtggagcccaccacagctcaaggaggcctgcctgcctctgtaggctccacctctgggggcagggcacacacaaacaaaaagacagcagtaacctctgcakacttaagtatccctgtctgacagctttgaagagagcagtggttctcccagcacgcagctggagatctgagaacgggcagactgcctcctcaagtgggtcc

SEQ ID NO: 9592 - DNA, 201 bp, Homo sapiens
tgggggcagggcacacacaaacaaaaagacagcagtaacctctgcagacttaagtatccctgtctgacagctttgaagagagcagtggttctcccagcacrcagctggagatctgagaacgggcagactgcctcctcaagtgggtccctgacccctgacccccgagcagcctaactgggaggcaccccccagcaggggcag

SEQ ID NO: 9593 - DNA, 201 bp, Homo sapiens
gctctcctcagcaaatgtaaaagaacagaaattataacaaactatctctcagaccacagtgcaatcaaactagaactcaggattaagaatctcactcaaarccgctcaactacatggaaactgaacaacctgctcctgaatgactactgggtacataacgaaatgaaggcagaaataaagatgttctttgaaaccaacgag

SEQ ID NO: 9594 - DNA, 201 bp, Homo sapiens
accaaagccgggcagagacacaaccaaaaaagagaattttagaccagtatccttgatgaacattgatgcaagaatcctcagtaaaatactggcaaaccgamtccagcagcacatcaaaaagcttatccaccatgatcaagtgggcttcatccctgggatgcaaggctggttcaatatacgcaaatcaatcaatgtaatcca

SEQ ID NO: 9595 - DNA, 201 bp, Homo sapiens
agtaaaatactggcaaaccgactccagcagcacatcaaaaagcttatccaccatgatcaagtgggcttcatccctgggatgcaaggctggttcaatatacrcaaatcaatcaatgtaatccagcatataaacagaaccaaagacaaaaaccacatgattatctcaatagatgcagaaaaggcctttgacaaaattcaacag

SEQ ID NO: 9596 - DNA, 201 bp, Homo sapiens
tactgaatgggcaaaaactggaagcattccctttgaaaactggcacaagacagggatgccctctctcaccactcctattcaacatagtgttggaagttctrgccagggcaattaggcaggagaaggaaataaagggtattcaattaggaaaagaggaagtcaaattgtccctgtttgcagatgacatgattgtatatctag

SEQ ID NO: 9597 - DNA, 201 bp, Homo sapiens
agctgataagcaacttcagcaaagtctcaggatacaaaatcaatgtacaaaaatcacaagcattcttatacaccaacaacagacaaacagagagccaaatsatgagtgaactcccagtcacaattgcttcaaagagaataaaatacctaggaatccaccttacaagggatgtgaaggacctcttcaaggagaactacaaac

SEQ ID NO: 9598 - DNA, 201 bp, Homo sapiens
aagcattcttatacaccaacaacagacaaacagagagccaaatcatgagtgaactcccagtcacaattgcttcaaagagaataaaatacctaggaatccamcttacaagggatgtgaaggacctcttcaaggagaactacaaaccactgctcaagggaataaaagaggatacaaacaaatggaagaacattccatgctcat

SEQ ID NO: 9599 - DNA, 201 bp, Homo sapiens
aactatactacaaggctacagtaagcaaaacagcatggtactggtaccaaaacagagatatagatcaatggaacagaacagagccctcagaaataatgccrcatatctacaactacctgatctttgacaaacctgagaaaaacaagtaatggggaaaggattccctatttaataaatggtgctgggaaaactggctagcca

SEQ ID NO: 9600 - DNA, 201 bp, Homo sapiens
ctaaaaccataaaaaccctggaagaaaacctaggcattaccattcaggacataggcatgggcaaggacttcatgtctaaaacaccaaaagcaatggcaacmaaagccaaaattgacaaatgggatctaattaaactaaagagcttctgcacagcagaagaaactaccatcagagtgaacaggcaacctacaaaatgggaga

SEQ ID NO: 9601 - DNA, 201 bp, Homo sapiens
gcatgggcaaggacttcatgtctaaaacaccaaaagcaatggcaaccaaagccaaaattgacaaatgggatctaattaaactaaagagcttctgcacagcmgaagaaactaccatcagagtgaacaggcaacctacaaaatgggagaaaattttcacaacctacttatctgacaaagggctaatatccagaatctacaatg

SEQ ID NO: 9602 - DNA, 201 bp, Homo sapiens
caggggtcctggaatcaatccccttgatggatacagagggaagactcactctcactctctcttgatatatatatatatatatatatatatatatatatatrtatatatgcacacatacacacacacacacacacatatatatacacacacatacacacacacgtatgtatatttacatgtatttataaactgatattttat

SEQ ID NO: 9603 - DNA, 201 bp, Homo sapiens
aggggtcctggaatcaatccccttgatggatacagagggaagactcactctcactctctcttgatatatatatatatatatatatatatatatatatatayatatatgcacacatacacacacacacacacacatatatatacacacacatacacacacacgtatgtatatttacatgtatttataaactgatattttatt

SEQ ID NO: 9604 - DNA, 201 bp, Homo sapiens
gggtcctggaatcaatccccttgatggatacagagggaagactcactctcactctctcttgatatatatatatatatatatatatatatatatatatatayatatgcacacatacacacacacacacacacatatatatacacacacatacacacacacgtatgtatatttacatgtatttataaactgatattttattca

SEQ ID NO: 9605 - DNA, 201 bp, Homo sapiens
gtcctggaatcaatccccttgatggatacagagggaagactcactctcactctctcttgatatatatatatatatatatatatatatatatatatatatayatgcacacatacacacacacacacacacatatatatacacacacatacacacacacgtatgtatatttacatgtatttataaactgatattttattcaaa

SEQ ID NO: 9606 - DNA, 201 bp, Homo sapiens
ctggaatcaatccccttgatggatacagagggaagactcactctcactctctcttgatatatatatatatatatatatatatatatatatatatatatatgcacacatacacacacacacacacacatatatatacacacacatacacacacacgtatgtatatttacatgtatttataaactgatattttattcaaatgt

SEQ ID NO: 9607 - DNA, 201 bp, Homo sapiens
tggaatcaatccccttgatggatacagagggaagactcactctcactctctcttgatatatatatatatatatatatatatatatatatatatatatatgcacacatacacacacacacacacacatatatatacacacacatacacacacacgtatgtatatttacatgtatttataaactgatattttattcaaatgtt

SEQ ID NO: 9608 - DNA, 201 bp, Homo sapiens
tcaatccccttgatggatacagagggaagactcactctcactctctcttgatatatatatatatatatatatatatatatatatatatatatatgcacacatacacacacacacacacacatatatatacacacacatacacacacacgtatgtatatttacatgtatttataaactgatattttattcaaatgtttcaac

SEQ ID NO: 9609 - DNA, 201 bp, Homo sapiens
caatccccttgatggatacagagggaagactcactctcactctctcttgatatatatatatatatatatatatatatatatatatatatatatgcacacatacacacacacacacacacatatatatacacacacatacacacacacgtatgtatatttacatgtatttataaactgatattttattcaaatgtttcaact

SEQ ID NO: 9610 - DNA, 201 bp, Homo sapiens
tacagagggaagactcactctcactctctcttgatatatatatatatatatatatatatatatatatatatatatatgcacacatacacacacacacacayacatatatatacacacacatacacacacacgtatgtatatttacatgtatttataaactgatattttattcaaatgtttcaactggcccctaggaagaaa

SEQ ID NO: 9611 - DNA, 201 bp, Homo sapiens
agattctagatattattttctatttatcaactgcattcaggcagtgctaagtagatgactgatgctgaaattttactagataatctttgctctctattttrttatatgacacatggggcaaatacgtgagatgagcaattagtgaaattctggaagggacagatttatgtcatactattgaaagggacaggaagtggatta

SEQ ID NO: 9612 - DNA, 201 bp, Homo sapiens
tgtaatccctgtttgttgtgggagggacctctcgggaggtgattggattatggaacggtttccgcatgctgttcttgtggtagtgggtgagttctcacaaratctgatggtttcataagaggctcttcccccttcgctctgctcttcccttctttaagctgccatgcgaagaaggtctttgctttcccttcatcttctgcc

SEQ ID NO: 9613 - DNA, 201 bp, Homo sapiens
agctaaaatccatctgagttggggagcagattccatgggagactgaaaatgtgtttcaaactgtagtgcaagaaattgaacaaagtattggaatttttctaaaaaaaaaaaaaggttcctttgctgaaagtagtacctggcatgtaaacctaaagtaatatagaagatgaagtggaaaagtatatcacaaggcaaaaatta

SEQ ID NO: 9614 - DNA, 201 bp, Homo sapiens
tatcacaaggcaaaaattactttttagactgatgaagagatggatggatggatgtgaattttttttatctatttcttattttgaaggttatttatttattyacaaacactggaaaattcagtgtttttcactgagcaaaatagcttgtctggtccaaagccagtaaaataagaattttgtgggtggggtatctactccatt

SEQ ID NO: 9615 - DNA, 201 bp, Homo sapiens
atagagtgagactctgtctcaaaacaaaaaaacaaaacaaaacaaaacaaaaaaagatgagcagcatggaacatgatgttggcatgaggccctactacccrgcagcagactatcagggaataaactagataaacctggaaaatgttttaacttcagtttattttattcacattaagtaatggagtagcatgttgtttgttt

SEQ ID NO: 9616 - DNA, 201 bp, Homo sapiens
aacttcagtttattttattcacattaagtaatggagtagcatgttgtttgtttgtttgtttgttttacctctaaacctcctgtatagcccccttttaaaakaagggcaggggaagaggcttaaaatatggtagtattgactcccaggcctgttcagtctatacgaattttcaggctgtatagtttaaaaaaaacattgttc

SEQ ID NO: 9617 - DNA, 201 bp, Homo sapiens
tttgttttacctctaaacctcctgtatagcccccttttaaaagaagggcaggggaagaggcttaaaatatggtagtattgactcccaggcctgttcagtcwatacgaattttcaggctgtatagtttaaaaaaaacattgttcaatttcttatacgtttttactagtgatattactttagaaatgggcctcgaaagactca

SEQ ID NO: 9618 - DNA, 201 bp, Homo sapiens
ttttacctctaaacctcctgtatagcccccttttaaaagaagggcaggggaagaggcttaaaatatggtagtattgactcccaggcctgttcagtctataygaattttcaggctgtatagtttaaaaaaaacattgttcaatttcttatacgtttttactagtgatattactttagaaatgggcctcgaaagactcaggtt

SEQ ID NO: 9619 - DNA, 201 bp, Homo sapiens
gcaaatctcagacattatcttgacttatatgtaagatgtacctctctctttaaatccaagtgcattgaaacttctggctcataaggtaatttttttttttaaataattaactaaacccttaaaactacatagaagtctactttgttttataaattaaccccattattttaggaattaatatagctttgtcttgtgagatgc

SEQ ID NO: 9620 - DNA, 201 bp, Homo sapiens
ctgaaggagataggctgcagtttgaaggcaagagcatctgatctccaaagaatcagaaaatctcttcttttgttgcatttgtaggtactttttgttgtgtwgcttttttttttttttttttttttttaatacaggtaaagttcaaacgagcacagcatggtccaaatggtgtttaaagctgtctaagtttcctttatgtaa

SEQ ID NO: 9621 - DNA, 201 bp, Homo sapiens
ttttctgtcttgaaagcaaatgtactcttccagagaaactcctgttctttttttaaagttttatttttaactgacaaattaataattgtatatataggtaygacgtgatgtttcaatgtctatattcattgtggaatgatcaacccaggataattaacatactcatcacctcaaattctttgtagcaagaacatttacaat

SEQ ID NO: 9622 - DNA, 201 bp, Homo sapiens
cctttataaaaccatccgatctcatgaaacttattcactaccacaagaacagcatgggaaaaacccacccccatgattcaattacttcccaccgggttccmtcccatgacacgtggggattatcgcaattcaaggtgagatttgggcaggacacagagccaaaccatatcacccgtcttacccaattctgttgaaataaac

SEQ ID NO: 9623 - DNA, 201 bp, Homo sapiens
aagctttcactcatggtgaatggcaaacagggagcaggcatgtcacatggtgagagagggagagagggagcaagggagacaggaggaggaggcgccaccctttttttattatttaattttttgagagggtggcacgatcatggctcactggagcctcaacctcccatgctcgagcaatcctgctgccttagcttcctgagt

SEQ ID NO: 9624 - DNA, 201 bp, Homo sapiens
ttttttgagagggtggcacgatcatggctcactggagcctcaacctcccatgctcgagcaatcctgctgccttagcttcctgagtggctgggactacgggyctgcaccaccacacctaatgtttaatttttttttaattttttgttgagatgggatttcattattttccccaggctggtctcaaacttctgagttcaagta

SEQ ID NO: 9625 - DNA, 201 bp, Homo sapiens
ccaagtctttttcgttttatcaagaatagaacaagcatttctagagcctctagaggatttccttgtttagctctttgtccagagctaccacatggccactkttagttgcaaaggaggcttggttaggccggtcacattgccagctctcgcaaggaggaagaggggaatggatattgacaatgtctgcaatagtcatcttcc

SEQ ID NO: 9626 - DNA, 201 bp, Homo sapiens
aatcccagcactttgggaggccgaggcgggcggatcacgaggtcaggagatcgagaccatcctggctaacccggtgaaacaccatctctactaaaaatacaaaaaaaaatcagccgggcgccccagctattcgggagcctgaggcaggagaatggcgtgaacccgggaggcggagcttgcagtgagccgagatcaagccac

SEQ ID NO: 9627 - DNA, 201 bp, Homo sapiens
atgcaaaataaaactaagggcccccttgcccaaaaatccagaaaaaaaagtgttaaaagtgctagaatagaatttcttttctctttcttcaatagtctatytgttatgttttttatttgctattgaatgacatttaagtaaataaaaatgtaaattagcatgaatattaccattcgtccttatattgtgtgcaatgccagt

SEQ ID NO: 9628 - DNA, 201 bp, Homo sapiens
ctcaaatgcagaatcattgaaataacacaatttgtatgtcatagcccatatatgcatgtgtcttttgttcttattggaagagtggaaatgccatccaaaaktaacttactgctttttgtttcacttcttgatgcacgcacattctaccaacgctttttaacttcagcctaccgatgcatcaggtagaaccaaaaacaagag

SEQ ID NO: 9629 - DNA, 201 bp, Homo sapiens
gctttttaacttcagcctaccgatgcatcaggtagaaccaaaaacaagaggtctcttgccctgtgcaagccaagcctttctgattagcaatcctagagagracaggtggctcacgcctgtaatcccagcactttgggaggatgaggcaggtgaattacgaggtcaggagtttgagaccagcctagccaacatggtgaaacc

SEQ ID NO: 9630 - DNA, 201 bp, Homo sapiens
acagccaagcctttctaattagcaatcctagagaggacagcaccaataagaaagaagagcagccatcaaagccaggcctttatatgtatgtaatcaacagrcatctgatctagattcttaaagatggtgtggtttgggtgggtgattttatttattttatttttctgtctcctaaataatatgtaatttcttcaggccaag

SEQ ID NO: 9631 - DNA, 201 bp, Homo sapiens
aaaatcattggcaagacatagtggctcatgcctgtagtcccagcactttgggagcccaaggtgggtgactcgcttcagcccaggggttagagaccagcctyggcaacatggcaaaaccctgtctctacaaaaaaataaaaataaataaattattcaggtgtggtggcgtgtacctatagtcctagatacctaggaggctga

SEQ ID NO: 9632 - DNA, 201 bp, Homo sapiens
gaataacttatagagaatattggtatttgacataggggaaccatcatacgtcagcactttaagcatagccattgaaagttatgagagctttagacaatcaytgtgaggggaaaaaatgtgaagatgacattgaacgcaacttgataaacattcccaacgtaactatgaatagaagagtttcctaaagcaacactgtttcct

SEQ ID NO: 9633 - DNA, 201 bp, Homo sapiens
catgagtctagatagtctagatatccatttctttgcaggcatactaactgctctttcttctaagtaattaaaagtaattacagacaatggttgtgattatrggaaaatacacagacatgcagcctaaggctaccacattttattaaaaggcagagatccaccaatttgttctacttatagcaattctattctgagtctgag

SEQ ID NO: 9634 - DNA, 201 bp, Homo sapiens
gattttcattaactcaccagctttcactcaatactagggaccaaagtcctaccgggccattctgcaaggcccttacagtcaaatcattaataatttccagytgaacacacttcagcagtgtattctcagcctctttattaccaccatcctaaggagttttttcagataagttttccccctaattgcccttttcccacaaca

SEQ ID NO: 9635 - DNA, 201 bp, Homo sapiens
taactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtat

SEQ ID NO: 9636 - DNA, 201 bp, Homo sapiens
aactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatg

SEQ ID NO: 9637 - DNA, 201 bp, Homo sapiens
agacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatgtatgtatatgtatgtctaggacagcatctggcttgtagtaattgc

SEQ ID NO: 9638 - DNA, 201 bp, Homo sapiens
gacggttgtgagaatcacgtctaattaataactgtaactaaaaagtgtgtgtgtatatatatatatgtatatatatatatgtgtgtgtatatatatatgtrtatatatatacatatatatgtatgtatgtatgtgtatatatatatgtatgtatgtatgtatatgtatgtctaggacagcatctggcttgtagtaattgct

SEQ ID NO: 9639 - DNA, 201 bp, Homo sapiens
attggtaagtggagccataaagattggtaaatgacttaaaactcatgaattattctgagctaagagaaccaaaaatatatgtatatatatattttccatgrgatttcaacagcagttaacatggtattatctttgtactaattttgttaactgtgtgtctagaaaacttgtgcaacaatatagtaaacacaaaattagtgc

SEQ ID NO: 9640 - DNA, 201 bp, Homo sapiens
tcagaagcttcaatgtgttccccatttggacccagatacattttgatgttttatggtctttctttatagtgagctacatatgacctaatgtccagcaggcaattgcagtccctgattatttcctatcaacttttcccagttgtctgttttgagacttactataagttaaacgtttatatgtatataatagagaacagatat

SEQ ID NO: 9641 - DNA, 201 bp, Homo sapiens
aggtcacaatcctcaatacgtacattaaattagcttgttttgtggcaaaccctttaagaaatctaggctttaattttatatatatatatatatatatatatttttttttttttttttttttttttttttttttgagatagggtctcactctgtcacctaggctggagtgcagtggcgtgtttatagctcgctgcagcctta

SEQ ID NO: 9642 - DNA, 201 bp, Homo sapiens
gtcacaatcctcaatacgtacattaaattagcttgttttgtggcaaaccctttaagaaatctaggctttaattttatatatatatatatatatatatattwttttttttttttttttttttttttttttttgagatagggtctcactctgtcacctaggctggagtgcagtggcgtgtttatagctcgctgcagccttaaa

SEQ ID NO: 9643 - DNA, 201 bp, Homo sapiens
cagtggcgtgtttatagctcgctgcagccttaaactcccgggctcaagtggtcctcctgcctgagcttcccaagtagctagaactacatgcaccactatgycagctaatttgttttattttgtgtacaaatgcggttctcaccatgttgctcaggctggtctcgagttccaggcctcaagaaatcctctcgctttgacctc

SEQ ID NO: 9644 - DNA, 201 bp, Homo sapiens
taataaggcagtgggcttttccagatctcagcttcagattctctagctctgtagctccccagtttatgggtatatattgctatttgttatgagacttgaayagcgtaaacctgaatggccccaaactaaatccatttgttttctagaggccacgcaggtattttctctgattcagaagcagaggacagaaattcaacacca

SEQ ID NO: 9645 - DNA, 201 bp, Homo sapiens
caatctgttgtgttctgtaagggagcatgagaggagataaagtgagtgacagaacccctacctttaaagagtgaacatgtagctctaggaggctgatattsatttcctccacctgtgattattcaactcatcacatttgaagaatgagcattgcatttttctaattttatttactccataaagtattcctggtgagtgatt

SEQ ID NO: 9646 - DNA, 201 bp, Homo sapiens
ggtagagaagtgcttgaacccgggaggcagaggttgcagggagccaagatcatgccactgctctccagcttgggcaacagagtgagactctctctcaattaaaaaaaaaaaaaaatatatatatatatatatatatgtatgtatgtatgtatgtatctcaggcttcacattttccaaaaacaatacagattaaaatcagaa

SEQ ID NO: 9647 - DNA, 201 bp, Homo sapiens
ctgtggaacaaaatagaattaccttcatggagcaagtttaacaaattgtcttcatttttggtcagcaggttgatttctaattccctcttattccctttatrtgtatttttggcttcctgtctttgttttgcgttgctataaagaaacatgtgagactgagtaatttacaaagaaaagaggtttattagggctcatagtttt

SEQ ID NO: 9648 - DNA, 201 bp, Homo sapiens
tatgttcatgggagtataatgttccagattaatgatacagtttttgtctttgttaacccaccaagttatttcactttcttttcttttttcttttttctttkttttttttttttttgagatggagtgtcactctgtcgcccaggctggagtgcaatggcatgatctcggctcactgcaagctccgcctcgtgggttcacgcc

SEQ ID NO: 9649 - DNA, 201 bp, Homo sapiens
ttttcttttttcttttttcttttttttttttttttttgagatggagtgtcactctgtcgcccaggctggagtgcaatggcatgatctcggctcactgcaasctccgcctcgtgggttcacgccattgtcctgcctcagtctcctgagtagctgggactacagacgcccgccaccacgcccggctaatttttttctattttt

SEQ ID NO: 9650 - DNA, 201 bp, Homo sapiens
tttttttttttttttgagacggagtctcgctgtcacccaggctggagtgcagtggcgcgatctcggctcactgcaagctccgcctcccgggttcacgccaytctcctgcctcagcctcccgagtagctgggactacaggtgcccgccaccacgcctggctaattttttgtgtttttagtagagacggggtttcaccgtggt

SEQ ID NO: 9651 - DNA, 201 bp, Homo sapiens
ggcctcccaaagtgctgggattacaggcatcagccaccgcacccggccctaaaagttcatctttaaggacatttcccacctttgttttagatatgccactrtctcagacatgaaacacaataacaaactaaaccagggtcatctccacccagcttgtacactacatatttgggtaggagcttaacgtcttgcccttcgctt

SEQ ID NO: 9652 - DNA, 201 bp, Homo sapiens
tgtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagc

SEQ ID NO: 9653 - DNA, 201 bp, Homo sapiens
gtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagcc

SEQ ID NO: 9654 - DNA, 201 bp, Homo sapiens
tgatctcccgcccacatactgtgtcatatcccagtaattcttccccaaaccttggctatgggttattgagctgacaaatgtctaaatgactgagatacgayttcacaacctgctgagagcctcttctttccctgtactctttgatttgtagctttgtaagttttgtgaggaaagtgggaaaaacattcttggtgacacagg

SEQ ID NO: 9655 - DNA, 201 bp, Homo sapiens
gcaggatgtgctctcagtaaaatttctggttgagtaaactcttggtgacattatcaaattaaacagcaatcccttccaaattcccctaaagctaagaccttttttttttttttttttgcatgtctttttttctctgataatcccagagtttatataacctcaaactataagcttgatgaattttagagttcattgtaatgc

SEQ ID NO: 9656 - DNA, 201 bp, Homo sapiens
atccatctttgtgtcaagagaaagtcaaatattatagtccccagccaaaataaggcatgtgatctacatcaaaggcaattcctgaatgtgtatctacagtyctcatcccctctcctcttttttgtctcttgggtaatctataccaataacctcctgattcatgaaatttattatctaaatattgaaaatattacactaaat

SEQ ID NO: 9657 - DNA, 201 bp, Homo sapiens
tgctttattatgtgacattcaaaggaaaaacttgaagtcatatttctagtaaagtatttaatttcagaaataatttaaactgttacttcaaagcaaatatytgctattcctgacataaagtttttacccaagcttggtaataaagttatcataagaataatatggattattctcaggatggaatagaatgtcttgattagg

SEQ ID NO: 9658 - DNA, 201 bp, Homo sapiens
tttttagtagaggggtttcgccatagtggccaggctggtctcaaactcctggcctcaggtgatctgcctgccttgacctcccaaagtgctgagattacagrcatgagccgctgtgcccaacctgagattttttttttaaaccttggattttcaaataactttatagttggagaaaagttgcaagaatagtatatggaattc

SEQ ID NO: 9659 - DNA, 201 bp, Homo sapiens
tgatgagttcactggaggaaggttggctagaaaaaaagtgacatggctgggcatggtggctcacgcctgtaatcccagcactttgggaggctgaggtgggyggatcacctgaggtcagaagttcaagactagcctggcaaacatggtgaaaccccatctctgctaaaaattcaaaaattagccaggcatggtggcaggcac

SEQ ID NO: 9660 - DNA, 201 bp, Homo sapiens
cgggaggtggaggttacagtgagccgagatcacgctctgcactccagcctgggcaacagaggaagactccatctcaaaaaaaaaaaaaaaaaaaagtaaarttgtctttttttttttttgcgtaccaaatcctatcaatgaaagagacaggaatagattcgactggaatagtcatgggagccatttccaggctctcatagt

SEQ ID NO: 9661 - DNA, 201 bp, Homo sapiens
ccatctcaaaaaaaaaaaaaaaaaaaagtaaaattgtctttttttttttttgcgtaccaaatcctatcaatgaaagagacaggaatagattcgactggaayagtcatgggagccatttccaggctctcatagtcttagagatgacacttggtagttcagtgtcttattgtgcttcttcaagcacatacagcctgattgaga

SEQ ID NO: 9662 - DNA, 201 bp, Homo sapiens
gttctattgtctaccttctctctcactgactccatcaaggcagacttgctcggtaaactattcaggtgactttgtgaacttttatttggtgcaaggctctgttaatagctgtaagtcagctgtttttggtcctccctctcattctcttcacactgattgatgaaatgggaaacaggttgaagaagctcacttttttagatg

SEQ ID NO: 9663 - DNA, 201 bp, Homo sapiens
tcaagagacacactaaaggaattacagtatggagtgtctcctaagttgcattgtggaactaaacactagagacaagagtcgagccctggctcaatagagcsagtaataactcagtgtctttatgaccctgagccggtgccttaaattctctgcagcgtagtttctttaaacggtggttctaaactaaggggacttttgtcc

SEQ ID NO: 9664 - DNA, 201 bp, Homo sapiens
gatagtaaaagaatgaattaaaattccagtgagccaaactacaacattgataatagtaatgagaattaattctgtgttgattttatggtgcccttgcctcrtaagtatatataactctggagtttatgaggcatgtttatagatcttaacttcttaattttgtaatgctgtcctcttaaaatttttgcttgagacggacaa

SEQ ID NO: 9665 - DNA, 201 bp, Homo sapiens
atcaaaatgtagccacgcatctgttcttgtttgattctagtaaaccataaccctaaacatgacacaaaaggggctagtgaaatatttgccgagagcggtactctaagttaacagtaaataattgaaaataagtaagtcaaaaccaaaaccaggaaagtttgcattcattcccaatcatactttaacagaacttgcagctgc

SEQ ID NO: 9666 - DNA, 201 bp, Homo sapiens
aaagaaaatacaatgaggtaatgccggtataatttagcttgattcagccatttcacaacttgtatacatttcaaaacattatgttgcacatgataaatatrtacaatttttatttgccaatttgaaaaacagagaagtccctcttcagaacctgtcctatgcagctgtcactcacttggctttgtaagcctgcagacagtg

SEQ ID NO: 9667 - DNA, 201 bp, Homo sapiens
atttcacaacttgtatacatttcaaaacattatgttgcacatgataaatatatacaatttttatttgccaatttgaaaaacagagaagtccctcttcagawcctgtcctatgcagctgtcactcacttggctttgtaagcctgcagacagtgtcatttaaaatattttcctctgtaccataacacttttccttttaatgat

SEQ ID NO: 9668 - DNA, 201 bp, Homo sapiens
gtgagccacagctattgttttgatagcccactctgcttttctagttaactttcttagaaccgtcagttccatatttaagactagaggatcagttctgatgrtgctcattcaaactcttgccaactgacatttaatgcactttaaagttgttaaaaccaagagcaggaaatgttacacttgtagtatcaagcctggctcatg

SEQ ID NO: 9669 - DNA, 201 bp, Homo sapiens
cttgtagtatcaagcctggctcatgagaaagttccatccactattctggaaaaaaaaatagaactagcctgcaggacacaaagctacctgtggtgatccgaactatgcttctcaaaaatctttcttttgtttggccacctttataataggagttctccaacagagaaagagctgcttacagcttcagagtacagatggata

SEQ ID NO: 9670 - DNA, 201 bp, Homo sapiens
cactttctcagctcaatattccatgtgtccaaagtaatactgttagtatcctacattattccaggatcttgtcatgccacttcaagaaacaaattatcacygctttctaagacttaccaagctaggggtgttgtaaagtatgtatgcaattgacttttgacttttgattcttatgttgaaaggcaacataaaaaataagct

SEQ ID NO: 9671 - DNA, 201 bp, Homo sapiens
cccatctctttctccatcgtgggtttttcctttgggccacaaatagtgaacgccactgctttacaaagttattcttttcaccactaatagttctttgatgycattttttgtacaagtgtcaaagtttttctctagaggcttccacacagttaagttcttgcttttggattctttctaaaccaaataaataaatcttcgaga

SEQ ID NO: 9672 - DNA, 201 bp, Homo sapiens
tatgttctgatgagctgggcaaggtgttgtctgactttatggacagaaaaggactgaagaaagcagaaacaaaatgagaagtagacaggttgtttcaacayttccttctttctaggctttaagcagagggtactttcttatgctggatcaggtaaagggccccttctgcttggttgctatgaatctcctgtttaaaaagaa

SEQ ID NO: 9673 - DNA, 201 bp, Homo sapiens
agttgtttttgtgcctaaagattagcttgtttgtaagttcccatactcagtgagaactgaatattttaaaaaactggtgaagggtggcactgtattttaaygtaaaacatgcaggactagatacagtcacggccattcaattttttaagttgtatatctttgggtgagttacttagcttatttcagcccagatttactgct

SEQ ID NO: 9674 - DNA, 201 bp, Homo sapiens
gagggtcccgtcttgatgttgatggctgctgacagatcaggatgtgggtgctgaaggttgggatggctgtggtaacttcctaagacaaaaatgatgtttgytgcactgactgatttttcttatcacaaaagatttctctgtagcatgcaatgctgtttcatagcattttaatcagagtacaacctctttcaaaattggagt

SEQ ID NO: 9675 - DNA, 201 bp, Homo sapiens
tgtacctttgtgtcctcatagcttatctcccacctataagagagagcatacaatatttacttttccattcctgagttacttcacttagtataaatggcctygcactccatccaagttgctgcaaaagacattattttgttcccttttatggctgaatagtattccatggtggatatatataccactattaaagttttatca

SEQ ID NO: 9676 - DNA, 201 bp, Homo sapiens
cttcacttagtataaatggcctcgcactccatccaagttgctgcaaaagacattattttgttcccttttatggctgaatagtattccatggtggatatatwtaccactattaaagttttatcataacattacagcaattcagtcacatcttcaggtcttacttctaattatcttgctatttccaccatatcttcagttact

SEQ ID NO: 9677 - DNA, 201 bp, Homo sapiens
cgcctgtagtctcagctactcgggaggctgaggcaggagaatggcgtgaacccgggaggcggagcttgccaagatggcaccactgcactccagcctggcarcaaagcgagactctgtctcaaaaaaaaaaaaaaaaaaaaaaaaatagatctcactagaagtattctcaattcagcagtagtgtccagttttgaatcaaat

SEQ ID NO: 9678 - DNA, 201 bp, Homo sapiens
atatttagtaaaccatgctgtaaacaactgtcatctaggctttgctagtccacttaaagactacaggcatagtacatttagcataattcttaagaaccctrggaattttgaagtggcaaataagtattgactttaagtcaccagctacattagcccttaactagagaatctgcctgttctttgaagctttgaagccaagca

SEQ ID NO: 9679 - DNA, 201 bp, Homo sapiens
ctacattagaactcgctgcttcactttgtgcttttatattatgaagatggcttttttttttcttaaacctcatgaaccaacccctggtagcttccaacttyacttctgtagcttcctcacctgcctcagccttcatagaattgaagagttagggcctttctctgcattagggtttggttaacaggaatgttgtggctagtt

SEQ ID NO: 9680 - DNA, 201 bp, Homo sapiens
tgccaacagagttcctggatgccgagttgccagaaacgttcaatttattaaaaatgtatctgtgaagcacagtaaagcaaagcacaataaaacaagatatmcctgtatttgtttttaaatataaaaataatttgctttaatgctgaacaaaaatgtcccatgtaaaaaattcatgtgctatctgttcccaaactcagtttc

SEQ ID NO: 9681 - DNA, 201 bp, Homo sapiens
ccacagcacacagggcgcatgcagcccaggacagctttgagtgtggcccaacacaaatttgtaaactttcttaaaacattgagtttttgcaatgttttttsgtctcataagctattgttagtgttagtgtttttttatgtgtggcccaagacaattcttcttccactgtggcccagggaagccaaaagattgaacacctct

SEQ ID NO: 9682 - DNA, 201 bp, Homo sapiens
gacagctttgagtgtggcccaacacaaatttgtaaactttcttaaaacattgagtttttgcaatgttttttggtctcataagctattgttagtgttagtgtttttttatgtgtggcccaagacaattcttcttccactgtggcccagggaagccaaaagattgaacacctctgcattagacccttttaatactattatagg

SEQ ID NO: 9683 - DNA, 201 bp, Homo sapiens
ttacaacataaaaaaatcatctgtgtaccagtcagaaatgaaggttttgtatgaaacattttcattcttcagtatcaacagcccaagattctcctgacttyatttctccagccctggcccctcacctcaccatctcttagctggccccagatatggcccaggtgttttaatcttctgggtgatctgatccagcctcttgac

SEQ ID NO: 9684 - DNA, 201 bp, Homo sapiens
cttgcatgtcctccaaattttctcatctcttaaatttgattcaggtgtacaaactccacatttgtcatcattcttgggcccctgtcccaactctcttcccyacacccagtcaagaagtcctgttgactctgcctcgataacaaattgctcacacatttcctttgctccagctacccatgctgtagtgtaagtcaccatcat

SEQ ID NO: 9685 - DNA, 201 bp, Homo sapiens
caacttctttctcagccctcccggtttgtaactttttaaatctttacccagtgttgcacgaagactgttgagatggttccctctgccttcctctctctagkattctccctgggaagtttaaaatatataatgttatgtaaagtaactcactggggccttcctcttgggcctcacctctatacactgaagacaatgctttct

SEQ ID NO: 9686 - DNA, 201 bp, Homo sapiens
ttgaataaatttgggataaatttcctgaagcagaactcatgaacccatatgtattttgattccaattcctgtcaatacaggttctagttcaactcccaacmcacacacacacacacacacacacacacacacacacacacacacacctctcacatgctttccttctaattggcaagaagccttcagatgtccttcacccct

SEQ ID NO: 9687 - DNA, 201 bp, Homo sapiens
gggaagaggttgctcctgagagggtagaagttttcagttgggagcaaccaacctagattttcttttttgaatactgtatccatgagccttggctgactgtsgaaatggcttttcaactgcctttcttttccttcagtttctcctggaagttgggtccttttcctccagatgttggaaaagtcagagaatgttttagatttt

SEQ ID NO: 9688 - DNA, 201 bp, Homo sapiens
ctgcctttcttttccttcagtttctcctggaagttgggtccttttcctccagatgttggaaaagtcagagaatgttttagatttttatcttcttcttcttyttttttttttttttttgagtctttctcctatttgcttgaattgttagtctgaaatgatgtgtgctcatcacttcattttgggcagatactttttttttga

SEQ ID NO: 9689 - DNA, 201 bp, Homo sapiens
ggggtgtgaggaggtggtcctagagtctaaaaattcaggttggactcctgtcttgtgaaggtgggcatacttggagaaggtgaaaagggagtgtgtgtgtragtgtgtgtgtgtgtgtgtgcgcgggtgtgtgctcctgtttggatcggttacaagggaatcttcctccactgccttccatttgtttatattaatgattta

SEQ ID NO: 9690 - DNA, 201 bp, Homo sapiens
gctgtacccagagtttcagctctttccctctctcttttttaaccacaaaacttaactgctttagaaacatcatcctgatgacaaggaaaaaaatgtgtccscccaccccccatcccttcttaggccagtgatgtaataccaacctaagggctcggctgctttgcaggtgacttaccctgtgattacttgttaaaaaaaaat

SEQ ID NO: 9691 - DNA, 201 bp, Homo sapiens
aatgtgtccccccaccccccatcccttcttaggccagtgatgtaataccaacctaagggctcggctgctttgcaggtgacttaccctgtgattacttgttaaaaaaaaataaaattttcccttcctccattaaatgtctgcctcttttaatttggatgtagaaatatcatcatgcaatgagaacatcatatttttgctaac

SEQ ID NO: 9692 - DNA, 201 bp, Homo sapiens
aaagtgagcaacagggctgggtttattttttaaaaacaaccggactgtgcgaatgcccttttctggagctttctggccctttctagtgaaataataatttwaaaaaaattgcttcttgagaagaggagggggcagaaattaaagggattctagattttgagagacagctacgtctttgcttctctggtagttccctattat

SEQ ID NO: 9693 - DNA, 201 bp, Homo sapiens
attattcttcaattggccttttagagaaaaaaaagagagagggaagggaggggttaatttggtgagggggcttggtcgtaattagcccactgctgcaaaastgagatacagaaatccatcggcaccagctttgggggcatggagaggcagcggagagatgggggacgggttgtcagtcttggatgaacagtggagcggtcg

SEQ ID NO: 9694 - DNA, 201 bp, Homo sapiens
tttgtgttttgtcaagcaccagcgtgcctccaattggacaacataggattgtcaacactgtgcgtgtggttcaagcaggaggctgcctgcctctttgtgtrgtgtggctgtgtttgttggatatgtgcgtatccagcctcatacggtggctctggacaggtgtggtagtgacggggaaggaaggcaagaagcagggatggt

SEQ ID NO: 9695 - DNA, 201 bp, Homo sapiens
gctcatggatgactggtgggcggatacagattgaagggggagaaggggatgaggtgggtgaaattgagggttttccctgctgccttgacagagcctggggmtgagctcgggagggtggtcttgctcccctggcatcagccacctcttgggcggctcggccttgttggaggctgcagcctgaaggagctgaaatcaccctcg

SEQ ID NO: 9696 - DNA, 201 bp, Homo sapiens
gactggtgggcggatacagattgaagggggagaaggggatgaggtgggtgaaattgagggttttccctgctgccttgacagagcctggggctgagctcggragggtggtcttgctcccctggcatcagccacctcttgggcggctcggccttgttggaggctgcagcctgaaggagctgaaatcaccctcggccgtgagag

SEQ ID NO: 9697 - DNA, 201 bp, Homo sapiens
gttagggagacagggttacgtcattgccagagaaaggggataaatggggagtaggatgccttgggggtaaattattgtgcccaatgcagagaagagattgytcttggtatcccccggccgtgttctccttacatgacccctcaggtgtggataggagacttgcaaaagaagaagcattccttctaaaacctcactgcctag

SEQ ID NO: 9698 - DNA, 201 bp, Homo sapiens
ggatggggcccactcccagccctttcctgcaggttgttcctcaaattatactcctcagagagacctttcctgaccagctttctaaaatagtccccttaccycaacctcctggctgctttccagcccatgacactgtctttaattttaattggtgaatcattatttaatattatattatacgatgatatattgaaacattta

SEQ ID NO: 9699 - DNA, 201 bp, Homo sapiens
ccactcccagccctttcctgcaggttgttcctcaaattatactcctcagagagacctttcctgaccagctttctaaaatagtccccttacctcaacctccyggctgctttccagcccatgacactgtctttaattttaattggtgaatcattatttaatattatattatacgatgatatattgaaacatttaagatggatc

SEQ ID NO: 9700 - DNA, 201 bp, Homo sapiens
actcctcagagagacctttcctgaccagctttctaaaatagtccccttacctcaacctcctggctgctttccagcccatgacactgtctttaattttaatyggtgaatcattatttaatattatattatacgatgatatattgaaacatttaagatggatctcgtctctttacccctctagaatgcaagctctgagaggtc

SEQ ID NO: 9701 - DNA, 201 bp, Homo sapiens
aggttgtcttctgaccttcctgggggaggagaaactggaatggaggaggacccccattccagtggggtgctcaaggttctcaatcccatatagccctgccygtcaagggtactttcaggtccagcagaggctccattcagagagccaagcagctggtatctggatgctgacgactctgggagcctgtcacttctcctagac

SEQ ID NO: 9702 - DNA, 201 bp, Homo sapiens
ggctgtaaacccaactacttttactaaagcttcgattggccaatatttgagacctgactatgggccagatactatgctaagcacttgacatgcattatctyacataatcctccaacaatcctgtgaggtgggtactgttatcatctctgtcttacaaatgaagtaactgaagcctaaggaggttaagtaacatgtccaagg

SEQ ID NO: 9703 - DNA, 201 bp, Homo sapiens
attctaagagctggcccatttgccaggcagtcagctgactcacagctctgggacttgctgaaggtgctgctgtcagttagaggcatttcaggcttaggagragggggctgctggttgtagcactgctgcttaggagtaatgctgctggttgtcttttgcatggcactaaggaaactctgtttcccaaggtgtccccgttac

SEQ ID NO: 9704 - DNA, 201 bp, Homo sapiens
aactagggctgcctcttcccctggctccaaatttggaattgtcaactctcccagagccttcaggaggcacctttcctacttcttgggtgccagggcaggtggagagggctctttgctgaaccccagttcaaggagggaggaacaattattctccaccttcctcagcatctttggtttatagagactgtgtacccagtctcg

SEQ ID NO: 9705 - DNA, 201 bp, Homo sapiens
tcagcatctttggtttatagagactgtgtacccagtctcgtgttcagcatgtgacatatatttgttctttgtttttttttttttttgtttctgtttttttktttttttttttttcttgttttagacagaatcctgctcttgttacccaggttggagtgcagtggcttgatcttggctcactgcaatctttgcctcctgggt

SEQ ID NO: 9706 - DNA, 201 bp, Homo sapiens
cccaagcccctttaaagggaaaaaaagaaaaaaaatgaagcatccagtagtaacaaaaagaaccatttgatattttctcattggctaagattggctgagckgccgctgcattaagttaagtgctttgcatatgaagttgggaggattcagtgaataagtgttaggcaatcattctcgttgtacaggtgaggaaagtggagc

SEQ ID NO: 9707 - DNA, 201 bp, Homo sapiens
cacaagtatgtctataattacacattatgatgagtgttctgaaggcaaagtattggggggcactgagaattagagagacctaatttagaatgatggggccgggggggacaatgatagctaaaattcgttgagcactcaccgtctgcaggccctgctgcaagggcttcacaagtatcacctcatttaattttcacaatgggt

SEQ ID NO: 9708 - DNA, 201 bp, Homo sapiens
ccgggggggacaatgatagctaaaattcgttgagcactcaccgtctgcaggccctgctgcaagggcttcacaagtatcacctcatttaattttcacaatgrgtcttggagaagagctaatgttattattgttgccttgttacggaagagggaactgatacatggaaaggtgcccagtctggaactaaaaccaaagcttgta

SEQ ID NO: 9709 - DNA, 201 bp, Homo sapiens
cttggctcaccgcaacctctgcctgccgggttcaagcgattctcctgcctcagcctcccgagtagctgggattacaggcagtgccaccaagcccagctgattttttttgtagttttagtagagacggggttgctccatgttagtcaggctggtctcgaactcccaacctcagatgatccacctgcctcggcctcccaaagt

SEQ ID NO: 9710 - DNA, 201 bp, Homo sapiens
tgagccactgcgcctggcctatcaaaattatctcaccacatcctttcagcagctaggataagtaggaattcttatccctttttttgcaggtgagaaaaaawaagtttttgggaggttcagtgactttcgataggaagcagctgggtgtggcagagctgagtctggagccagggcctcttgtctctgggcttctgtctgtgc

SEQ ID NO: 9711 - DNA, 201 bp, Homo sapiens
ttatctcaccacatcctttcagcagctaggataagtaggaattcttatccctttttttgcaggtgagaaaaaataagtttttgggaggttcagtgactttygataggaagcagctgggtgtggcagagctgagtctggagccagggcctcttgtctctgggcttctgtctgtgcgatggcacagttcccaggcggcggaca

SEQ ID NO: 9712 - DNA, 201 bp, Homo sapiens
tgggtgtggcagagctgagtctggagccagggcctcttgtctctgggcttctgtctgtgcgatggcacagttcccaggcggcggacatctctgcatcctgyctggacatcacctgctgggtaatgctaacaatggcaggttgggaggcaaggaggatcccccacagtccattggcctcttgttctgggcctgggagaaccc

SEQ ID NO: 9713 - DNA, 201 bp, Homo sapiens
ccattggcctcttgttctgggcctgggagaacccagaataaggatgaaacaagggacgtctttagggcatgccggcccctctgtgctgaaaggaagctccrtttttcttccttctggcaagaaccatcaggccagccctcttcctggtctgctggccctggaaaccacagtaaatgactttttcaggtaataccctccatt

SEQ ID NO: 9714 - DNA, 201 bp, Homo sapiens
gcatgccggcccctctgtgctgaaaggaagctccatttttcttccttctggcaagaaccatcaggccagccctcttcctggtctgctggccctggaaaccmcagtaaatgactttttcaggtaataccctccattgccttttttctctcctcttccctttcatccctagttgctaattagtgagatgcttgttacttgcag

SEQ ID NO: 9715 - DNA, 201 bp, Homo sapiens
catgccggcccctctgtgctgaaaggaagctccatttttcttccttctggcaagaaccatcaggccagccctcttcctggtctgctggccctggaaaccayagtaaatgactttttcaggtaataccctccattgccttttttctctcctcttccctttcatccctagttgctaattagtgagatgcttgttacttgcagt

SEQ ID NO: 9716 - DNA, 201 bp, Homo sapiens
gttttgtgtcccaccctctgcgtggtgcctactggaacactgtccctgcctgctcacccaagttgtgtggtcccctggcccaactgagctgaccagtagawatgagtgtaggtaggaagaagtacagggacttagttatgaattctgtctagagccaggagaaggaggcaagaaggtgaagaaagagaaaggagatgtgtc

SEQ ID NO: 9717 - DNA, 201 bp, Homo sapiens
cttctggggttgaagggctggttctggcaaggggagaagctagaagtgggcaggctggctttctgtctgtttttcttcaggtcttggggtaaagggagctscctccatactgggctctgattctgatgagactaacatttgaaagcaatagcttgactctacagatttctgaaatcaagatagaaaagggaaggtggggaa

SEQ ID NO: 9718 - DNA, 201 bp, Homo sapiens
ctggagagaatgacttgtccaccagccactgaacaaaattctcaggctttattttggttggaccaacatggatcaaatatctgtctttggaccaatcacartgggacgctcctgtagctagaccatgggtggggactagagtggacttggggagatgcaagagagtgaacacaagcatttggactttagtctgtgtgtcct

SEQ ID NO: 9719 - DNA, 201 bp, Homo sapiens
ctctactgtctcagcagaagccactaagctgggccatagagccaattctagaatctagtccatggaggtacatttgacacatcttggcattgggcaggaargaggagaggcagagtgaaagggtgacagtaaaggacccagccagtcttcgttggtcaatgttgttctcctatggttttcatcactcttcagagaaaagag

SEQ ID NO: 9720 - DNA, 201 bp, Homo sapiens
cccatgaggcaggtattagtgtcttcactttacaaatgacaaaaacagaggctctgacaggttaagtaatttgcccaagatctcttagcaagtatgtgagrtgtaaatctgagagatgttttggtggtgtgtgtgtgtttttttttttttttcctcaaagcttgcaatgctctgggtttcaagatgtggagggaaaagcat

SEQ ID NO: 9721 - DNA, 201 bp, Homo sapiens
gacaaaaacagaggctctgacaggttaagtaatttgcccaagatctcttagcaagtatgtgaggtgtaaatctgagagatgttttggtggtgtgtgtgtgtttttttttttttttcctcaaagcttgcaatgctctgggtttcaagatgtggagggaaaagcatgagctttggggtcactcatgcagacttgggtaggtaa

SEQ ID NO: 9722 - DNA, 201 bp, Homo sapiens
acaaaaacagaggctctgacaggttaagtaatttgcccaagatctcttagcaagtatgtgaggtgtaaatctgagagatgttttggtggtgtgtgtgtgtttttttttttttttcctcaaagcttgcaatgctctgggtttcaagatgtggagggaaaagcatgagctttggggtcactcatgcagacttgggtaggtaac

SEQ ID NO: 9723 - DNA, 201 bp, Homo sapiens
caaggtcatctaatctagtagttggtgcagccaggattggtacccacatggtctgatgttagaatccacactcaacacttcacatcactctggttctggtwtataggagctgtggccacagtaataacgatggccaaattctgctaataggaagtcttcgcttctggtgatggatggagcaggcatggagattttcttttc

SEQ ID NO: 9724 - DNA, 201 bp, Homo sapiens
aggaaggggagtccctatgtagagttgggaaatttgagctctaattacaacttcactaccaattcactgtatgctctttaacttttctaaaatgagtattyggtaaattaacacatagggagcactcgggccatgtgactgtcctccacatactcctgcacagctaatattgtcaccctggctttagagatggagaaacag

SEQ ID NO: 9725 - DNA, 201 bp, Homo sapiens
ttgagctctaattacaacttcactaccaattcactgtatgctctttaacttttctaaaatgagtattcggtaaattaacacatagggagcactcgggccawgtgactgtcctccacatactcctgcacagctaatattgtcaccctggctttagagatggagaaacaggatggattaaatggctcatggctccccagctag

SEQ ID NO: 9726 - DNA, 201 bp, Homo sapiens
tcctgcacagctaatattgtcaccctggctttagagatggagaaacaggatggattaaatggctcatggctccccagctagtaagtgttacatccgggacsaaaaacaggactgcaggattcaaggtttttcccctataggatacttgtgtttagaaaaagattgtagtctaactccttttccaccccatgacagttgggg

SEQ ID NO: 9727 - DNA, 201 bp, Homo sapiens
ctgtgtgtgcaaacttgggcaagtaatttcccttctcagagtctcagatttgtcatttacaaaatagcaatggcgtcatacctaccctacggattcctacrggttggttgggaatattgaggagttgtcagtaaattatctactttagtgctctcagaatgatgtctggcctggacctctcgccagactcactttgtgtat

SEQ ID NO: 9728 - DNA, 201 bp, Homo sapiens
tttcccttctcagagtctcagatttgtcatttacaaaatagcaatggcgtcatacctaccctacggattcctacaggttggttgggaatattgaggagttrtcagtaaattatctactttagtgctctcagaatgatgtctggcctggacctctcgccagactcactttgtgtatgcatctgcttgatcaccatctctact

SEQ ID NO: 9729 - DNA, 201 bp, Homo sapiens
atcattgaggaagctggtgacagaatgacaatgacaaccagcagtgttgtctgataatggtgggactgggaattggaagaatgcagcttgtgtcagtaacwtttatttatttatttatttatttatttatttatttatttacttacttacttacttaattacttacttacttgcttacttactgagtctcactctgttgcc

SEQ ID NO: 9730 - DNA, 201 bp, Homo sapiens
cagcagtgttgtctgataatggtgggactgggaattggaagaatgcagcttgtgtcagtaacatttatttatttatttatttatttatttatttatttatttacttacttacttacttaattacttacttacttgcttacttactgagtctcactctgttgcccaggctggagtgcagtggtgcgatcttggctcactgca

SEQ ID NO: 9731 - DNA, 201 bp, Homo sapiens
agcagtgttgtctgataatggtgggactgggaattggaagaatgcagcttgtgtcagtaacatttatttatttatttatttatttatttatttatttatttacttacttacttacttaattacttacttacttgcttacttactgagtctcactctgttgcccaggctggagtgcagtggtgcgatcttggctcactgcaa

SEQ ID NO: 9732 - DNA, 201 bp, Homo sapiens
gcagtgttgtctgataatggtgggactgggaattggaagaatgcagcttgtgtcagtaacatttatttatttatttatttatttatttatttatttatttacttacttacttacttaattacttacttacttgcttacttactgagtctcactctgttgcccaggctggagtgcagtggtgcgatcttggctcactgcaac

SEQ ID NO: 9733 - DNA, 201 bp, Homo sapiens
cagtgttgtctgataatggtgggactgggaattggaagaatgcagcttgtgtcagtaacatttatttatttatttatttatttatttatttatttatttayttacttacttacttaattacttacttacttgcttacttactgagtctcactctgttgcccaggctggagtgcagtggtgcgatcttggctcactgcaacc

SEQ ID NO: 9734 - DNA, 201 bp, Homo sapiens
ctgggaattggaagaatgcagcttgtgtcagtaacatttatttatttatttatttatttatttatttatttatttacttacttacttacttaattacttayttacttgcttacttactgagtctcactctgttgcccaggctggagtgcagtggtgcgatcttggctcactgcaacctctgcctcccgggttcaggtgatt

SEQ ID NO: 9735 - DNA, 201 bp, Homo sapiens
tcccgagtagctgggattacaggtgcccaccaccacacctggctaatttttgtatttttagtagagatggggtttcaccatgttggccaggctagtctcgratgcctggcctcaagtgatccacctaccttagcctcccaaagtgctgggattacaggcatgagctgctgcccccacccagtgactctcttttatatatga

SEQ ID NO: 9736 - DNA, 201 bp, Homo sapiens
gaggctgagaccttcccagggaggacccctgcaggcattggcctccgctgcaatagtccctttcccatagctccccaccctgatctagagttgcttggctrtgtggccagatagactgggaaagcctggtttcatctctttggcttggaagtttccttccagacatgtctagggctggtgtgatggaggtgggaatgtggg

SEQ ID NO: 9737 - DNA, 201 bp, Homo sapiens
gctgccacgaggcccctttggagagatctgagctatatccctgccccctttggctgcccgaaagtgtgtgtgtgtgtgtgtgtgtgtgtgtgtgtgtgtgwgtgtgagagagagagcatacatgtgtgcaagtgtgtaagtgcagggtgtgtgttgtcaggatattgttacactgcctaagggcaggagatggctcctggc

SEQ ID NO: 9738 - DNA, 201 bp, Homo sapiens
tgccacgaggcccctttggagagatctgagctatatccctgccccctttggctgcccgaaagtgtgtgtgtgtgtgtgtgtgtgtgtgtgtgtgtgtgtgwgtgagagagagagcatacatgtgtgcaagtgtgtaagtgcagggtgtgtgttgtcaggatattgttacactgcctaagggcaggagatggctcctggcta

SEQ ID NO: 9739 - DNA, 201 bp, Homo sapiens
ccacgaggcccctttggagagatctgagctatatccctgccccctttggctgcccgaaagtgtgtgtgtgtgtgtgtgtgtgtgtgtgtgtgtgtgtgtgwgagagagagagcatacatgtgtgcaagtgtgtaagtgcagggtgtgtgttgtcaggatattgttacactgcctaagggcaggagatggctcctggctatt

SEQ ID NO: 9740 - DNA, 201 bp, Homo sapiens
gggggctgtgtctatactccatctagtccagtggaggtaacgcacgctgggtttggagcgaggacatgatgtgcgacccacatcggtcccttccatctgcrtgaaaaggattttctagatgcagtgggctgagcacaatcatgagaaaccacagattcatcccattgcagccttgctttggcgttttgataggcaacgtgg

SEQ ID NO: 9741 - DNA, 201 bp, Homo sapiens
ctagaatgtgtgatctaggtgaggtcattgccaccttgaccctttatagtcagggcctggcctgccgggcctggctgcatctggcagaagaagggaggacmcgctcatctaccatggttgcctagggccttgggaagagtgggagagctacctatgctgcgggtgggttagaaggagaagggtggggtgagccagaatgag

SEQ ID NO: 9742 - DNA, 201 bp, Homo sapiens
ttttgagttgtgtttccttccagagagcattcagtcaaacctcagatgttcttttcctatagcttgagaaaaattcctgaaagattccttagcttggttcrtggctggcagattcctgtgagggccagctaatgggcatgtcttggttatatggtggcagagaaaaaaacctctgaccagtttctggctgaggaacagggc

SEQ ID NO: 9743 - DNA, 201 bp, Homo sapiens
cctgccgtgagccagggaggaactccatacattatgtaggagtggctctccccctgcagtggatattgtagacttttgtacctgcagcaggcgagtgtcarctgctttggaaatgaagcatagccctggaagaggggaatgaatggagaagaccaagggtaagtgctgctttagggtccctctcaccagattgtgacagct

SEQ ID NO: 9744 - DNA, 201 bp, Homo sapiens
ccttccccagacttcagtgggagatctattgtttgatcatggggtttggcaggcacttcgttaaggtggtgtgatataattttctggacctaggttctggycctactgtgtatcagtctcttgagctatggggggcctctccctggttccagggctcagcttcttcatccgtgaaatgaggctggatttggagctcttgaa

SEQ ID NO: 9745 - DNA, 201 bp, Homo sapiens
tggttgctgtgggtggggacagtgtccctgccaactgttaagagtccctgcccttttccagggacaagggcaagacaggaaaaggggaccaatttccgagkactgtgtgctagactcaggtttgtgatgtatattattttagttttataatcctaacccaatgccataggtagaattagcattttctgtattacatatgag

SEQ ID NO: 9746 - DNA, 201 bp, Homo sapiens
cccccatgtgagatgaggcttcctggggcccaggggcaatattactaataattactcattgttggcattttggagctaggtaaagcattctcccattgctrctgtttcagggttagacatcagtgacgagtagcctgggatatggcactggctcccaggtatgatgtatttctttgatcctagtctttttcagctgctcgg

SEQ ID NO: 9747 - DNA, 201 bp, Homo sapiens
aaaaagtcagaaaagcacagagacagaagcaaaaaaatcactattttcctaccacataccattgttgactttttggtgtagatccttccaggtgtgtgtgtgtgtgtgtgtgtgtgtgtgtgtgtgtttgtgtgtgtgtgtggtttgtgtgtgtgtgtggtttgtgtgtctgtattagattgtatacacttctttttttat

SEQ ID NO: 9748 - DNA, 201 bp, Homo sapiens
aggcctaaaaaagtgacatttttttttttgttttaaccttggccagttctaagaaagagcacgagcatgtatgaatgggttcttcagtggtgtgaggaaaraatatgtttgccaccttggtttgtttttctttatttgcctcttggtttttcctttgtcagcgtaatgcagaaacactagatctccaccctaagaaaaaag

SEQ ID NO: 9749 - DNA, 201 bp, Homo sapiens
tcatgtgttgggtcttttcagattggctgagatgatgcacggcacacttggatgttgttgaagtacttacactttgcttgggtagagtttgcatgaaagascattatttaactctttgagtagtaggattgggcttcctggaggaattgaggtgaaagatcaaaaagttgattgtggcttggcttaggccaagagggtaaa

SEQ ID NO: 9750 - DNA, 201 bp, Homo sapiens
actttctaaggaatattacctagccacagatctacagggtgtgtttgtttcttaaagcctatgaaaacccaccccttctttttggtttgtttcttttataygacccttaaatgtctttctccagagccctgccacccaccttcttcctgcgcactctaccttttctctctgtgatatcttttctaatcctatgcttttcac

SEQ ID NO: 9751 - DNA, 201 bp, Homo sapiens
attttctcacctataaaatgggcgataatattaatacataatttgtagggtgttagaaggattcaatgagttaatatttgtgatatgcttaaaaaagtgcytagcacatagtaagtactacttatgtagcatttactacgtgctttgttagtgtgtgccttattaaataaaataaatatatatccttagcttgacctagag

SEQ ID NO: 9752 - DNA, 201 bp, Homo sapiens
ttaacctctctgagcctcatctgtaagataggagtaggttacctacttgatgaggctatgtgaggattatatggccgtgtgtgtactgagtgccgggtccractctcagcacatggtaagctcacagcaagtactgtattgttatgatttccactaatacagccattatgtgctatttaatttgtagttcgcgtatgtgtc

SEQ ID NO: 9753 - DNA, 201 bp, Homo sapiens
tgtttacactgatgtgtcaccagcacctagaacattgcctgacacataataagtgcttaataaatatttattgaatgaatgaatcccaccacacaaggatyactgcctgtcttagtccgttcaggctgctataggaaaatagctttgactgggtaatttagaaatgacagacattttttactcatggttctggcgagtggg

SEQ ID NO: 9754 - DNA, 201 bp, Homo sapiens
agttcttctaggtggtgtcttcaatgtgtgctcacatggcagaagggccagaagggataaataagcttcctctggcctctgctgtaagggcactaatcccrttcatgaaggctccaccctcgtgacccaatcacctcccaaaggctccacctcttattatcacactggggatgatttcaacatataaacttaggtggggga

SEQ ID NO: 9755 - DNA, 201 bp, Homo sapiens
ttgctcccctcctgggccctctcaggcagctgagccttgcatcaggaacacctcttgcaatcacacagcatcagccctgtgagaagctaatttgataaacyccactccaaagctcattgaacctgtctataacgatgcttaattaaagtgcagaaactttgaagagatagcaagttactgcttaatgcaataccagagtgc

SEQ ID NO: 9756 - DNA, 201 bp, Homo sapiens
tcctttagaaagtatgggagcttcttggctagcaaatggagcctcctactttgttagaagggaaagtatagatggagctggcagatctcagagtggtgttmtgagcacaactaactagattactgtgactcagtggagacacttctagtaccaatagggtctcagagctgagagagagagatggtcattcatatctgttag

SEQ ID NO: 9757 - DNA, 201 bp, Homo sapiens
aaggacaggatgtgctgcctgagtcccagagagcccctgtggaagtcaggccaggttagtggggatcatcttagtcctcttaggaagactgatctgagatgggggaagagaatggaaggggaattaggatgagttctccaagaagcagacatcaaaacaggattgattagacatgcaagaatcttattgagggagatgcct

SEQ ID NO: 9758 - DNA, 201 bp, Homo sapiens
ctaaggataccctgatgtgtctgttcctgtggtctcttctaccttacctccagcttcctaaacccttccagtggtttcaactgttcttcacataaagactrcaccctttatccttgccttctgggcctggtctgggccctttctagccctccattcttattgcctactatgctttcctccctgtccctgttccagccccac

SEQ ID NO: 9759 - DNA, 201 bp, Homo sapiens
gagataatatgtgaaagagtgctcttttgtaaactctaaagtattttacaaatgtcaatactgtgccacgtcttagtattttcaaagaagcctaaacccamtggagatgggggtggatgggggtactgtccagaccctgttgctgatcctgttcccgagcccactctggccctctccccctgaccctgtagatgagatctt

SEQ ID NO: 9760 - DNA, 201 bp, Homo sapiens
gtactgtccagaccctgttgctgatcctgttcccgagcccactctggccctctccccctgaccctgtagatgagatctttttatgtatttctaaaaaggasctaaaacgtttttggagcatcggctctatggaggagagaggagacctgtgggatggaccagtgttttagcttctgggtccctgctccttcatcagtggaa

SEQ ID NO: 9761 - DNA, 201 bp, Homo sapiens
taggaagcacccttgtccacagctgtttcctgccgctgctttgttggtgctgggaagtttcgtttgtgctgggggggtttcgtttgtgctgcaggggggtggggggggcaggggttagtttgtgcacctaggtggccactctttggatctcccacatctgttctgggttctgaactttgaccccgttcctgcttcttcctt

SEQ ID NO: 9762 - DNA, 201 bp, Homo sapiens
tctctatccctctaaggacactagggattagatttgcagcccggcctactccagtatgacctcatcttgacttgatgacatctgtaaagaccctatattcaaataaagtcacattcacaggtaccaggtgttaagacttcaacatgtctttctcagcccacaacacctcatcttagtctagccttcctgcttatttgattt

SEQ ID NO: 9763 - DNA, 201 bp, Homo sapiens
ttttcccaaagtctttacttgatgaaataaaaaattaatcttatgtccttactaggcacattctctttttgtagggggtcaaattttatttccccatgacwtctataagtctagaaacctggccagatgccacagggtagacccccagtcctggttagaaagcatctccattttctgggatactaattctctctaagaact

SEQ ID NO: 9764 - DNA, 201 bp, Homo sapiens
ggcccaccctaaggacctcattttaacttagttagctctttaaataatctaactccaaatacagtcacattaggtactggggttaggagttttggtgggaggggggatgcagttcagcccccaacaattcctgtccaatatacagggtgactatttccaggggatggggagaatcagtggaaatttcatgtgacatctgat

SEQ ID NO: 9765 - DNA, 201 bp, Homo sapiens
ttcctcaagatagagaactggtggggtggtggaagttcaggggatgaggtaatgattgactatgcagcctcttctaggtaagaagtgaagagaatggagtrtgggagggatgatagactgtgagtgaagagattagggtgccgtatagctttggtgaggttagcaaggagggttaggaagagacaggagatagaaataaga

SEQ ID NO: 9766 - DNA, 201 bp, Homo sapiens
ccagtgatcttgcacctgcagtttggatggggtttggctgatctaggttgttcatagttggggtgggtggctggaatagctctggtcattgacctgttggractggtgggctagaacaggcatgcttatctcatcgtgagggcagaggtgccaaagagcaagcacttttcaaacttttggtcatgtcacacccactaatat

SEQ ID NO: 9767 - DNA, 201 bp, Homo sapiens
acagagggaagaattcgaaagaggcattgggaggcagttggctacccagggccagagagcagctgctggagcagggaggtcctagccttaggaataaaggrcacacacacacacatacacacacacacacacacacacagctgctagaagagcgtgggctcacccgaggtaaactcccacaaagccttattattttgggaa

SEQ ID NO: 9768 - DNA, 201 bp, Homo sapiens
ctctggctgcccaggcgtattgagaatggccatggatggttgagaactaggcacggggatcaagcccgggcccctctcctatctaccctggatatgagccrtggccaccttattagtctgtctgtgtcctgctgtattcctttcaaaaccgggtcccacaccatcgaaaatacagactttgtctcatcactccctctgttt

SEQ ID NO: 9769 - DNA, 201 bp, Homo sapiens
ctttgtctcatcactccctctgtttaaaatcttccaacagctccccaagactttcttagcttggcatccaggacctttggaactctgccctcaacaagactttttttttttttaacttttaaagttatctccttattaatattctctatttgatgagacattgtcatacctacatttactttttttgttttattttattat

SEQ ID NO: 9770 - DNA, 201 bp, Homo sapiens
ttccaacagctccccaagactttcttagcttggcatccaggacctttggaactctgccctcaacaagactttttttttttttaacttttaaagttatctcyttattaatattctctatttgatgagacattgtcatacctacatttactttttttgttttattttattattattatactttaagttttagggtatatgtgc

SEQ ID NO: 9771 - DNA, 201 bp, Homo sapiens
agcacctgttgtttcctgactttttaatgatcgccattctaactggtgtgagatggtatctcattgtggttttgatttgcatttctctgatggtcagggayggtgagcattttttcatgtgttttttggctgcataaatgtcttcttttgagaagtgtctgttcatgtcctttgcccactttttgatggggttgtttgttt

SEQ ID NO: 9772 - DNA, 201 bp, Homo sapiens
attctaactggtgtgagatggtatctcattgtggttttgatttgcatttctctgatggtcagggacggtgagcattttttcatgtgttttttggctgcatraatgtcttcttttgagaagtgtctgttcatgtcctttgcccactttttgatggggttgtttgtttttttcttgtaaatttgtttgagtacattgtagatt

SEQ ID NO: 9773 - DNA, 201 bp, Homo sapiens
ggttttaccacgttagccaggatgatctcgatcttctgacctcgtgatccactcaccttcacatcccaaagtgctgggattacaggcgtgagccaccgggyccggcccaagtagcaggtatttattagaggtttgttgaatgaatgaataagggcgcgttgtgttgaatgaaatggaggttgtgaccgcttaactccctct

SEQ ID NO: 9774 - DNA, 201 bp, Homo sapiens
actgtgacagggcagagtctggcataggtgggcccattgtgtgccatccaaatgcatttaattactgcaggatgagcccataggttttatatcatatgccygttgcaactgatgggaaggtagcacttcttagactgttggttgagaaggattctgaagctccctctgggctcaacattatggtaccatgattaattaatg

SEQ ID NO: 9775 - DNA, 201 bp, Homo sapiens
atggtaccatgattaattaatgattgattagtgaagtgtgctgtgaacacgtgtagggaagattcatgtattttgccaccttatctaacatatcccagaarcagtggtataatactaatcagtgtgatatatgacagaaatatgggacttattcagaagcttgaatttaagattcaattgcatcacttactgttttgtgac

SEQ ID NO: 9776 - DNA, 201 bp, Homo sapiens
actaaacctaccatcgttctaagctctgcaggtcctaatacttgccctggcctgggagggtctgaagtgtgccctcttgctgtgtcttttctttgccactrtcttccttctttatgcctcacatgtttatgtcttcctacaggacacagtgtgagggttggtagcaccatatactctctaggggttggcagtggaggggat

SEQ ID NO: 9777 - DNA, 201 bp, Homo sapiens
ctgtgtcttttctttgccactatcttccttctttatgcctcacatgtttatgtcttcctacaggacacagtgtgagggttggtagcaccatatactctctrggggttggcagtggaggggataataagtggggacctaaggatgttgcaacagatgggctcactgggtcactgttccctctccagttctcttcagccattg

SEQ ID NO: 9778 - DNA, 201 bp, Homo sapiens
agtggaggggataataagtggggacctaaggatgttgcaacagatgggctcactgggtcactgttccctctccagttctcttcagccattgacaaggatgmtaagttcatctgaccaaagtgcttttccaatgtagatccctttatttttatttattttgtatttttcttgagacagggtttccctctgtcacccaggcta

SEQ ID NO: 9779 - DNA, 201 bp, Homo sapiens
gcttttccaatgtagatccctttatttttatttattttgtatttttcttgagacagggtttccctctgtcacccaggctagagtgcagtggcacgatctcrgctcactgcaacctccgcctcctgaactcaagtgatcctcccgcctcagcttcccaagtagctggaactacaggcatgagccaccacacctgactaattt

SEQ ID NO: 9780 - DNA, 201 bp, Homo sapiens
caagtgatcctcccgcctcagcttcccaagtagctggaactacaggcatgagccaccacacctgactaatttttgtatttttagtagagacaaggtttcascatgttgtccaggctggtctcaaactcctgagctcaagcaatctgcccgtcttggcctcctagatcccttctagccacctctgtctctgtctctgtctct

SEQ ID NO: 9781 - DNA, 201 bp, Homo sapiens
gaaggtagaggaggagagatggtagattgggtgaggggcatcacataaactctggagctagacccagttctgcggttattcattcattcattcaacatatrgtatccatattctttttctcccccagagaatagattttctttagtccttgaggactcagcttcttacagggactttggcagaggtcaggggtgtagtgcc

SEQ ID NO: 9782 - DNA, 201 bp, Homo sapiens
gtagattgggtgaggggcatcacataaactctggagctagacccagttctgcggttattcattcattcattcaacatatggtatccatattctttttctcmcccagagaatagattttctttagtccttgaggactcagcttcttacagggactttggcagaggtcaggggtgtagtgccttggctctaaattggggtgag

SEQ ID NO: 9783 - DNA, 201 bp, Homo sapiens
ggcactactcatgtagtaatgttgtttcacatacagcttgggaggcacaaaagccttgaagatacatgattcatgcatgtcctgatggctgcagtctctgytgtattttggatgatgagcttcttaatggccttgtccttggctacacatagggccaaattcatgcaataaataggctgaatatggctgtggtcctttttg

SEQ ID NO: 9784 - DNA, 201 bp, Homo sapiens
tctgcttctaagataaagacataaatactctctgtagaacttccgttcactagacaaaattctatcctggagggcaatagagaaaccgtgggatctttttkccaatttaagtatgcttcaaaaaaaaaaaaaaaaaaaaaagaatgcttcctactcctgtggacactgctcctgccactgctgcattgcctgtgttagccc

SEQ ID NO: 9785 - DNA, 201 bp, Homo sapiens
ttagtagatactgccagcataattttccaaaagtagttacatttttataaatttttaaatttcatgaagttcaaaactgccctatgagataggtattattccccccccccttttttttgatgaagaaagactcaagagagttgcccaaggttaaatagctataggaatgagagtctgggtttaaattcagctgtgcctgcc

SEQ ID NO: 9786 - DNA, 201 bp, Homo sapiens
tagtagatactgccagcataattttccaaaagtagttacatttttataaatttttaaatttcatgaagttcaaaactgccctatgagataggtattattccccccccccttttttttgatgaagaaagactcaagagagttgcccaaggttaaatagctataggaatgagagtctgggtttaaattcagctgtgcctgcct

SEQ ID NO: 9787 - DNA, 201 bp, Homo sapiens
tatgagataggtattattccccccccccttttttttgatgaagaaagactcaagagagttgcccaaggttaaatagctataggaatgagagtctgggtttmaattcagctgtgcctgcctccaaagcccatgttctctctcactagcctgaactacttttatatctttgagagaattcatgccttaacctccctcactaca

SEQ ID NO: 9788 - DNA, 201 bp, Homo sapiens
taaatagctataggaatgagagtctgggtttaaattcagctgtgcctgcctccaaagcccatgttctctctcactagcctgaactacttttatatctttgrgagaattcatgccttaacctccctcactacatgcagtagagcctttgctgttgtattaagatagatagtgctgactatgtgagcttgccctaatggtgtg

SEQ ID NO: 9789 - DNA, 201 bp, Homo sapiens
gggtgagagacccatcttgaaactaatcactgtggccaagagattggaatgtcccagttgactaaactggatcatatgatttgggattgggatgaacctcwccttgaatgacacagaacgagattggtggtgaaaatcatttacctgcaaagtggggtgaggggagcagtgaacatggggcaaaaccaccagagagccact

SEQ ID NO: 9790 - DNA, 201 bp, Homo sapiens
tttcctcagtcagcctttttgatcccccacaatgcagggcagggaatggtggtatcccccagtgctggtctgggctggaggggaaggatgagggactgaakgaatggggaggctcagcctggaaggggtgtgtggccccgacaaagcaggctaagtgcccatgatcttcccccacaagggaatgtttctgggcagcagagt

SEQ ID NO: 9791 - DNA, 201 bp, Homo sapiens
catgacgaggccctgtggcagacaccatgttgaagcagtcattgcctccagggagccccccatcagcaatctggttccagagcctgggctcttaattgccrtgctttactgtctctgaagtaaacttgtcccccactagtttgtgatgccctggagggtgagattggtgtctttattttgctttgatccagtagtgcctgg

SEQ ID NO: 9792 - DNA, 201 bp, Homo sapiens
gccagcagctgtggctcatgcctgtaatcccagcactttgggaggcctagatggggagatcagaagtttgagaccagcctgggcaacatgatgaaactccrtctctactaaaaatacaaaaattagctgtgcatggtggtacatgcctgtaatcccagctacttgggaggctgaggcaggagaattgcttgaacccaagag

SEQ ID NO: 9793 - DNA, 201 bp, Homo sapiens
gggaggctgaggcaggagaattgcttgaacccaagaggtggaggttgcagtgagccgagctcacgccactgcattctagcctgggcaaaagagcaagactstgtctcgaaaaaaaaaaaaaggcttatgctaggatcttcctatacctgatttcattgattcctctcttcaatcttgggaagaggctattattttctctac

SEQ ID NO: 9794 - DNA, 201 bp, Homo sapiens
agtcacattgaacattgtggagaatgagggacagagaagaggccctagatttgtacatctgggtgttatgtctataaatagaatgctttggtggtcaactrgacttgttcatgttgacatttagtcttgccttttcggtggtgatttaaaaattatgtatatcttgtttggaatatagtggagctatggtgtggcattttc

SEQ ID NO: 9795 - DNA, 201 bp, Homo sapiens
ggagctatggtgtggcattttcatctggctttttgtttagctcagcccgtcctgttatgggcagccttgaagctcagtagctaatgaagaggtatcctcaytccctccagagagcggtcccctcacggctcattgagagtttgtcagcaccttgaaatgagtttaaacttgtttatttttaaaacattcttggttatgaat

SEQ ID NO: 9796 - DNA, 201 bp, Homo sapiens
ataccaccctgcgcctgacattctaggtgctttttatattcattggctcatctatttctcacaaaactcctatgaagttaataccattagctccattttayggatgaggaaaccgaggaaccgagaaattgggaacttgaaccccccgtttggcatagtggataagagtatggctgctggagggaaaatgatccggactta

SEQ ID NO: 9797 - DNA, 201 bp, Homo sapiens
ggctcatctatttctcacaaaactcctatgaagttaataccattagctccattttacggatgaggaaaccgaggaaccgagaaattgggaacttgaacccsccgtttggcatagtggataagagtatggctgctggagggaaaatgatccggacttaaatttgggcttgtctacttacatgttgtatggctctggagaagg

SEQ ID NO: 9798 - DNA, 201 bp, Homo sapiens
tcatctatttctcacaaaactcctatgaagttaataccattagctccattttacggatgaggaaaccgaggaaccgagaaattgggaacttgaaccccccrtttggcatagtggataagagtatggctgctggagggaaaatgatccggacttaaatttgggcttgtctacttacatgttgtatggctctggagaaggttt

SEQ ID NO: 9799 - DNA, 201 bp, Homo sapiens
gggaaggtgtggtgggaagaggagatgtctaggatatccactgggaaaagggaggaaatgtttggaaatatttgcagtagatttagaggaacaaggtggtwtttagacagagggatcactctagtcatcctcctgagggttttttccctgctgaagttgggaggtttagtttgctgtggctcacaaggtaagggggagtgg

SEQ ID NO: 9800 - DNA, 201 bp, Homo sapiens
gaaaaagtacagtgagagtgtgtacagcttatttacttaataggttgctttcaaatagaaaggagtacccacttgcgaggagggatacgctggaaagcaargctgagatcacttctttgtgatccacatcatggggaaagggctggacaggctgggagtttaccacacactcagtttcttccttcctcctcattctctcag

SEQ ID NO: 9801 - DNA, 201 bp, Homo sapiens
gacaaatcctcccacagtatgtttgctctgtctgggccagaaaagacaaggctggagtttaggcagaggtgttgtacaatcacatgatgtgctttgactcrcggcttagttttaaggaaacacactgaaatttggggagattctggtgttgcaggagaagtctgtgaaggatgaagtgtggatcatgtggccctgttagag

SEQ ID NO: 9802 - DNA, 201 bp, Homo sapiens
tgggataataagtttaaaggggacttcaaaagtcattggatctaagtactcatttctcatcctcctctgcactatataaaatgagcctccccgtgccccgcccccccgcccaaagaaaacctgctagccatctgcaataatgggagcttggtgcttttcaaggcagcctaatgtatctctggtcaatactgagtatcaggg

SEQ ID NO: 9803 - DNA, 201 bp, Homo sapiens
cctgccaagcaaattcgctcctgcaccctaaaggggatgaggctagtcttggccgtcagccatctccccattgacagtcatttacctgacacagcagcagaaaaaaaaaaaaaaaaaaaggaacccgtctcatcattttgtggtttaaaatagtttacttttaagagcaaagcccacagacatcattttgagtccaagcac

SEQ ID NO: 9804 - DNA, 201 bp, Homo sapiens
gaggaggtattctctttaggaactgtaagacgtgaaaccaagggtggaggactctgtttcccttagttaatgcacttacaggcttgtttgctaaatgtcaygtctctgacaaaaagcaggtactcaataaatgtttgttgccttaatcacattgtgtgtatatgcaggttttatatgtgcacatatgtgtctgtattcata

SEQ ID NO: 9805 - DNA, 201 bp, Homo sapiens
tccgagccacagaggaagaattctctgttggttagaggtgttggaccacagaacgcacaactttggcaagctctgttcccaaaaggggcacagcaggtgcyttcgtgaagctatcaggagcatgtgccagcatgtgcatgccttcaatccaaggactctgtggttttggggtcttggtagccaggcccaccctcatgtttg

SEQ ID NO: 9806 - DNA, 201 bp, Homo sapiens
atcagttttccaggaatttcaggacacaggaattatcacccagctgtgttgtgtgttgctgttcagcaatctgaagttgcttatctagcgtaagtcagaayggggagcctagggaggaggggcaacgccttcatttttctaagcagaagagactgaggtgttaggggcccagctggtatgcgatgggaaccaagaaatgga

SEQ ID NO: 9807 - DNA, 201 bp, Homo sapiens
ccgatctaccctccacccagtagtacaaagatacacaaggcgctagagtgaagtttttccatcctgcatgaaaacaataaaaataaacaatgtagtacatytttggtgaagtcactttttttttttagtttatgggatatgcccttttattttggggatgtgaaaagaccttttctttttaagagaatatgatgatataaa

SEQ ID NO: 9808 - DNA, 201 bp, Homo sapiens
tttgcaggtctaaattttgtcaagaatgtttgatccttccttcaattttttagttaataacaaatttcaccatgcgcatttttagctgctgtcagttctattttttgtgtgtgtgtgtgtgtgtgtgtgtgtgtgtgtgtgtgtgtgtgttttcctgacaggtctaatttttttccgggtcagtttttgcagtttgaaaaa

SEQ ID NO: 9809 - DNA, 201 bp, Homo sapiens
ttgcaggtctaaattttgtcaagaatgtttgatccttccttcaattttttagttaataacaaatttcaccatgcgcatttttagctgctgtcagttctattttttgtgtgtgtgtgtgtgtgtgtgtgtgtgtgtgtgtgtgtgtgtgttttcctgacaggtctaatttttttccgggtcagtttttgcagtttgaaaaac

SEQ ID NO: 9810 - DNA, 201 bp, Homo sapiens
ggtctaaattttgtcaagaatgtttgatccttccttcaattttttagttaataacaaatttcaccatgcgcatttttagctgctgtcagttctattttttgtgtgtgtgtgtgtgtgtgtgtgtgtgtgtgtgtgtgtgtgtgttttcctgacaggtctaatttttttccgggtcagtttttgcagtttgaaaaaccaaat

SEQ ID NO: 9811 - DNA, 201 bp, Homo sapiens
tctaaattttgtcaagaatgtttgatccttccttcaattttttagttaataacaaatttcaccatgcgcatttttagctgctgtcagttctattttttgtgtgtgtgtgtgtgtgtgtgtgtgtgtgtgtgtgtgtgtgtgttttcctgacaggtctaatttttttccgggtcagtttttgcagtttgaaaaaccaaatct

SEQ ID NO: 9812 - DNA, 201 bp, Homo sapiens
tgtctttagagtacaacagaaattataagataaaaatagtgattaataataattctaattataattcacaaacatattattaatatgtgaatgtgaaatcraaatgctttttagggactctctctcctcttacttaatctgtgtttctttctttctttttttttgagatggagtctcactctgtcgccaggctggagtgca

SEQ ID NO: 9813 - DNA, 201 bp, Homo sapiens
ttctttctttttttttgagatggagtctcactctgtcgccaggctggagtgcagtggtgtgatctcacctcactgcaacctctgactccctggttcaagcrattcttccacctcagcttcctgagtagctgagattacaggcacataccaccacgcccagctaatttttgtatttttagtagagacagggtttcaccttgt

SEQ ID NO: 9814 - DNA, 201 bp, Homo sapiens
aacacagtattccaggttgtcaacaatcaaagaacagggaattagtatgtgctgagcatggtgtcaggcaggtcattaagcattttatatacaattgattsttttgataagcttgacaactctggaattgatacaatgactcccaatttatagatgaagtttaagggacttatctaaggtcacataatgaatagcaatatt

SEQ ID NO: 9815 - DNA, 201 bp, Homo sapiens
agcgttctctgtcaactctaaatcccccattagtgctaagtatgataatagaagaccatgtaggaccacactatcatgtttacatcgtctcttggttcatwagattggtgactaacagcaatgcagagccgtctttttgagtctccagtgcctaagtcagtgtctggcatgtagcacctggtcaataaatgttagctattt

SEQ ID NO: 9816 - DNA, 201 bp, Homo sapiens
tttgtggcctcattcaaacctcacagcaacctggtcatgtacttactgtcattattcccagtagttggggatatggaaaatgaagctcacagaggctcagytggcaaaagtcacacagctagtaggaagctggaaagtcaggcctcaaagccagggcttctgtaactaaaatgtggactgtatacacaatggaatattatt

SEQ ID NO: 9817 - DNA, 201 bp, Homo sapiens
aactgtcaaaccctgtttcctcaagccagagccactgcaagtatgtgagagcccctgaaggtgtttgagtacagcagtgacctggcccacagaaatgcctrccttggtccttcctcttcccctcctggccgctgcctgcccaggctgactggtgcctgatatagctgctactgatgctccatcttgcaatctggagttatt

SEQ ID NO: 9818 - DNA, 201 bp, Homo sapiens
gggaggccttaggaaacttacaatcatggcagaaggggaagcaaacatgtccttcacatggtggcaggaaggagaagtgctgagcaaaagggggaaaagcyccttataaaaccatcagatcttgtgagaacttattcactaccacaagaacagcatgagtgtaactgcccccatgattaaattatctcccactgggtccct

SEQ ID NO: 9819 - DNA, 201 bp, Homo sapiens
ggggaagcaaacatgtccttcacatggtggcaggaaggagaagtgctgagcaaaagggggaaaagccccttataaaaccatcagatcttgtgagaacttaytcactaccacaagaacagcatgagtgtaactgcccccatgattaaattatctcccactgggtccctcccatgacttgtggggattacgggaactacaatt

SEQ ID NO: 9820 - DNA, 201 bp, Homo sapiens
ccaatcactatttgacattatgtatctgtttttattcccattaaaacccaagagtattgtctgtttcattcactgcttgtatctccaatgtttaaagcagrgttcagcctatgatagatgctcggccaataggtattgaatggtgaatagatgatcttcattgataaaactcgcagaaatacttttagtatctccatttat

SEQ ID NO: 9821 - DNA, 201 bp, Homo sapiens
tttaacatctattccaggcaatccatcagtaacagttaatggacccgcctagttatttatacaacactttttccctttccacctcttctcttcttcctgcyattcatccctaaatctaacacactagaaaacctgaaggggcggtgtggctgaggcatgattcagagctttctagaagtttctttgggcagatacagcttc

SEQ ID NO: 9822 - DNA, 201 bp, Homo sapiens
acagtgccttgggctgctctgggttatgcttccccagcccgattctatttcacatctgagggaaggaggaggagattatgttgttcatggggctgataggmgcgaaccgttcttcattttctgaaagttcattggcttaattcaaatgtcaacctgtctagggttgggtgtttattcgtagttgtcaaaagtgatttcaag

SEQ ID NO: 9823 - DNA, 201 bp, Homo sapiens
ccctggacatggcaggaggtggcctgagcgtgcccggccctggctgaggtcagtgggggcctcctgcctctctgagccccttgccaggcattctggagccrgcagcgctgtggttctgaaacaagaagccttcagcagttctctgactcttttttccttcccctcaggaagtcaagttggggattttatgagctaatgtaa

SEQ ID NO: 9824 - DNA, 201 bp, Homo sapiens
cctggacatggcaggaggtggcctgagcgtgcccggccctggctgaggtcagtgggggcctcctgcctctctgagccccttgccaggcattctggagccarcagcgctgtggttctgaaacaagaagccttcagcagttctctgactcttttttccttcccctcaggaagtcaagttggggattttatgagctaatgtaac

SEQ ID NO: 9825 - DNA, 201 bp, Homo sapiens
ccttgccaggcattctggagccagcagcgctgtggttctgaaacaagaagccttcagcagttctctgactcttttttccttcccctcaggaagtcaagttggggattttatgagctaatgtaactatttacccagaggccgctggaagactataaagggatgattgattaattgattaattttacatgtggaggagatgag

SEQ ID NO: 9826 - DNA, 201 bp, Homo sapiens
attcccagctctttgcacagcacatggcacagagcttaacctcaaaaatctctattgaacaagaagtatggccacaagcacatggggagttttgagtttgyagggttccaagacatggtggagcttaaagggtatcctgtccaaggagtgcaaactgaggcccaagaagggaaaggacctatccaaggccatgttacccat

SEQ ID NO: 9827 - DNA, 201 bp, Homo sapiens
cataagttatccatttgatcctttaagcacatgtttccattttatagatgaaaatactttggctcagaaaggtttttttaaaaacggaaaatcaacccacmgttgtagctgtgtcttggtctccctaattgtcttgaggcatgctcctgtgcagtgccgtagaacctccccaaacacacctgctgttctctcctgtctcat

SEQ ID NO: 9828 - DNA, 201 bp, Homo sapiens
ctgttggttactcatgggcatgataggaagaaaccctttctgttcagtccagccaccttgccataagaacaatattggtctagtggcaaacagtgagtggrctggtatgattacatggtacaaaaggctaggtggtgaggactgaacatggtagtatcatggaagggcaaaacccagaggctggaatctgggcaaccccta

SEQ ID NO: 9829 - DNA, 201 bp, Homo sapiens
tcaggaggctgaggtgggaggttcacttgagcccaggagtttagggctgcagtgagccacgatccacgattgtgccactgcactctagcctgggcaacagrgtgagaccttgtctcaaaaaaaaagggggacttaggtagaaggtttcttctaacccttcccctttcctgtaaacattcttctcaatcccacgctgtctcc

SEQ ID NO: 9830 - DNA, 201 bp, Homo sapiens
gaggattgaggaaagggagaagacagccatttaaaagggcttcccagggccctttaaaccatgctgagccagggtcataaatgaagctgatgtctaggcaygattttctgcttctggattctctgagatatgtctcctttcttctccattagcactgaactagagggggtaactggtgtcatggttaccatcacaggctgg

SEQ ID NO: 9831 - DNA, 201 bp, Homo sapiens
aggcaatttcaactttgtatgccttatctcctggtgatctttttctcctcttattcctctatgtaccctgagaacctgtgcgccacagataggcaggtacragaagggtggaatatattaacaggactagaaagagggaggtggaagggtcaaaagtatcagacatcctgttgggatccagctggagtagcactttttcag

SEQ ID NO: 9832 - DNA, 201 bp, Homo sapiens
acatcctgttgggatccagctggagtagcactttttcagggtgtgacatcaaacgggagacacttccgttgctttcttatatttttgtaattattttttawaaaaggaattgtagttccataagaatttgacattggcaattcttaatttccttagctgaactttaatggtgctgcattttgagtcatagctgaagatctg

SEQ ID NO: 9833 - DNA, 201 bp, Homo sapiens
agcctgtgccttttcttttggcagccctggaatatcaaacccagaataaatgccaaactccaaaaccagccagggtgcttgtcctagggctggcagtgtgrcctgggagattgctgctgatgggcatgcattttgaccccgtttctgaggtcgactagaaggtccatcttcatttttaccccttcctcatctacaacatac

SEQ ID NO: 9834 - DNA, 201 bp, Homo sapiens
ccttttcctttttttttgaatgtaaaattatttcaacatttatatcttaatgttgaatatgcttggaaaaaagaacctccaggatatcttaatatttcccyactcctcccaggttaagactcagggctccaaccccttttcctttgaggtgtcattcactgacacaggtgctgaccctctcatctatgaatggggttgtga

SEQ ID NO: 9835 - DNA, 201 bp, Homo sapiens
aatgttgaatatgcttggaaaaaagaacctccaggatatcttaatatttccccactcctcccaggttaagactcagggctccaaccccttttcctttgagrtgtcattcactgacacaggtgctgaccctctcatctatgaatggggttgtgagaagcccttatattaatatttgtcctgactctctctcagactgtagtc

SEQ ID NO: 9836 - DNA, 201 bp, Homo sapiens
tctttatagtccctactggtcttattgtctgaattaatcatttgacacttaggaattatccattcactcattcaatcatcaaacacacactgaacacttaytgtctgtcaggtactataataggtgttgccttacatgtcagtacatttccatagcataataaaaataacatcaacaacaactgttataaagctcgtgtca

SEQ ID NO: 9837 - DNA, 201 bp, Homo sapiens
tgaggcaggagaatcacttgaatctgggaggcagaggtggcagtaagccaagattgcaccattgcactttagcctgggcaacagagtgagattccgtctcaaaaaaaaaaaaaaaaaaaaaaaagaaaaagctcctatgtgtaggcacaaatttgtatatgttaatcctcaaagtaacttttgaggtaggcattattatta

SEQ ID NO: 9838 - DNA, 201 bp, Homo sapiens
gaggcaggagaatcacttgaatctgggaggcagaggtggcagtaagccaagattgcaccattgcactttagcctgggcaacagagtgagattccgtctcaaaaaaaaaaaaaaaaaaaaaaaagaaaaagctcctatgtgtaggcacaaatttgtatatgttaatcctcaaagtaacttttgaggtaggcattattattag

SEQ ID NO: 9839 - DNA, 201 bp, Homo sapiens
gaatctgggaggcagaggtggcagtaagccaagattgcaccattgcactttagcctgggcaacagagtgagattccgtctcaaaaaaaaaaaaaaaaaaaraaaagaaaaagctcctatgtgtaggcacaaatttgtatatgttaatcctcaaagtaacttttgaggtaggcattattattagtcaaattttatgatagga

SEQ ID NO: 9840 - DNA, 201 bp, Homo sapiens
aatctgggaggcagaggtggcagtaagccaagattgcaccattgcactttagcctgggcaacagagtgagattccgtctcaaaaaaaaaaaaaaaaaaaaraaagaaaaagctcctatgtgtaggcacaaatttgtatatgttaatcctcaaagtaacttttgaggtaggcattattattagtcaaattttatgataggaa

SEQ ID NO: 9841 - DNA, 201 bp, Homo sapiens
caaacctggctctgaagtccttgatcttaacccccatgcatcactgtcaggtatgagtatatatggcaaatgtgtgtgtgtgtaaatataagcacatgcayaccttcgcagctagactgaactctagaggtcagggatgatgtcccacacttacttgtatccccactaccttattcagtctatgcatgtggtagatacatg

SEQ ID NO: 9842 - DNA, 201 bp, Homo sapiens
tgagtatatatggcaaatgtgtgtgtgtgtaaatataagcacatgcataccttcgcagctagactgaactctagaggtcagggatgatgtcccacacttayttgtatccccactaccttattcagtctatgcatgtggtagatacatgaattgtttggatgattggttgttggtacttccattcactgttgaggggcttga

SEQ ID NO: 9843 - DNA, 201 bp, Homo sapiens
gcccaggatcttcgttttttaataaccatctccaggtggccgatgtagattgtcagtgaaatacactttgggaagcatataagataaagcgcaatgatagrggtttttacgaggcttgaatcccctcttactaccaaatgtcctgttcactatttagtaaatttaaaaaatattcacgtgggtcaaataaagactcttcca

SEQ ID NO: 9844 - DNA, 201 bp, Homo sapiens
atcttccttattcttttcttttcttttttttttctctctctctgtcttttttttttttttttgagacaaggtcttgctctgtcacccaggctggagtgcartggtgcgatcatagctcattgtagcctcaaacttcttggctcaagcaatcctcccacctcagtgcccacccgagtagctgggactacaggcatgcaccac

SEQ ID NO: 9845 - DNA, 201 bp, Homo sapiens
taatttaaaagaaagaaacctactttacctggcgtcttaagtctgcttcccaagggacttaatctttaacagatttatcacaaatcctacctattgcacaraacaacggtaaaaggaaagttctcgtgattaggcccagagcagttctgcaaacacaagactgtaagctagaaagccaggctttctgcccagcagcaggaa

SEQ ID NO: 9846 - DNA, 201 bp, Homo sapiens
ctgcatataaagatctgtaaattcagcatctgcaacctaaaatattcaaatatgcaaggaatgaactgtgcaggaaattcagctcagctaagcacagggtrggatgtgaatgaagcctttttctcctaaataaaaattttccacattatcagcctaaatcaggagttgagagctgagcctagttaaaattgtcttttcctt

SEQ ID NO: 9847 - DNA, 201 bp, Homo sapiens
actgggagaggagatcaggtgacttctctagtattagaaggggctccagaagaggctgagatgaagtctctgttcttgcagtttagtgagggagggaaggrccaacagcaagtgactatgaggtggacatgagtaggggatgtacctgatgttgaccagtgtgcaggcagcttgagagagttaagcacatctctttgagga

SEQ ID NO: 9848 - DNA, 201 bp, Homo sapiens
aaaaacatttggagagcctatattatattccttatgcacacacacagagcttcagatacaaccatgctccgggggaataagtctggtaccttctagaaagagagaaagacataatgacagacatggatgttgtgaattcctcttttgagaggttttcaagaaaggatgcagaattcttctgggtaactggtgctactaata

SEQ ID NO: 9849 - DNA, 201 bp, Homo sapiens
gatgtctccctgtttgttaacgcatttcccacctgccttatcaccgtggggtgtgaaacccaggaattactttctatcattctccttcctgaaccttcctmctcctaggcaattggtagagagagagcttgttgagactctcctccagaatgtctcttgcatctctgctgtcagctccctggatcagtttccagttagcac

SEQ ID NO: 9850 - DNA, 201 bp, Homo sapiens
ccacactgcattctcctgcctttggacttttgctaaagctctattctctttcttaaatgtccttgaacatgcttctccctcttatccttgaagatccaagyctcctaagtctgccagactttgtgctgtgttataaggtacctatgccaaactgccttgagtcacgtttactcatgtatttcaatccactccccaacacct

SEQ ID NO: 9851 - DNA, 201 bp, Homo sapiens
ctaaggccttctcttggccctgtgtgtgcaagtgtcagagggaaaattttatagattacaccagaataaacgtgggaaaggtcttgaatttattcttagayatttgtcagagaaaagaaggactatgcctcagatgttgtcattcttttaaagctgaatgatgaagtagtaaatccataatggaaagaattgtcaagttaa

SEQ ID NO: 9852 - DNA, 201 bp, Homo sapiens
gagggtatggagaatgcagagaatgacctgggagagaggtatctgacatctttaataacgatcaagaactgatttttaaacctttagggcggccgggcagsagggggatttagtttctttttccttttgctctacagagttttgtattcactggattgcctggtgttgaccctaagatctattctagtcctttaaagttca

SEQ ID NO: 9853 - DNA, 201 bp, Homo sapiens
tcaagaactgatttttaaacctttagggcggccgggcagcagggggatttagtttctttttccttttgctctacagagttttgtattcactggattgcctrgtgttgaccctaagatctattctagtcctttaaagttcagaagccctttttgatttgtttatgtgtatttttcccatgtagatttgatcactggccttct

SEQ ID NO: 9854 - DNA, 201 bp, Homo sapiens
cataaaagaaattatttctcagattttgaaacaacatgtctgtttcctcctcctcaatgatcaatttggatttattgattacttatagattttatgtctgygtatatatgtcataaaatactttctcctctaaggtatgaataatgatctatctgtttgtatagacctttgcttatccagttgagttagttaatcttagaa

SEQ ID NO: 9855 - DNA, 201 bp, Homo sapiens
ctcacagtcaatgggagtttgaaaatagctttcagatgtaacaaccacctttcctcaagtaaaaagccttaaatgcattgtttttaatgtatttttatatrtgcagtttttaaattaatttttttattttaaagggaaattgttaggtaatcatttagtcagatcacccacgctttacattatcagaatcagaaaagaaaa

SEQ ID NO: 9856 - DNA, 201 bp, Homo sapiens
agggaattttttatttgcttgtcatttatttgtttattggggatggcatacacagtgcaaagtgtataaaatgcatgctcttaagcatacagcttaaaggttttttttttttaacctgtatatacccacataaataccatccaaatcaagaaatagaatatgcccatcactataaggttccattgtgaccctttctgccat

SEQ ID NO: 9857 - DNA, 201 bp, Homo sapiens
tttcactgtgtgtaaatagaagcaaaaatattgtcctcttgtgaggtagctttgccctgtttttgatgaagcgcaggtttccctctatacaaagagaatayctaattgatattattgagtttttctcttttttcctaaggcatttagtggtaagcagaatagcagaggtggaaaagaccatatgctttgtaaaaagccaga

SEQ ID NO: 9858 - DNA, 201 bp, Homo sapiens
taataacactttttgatggatgtctgattgtaaaagtgctgcatctttcattaaaatttacatgtaaagcaagggcagaagcgatgacatgaaacctaatscaacttgcacatcttgacataataacaatcacaagaaactgcagatcccagatggcagcttggcctttgccatccttttaataagctactaactgctaat

SEQ ID NO: 9859 - DNA, 201 bp, Homo sapiens
acaaaacagagaccttccacctggagctttgaaaagtgcttccctgcaggttggaagctttccagtcagttgtaacaacgatggcaagtattgggatgaamaatgttgcttaataacattttcttgttttttttttatgaatatagagaatttaaaaaatttgttcgactaaagagccattgtgtgcatgtgcatgcatgt

SEQ ID NO: 9860 - DNA, 201 bp, Homo sapiens
acactcttctattattagtgatatctctgaacctgaacttgataatgtgagttttgtggtccagtattttacctataatggcttgtgtgctatgaagttgmtgaaaggactgtgaaactcaaatcaaatagaggctaatgcctcttgcttattaaacctagacttattaaacctatttgcgtattgactgggtaagtttta

SEQ ID NO: 9861 - DNA, 201 bp, Homo sapiens
tgactgtgggacttctcagagcctttgttatggcaatgcaaattacaaacctctgagaaggaaaatgtacatttcaaagttaccaaaatttatttgacatraaacgcttttttatgattttcattttggatgaaaatagctagaattagaactagttagtgttcagttaaaaacactttggacagcaattttatagtagct

SEQ ID NO: 9862 - DNA, 201 bp, Homo sapiens
gtaaaatacacaccacagatgttaaaacaactgcaattttaaagatactagtctggttaaaacacttccagtttgtattacctgagtacttaaacagatakccatatagtgagcataaacaatacttctgagaatggctgcttaactctaggaagagctgatcttggcataacatgagaaaactgctaggaactttagtct

SEQ ID NO: 9863 - DNA, 201 bp, Homo sapiens
tgtattacctgagtacttaaacagatatccatatagtgagcataaacaatacttctgagaatggctgcttaactctaggaagagctgatcttggcataacrtgagaaaactgctaggaactttagtcttatttgctttcaaatttggagcaggtcaacagtcatcatggttatttctctactgtatatctaaggtcattca

SEQ ID NO: 9864 - DNA, 201 bp, Homo sapiens
agcaggtcaacagtcatcatggttatttctctactgtatatctaaggtcattcatcctgagagtctggttatgaatggctttttttttttttttttttttyccagacagtgaacatgtaggtgaaggaattgctttctggtaggaattacttgtttagaagtcattggctcagctaaggattttgtgggttgtcgcagtgc

SEQ ID NO: 9865 - DNA, 201 bp, Homo sapiens
attttgtgggttgtcgcagtgcacagctgaggactttgtcctatttatgtgctgtctgttcagtatgaagtggcagccattgatccatctgtagtacaccrtttgcctggggctatttatctggttgtggagatgtagtttgctgagccaggcatacgctcccttgtttccccaagtgaccagtaatgagtctttacaaat

SEQ ID NO: 9866 - DNA, 201 bp, Homo sapiens
cattagtctcttcctttagaacaagttcatccaaccccaggtctgcaggctgcacacagcccaggatggctttgaatgcaatccaacacaaattcttaaaytttcttaaaacattatgagatttttgtgtgtgtgaattttttttctaagcacagcagaaatcattagccttagtgtatttcatgtgtggcctaagtcaat

SEQ ID NO: 9867 - DNA, 201 bp, Homo sapiens
tttatgatgctttgtaccacttacacagacttgctttgttgatggctttgtcttggctgaagtaagacggtgacaccagttgacttttaaaaagcttttayacccataactttttctttcttgctgtcccatgttgactatttataacagcgtggatgcatgttgagtgcaataaagatgagctgtgatgatattcaccag

SEQ ID NO: 9868 - DNA, 201 bp, Homo sapiens
ttggagatccagcactacttctttcttagaaatggtttatcttgtctgaaataatcctccagtttccctacttttacctctgcctttctttaaataaaggtttttttttttaacaaaactttctcgtatcagtttaaatacatttctgaatgattacatggcattatccccattttcacaggcaagaaaacagaggcccaa

SEQ ID NO: 9869 - DNA, 201 bp, Homo sapiens
ttcacaggcaagaaaacagaggcccaaggttacaaagctagttacagagctagcagcagaaccaagataaactgagctttgtctgaccccaaagcctgagstgacactactatatacgataccatcatttcaattaatttcactgaacctcagttttctcttctgtaaaatggggatgctaatatattattctaatatatt

SEQ ID NO: 9870 - DNA, 201 bp, Homo sapiens
gcaagaaaacagaggcccaaggttacaaagctagttacagagctagcagcagaaccaagataaactgagctttgtctgaccccaaagcctgagctgacacyactatatacgataccatcatttcaattaatttcactgaacctcagttttctcttctgtaaaatggggatgctaatatattattctaatatattctgaatt

SEQ ID NO: 9871 - DNA, 201 bp, Homo sapiens
gtattacatatgatgtattataaataataagacattattttacttttggtaaaattgagaagtatataagctaacacatattaaatgcctaaaaagatgtstagctctcgttatggttttaatatattccctttcctctcgacagtaacaataaagtgtaattgaatttaacaagtattgagcacaagggatacacaaaat

SEQ ID NO: 9872 - DNA, 201 bp, Homo sapiens
aaacaaaggtgagtatggtttctatgagatagagaatcacttctcattcatttttctattacacacatgtatgtgtattttgtgtatttttcttttccttyctttctttctttctttctttctttctttctttctttctttctttctttctttctttctttcttccttccttccttccttccttcctctccttccttcctt

SEQ ID NO: 9873 - DNA, 201 bp, Homo sapiens
acacacatgtatgtgtattttgtgtatttttcttttcctttctttctttctttctttctttctttctttctttctttctttctttctttctttctttcttycttccttccttccttccttccttcctctccttccttccttccttcctttctctttctttctttctttcttttctttttatttttttttgagacagggtct

SEQ ID NO: 9874 - DNA, 201 bp, Homo sapiens
tttttcttttcctttctttctttctttctttctttctttctttctttctttctttctttctttctttctttctttcttccttccttccttccttccttccyctccttccttccttccttcctttctctttctttctttctttcttttctttttatttttttttgagacagggtcttgctctgtcacccaggctggagtgca

SEQ ID NO: 9875 - DNA, 201 bp, Homo sapiens
ttttcttttcctttctttctttctttctttctttctttctttctttctttctttctttctttctttctttctttcttccttccttccttccttccttcctctccttccttccttccttcctttctctttctttctttctttcttttctttttatttttttttgagacagggtcttgctctgtcacccaggctggagtgcag

SEQ ID NO: 9876 - DNA, 201 bp, Homo sapiens
tttcttttcctttctttctttctttctttctttctttctttctttctttctttctttctttctttctttctttcttccttccttccttccttccttcctctccttccttccttccttcctttctctttctttctttctttcttttctttttatttttttttgagacagggtcttgctctgtcacccaggctggagtgcagt

SEQ ID NO: 9877 - DNA, 201 bp, Homo sapiens
ctttctttctttctttctttctttctttctttctttctttctttctttctttcttccttccttccttccttccttcctctccttccttccttccttccttyctctttctttctttctttcttttctttttatttttttttgagacagggtcttgctctgtcacccaggctggagtgcagtggcatgatctcagctcactgc

SEQ ID NO: 9878 - DNA, 201 bp, Homo sapiens
tttctttctttctttctttctttctttctttctttctttctttctttcttccttccttccttccttccttcctctccttccttccttccttcctttctctytctttctttctttcttttctttttatttttttttgagacagggtcttgctctgtcacccaggctggagtgcagtggcatgatctcagctcactgcaacct

SEQ ID NO: 9879 - DNA, 201 bp, Homo sapiens
tgcagtggcatgatctcagctcactgcaacctttgcctcttgggttcaagcaattcttctgcctcagcctcctgagtacctgggattacaggcgcttaccrgctaatttttgtatttttagtagagaccctgttggccaggctggttttgaactcttgacctaagttgatccgcccacctcagcctcccaaagtgctggga

SEQ ID NO: 9880 - DNA, 201 bp, Homo sapiens
agtgtttctcaaattcgtgagaatcacccagggaacttgtgaaactatagactttagttcctgcctcagaactgtaggacctgcagctctaaattattctrtgatcaggtaaatttgagacacgctgtgttacagcaaattccaaggaataaaatgaaccgaaaggaagtgtatgagactttaatagaagtattttgttgt

SEQ ID NO: 9881 - DNA, 201 bp, Homo sapiens
ttgataggcctgcttattttttgtgactgacttgtgaacagttaactgatggcaactcattttagtttgtagatatatcttaatctcttgtacgcatagtraccattacctccatgatgttctgaaatgaagccccttcctgtaaagctgtgcttttttctcttgtagctagaggttggcccattgtactattggaatgga

SEQ ID NO: 9882 - DNA, 201 bp, Homo sapiens
aaagaacagaactttcaactcaactgccttaaacaacaaagggcatttatgggctcagtttctaaaaagtccagtaactcacatgatatgaccaagacctrgtgtttgtcttccccattttttggctcgactttcttggtgttggcttcatttttggcagctcctgcccatgtgattttaagatggctgatggccattccc

SEQ ID NO: 9883 - DNA, 201 bp, Homo sapiens
acacgtaaaattacacttcacaagtccaccccttttcaactcgacactcatctatatctccttaaatgatacttaatctataaataaagataaaaagatcrtaatttcacctaacatgatacacctatcctgagtataattgaaaatgcactaaagagttggttttcctcctacagtatattggatttagggggaggctgg

SEQ ID NO: 9884 - DNA, 201 bp, Homo sapiens
actcccaacagcgatgacaatatacattctcagtaacctggagctggcactgaggctgcagccctggacatggggtgtcctctgggtataatctcacttamctttactctgcaaatgcaatgttggtcttgccatccctgtgttgtgttcagtcttatttgatctcactctccctgttacccatctgtataatcccctggg

SEQ ID NO: 9885 - DNA, 201 bp, Homo sapiens
gtttccccttccagatccattgcttgagtgtctgttgtgtgctgggcgtcggagattcagagaccatgttccttgataaccagcaattaccttctgaatgktacctgagtgcagatgaggaaggtctctgaaagcatacagggcgggggcttccaatacacactccctactttggactgttcaccactttgaataaaacta

SEQ ID NO: 9886 - DNA, 201 bp, Homo sapiens
tatgggctacagaaattgagattggggcagaggaggaacagtaacacagaaggaggtgagttgggaaagaatgaagagagacctaaaatcaaagtgccctrtgtgtggattgagaagccctggatttaagtcctaactctgcatttctgactgcatagcttgggtaagacgcagcacacctggagcctcatctgttgaagg

SEQ ID NO: 9887 - DNA, 201 bp, Homo sapiens
tgagaagccctggatttaagtcctaactctgcatttctgactgcatagcttgggtaagacgcagcacacctggagcctcatctgttgaagggggatttaamccctgccgtgcctgccccaggtttgttgggaaattaaatgtgtgcagtttgtaaactgtaaagtgtactgtgaatggaagggagtggtgttactataaac

SEQ ID NO: 9888 - DNA, 201 bp, Homo sapiens
aggtttgttgggaaattaaatgtgtgcagtttgtaaactgtaaagtgtactgtgaatggaagggagtggtgttactataaacagcatcatcatttatcagstaaatcctccctgagccatactgtggcaggggaatagatcgatggataggtctgctgtgacaggcaggaaaagaccagactggagggagcctgtggtcag

SEQ ID NO: 9889 - DNA, 201 bp, Homo sapiens
tgatgagagaatggacatggaaggactgtgcacactgcaaagtgtctatggtacattcactgagcacctactgcatacctggcattgctgtgggtactagsacatagtggagcataggacagctgagacacctgctcacaatgagatgtgttctacccatgatctgttaacagaggaagctgtcagaaagtgggaagaaaa

SEQ ID NO: 9890 - DNA, 201 bp, Homo sapiens
cagctgagacacctgctcacaatgagatgtgttctacccatgatctgttaacagaggaagctgtcagaaagtgggaagaaaaaaatgcagtgatctgagartgtttttgttttcaaaaaggaagaagtcctgttaattgccagtcattgccctttaagtctaccttcattcattctgaagtataaataacaaaaccaaatt

SEQ ID NO: 9891 - DNA, 201 bp, Homo sapiens
tgtaatatatctggattttagtaaaatcacttgatggagaaatggcctgaaatcttgcctgagaaattaattcaagctggccaggggggaagccatgtcaytcagaatgagaactggctgggagatgggagtgaaggttgtgatgacaaatggccttagctttcggggtgtgatagggtcaggtgagaagacccaatttgg

SEQ ID NO: 9892 - DNA, 201 bp, Homo sapiens
aagaggtcagcagtcaaggacaggaggccgaggcaggtaggaacaatgcgggagagtacaggcaaggacaaatggagggaatttccttgaggacaatctgmaaacattaaaaaatttgcaaatatataaaaattagcatcaggacaggaatgagacaaaggtccaaggccgtccaaggatttatccttccataatttgaac

SEQ ID NO: 9893 - DNA, 201 bp, Homo sapiens
atatcttctaacacatctcactctatagacttattctttacccagcaattgccatcctggagagggtgacaaacttgtatacttttagcactgaaagcccygtcttccagaaacccccttagtcctgggcaaaccaggatgattggttagcctgcccataggataactgctagcctgttggaatgttgcatggaagtctaa

SEQ ID NO: 9894 - DNA, 201 bp, Homo sapiens
agacatgcagtgtgtgtaattgtgaacagaatggatctgaattcgaatccagttagtctgcttactcacacaactcactgtgttgccttgagtgagttacaaaaaaaaaaaaaaaaatctctctgttcctgagtttcctcatctgtagaatggacataatcatagtactgcctgttatggttgtgaggattaaactagttt

SEQ ID NO: 9895 - DNA, 201 bp, Homo sapiens
gacatgcagtgtgtgtaattgtgaacagaatggatctgaattcgaatccagttagtctgcttactcacacaactcactgtgttgccttgagtgagttacaaaaaaaaaaaaaaaaatctctctgttcctgagtttcctcatctgtagaatggacataatcatagtactgcctgttatggttgtgaggattaaactagttta

SEQ ID NO: 9896 - DNA, 201 bp, Homo sapiens
tagtctgcttactcacacaactcactgtgttgccttgagtgagttacaaaaaaaaaaaaaaaaatctctctgttcctgagtttcctcatctgtagaatggrcataatcatagtactgcctgttatggttgtgaggattaaactagtttatgtattttaagtacttacaagaatacttggcacatgatccatgttactaata

SEQ ID NO: 9897 - DNA, 201 bp, Homo sapiens
tttatgtattttaagtacttacaagaatacttggcacatgatccatgttactaatattattattaagtgaactaatgcattcaaagtgctcagtgcaagastcaataaatgttagatattattagttattgttaatggtatatcgaaatgaggcataatagaaccatgtttgaagtgcaaaggcaacaaagacaaggcaaa

SEQ ID NO: 9898 - DNA, 201 bp, Homo sapiens
gaggtgctaaaggaggatccaggggaatgtagagcagttggaggtccagccgctgcttcatgtcagtgaggtgaatcagcacatcagcaacaatgtgtatgggctgcaaaatggctagtgcttttcctctatcctccaaattgcccaagagtcttccttaaggccctctctaagcagaaacattcaagaaagagaattctg

SEQ ID NO: 9899 - DNA, 201 bp, Homo sapiens
caaacctaggctgctgaggaagtgcagcaggcatttggggtaggggtggggacaggattctgccacatggtctccatcacagctttaaaaaaaccagatctttttgtgttcattccagaagctgcacagtttctagagacttgtcttttcacaggaaatatcctactcagaaatagtgtatttggcaggggactattctcc

SEQ ID NO: 9900 - DNA, 201 bp, Homo sapiens
tcttttcccttatctcccttcaattcttttcttcctccccatcattgttgccctctttgcctttggcccctatcttttaccatattttcttttcttcttctttttttttttttttgatggagtcttgctctgttgcccaggctggagtgcagtggcatgatctcagctcactgcaacctctgcctcccggtttcaagcaat

SEQ ID NO: 9901 - DNA, 201 bp, Homo sapiens
tttgaacaatttaaaaattattgtgacttaaaggaatcgatatctaatgatagaattctagttcctggcttactggtatgggagacagttttgtctggggvcagtcccatcttggtatcacactttgtaattttctgagcatttgaccttttcttcatgtggtctttgtcaacctacttgtaaggccagcctgcctataaa

SEQ ID NO: 9902 - DNA, 201 bp, Homo sapiens
cctaagggagactggtcatccagccaggtgtagggtaaaggaattattgggaaatatacagtaagggaggcctgtgaggtcagtaccttgagggatttgtrctgtgacttccaagtccaaattcaacagagatttagtgcgtgcctactgtgtgccagacaccattctaggaattgaggatgtatcagagaataagatgaa

SEQ ID NO: 9903 - DNA, 201 bp, Homo sapiens
gacctcactgaggatatgatatttggatatttgaatgatgatgacatagggagggacctacagattaggaattagagtgggaagtggttgaggtgtgtgtkgggggcatattttataagcctttgatggcttctgtgaggactctggtttctactctgagagaatggggagtcaacagagggttctgtgtagagaatctct

SEQ ID NO: 9904 - DNA, 201 bp, Homo sapiens
aagcctttgatggcttctgtgaggactctggtttctactctgagagaatggggagtcaacagagggttctgtgtagagaatctctcttgtattttaatagkatccctctggctgcagcagggccatttgggaggctcctgccgtaatccaggtgagagattgaggaggtgggtgttgggctagagtggctgcagtggacgg

SEQ ID NO: 9905 - DNA, 201 bp, Homo sapiens
tccctgttggagtaagagggacactgagcttacctattgtagaaaagctgcctttttaatgattctgtaaacacttattgaaacacctactagggctggayggagcagtggaaatttttgccaacattatatcctcagagcaaccccaggagtttggaccagagaatcgctctccatgaaggaaacaggaatggggaggtg

SEQ ID NO: 9906 - DNA, 201 bp, Homo sapiens
cattatatcctcagagcaaccccaggagtttggaccagagaatcgctctccatgaaggaaacaggaatggggaggtggattgaaggtgggtacaggggatrcccctcacttcataaatgaggggaggcgtcatcccaggctctcaccccaaggccactcttctctagtttcaagcccacccttaccccatgaattcctgat

SEQ ID NO: 9907 - DNA, 201 bp, Homo sapiens
actttggatcatctgtatgtttatagcacaggtcctctctgattttctagaatttctaattttttagaattttctagaatttagtctaagcccctttctawtttttttgtattttctagaattcagtgcccagacttttttctgagcacgcctggtgtctgcctcagtggtgtcttaaggtgcgaaataataactagcagt

SEQ ID NO: 9908 - DNA, 201 bp, Homo sapiens
ggggaggcagcaggcatgccttcacagtaatggacatgtatggaggtggagagcaaagagccaaatggaagagggaggtgcagtttccctgactgtacagrgggaattacatgacctccctgcctttaaccttgagctcagggataccacttattttcacaccatccaaattctagcattctggagcaaagagctgctcac

SEQ ID NO: 9909 - DNA, 201 bp, Homo sapiens
gtggctatgtgcctgtgcatagggcttgctctggggtttcaaaggctgtctcaccctgtgtgttaggcagagcactggatattttctctaagcactgaagrtctaaatgaaatttagctttctcaaacatcctaattatttctacattcctaaagctctgagaaggccgtatatatagtactgatattgttctcccaggtg

SEQ ID NO: 9910 - DNA, 201 bp, Homo sapiens
gtctaagatcctgagggtcatgactgactcagcttaggctgtcatggcactgagtgacttcagagtacccagtgggaaggtgggctggaggtacatggatsgggggatggagaatggggtgtgagtattgtgtatttctctcttccctttggtgtttaggttgttattgctaggagtgagccaggtctttctgtcctcaaa

SEQ ID NO: 9911 - DNA, 201 bp, Homo sapiens
tgagaggttgtgtgacttgcccaaggtggtggaggtggttaggctgagcctcggatctaggctcctgactttgatttattggctttttgtattggaccaamctacctctcaacaaaaggggaatattatggcctcattgggtctgcagtcctctgtggtcaaacaagttgctcttcttacctgagaaggacagataagggc

SEQ ID NO: 9912 - DNA, 201 bp, Homo sapiens
cgggtttctgggagagaatcatgccttggaaatatccgttcatcaaaagcatagtttgcatctgcaagcccgaagggaaactgagaaaaccagccaccaayttggcaggcaacagaattgtctcctccaagatagtgagtggaggagagaaggctgccttttcccaagaggaccagtccagcccttgttaggccatctccg

SEQ ID NO: 9913 - DNA, 201 bp, Homo sapiens
gttctgtacttttagggaggcattgttatagggaatacaagcacagggttgggaagtgcttgctagggccacatttcgtggccctctgtaattaggtgccragattgccgagggtgacattagtggagatggtgatggtaataataatagttattataaataaccactaacatttcttgggtgcttacatatatgtcaggt

SEQ ID NO: 9914 - DNA, 201 bp, Homo sapiens
acaagcacagggttgggaagtgcttgctagggccacatttcgtggccctctgtaattaggtgccgagattgccgagggtgacattagtggagatggtgatrgtaataataatagttattataaataaccactaacatttcttgggtgcttacatatatgtcaggtaaattgtatgtttcacattcattatctgattaaatg

SEQ ID NO: 9915 - DNA, 201 bp, Homo sapiens
tgtgtttttgataggatattttacttcactgagcctgtttgctcatatgcttaaaaacagggggtggttaataacactttagattgttcatttctttatcyactccccctgcctcccactttttgccacagtcataattatttcattctgcagggtgattctctaccatcagagaaagtttggcatagttcagtcgttctc

SEQ ID NO: 9916 - DNA, 201 bp, Homo sapiens
tggttaataacactttagattgttcatttctttatccactccccctgcctcccactttttgccacagtcataattatttcattctgcagggtgattctctrccatcagagaaagtttggcatagttcagtcgttctcaaagtttggctaccagactagccacaactgggaactgttagaaaagcaaatttcttgagcctca

SEQ ID NO: 9917 - DNA, 201 bp, Homo sapiens
ccatcagagaaagtttggcatagttcagtcgttctcaaagtttggctaccagactagccacaactgggaactgttagaaaagcaaatttcttgagcctcaycctagatctactgaatcagcaaatctagaggtggggtccaacaatctgttgcatggtaaggcttgagaaccatgagtataatgaaaagagcttggggtct

SEQ ID NO: 9918 - DNA, 201 bp, Homo sapiens
caactgggaactgttagaaaagcaaatttcttgagcctcaccctagatctactgaatcagcaaatctagaggtggggtccaacaatctgttgcatggtaargcttgagaaccatgagtataatgaaaagagcttggggtcttaaatcaacacaaccaagttgaattttgcttctgccatttgggtgatgcttacatcaaca

SEQ ID NO: 9919 - DNA, 201 bp, Homo sapiens
gggtccaacaatctgttgcatggtaaggcttgagaaccatgagtataatgaaaagagcttggggtcttaaatcaacacaaccaagttgaattttgcttctrccatttgggtgatgcttacatcaacaccacactataaactttttgagcctttgtttcctcttctctaatatggaatatcataatctcacagttctatcta

SEQ ID NO: 9920 - DNA, 201 bp, Homo sapiens
ggcaggccactatctttagagtactttcaaatgattttatttaattcttacaccagttctgtgaaatagaattttaagggagctttgagtttcagagtgtkaatgacttgcctgagttgccactgcaagagtgtgtgacaaagctaaggcttaaattcagtctcaattaaaaatctggtgcttcctctagatcactctggt

SEQ ID NO: 9921 - DNA, 201 bp, Homo sapiens
acttctggctttatcacttggcaaaaaagcacttgttaaaaatgcacacacatgtgggtttgccctcttcatggttcagcaccagaatttaagcagctggyggacaagacttatccttggaacaacatccaacattcctaccctagggcatattggagtctctcaaccaatgagggcccacaaataaagcagtcagcattt

SEQ ID NO: 9922 - DNA, 201 bp, Homo sapiens
tgggataagggagggcatgcacatgcgcatgtgtgtgtgtacatgtgtgtgcctgtgtgtgggtacatgcctgtggcccacacttggggggcagctgttayatttgctgcttaggtattcatagccaattgttttaactgttccttgctttattagcttttgccaagtagttcagcttttactaagggcacccgggtttat

SEQ ID NO: 9923 - DNA, 201 bp, Homo sapiens
acaaaggggcaggggcttaactgtgggacttagggagagatttcctctctctcctcccctctcttttattaccacttctcagtctcgatggatatagcaarccaattggtttcccttatgggttataaagaggaacccgttttgggatgttgagggatctgggaaataagtctcctggcaatttctgagatttcctctctt

SEQ ID NO: 9924 - DNA, 201 bp, Homo sapiens
aattggtttcccttatgggttataaagaggaacccgttttgggatgttgagggatctgggaaataagtctcctggcaatttctgagatttcctctcttctycctggttacatccaggcacctgctgggcaaaccggctgccacttgttgcaaaaaatgttgacaataccgagggaaactgagacttgaaagaactggaggg

SEQ ID NO: 9925 - DNA, 201 bp, Homo sapiens
gctctgaagggcctggggcagatgtgtcagggacttctgagaagatggggttgttttcaaatgggaaggccattaaaggctttgggacacttgggaggctragaggggatgctcaggagagggaaaggccatgggtgctggctcagcaacagggatctgaaactgctgatgctctattgagacctgaagcacgggtgatgg

SEQ ID NO: 9926 - DNA, 201 bp, Homo sapiens
ggatctgaaactgctgatgctctattgagacctgaagcacgggtgatggggaaaagcaggcatcttctgatgcatgattctcccagcaaccagaaggcccyacaacctctggctgatctctgactacagtcttgactgcggctcttgcccatcctagggtcactggaatcagatgtccatcttcccaactccagaaggttg

SEQ ID NO: 9927 - DNA, 201 bp, Homo sapiens
actccttgaaacagttgcagtggccctgtggaatagggggcaggtattagggcccccattttctgggtgaggaaacaggatcagggaagttaaatggcttmcattcacacagagaacacaatacaactggggtgagatgagctcttctgacttctcaatctgtgatccttctaacaccccaccttacccaggggagccttg

SEQ ID NO: 9928 - DNA, 201 bp, Homo sapiens
gcaggagcaggtggcatgtgggcagaggcttgtccactaaatgtggaaagaaaagcagtcatgtttttacgtgcagggaaggaatgaggactttgctgacrgcaaagggtgatggatggtgtgggagactgcatggggcgtgagtagtaatgtgatagagggtgcacattacaggcaattacaatttgaataagttatcaa

SEQ ID NO: 9929 - DNA, 201 bp, Homo sapiens
accccctgaagttacgttcacagcattttgaaaaagtttatgaattgccgtcaattacaatcccggcgacaaatgcggatgctgggagaatccctgattgyagcttctgtagcaggcaatgttttatggggacaatttaaaacaacagtcttatgtattttaaaacagcaaaggaggaagaaaaaggaagtgctcagggag

SEQ ID NO: 9930 - DNA, 201 bp, Homo sapiens
tcggaagtcagttgagcccaggtgtgcatggcatcaaagctcatgtttttcaccacaccaggtcctctgtgttttctcagatacagaactattcattaccrtcacctgggaacagcttggaaatgctaattcttggctcagcctacacctatgcattcagaggctacggttaacaagattcccaggggattcctatacaca

SEQ ID NO: 9931 - DNA, 201 bp, Homo sapiens
ccatttatcttcttccacaatttctcccacatgttcattttaaagtagctctctatctaaatgctttaggataaatctggattgtgtgtcactcattttarctttcaattacatgcggtctagttataggctttcagttgcttcatgtcttagtattatttctccagcaggactgtaagctccttgaagacaaaagatatg

SEQ ID NO: 9932 - DNA, 201 bp, Homo sapiens
gaggcaggagaattgcttgaaccagggaggcggaggttgcagtgagccgaggtcatgccattgcactgcagcctggacaacaagagcggaacttcatctcaaaaaaaaaaaaaaattgttagaaaagggttctctgggaggctggagaaagagccctgaatgcaggctaggatgaccaggaaagattgctgagcccaatgc

SEQ ID NO: 9933 - DNA, 201 bp, Homo sapiens
gctggagaaagagccctgaatgcaggctaggatgaccaggaaagattgctgagcccaatgctgaaggacaaatagtaaggggagggggaaagggcaccccmacaaaagcatgtaggagttggggctttggggcagtgaatgtggccagagcagggtatgcgtgggagacaggcagggactggtatttggggccaaagaggg

SEQ ID NO: 9934 - DNA, 201 bp, Homo sapiens
taagacagttagatttgcattttttaaacaatttaaaaaagatttatgtttcagaaaaatcaccctggtaacaatgtagaggtggaaacatgaggcagggrgctcattaatgacctgtatgagaagggatgaaagtctgagctcaggcagtgagatggagggaacaatgtagacatatttagggtgtgagggtttctatac

SEQ ID NO: 9935 - DNA, 201 bp, Homo sapiens
tgaggcagggagctcattaatgacctgtatgagaagggatgaaagtctgagctcaggcagtgagatggagggaacaatgtagacatatttagggtgtgagrgtttctatacaatgtgagagcattatatgcttttctttccttgcttctgaaaacattaaaatagaaaaatctggagaataatacaaacccctaaaacccc

SEQ ID NO: 9936 - DNA, 201 bp, Homo sapiens
tttacagttattagcttttgcaaacatttcagtttttgcatacatgaatgaggacctttctaggatatatactagaaatggaatttttagtcttaaggaawacatattttcaaatttattacatactgccgaagactttctgaagtgattgtaccaactaaaattcccaccaatagtagacgttctctttctccatgtctt

SEQ ID NO: 9937 - DNA, 201 bp, Homo sapiens
gaattctttattattctggataaccactcctttcactggaaaggattatataatatctttcccagtgtatctcttgtcatttaactttttggtatttttcttttttttttttttttgccaaaaagaggttttaacattttgatgttggcaaatttattaatttggctctccataggttgtattttttatgccttattaaaa

SEQ ID NO: 9938 - DNA, 201 bp, Homo sapiens
aattctttattattctggataaccactcctttcactggaaaggattatataatatctttcccagtgtatctcttgtcatttaactttttggtatttttcttttttttttttttttgccaaaaagaggttttaacattttgatgttggcaaatttattaatttggctctccataggttgtattttttatgccttattaaaaa

SEQ ID NO: 9939 - DNA, 201 bp, Homo sapiens
catggatttttattcttatagatgaggaaaccggactggagagaggctgagtagctggtgcaagttataatgctaaggaaagtcagggaaagcacaagacmccacgtctctggttcccacacacgttcacttttcactgcagtgctctctttgactggggtgtcttagagtccatttgggctactaaaacaaaataccgta

SEQ ID NO: 9940 - DNA, 201 bp, Homo sapiens
tacatgattggtaaggagagttgaggcattcagagaatcatataaccgtaataggaaaagggctagctccagctgcttccagcactaggcaacagttgagytccttcattcattgtagcattcaggtttgttccatttgtggtggaagttggctaagtctgagggcaactttaaactttcctttaaaggcagcctcagaga

SEQ ID NO: 9941 - DNA, 201 bp, Homo sapiens
atgattggtaaggagagttgaggcattcagagaatcatataaccgtaataggaaaagggctagctccagctgcttccagcactaggcaacagttgagctcyttcattcattgtagcattcaggtttgttccatttgtggtggaagttggctaagtctgagggcaactttaaactttcctttaaaggcagcctcagagacag

SEQ ID NO: 9942 - DNA, 201 bp, Homo sapiens
acaacagcaataataatagcaatagctaacttagattgagtgtgtatgatatgacagcatcctacatcatcttcttcagtcttagagcaaggtatggttgyactacatctcatatatcccatagaaaggctgcagagagagagagtctctgctcagttctcaagtcaggtgagttgagggggttgagaatataggacagaa

SEQ ID NO: 9943 - DNA, 201 bp, Homo sapiens
tggttttgttttagggatatggttcatggctatcagctagatccaagctcactgttttccctaggaacagtacacatgactttggacttggtaagcagctyttaagaccctctaaaatgatgaaaagatgctatattcacatgaaggattgtggtagtgggggatactgttgagggacacgttttggttgtttcttcaaga

SEQ ID NO: 9944 - DNA, 201 bp, Homo sapiens
tatcacttctgctcatattctattggctagaactcagtcatgagctcattctcaactgcagggaaagccgggacatgttgaccggctatgagtccagtagrtaaagaaaaactgtttggagaacaatttgccagtcttgatcagagtggaagatgaaaaaaatgtggagactaatttgctcatatgaggttgaaaactcaa

SEQ ID NO: 9945 - DNA, 201 bp, Homo sapiens
tctattatatgccaggcactcttcttggctctggagatgtagcagtgaacaaaacagatacaaatttctaccaagaatcttatgtttgagagggtaccccraatgaaagaggagcaaccaagagtggagaaaagcgtaaaatataatgtttgggaaagttgctttgatttgaaccaagtggcttaaaactatgaactcaga

SEQ ID NO: 9946 - DNA, 201 bp, Homo sapiens
tttgtccttagaaaaaagcatatttattttctttctttttttttaaaacaaggatatccacattttattgttttccttttatctgattctgaaaaaaaaawatttaccagaactatgtattttttcctgtggatataatcatcaggctaatccctacgatgactaaaagttgtggtggttgcatggtcaccaacttctctc

SEQ ID NO: 9947 - DNA, 201 bp, Homo sapiens
gacctgtctgtaatgagcttttagcttgcatctgaaggagtctgctaacttgagctaccagaataatatttgccatattctttttaaaaaatattggtttytattttgtgctttaattcagtgttaagtgagttgttgacttttttggtttgtttaaaaaagaagttaaacagttggaatcccatgtaggcataaaagtgg

SEQ ID NO: 9948 - DNA, 201 bp, Homo sapiens
ataagtaagggttagagagagcatattaagttatacctgggagtttatagttctttaaatcttgtcaaactgtattattcttttaaatatgtcatatgacrgtttataattattgtgaatactttaaaaagctggtggtgaatacgttacaggtggatcacacctgtaatcccagcactttgggaggctgaggcaggtgga

SEQ ID NO: 9949 - DNA, 201 bp, Homo sapiens
actcccaaggaaccctaaaaaggataaacctacatggttcagtgttagtgaaaattctttttttaaaaatttttgctggttcaacttcttcctccttgatmcacacacacacacacacacacacacacacacactcattctcctaaagataatatcatctctgctagatccattctttgagatttgtgatacagcactgaa

SEQ ID NO: 9950 - DNA, 201 bp, Homo sapiens
taattggtaataaattgatataggaaatcagcaaggataaatgtatgagtctgctagggatgctgtaacataatgtcacacacagagtggcttaaacaatstaaatttatttctcacaagataatgtggaagctgaaagtccaagagagaggtgtcagaagtttggtttattctgctgaggcctctctctttggcttgctt

SEQ ID NO: 9951 - DNA, 201 bp, Homo sapiens
gaaattgaattcataatttaaaaactcccacaaaagaaacttctaggcccagatgattgtactgagaattctaccaaacagcagagttgacactaattgcmtataagctcttctagaaaatagaaaaggagaaatctcttccctatttattttatgaagttagtattactctgatacccaaaaccagacaaagatagtaca

SEQ ID NO: 9952 - DNA, 201 bp, Homo sapiens
catatcatgacttggaagactcaaaatagtagagatttcaattctccctgaattgatatccaggttgtaatgagttgagtttggcccctcaaaagatgtgyttacagcttgcagtgagccgagattgcgccactgcagtccgcagtccggcctgggcgacagagcgagactccgtctcaaaaaaaaaaaaaaaaaaaaaag

SEQ ID NO: 9953 - DNA, 201 bp, Homo sapiens
tgtaatgagttgagtttggcccctcaaaagatgtgtttacagcttgcagtgagccgagattgcgccactgcagtccgcagtccggcctgggcgacagagcragactccgtctcaaaaaaaaaaaaaaaaaaaaaagatgtgtttacatcttaatccctggaatctgtgaatgctaccttacttggaaaaagagtctttgca

SEQ ID NO: 9954 - DNA, 201 bp, Homo sapiens
aagaatcttgacatgaggagatcatcctggattatctgggtgggcataaatccaatgacaagttttcttacaggatacacacacacaggagtacacagacrcaaaggagaaggcaatgtgaagacagagcagagggaaatgcagccacaagccaagaaatgttaccagtgccagaagctggaggaattaagaaaagattct

SEQ ID NO: 9955 - DNA, 201 bp, Homo sapiens
cagtcctggtcatttatcccagggaaatgacagtattacaaaatcgtgtacacaaaatcctatacaagaatgtctataggagattatattataatagcccyaaactggagataacccagatatccatcaatgagtgaatggttaaacaaaccatggtacatctatactttggaatacttgccagtaatcaaaagggttaaa

SEQ ID NO: 9956 - DNA, 201 bp, Homo sapiens
atataaaagagtgaacaggttagtggtttccactgtctaggcctggggagagggaagaatgtgtgcggctgtgaaaggacaacttgaagggttcttgtgayggaaatttcctgtatcttgatggtatcaacatcaatattctgcttgtgatattgtactataggtttcacaagatgttactactgggggagactggataaa

SEQ ID NO: 9957 - DNA, 201 bp, Homo sapiens
gatacatgaacttaagcgtctttagtttttttgagttctattcctgacttggcaactaatgaattagccactcattggggtgtaactttccttaccagtaraatggggctcataatgtctaccttgagagcagataggatggagagtgatgcctgatgcatagaaggtactcagtaagtgttaatccttgcctttgcccaa

SEQ ID NO: 9958 - DNA, 201 bp, Homo sapiens
gcttactttcataaaatgaagttttatttagatacccaagatgtaaaacatgaaaaatgtagacccactataactgggggagttcttgagggtggaaagagagaaccctgctcagccttcctattctgccccctccccagattcccttgcctttgctactggctttcccagccttggaagctactggggtacgttaaggat

SEQ ID NO: 9959 - DNA, 201 bp, Homo sapiens
gtataacaaatgtcaataaaatgacattttatacttcaagtcatttctaatttaatattgaaggaaataatgatttacttaatttggagaatgtctttcaycctcataaaaaaagtaccaaagtatttgatttttttgggttagcatcatgatttcttttttgagttatgctgggaaccaggttatagggcagaagatggt

SEQ ID NO: 9960 - DNA, 201 bp, Homo sapiens
ctgatgcttgtgtcagtattacactgttttagttattgtagctttacagtaaagattaacaccgggtacggcaagtcctcctttattattatttatttttrtgcatactattttaaaactgtaagtgcttattgggctataccagtaagtatctagagcagtggtttttaagctcctaatttggcccactacctatttttg

SEQ ID NO: 9961 - DNA, 201 bp, Homo sapiens
tgaaaggcaacaatgtttactaagaaggttaattcttcaagtgtgaaggtgtatctaaaagttccttcatgaccttttttgtggcaggtgtggctatgtgytcatgggctactaaagcgaggcttcaacagactttttaaaaattggataaccatatctctctaaggatagaccatttcccacagagaccactcactcaag

SEQ ID NO: 9962 - DNA, 201 bp, Homo sapiens
ggattgctgtaactagtcagggctccatgagaggctggcaggaacacctaaaaagttgctaatatgtgcacacatgaacacatacacccaatgaagagaargaaaacagaaaagcaaaggaattattttaaaagtcatatatattttctcatataatctcagaatgatatagagaaaaatgtattgggtgttggcttctat

SEQ ID NO: 9963 - DNA, 201 bp, Homo sapiens
tttcttgagacttcctttttgacttatatattatttagaaatgtcttatttaatttacaactgtttacttgtttttgttgttgttgttgtttcatttggtytaatgttggttggcacatgcactgcatatgatttcaattattttgattttgttgaggtttgttttgtggtccaggatgtggactatcttggaaaaaaatg

SEQ ID NO: 9964 - DNA, 201 bp, Homo sapiens
gccatgcctcctttgtcctcttcctcttggacttcattacagaaatgttacaccttttgctatagtccacagaccctgtggctccattcaccttcttctcttttcttgctgctgtttagattgggtaatgtctatcttccaattaattgatttttctccccctctgtgtcctccattctgctgttgtgcccattcactgcg

SEQ ID NO: 9965 - DNA, 201 bp, Homo sapiens
agatgtgggaccacactctttctgtgatgtttggctggagtatggaaattgctttgtgaaagttttttgtcttcctggttctttgactagagatagcaggscttctatggggctttttgtcacattaccaatttattcaatacttagtctgagatatgcgatacaaaacaaaaacacagaaaacttattgctgtgtcattc

SEQ ID NO: 9966 - DNA, 201 bp, Homo sapiens
agctctcagactcagtgcatgagaattttccatttctctgtcttctaatttcttcttctgtttaacctttttaaataccagcctctaactactctgctctrcccttccatactcaatgtctaactgctgcctggtgaatttgtggttagttggcccttaataactagtgatgcattggctatttttgacagtaatttttat

SEQ ID NO: 9967 - DNA, 201 bp, Homo sapiens
actgtaaaacattttacttcattctattagaaatattgaaaggggatgatgcagccatggcagaaaaaggcattattcccctttaagagaaatttctctcmgacatagaaaaaatacagcagtctcctattatgagttgaccttggagccaagaagtagtagttattccctccatccattccattactaatacagcaggca

SEQ ID NO: 9968 - DNA, 201 bp, Homo sapiens
gttgaccttggagccaagaagtagtagttattccctccatccattccattactaatacagcaggcaaaagtcagaaagattagtttcaaaatttctataamctcgaagtaaagtttcagctgtcttcctttatctgacagtgtttttactggtggtacttttaagacttaaaccaaccataggcaactattttctcttctt

SEQ ID NO: 9969 - DNA, 201 bp, Homo sapiens
taggcaactattttctcttcttgagctttatgggcatcttttatagaaactttacctagctgtcagtctattaactcccaagtatttagtttgattcatcrgattgcggatatttctaaaaggtaccgcaaaaatacatgggcctgagaatcctcaagggggttggattccagtgagctagtgaaggatcttcaaggtgtt

SEQ ID NO: 9970 - DNA, 201 bp, Homo sapiens
tggggtcccaaaatgccactttttattttttttgggatggcgtctttctctgttgcccaggctggagtgcaatagcgtgatcttggctcactgcagccacygcctcctgggttcaagtgattctcctgcctcagcctcctgagtagctggaattacaggcacccgccaccatgcctgactaatttttgtatttttagtaga

SEQ ID NO: 9971 - DNA, 201 bp, Homo sapiens
ctgtgcctcattcaattcactgcttggatcagagtgaatactcaataaatgtacaatgattaaatgttagtatcaaaatacatacttttgggataagctcrgattgatattctgggttctgcttagaatgataagatggagtaataagggagagtaatgttgattggtagataattatgaagaaatgagttctgttaaata

SEQ ID NO: 9972 - DNA, 201 bp, Homo sapiens
cctcatctcagagtgtttgtcactggccacagtttatatacaagctatacaggctgcctggaacttgaattggctttagagtggatgctggggaaggggcgggggggttccgggtatctgatgaattcctgcaactgcagggctgggagcctggcggggagccaaggggattgtggacagatgctatgcttgctgggtcga

SEQ ID NO: 9973 - DNA, 201 bp, Homo sapiens
cacatctgtaagaaaagacattcaggaaagacttttacaagacagtgcatgctaagggctaggaagtttggtgagagatggctcccatggagaagtagaamttaagatgggcttcgaagcatgagcagatgacaaaaaagcccaatccaaactggcttaaacagcaagggggtggttattggctcatgtgattgagaagat

SEQ ID NO: 9974 - DNA, 201 bp, Homo sapiens
atcccattagtcaacgaagtcgtattgattttatatccaaattcctcttaaacccacaccatcttgttcatccccatgttccagtgctgctcctccctcaytggactcttataattgctgctttactgtgcatgggatatgagaggtcctccataaatagcatttgaacaaatgcagaatgagataataacacaagtgaaa

SEQ ID NO: 9975 - DNA, 201 bp, Homo sapiens
gctcacaacctggatgatgatgccaattctaagactaacaagaacaggtactagcgtagatggtggtttctatatgctaggtaccattctatgtgctttaygtgctgaagtcattgcattatcacaacaagcctataagactcttaaccctgttttacaggtgaggaaactgggacactgtcttgttaagtgtcttgcctg

SEQ ID NO: 9976 - DNA, 201 bp, Homo sapiens
aacctggatgatgatgccaattctaagactaacaagaacaggtactagcgtagatggtggtttctatatgctaggtaccattctatgtgctttacgtgctsaagtcattgcattatcacaacaagcctataagactcttaaccctgttttacaggtgaggaaactgggacactgtcttgttaagtgtcttgcctgaagtca

SEQ ID NO: 9977 - DNA, 201 bp, Homo sapiens
ttagcttaggccaatgggtataagaataaatgaaagtggagaaccagtaagtctctgaggaaattcagtttacgctggagaatggtagtgacatcttcaawggaagcttcttgagtgacctatgttatagctctgttagatggcgtggtccctccagggctaacagcatctataatacgtatgtttccttattctcctcct

SEQ ID NO: 9978 - DNA, 201 bp, Homo sapiens
agaatggtagtgacatcttcaaaggaagcttcttgagtgacctatgttatagctctgttagatggcgtggtccctccagggctaacagcatctataatacstatgtttccttattctcctccttacctatcagtatgtctgctctatgctcaggagtattccacagtggctcagtggcatgaataataggaaataatgtct

SEQ ID NO: 9979 - DNA, 201 bp, Homo sapiens
gcttttgaattagtattttgagcagttgcatcaaatcacagaacagtggaggggttctgattaagctgagcctttccctgctgcagcacaggccctgggtragggccatttgtattaggatccctgccttgcccctgactagccagatcactttggtctctgacctcagtgtcctgattagtccacatggggataataata

SEQ ID NO: 9980 - DNA, 201 bp, Homo sapiens
ttttgcaatttaaaacatcacttccatgcatggctgtctctggaagggtataggcccagaggacctcatctggtgatggggaagccccctaaattgctcakacgtatacatgtaaaatcaaaatccaccagtgcagttctccctgcacctccccctatccaagcatggggccagggtggctgccagattgttttttccaag

SEQ ID NO: 9981 - DNA, 201 bp, Homo sapiens
tcagtcagcctgggtcccgagcatcccagccaacataatggcaggtactgtgagagggaaataacttgtggtgtactaaggcacttgaaatttggaggtgtttttttactgttctgtaacttcatctacattgattgatacgcacattgttttatccaagataataataactaatagtacttgggcatttgctatgtgcca

SEQ ID NO: 9982 - DNA, 201 bp, Homo sapiens
cccagccaacataatggcaggtactgtgagagggaaataacttgtggtgtactaaggcacttgaaatttggaggtgtttttttactgttctgtaacttcayctacattgattgatacgcacattgttttatccaagataataataactaatagtacttgggcatttgctatgtgccaggtgagtattggttcacattttgc

SEQ ID NO: 9983 - DNA, 201 bp, Homo sapiens
ctgcatcccctgtagtttcatttggaagtgatttcctttgttggccattactcttcagagtggtggtgaggttgggaagccagcagagtggcctgctgtgrgtattgaatgctgatgttgtcataggaagtctctcatttgctttgctttgcttgactactttttggtttttaacctgttatttaagccaaagtatttgat

SEQ ID NO: 9984 - DNA, 201 bp, Homo sapiens
ttggccattactcttcagagtggtggtgaggttgggaagccagcagagtggcctgctgtgggtattgaatgctgatgttgtcataggaagtctctcatttkctttgctttgcttgactactttttggtttttaacctgttatttaagccaaagtatttgatatgggaacaggaagcctcttaagggtaaggaaggcatttt

SEQ ID NO: 9985 - DNA, 201 bp, Homo sapiens
gggaagctaagcaaagatgtggtatagctgaggtctagctcagcctgatccacagaggagctgagcatgacttgtgacacagagtttgctctgcattgagrcaacagggctaagtttgtttgtttgtttttttggacagagttttactcttgttgcccaggctggagtgcaatggcataatcttggctcaccacaacctcc

SEQ ID NO: 9986 - DNA, 201 bp, Homo sapiens
agggaccctgtgggaggtaactgaatcatgggggcaggtttttgccatgctgtttttgtgacagtgagtaagtcttatgagatctagtcgttttataaaaragagttcccctgcacatgccctcttgcctgtcagcatgtaagacatgcctttgctcttcctttgccttctgccatgatagtgaggcctccccagccatgt

SEQ ID NO: 9987 - DNA, 201 bp, Homo sapiens
gcctagcaattctattaggtgaatgacaagtgctttgtaatgaaacagaaggactttatttaaacagatataaggactggacagaaatcaggcttaaattrtaccttatctgggctcctgctttaactttgtaactggtcttaccacttgtggtctcaagactattttgtcctgcagcccccagagcaatctccctgaaat

SEQ ID NO: 9988 - DNA, 201 bp, Homo sapiens
atgacaagtgctttgtaatgaaacagaaggactttatttaaacagatataaggactggacagaaatcaggcttaaattataccttatctgggctcctgctktaactttgtaactggtcttaccacttgtggtctcaagactattttgtcctgcagcccccagagcaatctccctgaaatgcaaggtcaactatgctggccc

SEQ ID NO: 9989 - DNA, 201 bp, Homo sapiens
aagtgctttgtaatgaaacagaaggactttatttaaacagatataaggactggacagaaatcaggcttaaattataccttatctgggctcctgctttaacyttgtaactggtcttaccacttgtggtctcaagactattttgtcctgcagcccccagagcaatctccctgaaatgcaaggtcaactatgctggcccccggc

SEQ ID NO: 9990 - DNA, 201 bp, Homo sapiens
cctcctgagtagctgggattacaggtgcttgcctctaccacctggctaatttttgtatttttagtagagatggggtttcaccatgttggccaggcttctcrgcctccctgagttctgggattacaggcatgagccaccatgcctggccatagtccaacttttaaattttggtttaggaagtgttttttatcccatcaatcc

SEQ ID NO: 9991 - DNA, 201 bp, Homo sapiens
agtgaagaggatgttatagagagggatgcaataaaatttatctttttcatcatgttcctcatctgggttaccatgaaactaatgtgaacagtttccagctmcaggcaaaacatttacactcctcacctttcagtgctatcatttgttgcatttgggaacaaatgtgcagcttcagggtgagaatggaagaatatataggca

SEQ ID NO: 9992 - DNA, 201 bp, Homo sapiens
gccttagctacagctgattcttttctcttagtaaaaacattgataagtttaccaagaccccttgcatgttccctgtctccacatgtgctagaaagtattaygttggtgcaaaagtaattgtaccaataatgcatctgcatttattaagtgtcctttaatgcccacttcactgtagcagtccagttagggactattagcaag

SEQ ID NO: 9993 - DNA, 201 bp, Homo sapiens
aattattttatcccattgttctcaactttaaaatcactgatgcttgagtcttgtcttggagcaatccatccatctgtggggtgaaccctgggaattagtayttttagaggcactcttctagcgttactatggctaaatgtttccaccagtctggctaaaacttctcatttcatggatggaaaaagtgagactcaaagaggc

SEQ ID NO: 9994 - DNA, 201 bp, Homo sapiens
ctcatttcatggatggaaaaagtgagactcaaagaggctaagtgactttcataaaagcagacttgcagggacaaagccagcacctaaggttttataaatastagtccagtgctcttgttcagacaccacattccttctcatcttgtttcctcagatttatagccaaaaacaatgggaccatcagggacccaccttaggacc

SEQ ID NO: 9995 - DNA, 201 bp, Homo sapiens
cagccattacatgaattttctcattattttcttacaacattccttggaggtaagtattattattatccccactttgcagatgaggaatctaaggctcatakgtcagtaagccagtaaaaggcagagttgggatttgaacccaaggctacactctttccgtggccaggattttaaccggggtattcagtactggtgccatta

SEQ ID NO: 9996 - DNA, 201 bp, Homo sapiens
gtatattcctcagtgcaaccacacaaggtgaatactgttattatccttgctttacagatcaggaaactgaggcacaaggaggaaaataatcatgccaaagwactatcaatgagcagattggggattttattccagcagtttactctacagcagctctgtccagtggaaatttcagtgatgatggaaatgttttgaatcctt

SEQ ID NO: 9997 - DNA, 201 bp, Homo sapiens
tgttcaattagacttttggggtcagagacctgggaatctgcattttaataaatttcccaggtgatttttcatgaacaccttaactaataataaatcaattwaaaaatttaacggtaagagaagtagaaggagagaccaggttttcagatgtagaagataccctggagagtagggttattctgcaaacagacttaattttag

SEQ ID NO: 9998 - DNA, 201 bp, Homo sapiens
atgaacaccttaactaataataaatcaattaaaaaatttaacggtaagagaagtagaaggagagaccaggttttcagatgtagaagataccctggagagtrgggttattctgcaaacagacttaattttagaaagatctttctggtggctggtgttgaagatggacttgataaagaacgtcctgggggtagatgtggggtg

SEQ ID NO: 9999 - DNA, 201 bp, Homo sapiens
ttccctgaggaatggccaagatgcaggcatcagctgatgatgatgatgattactgttattgcagctattatttttataaatactcccttccttgagatgcaaaaaaaaaaaaatgtaatttgcaaagatgctttgttgggagataagtaggcttcctcttgggcacggagtttatctcactcgtgcataggttcctagagg

SEQ ID NO: 10000 - DNA, 201 bp, Homo sapiens
acttttaaaaacctatcactaactttctttttctagcgtactatgctgtcttcatgttgccttctttgcgtgtacttcatttctttttctttcttcatccrgctttctcttaccttcttatcatctgtcattgcattcatttattccttcttccactgtcctaaatctcatcaccttcttattctgttccttatcctagcc

SEQ ID NO: 10001 - DNA, 201 bp, Homo sapiens
ctgcaggatttctttccctttctctctctctttctctctttctttctttctttctttctttctttctttctttctttctttctttctttctttctttttctctttctttctttctttctttccttctttcgttcgttcattcctccttccttccttccttcctctctccctcccttcctcccttcccttcccttccttgct

SEQ ID NO: 10002 - DNA, 201 bp, Homo sapiens
tgcaggatttctttccctttctctctctctttctctctttctttctttctttctttctttctttctttctttctttctttctttctttctttctttttctctttctttctttctttctttccttctttcgttcgttcattcctccttccttccttccttcctctctccctcccttcctcccttcccttcccttccttgctt

SEQ ID NO: 10003 - DNA, 201 bp, Homo sapiens
gcaggatttctttccctttctctctctctttctctctttctttctttctttctttctttctttctttctttctttctttctttctttctttctttttctctttctttctttctttctttccttctttcgttcgttcattcctccttccttccttccttcctctctccctcccttcctcccttcccttcccttccttgcttc

SEQ ID NO: 10004 - DNA, 201 bp, Homo sapiens
caggatttctttccctttctctctctctttctctctttctttctttctttctttctttctttctttctttctttctttctttctttctttctttttctctttctttctttctttctttccttctttcgttcgttcattcctccttccttccttccttcctctctccctcccttcctcccttcccttcccttccttgcttcc

SEQ ID NO: 10005 - DNA, 201 bp, Homo sapiens
ctccccagatttgattgatttgctagagaaactcacagaacttaggggaacgctttatttacatctacccatttattataaaggatattacaaagaatacktatcaacagccaaatgaaagagatgcagagtgggaggtaggtggggaggggtttggcgcttccacgccctctccagcacaccaccctccaggaacctcga

SEQ ID NO: 10006 - DNA, 201 bp, Homo sapiens
attgatttgctagagaaactcacagaacttaggggaacgctttatttacatctacccatttattataaaggatattacaaagaatacgtatcaacagccaratgaaagagatgcagagtgggaggtaggtggggaggggtttggcgcttccacgccctctccagcacaccaccctccaggaacctcgacatgtccagctgt

SEQ ID NO: 10007 - DNA, 201 bp, Homo sapiens
tacccatttattataaaggatattacaaagaatacgtatcaacagccaaatgaaagagatgcagagtgggaggtaggtggggaggggtttggcgcttccaygccctctccagcacaccaccctccaggaacctcgacatgtccagctgtctggaagatctctgaaccctgtcttttggggtttttgtggaggcttcattac

SEQ ID NO: 10008 - DNA, 201 bp, Homo sapiens
ttcatggattaggtctgagattctatccctgttgggtcaataattagttggtatgtgactaatgtattgggaagatgcccggtggtctatgatattgggattttttttttctttttgattctttgggcctctgaagataattcagcagtttaccagaggagtacccattctgcctgctccttccctctctaacttcctttc

SEQ ID NO: 10009 - DNA, 201 bp, Homo sapiens
gtgtgcatgtgttcgcatgcaactgtgtgagatgctttgttaattaacattgtgaagctaagtgctcagtgaaaaaagtactagagaattgcatattgtcmttacagaattgtttgtaaatacaatcaagtaaaagctgtattgaaagaggtaggccttgttcagagccgtgttactaatctcaagtctaggggtttgctc

SEQ ID NO: 10010 - DNA, 201 bp, Homo sapiens
taacctagtttgtgttcaggtaattctggtaatgggacatttgcctctcccctgggggaccatttttagtgtctgtccatccaaccagttagtcagagaamagagccctgatgtaagtagagaaagaggtatttgtagaactgtgggaaaaagaaaaacataacacactgacctgttttaagagtgcagggtgggttcaag

SEQ ID NO: 10011 - DNA, 201 bp, Homo sapiens
tctgggcttttagtgtatccatcacctgaacagtgtacactgtgcccagtaggtaatttttatccctcatcccctcccattctcccaccttttggagtctmtaatgtctttattctactcggtacacccacgtgtactcattgttaagctcccacttgtaagtgagacatgctgtatttgactttctgtttctgaaatagt

SEQ ID NO: 10012 - DNA, 201 bp, Homo sapiens
atatctcaaattttcctgatccagtcaccagttgatggacacttaggttgattctatgactttaactttgctattgtgaatagtggctgcaataaacatatgagtgagtgccagtgtctttttaatataatgatttcttctcctttgggtagatacccagtagtgggactgttgaatcgaatggtaattctatctttagtt

SEQ ID NO: 10013 - DNA, 201 bp, Homo sapiens
tatctcaaattttcctgatccagtcaccagttgatggacacttaggttgattctatgactttaactttgctattgtgaatagtggctgcaataaacatatgagtgagtgccagtgtctttttaatataatgatttcttctcctttgggtagatacccagtagtgggactgttgaatcgaatggtaattctatctttagttc

SEQ ID NO: 10014 - DNA, 201 bp, Homo sapiens
atctcaaattttcctgatccagtcaccagttgatggacacttaggttgattctatgactttaactttgctattgtgaatagtggctgcaataaacatatgagtgagtgccagtgtctttttaatataatgatttcttctcctttgggtagatacccagtagtgggactgttgaatcgaatggtaattctatctttagttct

SEQ ID NO: 10015 - DNA, 201 bp, Homo sapiens
tctcaaattttcctgatccagtcaccagttgatggacacttaggttgattctatgactttaactttgctattgtgaatagtggctgcaataaacatatgagtgagtgccagtgtctttttaatataatgatttcttctcctttgggtagatacccagtagtgggactgttgaatcgaatggtaattctatctttagttctt

SEQ ID NO: 10016 - DNA, 201 bp, Homo sapiens
aattatattaaagatacagatgcatactagatgcaacacagaagaaagatgccttgtttctggccatagatatgacagagagatcaataaaggccacagarttctcttcctgtttattcctgtggttgttgttgggattttttttagatatagcaagtactcagcaaatttttgctgaatacatttacttagaacaaaggg

SEQ ID NO: 10017 - DNA, 201 bp, Homo sapiens
gcctcccaggttcaagcaattctcctgcctcagcctcctgagtagctgcgattacaggggcccgccaccatgcctggctaatttttgtatttttagtagasgtgggatttcaccaagttgggtcttattattattgttaatggcagctttattattgttagtgatcttggttaggtagatgtatcagttggctattgctgt

SEQ ID NO: 10018 - DNA, 201 bp, Homo sapiens
tcagcaggaaaagtaggtttatattagggggcctggggcatgggagaggtcaaagatggagggagaaaataagtttagagtttagcaaagtgggactcttyccacaaggagaaaccttctccacctagttacacaataaaatcgcctaaagagcttttaaaattgataattgagtctcatccaaggccaattaagcttaaa

SEQ ID NO: 10019 - DNA, 201 bp, Homo sapiens
aaagagctcatgttacatcttataaacaaaataaaactggtacatgattcgtgagtgtcttcattcttctctttcttccctttcttctcttcaacacactcaacacacacacacacacacacacacacacacacacacccaagaaattcacctctggctctggaatctggagaaagttcaaagtcatgcagcaatgaccgt

SEQ ID NO: 10020 - DNA, 201 bp, Homo sapiens
aagagctcatgttacatcttataaacaaaataaaactggtacatgattcgtgagtgtcttcattcttctctttcttccctttcttctcttcaacacactcaacacacacacacacacacacacacacacacacacacccaagaaattcacctctggctctggaatctggagaaagttcaaagtcatgcagcaatgaccgtc

SEQ ID NO: 10021 - DNA, 201 bp, Homo sapiens
agagctcatgttacatcttataaacaaaataaaactggtacatgattcgtgagtgtcttcattcttctctttcttccctttcttctcttcaacacactcaacacacacacacacacacacacacacacacacacacccaagaaattcacctctggctctggaatctggagaaagttcaaagtcatgcagcaatgaccgtca

SEQ ID NO: 10022 - DNA, 201 bp, Homo sapiens
gagctcatgttacatcttataaacaaaataaaactggtacatgattcgtgagtgtcttcattcttctctttcttccctttcttctcttcaacacactcaacacacacacacacacacacacacacacacacacacccaagaaattcacctctggctctggaatctggagaaagttcaaagtcatgcagcaatgaccgtcag

SEQ ID NO: 10023 - DNA, 201 bp, Homo sapiens
agctcatgttacatcttataaacaaaataaaactggtacatgattcgtgagtgtcttcattcttctctttcttccctttcttctcttcaacacactcaacacacacacacacacacacacacacacacacacacccaagaaattcacctctggctctggaatctggagaaagttcaaagtcatgcagcaatgaccgtcagc

SEQ ID NO: 10024 - DNA, 201 bp, Homo sapiens
tcatgttacatcttataaacaaaataaaactggtacatgattcgtgagtgtcttcattcttctctttcttccctttcttctcttcaacacactcaacacacacacacacacacacacacacacacacacacccaagaaattcacctctggctctggaatctggagaaagttcaaagtcatgcagcaatgaccgtcagcatg

SEQ ID NO: 10025 - DNA, 201 bp, Homo sapiens
cgtgttgattcatgtagtaactgggaattcttagttaatatttgtctgcagatccatttatcttccataacaccttagatgaaatgtttctttttgggctygtattcaagatcttggggtgatctttttctgtgtctagtttccatgcaatctgagctctgcagcagccagtggaaatgcccttagttgtcttcagtttct

SEQ ID NO: 10026 - DNA, 201 bp, Homo sapiens
gctgcaattctcattgcatctgagatgttcaagaggtaactttcaaaaccacacttggcacattcaacataattaggtaattgcacacagcacaggttgtrtaaaggttagaggagcatctttcaaattttagaggatattaaaattaccaggggtatttgttaaaagttagattcccaagtcagagctccagagagtccc

SEQ ID NO: 10027 - DNA, 201 bp, Homo sapiens
ctaggtataagtgtaggctaaaatggcaatgttcaggatacatcctttaagggtgtaatattattacatacatctgtctcctttctcatttacatattgtrcagctttttttgtccctttctatactattcccccttttattaaaaaatggagcagacacatgattaaaatgaggaccaggtcaagtttgcatttagctaa

SEQ ID NO: 10028 - DNA, 201 bp, Homo sapiens
ttcagtggaagcctccttttgaagaagggcaagccattcatttttcagcataaaccaagggatgctcttacacacacacacacacacacacacacacacasagagagagagagagagagagagcaaaaaaagaatagccatcataaagatacatttctgttctggattcaagaggcagaattattaatacaggtagactgc

SEQ ID NO: 10029 - DNA, 201 bp, Homo sapiens
cagtggaagcctccttttgaagaagggcaagccattcatttttcagcataaaccaagggatgctcttacacacacacacacacacacacacacacacagasagagagagagagagagagagcaaaaaaagaatagccatcataaagatacatttctgttctggattcaagaggcagaattattaatacaggtagactgcca

SEQ ID NO: 10030 - DNA, 201 bp, Homo sapiens
aaagaatagccatcataaagatacatttctgttctggattcaagaggcagaattattaatacaggtagactgccaggaatgcagaatgttaatgcagctgyggaataatacactagtgccacagagtttaataatagataatgacaaataatacagttggggaattgtgtaattcaataacagagtaaataacaaggaaac

SEQ ID NO: 10031 - DNA, 201 bp, Homo sapiens
gctgccatagtaaaatagcacaggctggaggacttgaacaacagaaattcattttctcacagttctggaggctgtaagtctaagaccaaggtgccagcagrtttggtttctccaaaggccattctctttggcttacagatggccatctttttcctgtgtcctcacgtgacttttcccccatgtgtacatccctggtatttc

SEQ ID NO: 10032 - DNA, 201 bp, Homo sapiens
tggaggctgtaagtctaagaccaaggtgccagcaggtttggtttctccaaaggccattctctttggcttacagatggccatctttttcctgtgtcctcacrtgacttttcccccatgtgtacatccctggtatttcttcattccaaatttcctcttgttataaggataccagtcacactggattagggctcactctaatga

SEQ ID NO: 10033 - DNA, 201 bp, Homo sapiens
tcactctaatgacctcattataacttaatcacctctttaaaaatcacctatctccaaatacagtcacattctgaggtcctgaaggttagggcttcaacctrtgaatttgggtaggaggcagggacacaaatcaactcataacacaagatgaggaatattgttaaatgataaaaacaaaacacttgatccctatgatctaaa

SEQ ID NO: 10034 - DNA, 201 bp, Homo sapiens
ttgctgtcaggttgttcatctccacgcctctgtgagatattattgaaacagaacccagcactgtcctccttgccaaagtggttgacgttggccttaacttyccccagttctgagacagggacagactggctaatgtaagtgtgccctgtggatgtgcaatttagagggaggaatgggaaagtatgttgtatgcagctaggg

SEQ ID NO: 10035 - DNA, 201 bp, Homo sapiens
tgaatgcatctggtggtggggagcttactaccctttaaggaaagtcattgtttaaaaacatgtatatataatttttaatttttacagaaaaatgtttgcawtgagcccaagtctgcctaataataatagcagtaagctaactctcatgtaaggtatactctgcagcagacccactttgggaactttacatatattaacatt

SEQ ID NO: 10036 - DNA, 201 bp, Homo sapiens
gatcagctgtgacctaattatgagtctcgtaaacctgcattgtgcccttcattttccagctcattgaccactcagagggggagggaaaagggatgagattctggtcaagtccttcctgccactaccatgtggccaaggtcacaggccaatgatgtccagagggagttggggcaggggatgcgctctttgtcttctctgaat

SEQ ID NO: 10037 - DNA, 201 bp, Homo sapiens
gggggagggaaaagggatgagattctggtcaagtccttcctgccactaccatgtggccaaggtcacaggccaatgatgtccagagggagttggggcagggkatgcgctctttgtcttctctgaatgaagcgagcgaggagtgaggcagagaggaaggaagatttgcagacaagcaagcctcccaggagcttgttggattgg

SEQ ID NO: 10038 - DNA, 201 bp, Homo sapiens
agcgagcgaggagtgaggcagagaggaaggaagatttgcagacaagcaagcctcccaggagcttgttggattggaatgtattctcaggtctattgtagagrcagaaattccagatttagcattctgtcattgtcagaataacaaattaatatgtcttatgcccacacaactacatatacgcaaatatacaggcatgaaacg

SEQ ID NO: 10039 - DNA, 201 bp, Homo sapiens
ccaggaggggtcaggcattgtggctcatgcctgtaatcccagcactttgggaggatcaggtgggtggatcacctgaaatcaggagttcaagaccagcctgrctaacatggtgaaaccctgtctctattaaaaaaaaaaaaaattagccaggcatggtggcacgtgcctataatcccagctacttgggaggctgaggcagga

SEQ ID NO: 10040 - DNA, 201 bp, Homo sapiens
gcctgtaatcccagcactttgggaggatcaggtgggtggatcacctgaaatcaggagttcaagaccagcctggctaacatggtgaaaccctgtctctattaaaaaaaaaaaaaattagccaggcatggtggcacgtgcctataatcccagctacttgggaggctgaggcaggagaatcacttgaacctgggaggcagaagt

SEQ ID NO: 10041 - DNA, 201 bp, Homo sapiens
gaggcaggagaatcacttgaacctgggaggcagaagttgtactaagccaagatcgcgcctttgcactccagcctaggcaacaatcgtgaaactccatctcaaataaataaataaataaataaataaataaataaataaataaaaagaattagccaggaggaatgacaaatagatttcatctttggactaccctctttaggg

SEQ ID NO: 10042 - DNA, 201 bp, Homo sapiens
aggcaggagaatcacttgaacctgggaggcagaagttgtactaagccaagatcgcgcctttgcactccagcctaggcaacaatcgtgaaactccatctcaaataaataaataaataaataaataaataaataaataaataaaaagaattagccaggaggaatgacaaatagatttcatctttggactaccctctttagggg

SEQ ID NO: 10043 - DNA, 201 bp, Homo sapiens
ggcaggagaatcacttgaacctgggaggcagaagttgtactaagccaagatcgcgcctttgcactccagcctaggcaacaatcgtgaaactccatctcaaataaataaataaataaataaataaataaataaataaataaaaagaattagccaggaggaatgacaaatagatttcatctttggactaccctctttagggga

SEQ ID NO: 10044 - DNA, 201 bp, Homo sapiens
gcaggagaatcacttgaacctgggaggcagaagttgtactaagccaagatcgcgcctttgcactccagcctaggcaacaatcgtgaaactccatctcaaataaataaataaataaataaataaataaataaataaataaaaagaattagccaggaggaatgacaaatagatttcatctttggactaccctctttaggggaa

SEQ ID NO: 10045 - DNA, 201 bp, Homo sapiens
ttaaaacatttcaaaagcccccaacctcagtacattccaaagcaggataaaataaatacaaacaaaaaatcaacacctacaccaaaccaggctaatataaracaaaacctacttaaggtccagatttttttgtcccagcatttaaaaacagtgccagcatggactgaagtaaacacgctgcaatgatttctcagcttggga

SEQ ID NO: 10046 - DNA, 201 bp, Homo sapiens
gagccagcccaaaaaaatatgtgattcctgccctgattcagatagagatatctccaggctacttactatatgtatttattatgaagtacatgaataaatcrccacccaaatacagtaaatgcattggtattaaaaattaacacagactttttgttgtctgtcatcccatcattttctctttaatgaaataacggtctggaa

SEQ ID NO: 10047 - DNA, 201 bp, Homo sapiens
cacagactttttgttgtctgtcatcccatcattttctctttaatgaaataacggtctggaataccacctaatggcctgagatgcctcagagtgaggtgtgttttaccaattctttaacttaatcagactggcctcttgatatggggccaggttcttctgagtaactcactctgaagaaaagcaggatggattgattcatgg

SEQ ID NO: 10048 - DNA, 201 bp, Homo sapiens
tcatggaatatggaagtgtttgcctagtgggcttcttttcaaaagctcaagaactttttctaaggtccctggtgtaccctggggaaaaaatattcttgactttttttttttttttgtcaaactgtttgtatatgtggggtgtgtgtgtgcgtgcgtgtgtgtgtgtgtgtgtgtgtgaagttgcatgttggtacatacttg

SEQ ID NO: 10049 - DNA, 201 bp, Homo sapiens
cgaatcttcagggaaggtggggggtgaataattgaaataactcttgatttcttatattagggaccaggaatatgcccttgataggaaatctgtcatttggrggtcattttggccctttctggaagaaaaggagacattgagtgctttgaggttccaacatcaccacataccagttagtgaaggtgacagtcttctggatct

SEQ ID NO: 10050 - DNA, 201 bp, Homo sapiens
tgctgttctcattaacctggaaatagacaccacattttatctgctgctctgtttcctgctgtagatctgtgtagtaaatccattaatctgtctgtccatthatccatccatccatccatccatccatccatccatccatccatctatccatctgtccacccatctgtctttccatccaaatttccatttttaaagggacta

SEQ ID NO: 10051 - DNA, 201 bp, Homo sapiens
catccatccatccatccatccatccatctatccatctgtccacccatctgtctttccatccaaatttccatttttaaagggactattttgtgtcaagtgtmatactgggaggcaatatatttcatggttagatatataggctgtatgtagcctcagactgtctggaattaaattctgcccattactttagctatatgacct

SEQ ID NO: 10052 - DNA, 201 bp, Homo sapiens
cagtggtgactttagtgggttttagaagcacgtgagaagtaaatatgggggactctggagctagaatgcctgggttcatagctcttatcttttctttttctttttttttgagatgggggtctcactatatcacccaggctcaccttgaactcctgggttcaagtgattcttttgcctcagcctcccaagtagttgggactg

SEQ ID NO: 10053 - DNA, 201 bp, Homo sapiens
ctttttttttgagatgggggtctcactatatcacccaggctcaccttgaactcctgggttcaagtgattcttttgcctcagcctcccaagtagttgggacygcaggcatgaaccactgtggctggtcagctcatagctccatcttttattggtcatgttaccttgggcaatgttgttagcttctctgtaccttagttttat

SEQ ID NO: 10054 - DNA, 201 bp, Homo sapiens
cacctggttgtaagcacaacttcattcctggagtgttgtgggattgaaggtgtcagttcctagctggctgttcactagaggctgccctcagtttcttgccrtgtgggctttcccatcatggcagcttcaccaaagtcatgagagagagagggagagagagagacagagcctgctaactagatggaagttgcaatcttatat

SEQ ID NO: 10055 - DNA, 201 bp, Homo sapiens
gtgggcagtagcctctaataaagggaacagttttaagtttccttttcttctcagcttctctgttaaatggttaatgatctggaagcaagtacttggaggtscttagggagctcctatttaaaggaacactgtgaagagaagttgccttctacagtaaaaaagtggggatgattagtcctccatttacatgtttagtaaatc

SEQ ID NO: 10056 - DNA, 201 bp, Homo sapiens
ccactcctagttgattccctctccctttcttttacttatgacatgcaacttccacaaaggcagtttatgttagttatctatggctgcataacaaattactsttgaacttagcagctaaagacaaaaacatttattatttcacagtttccatggaggaggaactcaggcatacccttgctgcgtcctgtaactcagaatctc

SEQ ID NO: 10057 - DNA, 201 bp, Homo sapiens
attttattttttacaaagcgttatcacatattaaatctggaaaggacattagagggccttatgcaaatgaataaactggcctagagatcttctatgcagcscccccagggtctgttctactgcagaccctggatctcctataacagaactataacagaacactggatctccacagaaagccacaaaggcccagagatgtgt

SEQ ID NO: 10058 - DNA, 201 bp, Homo sapiens
aatcatgtttaggattaataatagtttatataattaatatatgtgccatgcttgagccaacacattccatcacttatcttcaggctggctgcctcctgggrgccactaggtctcgagctgcaggctgagcatgctgggtaacaatgctataagtctgcttactggacccagtcctacagcctatgaatattcttttctgta

SEQ ID NO: 10059 - DNA, 201 bp, Homo sapiens
catgctgggtaacaatgctataagtctgcttactggacccagtcctacagcctatgaatattcttttctgtatttgaatagcaatagctggagatgcacargtcttgataaaataattttacatttgttatattcactttttttcttgcctgtcaaaaatgtcagcttttactctctggcttgcaatctaaatggacccaa

SEQ ID NO: 10060 - DNA, 201 bp, Homo sapiens
tgctgggtaacaatgctataagtctgcttactggacccagtcctacagcctatgaatattcttttctgtatttgaatagcaatagctggagatgcacaagkcttgataaaataattttacatttgttatattcactttttttcttgcctgtcaaaaatgtcagcttttactctctggcttgcaatctaaatggacccaatt

SEQ ID NO: 10061 - DNA, 201 bp, Homo sapiens
actggacccagtcctacagcctatgaatattcttttctgtatttgaatagcaatagctggagatgcacaagtcttgataaaataattttacatttgttatrttcactttttttcttgcctgtcaaaaatgtcagcttttactctctggcttgcaatctaaatggacccaattttaccttagctactttgatatgatattag

SEQ ID NO: 10062 - DNA, 201 bp, Homo sapiens
ttgatatgatattagctgcttagggcaattgcaagaaataccatacaagggttaatctccctcacccttccattcctttgatatgctgttggaaatttcaragtgctcaaacacggagatgaggaggcagagggtaaatggatacagaatggctgggaaagggagtagcagtggttggctgctcttaagatctctctccca

SEQ ID NO: 10063 - DNA, 201 bp, Homo sapiens
aagtgctcaaacacggagatgaggaggcagagggtaaatggatacagaatggctgggaaagggagtagcagtggttggctgctcttaagatctctctcccwtggcctggtgccatgagtctgtgtccagtgtgatttttggcaatttctacattctatgtgtatttgtgaagtactgtttttgcatcagatgatatctaag

SEQ ID NO: 10064 - DNA, 201 bp, Homo sapiens
catgagtctgtgtccagtgtgatttttggcaatttctacattctatgtgtatttgtgaagtactgtttttgcatcagatgatatctaaggataaattttgygttagaggagtgtagttacttgggaggaaagcagtgccatattattttatattaaacatcactggcagaaatatgaggatgggtaaatgtctactgataa

SEQ ID NO: 10065 - DNA, 201 bp, Homo sapiens
gcaatttctacattctatgtgtatttgtgaagtactgtttttgcatcagatgatatctaaggataaattttgtgttagaggagtgtagttacttgggaggraagcagtgccatattattttatattaaacatcactggcagaaatatgaggatgggtaaatgtctactgataatttaatagattttacctgcctaaatgac

SEQ ID NO: 10066 - DNA, 201 bp, Homo sapiens
gacattatttgcaatctgtttatttagttagtagcaaatcctggcacattagcataatacctaagggcaaaatattggattgactgtttgtttgcccttaggttatttttaaaaagctacttgtataaattaaaaaataaagcgaggcttggttgctaagaggatggtgggatttgtagactgcacaggagactaatgcaa

SEQ ID NO: 10067 - DNA, 201 bp, Homo sapiens
agcaaatcctggcacattagcataatacctaagggcaaaatattggattgactgtttgtttgcccttaggttatttttaaaaagctacttgtataaattawaaaataaagcgaggcttggttgctaagaggatggtgggatttgtagactgcacaggagactaatgcaaatcaaagagaccaggaaggaaaggccaggaga

SEQ ID NO: 10068 - DNA, 201 bp, Homo sapiens
gcacattagcataatacctaagggcaaaatattggattgactgtttgtttgcccttaggttatttttaaaaagctacttgtataaattaaaaaataaagcraggcttggttgctaagaggatggtgggatttgtagactgcacaggagactaatgcaaatcaaagagaccaggaaggaaaggccaggagaacaacagacaa

SEQ ID NO: 10069 - DNA, 201 bp, Homo sapiens
caacaggtgaatatccagaaaccagcagattctaacaggcaagaggtagaggctcaaggggagacagatgattgattggcttcagagaggtctggtaggartctaggttgtcagctgggatcgtgatcttcagaacagaccagtgtggggcaagcccaaagcaataacttggggtcaggcatgaggtcagggcaaggcagt

SEQ ID NO: 10070 - DNA, 201 bp, Homo sapiens
atcgtgatcttcagaacagaccagtgtggggcaagcccaaagcaataacttggggtcaggcatgaggtcagggcaaggcagtgggagaattgtaagctttsaggtatgtgtaggttaggggcttggtcaggaccaccatcagcaggatcaggattagggctcatgggtcttgaacttctttcattcttcctgaccagaggc

SEQ ID NO: 10071 - DNA, 201 bp, Homo sapiens
aggcatgaggtcagggcaaggcagtgggagaattgtaagctttgaggtatgtgtaggttaggggcttggtcaggaccaccatcagcaggatcaggattagkgctcatgggtcttgaacttctttcattcttcctgaccagaggcagggctagtcccagggcctaggacaaggctaagcctgaaggtggacattatgtgaca

SEQ ID NO: 10072 - DNA, 201 bp, Homo sapiens
atcaggattagggctcatgggtcttgaacttctttcattcttcctgaccagaggcagggctagtcccagggcctaggacaaggctaagcctgaaggtggayattatgtgacaaccaacaaaaggaggaacatcatactagagtcaccgtatgtcctagtttctctaggacaggcccactttacatgtgttgttccagcatg

SEQ ID NO: 10073 - DNA, 201 bp, Homo sapiens
ggacaaggctaagcctgaaggtggacattatgtgacaaccaacaaaaggaggaacatcatactagagtcaccgtatgtcctagtttctctaggacaggccyactttacatgtgttgttccagcatgataatcagtggttctcccctttcacttgaaagtgactgacttgcgtgataagttacatagttaccctgattattt

SEQ ID NO: 10074 - DNA, 201 bp, Homo sapiens
ggaacatcatactagagtcaccgtatgtcctagtttctctaggacaggcccactttacatgtgttgttccagcatgataatcagtggttctcccctttcayttgaaagtgactgacttgcgtgataagttacatagttaccctgattattttccagaatgtgtttcataaaaatctttttagaagaatgtcatccagagac

SEQ ID NO: 10075 - DNA, 201 bp, Homo sapiens
gactgacttgcgtgataagttacatagttaccctgattattttccagaatgtgtttcataaaaatctttttagaagaatgtcatccagagaccacaaaagyagagttctctagtcacataagtatggcaaatccagaatgaaaggaagtttaatggaggagtctttactgcaggatttctcactgcctttatatgctaaat

SEQ ID NO: 10076 - DNA, 201 bp, Homo sapiens
ctgattattttccagaatgtgtttcataaaaatctttttagaagaatgtcatccagagaccacaaaagtagagttctctagtcacataagtatggcaaatmcagaatgaaaggaagtttaatggaggagtctttactgcaggatttctcactgcctttatatgctaaattataataggaattgctaagaggggaatagagt

SEQ ID NO: 10077 - DNA, 201 bp, Homo sapiens
acactttggtactcctgagactacgttatgtggaacacactttgggaaaccctggttagttgaatatggggtcagaaagggaaactggtcattgctcctgytgtaataagggtgcttgcaaagacagcagtcaccagttaaataaataattctggaaacaacaactgcagactctgacaaaatcttcaatttgctgattat

SEQ ID NO: 10078 - DNA, 201 bp, Homo sapiens
actacgttatgtggaacacactttgggaaaccctggttagttgaatatggggtcagaaagggaaactggtcattgctcctgctgtaataagggtgcttgcraagacagcagtcaccagttaaataaataattctggaaacaacaactgcagactctgacaaaatcttcaatttgctgattattgactgacattagcagagg

SEQ ID NO: 10079 - DNA, 201 bp, Homo sapiens
attttatctctctgcctggtggaatgggtcaatatcaaacaagctaatccagggagaatgatgcattgatttcctaggccttaccaagtgtgcaggctgawgtcaacctacctaggaaggttttttttttaagatgaggtggaagagagaatacagcaagaaacaaggagaaagatttgctttgcttttgttatggagtta

SEQ ID NO: 10080 - DNA, 201 bp, Homo sapiens
aaatatggctgttttctcagaaatttcaactttttaaacaaaagttgaaaatctatattttttgaaagtttttctgatttttaaaaacagacttcttgagrtataattgatatacaaagagctgtacatatctaatttgatgaatttggacatatgcaaacatcgatgatgccttcaccataatcaaggtaatagacatat

SEQ ID NO: 10081 - DNA, 201 bp, Homo sapiens
atattcaacacctcccaaagtgtcctgtgctcctttcttttttgtgggtaagacgcttaacctgtgatctaccctcaagaaactttgaagtgctcaatacsatattattaactatgggcacaatgttgtatagcagatctctaaaatttattcattgagcctatatccattgaacaattccccatttctccctcccctcca

SEQ ID NO: 10082 - DNA, 201 bp, Homo sapiens
cttcttttaaaaaactaaataatagtcatgcttggatgaaactttgggttgtttccatatgttattgcgaacagtgctgcaataaacatgggggtgcagakatctctttgagttcctggtatcaattgtttagatatatgtccagaagtgggattgctggatcatatggtagttttatttttaatcttttgagtagccttc

SEQ ID NO: 10083 - DNA, 201 bp, Homo sapiens
tatattggaaattttgtgacacttcttgagacaccttgagtttctctgagttgttacaaaaccagagcaaagagtcaaagctgtaatttctgcctatcacyggcttttgaatagattatgaactcttagaggattgggtttgtatctatatagttctctttatacagagatgaaggctttcacagcagtatctataattgg

SEQ ID NO: 10084 - DNA, 201 bp, Homo sapiens
gggcgtgttttaagccatatgctcataacctttgtgtcatgattcagttggtgtgtcttgatcagtttcctcatctgtcatctcttggaaagcatgtaaarattaatcacagatatctgcttgtattacctagattaatgctagatgattagcagatgaaccttaacatctcagtggcttaacaaaaaaaggtgttaatct

SEQ ID NO: 10085 - DNA, 201 bp, Homo sapiens
ttattaatatcccaaattttttaaatggtcacaataattccccttgcaacttctgtcatatgaataagcccaggatcgcttgatggatgatgatgaaggaytcatggccaagtcatccacaccacctcagccgactttgagtcagtcaccagacatgtaagtcatgtaagtaagaccatcctagagcatacagccccaggc

SEQ ID NO: 10086 - DNA, 201 bp, Homo sapiens
gatgaaggattcatggccaagtcatccacaccacctcagccgactttgagtcagtcaccagacatgtaagtcatgtaagtaagaccatcctagagcatacrgccccaggcaagccagcctagatcagaagaaccagccagcctactcacagaactgtgagaatgaccaatgtttgttactttaagccactaagtttggtgg

SEQ ID NO: 10087 - DNA, 201 bp, Homo sapiens
tagagcatacagccccaggcaagccagcctagatcagaagaaccagccagcctactcacagaactgtgagaatgaccaatgtttgttactttaagccactmagtttggtggtggtttattatccaacaaaggctgatacagaaaggatcacaattgaggagtttatgtgagctcaatctgaaagtttatatgagctagatt

SEQ ID NO: 10088 - DNA, 201 bp, Homo sapiens
tgtgagctcaatctgaaagtttatatgagctagatttgcccattatttcactaaattcatcacatggccccacctaactccaaaagagactggaaaatgtraaaaacccagacagaaagggaagtaggctccaggacagctggccaatatctgccacactgatttaccttgattttgtaaaaacaaaacaaaatcaaaacc

SEQ ID NO: 10089 - DNA, 201 bp, Homo sapiens
ttaatattgtatttattaggagtatggcacacgataggtacttattagatgttagctatcatcatcatcttcatcataatttgattttgcttttcttattycctttgatcttgcctcctagtctaacaggagaaacattagaagttggtggagacggcctagaaaaggaagggtagattagagagcaggagatagtgaaaa

SEQ ID NO: 10090 - DNA, 201 bp, Homo sapiens
ggggatgtgccactggggccgagatgacgagtttcgtgaaaaacagagttcaaaagaggaggctcttgagtgtaaagataatttgaggggaaaagaaaaaratagaatgtgactggaaggaacggaataggaaaagcagcatgatatagatggaaatctcctcatttctttgacgtccttaacaagaacatcaagtgaggc

SEQ ID NO: 10091 - DNA, 201 bp, Homo sapiens
gccaatatagagctggggttaaacatgtcaagaattcaaagctatagtgcccctgggtattcaaaaagcgtaaagatttgactaaattcacagccaaatgrcatttaccccaggtctaccccataccagtcactggcttctctctaatagttgttatcccttttaattctatagaatagaaaagaaggaattggggctagg

SEQ ID NO: 10092 - DNA, 201 bp, Homo sapiens
tggcttctctctaatagttgttatcccttttaattctatagaatagaaaagaaggaattggggctaggctgagcagcagaggagagattggctgtggagartatagatgacacatgaggccaggtgatctctgagaaaagtttctcccatctgttgcttagattgcccatcttggaactcaggaaatctgagatggcttta

SEQ ID NO: 10093 - DNA, 201 bp, Homo sapiens
tttaatatgttgatttaagtaatgctgggtgatgagtggtagtgacaaggctcttctcttactaggatatcacatgaacaggttctgtcctaattctgccyttgcctagtacatatgggtgactagaatttggtgagagggggctgtctgctgagctaccccaactgtggttacagcacagttacagagatggatttttaa

SEQ ID NO: 10094 - DNA, 201 bp, Homo sapiens
ggagcattcacagagaaggttatatttgttgaggaccttgaaggagtaggagttgcctaggtaaatcaaggaaataaagggaataaatatcaaaggacccrcatgtatgaagacacagaagacatagctttagagaagtttagagatgtttgtagagcatgctggaacacaagaaatgcttttggaaagactctgtaaaat

SEQ ID NO: 10095 - DNA, 201 bp, Homo sapiens
tactaggtatgcaacagtgaacatttaaagtttattgaattaagtcaaccaaagaagacccaagttgtgggattcaagaatagcaaggctctttcaaatgyctctgaaacagttgggggtggacctctccatggtgctgaaacatcccctgttcaagccttcctatctatctggattattggctcctttccatgttcctaa

SEQ ID NO: 10096 - DNA, 201 bp, Homo sapiens
tttgaagatagactcaaacaatgggcatgtctcacaatgatacagaggactcagataaagttggtggaatagagtggaaagaatactggatttgaaattamaagttcaaatcagggtttcaccacttagaagctgggtaaagtcatttagtttattttgaagcctcagtatccttatttgtaaaatgtagacaggttattc

SEQ ID NO: 10097 - DNA, 201 bp, Homo sapiens
aataatttatgggggatccattgcatgctcctttgtgtactctgtctgtctgtctctctctcttcctctatccccactctaattcctttcaccgtcatttmtttctgcctctttctggtattcagtcctgtatatattaaaagcataagccaattagaaaataattgctgttactctgcttggcccatctttcttgatgtt

SEQ ID NO: 10098 - DNA, 201 bp, Homo sapiens
gcagaagtgctctgcctgaagcccagggttaatttttacaatggccacttagccaattgaggatggttaagtgagcaatattttatagactcttgtattarttattttgggggatggatataagtttgtggatggggaaaacactctcagattattctaggggagatgaatgatatatctttacaaaaacatataaaaacc

SEQ ID NO: 10099 - DNA, 201 bp, Homo sapiens
agccattaaatcgaggtgtgcctaactctaaattccatactctttatattacactatgatgtctaataaataatttggttgaaagagtcatttttattcargataggagagtagactcattgatttctgttagtcttttctatgaatctgttatcggaaatagttgactacaattaaaataattcctggcactataacact

SEQ ID NO: 10100 - DNA, 201 bp, Homo sapiens
agtagaatgcaaggctagactactagcaggcatccttctcattaattagcgagagaagagcttgtctgaactatggagggaaaaatagagaatcaatatcwaacggtattctttaagaccctgaatccagccacacttgaaccatttttctaaaggaatgtgaattcatagtgtttttcttttatcttgggtctatgttat

SEQ ID NO: 10101 - DNA, 201 bp, Homo sapiens
ccagtaatggttagtaaagaatacaagagagtgtaggccgggtgcggtggctcacgcctgtaatcccagcactttgggaggccaaggcgggcggatcacgrggtcaggagattgagaccatcctggctaacacggtgaaaccccgtctctactacaaatacaaaaaaaaaaaaaaaaaaaaaaaattagctgggcgttgtg

SEQ ID NO: 10102 - DNA, 201 bp, Homo sapiens
aatcccagcactttgggaggccaaggcgggcggatcacgaggtcaggagattgagaccatcctggctaacacggtgaaaccccgtctctactacaaatacaaaaaaaaaaaaaaaaaaaaaaaattagctgggcgttgtggcaggtgcctatagtcccagctacttgggaggctgaggcaggagaatggtatgaacccagg

SEQ ID NO: 10103 - DNA, 201 bp, Homo sapiens
atcccagcactttgggaggccaaggcgggcggatcacgaggtcaggagattgagaccatcctggctaacacggtgaaaccccgtctctactacaaatacaaaaaaaaaaaaaaaaaaaaaaaattagctgggcgttgtggcaggtgcctatagtcccagctacttgggaggctgaggcaggagaatggtatgaacccagga

SEQ ID NO: 10104 - DNA, 201 bp, Homo sapiens
agctcccttttcaaaatacttgaactccacctggacctaggcaaaatgttttaaaatggcatcagagtgaatcaaatcacattaacctgagatggtgggcraggatcatgaaaaaggacagagggaagcctgaatgtgagtttgcctgaagaggaaatgatgattccaataagtgccttttctttccgtttgcattctgtg

SEQ ID NO: 10105 - DNA, 201 bp, Homo sapiens
cctaagaggtaggtagggatgatgactatttatagacaggaaagctgagttggactaagtgaaataaacagcgatgaataaagtctgtggaagaaaggggmttcatattttctatgcttcctgatatccaagtcacccagaaatacaccaaagaagctttcagttttcacacctggctgtatgaatttattccatctcagt

SEQ ID NO: 10106 - DNA, 201 bp, Homo sapiens
gactgagtaatttataaagaaaggaggtttaattggctcatggtactgcaggctgtacaggaagcacagcagcatcttctctgcttctggggaggccttargaaacttgtaatcatggcagaacgaaagggggaagcaggcacatcttacatggctggagcaggaggaagagatgaagtgggaaggtgatacacactttta

SEQ ID NO: 10107 - DNA, 201 bp, Homo sapiens
gaggtttaattggctcatggtactgcaggctgtacaggaagcacagcagcatcttctctgcttctggggaggccttaagaaacttgtaatcatggcagaasgaaagggggaagcaggcacatcttacatggctggagcaggaggaagagatgaagtgggaaggtgatacacacttttaaacaaccagatcttgtaagagct

SEQ ID NO: 10108 - DNA, 201 bp, Homo sapiens
cagatcttgtaagagctcacttgctacacagtaccaaggaggatggtgttaaaccattcatgagaactccactcccatgatccaaccacctcccaccaggmcccacctccagcactggggattacaattgagcttgagatttgggtggggacacagatccaaaccatgtcagccttcttttctgtgttatttttatgtcca

SEQ ID NO: 10109 - DNA, 201 bp, Homo sapiens
aagttatttttcaggtgcctggaggatggaaaagggttgccctggaaattgatatcttcttctgagtttggcttaacaggggaaccaccagtgcccttgckgatggctgaggtgtcttttatgctaggtatggctctcttccagataaccaagtgtagacaggagtaggcccagttgttcatggagcattggttttaggac

SEQ ID NO: 10110 - DNA, 201 bp, Homo sapiens
aactttcaggttttactgtatttggctgtaaaattcaaaagccagattgactaattctcagtgcctgttaaattcttttaggagcaaagtgatacattgtscccacccctgcctttcctaagaactcattttttcccctactcattagctgtattcaaatgcagagctttgctgatgaacagcaaagtggcttcttgacta

SEQ ID NO: 10111 - DNA, 201 bp, Homo sapiens
gaagcttaggacaggagctgatggagattagccaaaatgtcagagttagcctaccctttgacctgggcctggaggtgaggttttcttcttacacttacttyggaatgagaaatgagagagtgaagttttcttcctacacttacttcatgtcaatcttctcagtgtctaattgctatgatcagaaattcagagttatcccag

SEQ ID NO: 10112 - DNA, 201 bp, Homo sapiens
cagaaattcagagttatcccaggctgggtatttgcataccacaatgagaattgctacaactaatgttgcttgatggaagggcaggagctgaaattttaccygagccaccaattttctcaaaaccttggcctgagagagaattcaagttttacccagaagtatctacattttgttttttacaaaagggctcatgatagagct

SEQ ID NO: 10113 - DNA, 201 bp, Homo sapiens
gtatctacattttgttttttacaaaagggctcatgatagagctcagttaccttctgctatccatctgtgccaatctgaactgaatcagagtatcatttccttttttttgcatgtgctggtgtctcctgtgttggccttttagagtctgacacggtatttgggaccctccatgagattggaaggagttccattaagtgatag

SEQ ID NO: 10114 - DNA, 201 bp, Homo sapiens
aaggtactcaaatactttttatttaaccttcttactttttgtccttagggaaactgtagacactttgagactgtttattttatgcttcttttctaggaggyaaagcttttgggggaaggttttatgctttcagaattttcagttaacatttctgctttgtgatggtctcccaatcccatctccttcaatgacagctccaaa

SEQ ID NO: 10115 - DNA, 201 bp, Homo sapiens
aaaatatcaccagttttttatttttcttattcaaccctaagttttattggagaaccttattcctgcttcatggagaaaactggctaggcgtggtggctcaygcctgtaatcccagcactttgagaggccgaggtaggtggatcacctgaggttggaagttcaagactagcctgaccaacatggagaaaccccatctttact

SEQ ID NO: 10116 - DNA, 201 bp, Homo sapiens
ccagttttttatttttcttattcaaccctaagttttattggagaaccttattcctgcttcatggagaaaactggctaggcgtggtggctcatgcctgtaaycccagcactttgagaggccgaggtaggtggatcacctgaggttggaagttcaagactagcctgaccaacatggagaaaccccatctttactaaaaataca

SEQ ID NO: 10117 - DNA, 201 bp, Homo sapiens
atcacttgaacccaggaggcggaagttctggtgagccaagatcgcgccattgcactccagcctgggcaataagagcgaaactccatctcaaaagaaaaaaraaaagaaaagaaaagaaaagaaaaagaaaattgatgatattttgtgtgtgtgtgtgtgtgtgtgtgtgtgtgtgtgtgtgtgttttagttctccagcccc

SEQ ID NO: 10118 - DNA, 201 bp, Homo sapiens
tctatagtactgggcaaggttcttgacacacatgagctgcttaattaagtttaatgtatttatgacaaatttagagcaggtttgaagaaattcaggctttkccccattaagtaatggtgcaccccattaagtaatggtgcactttgggagaaatgggctgaaaaagttttaacgatagcttttgcagcctatttgccccaa

SEQ ID NO: 10119 - DNA, 201 bp, Homo sapiens
aaagcacaattaataattgtgtgtaatgagcaaattagagcaataatacaagaaaatgagaggcaattccttgaaatgtttctgtcttatcttttaattgaaaaaaaaaaaaaaagccttccatttccctcaggtagagtgaaactgacaactgagctgccctgcttctgccaaatatgaagatatctaagactctgcttc

SEQ ID NO: 10120 - DNA, 201 bp, Homo sapiens
aagtcctggagggagagtggggaggggaaaggaagaagtctgttgaacttggggcttagtttcactctggattatgtggcaaattgattttgataacaggyacctccccattcatacctatgttattcttaggattatgcagtaaaatagtttaatagtaaaaggatagaactttggtgttagaaagacctaatttctggt

SEQ ID NO: 10121 - DNA, 201 bp, Homo sapiens
ccaaatctattaaaaaatggataatcatgcttaatatagaacagttctgagaattaggtaagaaaatgtctatgtaagtgcctagtgccacatcttgccaytagtaagaaccaagaaatgctatttgtggtgggatgccattgatgttgggtagagcttagctatgatttatgatactcccaagagactttttttttaatc

SEQ ID NO: 10122 - DNA, 201 bp, Homo sapiens
tagctggctcttgccccgtctgtaggtcacatccccgcatcacgttcctaataatctacctgcacttcactcttggtctgaaggtttgcttctgaggaaamccaaactaaggcatggggctactctagtaagccagcccagtgatgtttatggtgaattatcataagtagatctcgataccaggatttgtattatattgta

SEQ ID NO: 10123 - DNA, 201 bp, Homo sapiens
tgctgcacccatcaactcatcatttacattaggtatttctcttaatgctatccctcccccagccccccacccatgacaggccccagtgtgtgatgttcccyggcctgtgtccaagtgaactcaatgttccattctcacctatgagtgagaacatgcagtgtttggttttctgtccttgtgacagtttgctgagaatgatgg

SEQ ID NO: 10124 - DNA, 201 bp, Homo sapiens
aagtctttgctattgtgagtagtaccaccataaacatacatgtgcatatgtctttatagtagcatgatttataatcctttgggtatatacccagttatggkattgctgggtccaatcataattctagttctagatccttgaggaattgccacactgtcttccacaatggttgaactaatttacactcccaccaacagtgta

SEQ ID NO: 10125 - DNA, 201 bp, Homo sapiens
gtacttcacatcccttgtaagttggattcctaggtactttattctctttgtagcaattgtgaatgggagttcactcatgatttggctctcagtttgtctgytaatggtgtataggaatgcttgtgatttttgcacattgattttgtatcctgagactttgctgaagttgcttatcagcttaaggagattttgggctgagac

SEQ ID NO: 10126 - DNA, 201 bp, Homo sapiens
ccagtagtcattcaggagcaagttgttcagtttccatgtagttgagtggttttgagtgagtttcttaatcctgagttctaatttgattgcactgtggtctvagagacagtttgttgtgatttctgttcttttacatttgctgaggagtgctttactcccaattatgtggtcaattttggaataagcgcgatgtggtgctga

SEQ ID NO: 10127 - DNA, 201 bp, Homo sapiens
ctaatttgattgcactgtggtctcagagacagtttgttgtgatttctgttcttttacatttgctgaggagtgctttactcccaattatgtggtcaattttmgaataagcgcgatgtggtgctgagaagaatgtatattctgttgatgtggggtggagagttctgtagatgtctattagttctgcttgttgcagagctgagt

SEQ ID NO: 10128 - DNA, 201 bp, Homo sapiens
tatgaaattctgggttgaaaattcttttattttagaatgttgaatattggcctccactctcttctggcttgtaatgtttctgctgagagatctgctgttastctcatgggcttccctttgtgggtaactcggcttttctctctggctacccttaacacttttcccttcatttcaaccttggtgaatctgacaattatgtgt

SEQ ID NO: 10129 - DNA, 201 bp, Homo sapiens
ttcttgctttatttcattaatttgatcttcaatcactgataccctttcttccacttgattgaatcagctattgaaacttgtgtatgcatcatgaagttctygtgccatgattttcagctccatcaggtcatttaaggtcttctctcactgtttgttctagttagccattcatgtaatattttttcaaggttcttagcttcc

SEQ ID NO: 10130 - DNA, 201 bp, Homo sapiens
gttggtgaggagctgtgatcctttggaggagaagaggcactctgatttttagaattttcagctttcctgctctggtttctccccacctttgtgctttcatyccacctttggtctttgatgttggtgacctacagatggggttttggtgtagatgacctttctgttgatgttgatgctattcttttctgtttgttagttttc

SEQ ID NO: 10131 - DNA, 201 bp, Homo sapiens
tgctggaggtccactcaagaccatgtttgcctgggtatcaccagcagaggctgagaacagcaaatattgcagaacagcaaatattgcagaacagcaaataytgcaggaaagcaaatattgctgcctgattcttcctctggaagcttcgttccagaggggcagctgcctatatgaggtgtctgtcatcccctactgggaggt

SEQ ID NO: 10132 - DNA, 201 bp, Homo sapiens
ggttatctgagcaccaggtaaggcctgggaagggtagaggcaatatggctagatgtccatttcctataatctctaaatttgtatgaattgatgcattcatratctgagatcataaatgaagtccataaagtccataaacctcctgatattttatgtaaaacttaatgcatatgtacacttttctagagaggaagtcttgag

SEQ ID NO: 10133 - DNA, 201 bp, Homo sapiens
cttaatgcatatgtacacttttctagagaggaagtcttgagcttttggattttaacaggtgtcctcaacatattgaaaactgcttcagcttgatgtccaatttcagtgctaacaattgttgcagaagtgtttttgagcactaatcatatcaattgcaataatggtgctccttggggtctcaggtgagctgagacttggagc

SEQ ID NO: 10134 - DNA, 201 bp, Homo sapiens
caatctggccttttattacattgctgttgactttgttgttgttgttattgttacatgtttgtttttctttggatatcaatgcttttatgggaattatttcycatttcgttaatcctagcctagtttccttcaaaagggtcttgagtgcaggtagcctcttcagggtagagtaaaacaacaaaaaagtcaaagccggaatca

SEQ ID NO: 10135 - DNA, 201 bp, Homo sapiens
agagtaaaacaacaaaaaagtcaaagccggaatcaagggtgtgttttctatcatacagaatattatgatggaccactgaggctcagtgccactagggactytcttgggaggtgcatagaatgaatattaaaactctctgcctgaaagatggaataaggcagaatgtatttactgttcccatttccccttggccaaggatta

SEQ ID NO: 10136 - DNA, 201 bp, Homo sapiens
tctttgcagcagctggcatgcaaaagtgaacagagaggatatgagggcacaagaggtgtctcatacaccttctccattctagcatctctcctcactgagamcatggtaatcttaacttgtaggcatgcagtgttaataaatgaagccaaagtgctggatttgatccctatgtaggtcacttagctgcccacagtgaaaagt

SEQ ID NO: 10137 - DNA, 201 bp, Homo sapiens
cttctccattctagcatctctcctcactgagaccatggtaatcttaacttgtaggcatgcagtgttaataaatgaagccaaagtgctggatttgatccctrtgtaggtcacttagctgcccacagtgaaaagtagcaccatggacatcaaagtgaacaaacccctgcctgagtacttatttccatggatcaaaaggatggg

SEQ ID NO: 10138 - DNA, 201 bp, Homo sapiens
gcccaagagacagcagggagattctgggaataaacaggagttgggttctcaatttggcaactaagcattcttttgttattgcactttctcaggctgcagcrgagcctgattagctttaaaattcatttccattggtttcttctttcatgatagttttagatgttgttttattggcattcctatagatgtaatttaaccttg

SEQ ID NO: 10139 - DNA, 201 bp, Homo sapiens
ctgagacataggttttcttaccatatccattttacacttgaggaaaatgaggcacaaaaaaattgagtaattagcccaaaggtcacagaggaggtcaagtkgtgaatgtgggatttgaactctgggaatctggcactgaaatccactcttattatagttcctcttatttgttaggccaggactatttatgaaaaaagccac

SEQ ID NO: 10140 - DNA, 201 bp, Homo sapiens
catggagatcattttagttaaaattagaatgcatttagggatgtcccttgttatctatattaaacattgcatttgctatagcctccaaggccataaaacasaaaagtaaaatagttggtgtaaatatcagaagaggtaaaactatctctttttgctgatactataattccttatcaagaaatttaaacaactctagttaaa

SEQ ID NO: 10141 - DNA, 201 bp, Homo sapiens
gaggtaaaactatctctttttgctgatactataattccttatcaagaaatttaaacaactctagttaaaaacttacagaatgaataagatactttgataasctatctggatataagtatataatatcaatcacttctttattctatcaataattaaccatttttagttctcaaggttcaaatttcagagaaggtggctttg

SEQ ID NO: 10142 - DNA, 201 bp, Homo sapiens
cactatgcctggctggctctgcaaacttttacttctatgaccctttctttctcttggtttctccttgacacttctccccaatgaacccatggtgcaatatrggagttggtgccctaaaagtgactacctcctaaaatcactcacactcaattattagtaaagttcaaatgacaacttttttatgataattgtgttttaaaa

SEQ ID NO: 10143 - DNA, 201 bp, Homo sapiens
aaagcctgagtatttctgtgccttgtagcacatcttagaaagggagaagggctattcagcagcattgttcatgctcaggcccaggcccagctgcctctaamtgtggtcatgagaagtctcagacactggcatgaagtcagcaaataaaaataaacaacatagccaagtatgatggtgcacgcctgtagccccagctactca

SEQ ID NO: 10144 - DNA, 201 bp, Homo sapiens
ccaggagtttgaggctgcagtgacctgtgatcacaccagtgcactccagtatgggcaacagggaaaaatctctgtctccaataaataaataaataaataartagtaattagaaataaataaacaacatttttgaggagaagggatgaagttgattaatgggtacaaatacaccgtttgatggaataagacctagtgttaga

SEQ ID NO: 10145 - DNA, 201 bp, Homo sapiens
acctaatataaaaaatccagcctctagtttgaggagctgaaagaatgaaccctatgcagtcctgattgtctgggcttattttcacttgctctgtgaagcasctgagcccttgttggtgaaccctgctacagtccccactgagtttaagacccactcttttcaagggtccccatgttaggtttgcctccacaccttagcttc

SEQ ID NO: 10146 - DNA, 201 bp, Homo sapiens
tgctgtgtatttctacccataccctcatccaacttatctaaatcttgctcctttttttccattcttgctgatttaattttatccctcaactcatggttccraataatcccctgtgttagttgtgcctacagcaacttgtttaactctctctaccaggcaataaggtggaggggcaggggaaggataaatgcagcctacttg

SEQ ID NO: 10147 - DNA, 201 bp, Homo sapiens
cttgaacaaatcattctgcctgtctaaacattaattaattcctcaacttttaaatggaatatgatgactatttccctttatatgtgtatcttagatgtagkcatggagctaaaatagaaactcaaaatgaagtaacagtaagggctggcagtggaatattattgatcccagaggaaaataaaaattttatttccaacgttg

SEQ ID NO: 10148 - DNA, 201 bp, Homo sapiens
agagtagacctccctggagcttcttaaactagccaatgttaatcttggtgctgagacatattgatggtatgtcatatgtaataggttaccaaataataatkcatatactaaaattatgctaaagatttactaaaaatttaaattaaggcagatcaggcttatggctaaaataacatcatttccatgcacctgcattctgac

SEQ ID NO: 10149 - DNA, 201 bp, Homo sapiens
tcaacactgtttataagatctttcatgttgctatgttttcatttagttggttttctgtaactgctgcatagcatttctctgtatgcatccaccacatcttygcatctgttcctctagtgctaaaactctgcttcaattccacaattaccaatagtgtggtgtgtggccctgagcaaaaattgcttggggatatattcccaa

SEQ ID NO: 10150 - DNA, 201 bp, Homo sapiens
ttgtaaattgcatctttcttccttacctgtgtatgccctcaatgctttgcttgttgcaagactccagtaagtgttttctgaaataaattgtctgatctctsgaaggtcctgcctgacaataaggggccattggctatgaaagggtggtaggatctaggagtggaaagtcacagatgattattttctattctaatagggtga

SEQ ID NO: 10151 - DNA, 201 bp, Homo sapiens
tgctttgcttgttgcaagactccagtaagtgttttctgaaataaattgtctgatctctcgaaggtcctgcctgacaataaggggccattggctatgaaagsgtggtaggatctaggagtggaaagtcacagatgattattttctattctaatagggtgatcggtttatttttttcttttcttgactgttttcctccctact

SEQ ID NO: 10152 - DNA, 201 bp, Homo sapiens
ctacaaacacttctcttagggactcaggtcccaaccttgctgggcagagtgcatgatgtgtttcataatgcatgagtgtttatttaacaaacagcaacackttttaattaaactgttgttgaagatacagactgtataacctttctccaaggcctggatgctcactggcccttccaagatgctgacccctcgctagctgca

SEQ ID NO: 10153 - DNA, 201 bp, Homo sapiens
attacatgtttaacactgggtaacagtggggctatgcttatcttggacgttcagggacctatacgctcagaagcttggctgctttttgatgtgaccatctygacatgagtctttagggttttctacagcagagaaagaacaagaaataaattgtctcttaaatgttcttaccattttcattggccaaagcaggtcacatga

SEQ ID NO: 10154 - DNA, 201 bp, Homo sapiens
ctctactccaaggaggcataggagtttaaaataggaaaacagtagtacgttgtgatggattgtatttttcaaagaaagtcacaataatatttcccatcccrtgcactcttctgcaatgtatccttgacattctgtcatcaagattaagaggtagactctctctctaccctcttgaatgtggataggccctatgatggcttc

SEQ ID NO: 10155 - DNA, 201 bp, Homo sapiens
tgaaggttatagtgtttggctctgtcaagagcaacctcacacatcttcttcactggaggctcacaaatgctcctcagaatgtctatttaactatctctagrtaggactgggctctgactgggctcctacttcacccattacctgtttcttcctttgtcctgagaatgtttgcatgaagccagaatctctgtttgtttagaa

SEQ ID NO: 10156 - DNA, 201 bp, Homo sapiens
caatctattcaatttggaattcacaaacttacctaaaacaaggcctttcaatttcctgtttcccctgtaaacagagctctaccaccaggatttctcagaarctctttctccacactgaaccctaaaactgaaggttcaggtagagagcttttccagtgtgagagaatttttaaagcatctggggtttggcacatccagtgc

SEQ ID NO: 10157 - DNA, 201 bp, Homo sapiens
gcagtggatgctggtaggggagctcagttggaagtggggctcatgttctgatcttcagtgccgaatgtctgtgtccctccctcagatttacatgttgaaaygtaatcaccaatgtgatggtattaggaggggggccttttgggaggttagtaagtcatgagtgctttgggattagtgctcttataaaataggcccaaggga

SEQ ID NO: 10158 - DNA, 201 bp, Homo sapiens
tcagatacaaatttttgttgtttataagctacccagtttatggcattttgttgtagccacctgaacagattgagatatccagtttatagctggaactggargtataccaggtatcccagactttggtaatttatgtatcaggttcactattttcaccataactccctacaacagtattgattttctttacaccgattatct

SEQ ID NO: 10159 - DNA, 201 bp, Homo sapiens
acaacatctggagacactgctatagggtagtggttcttaaactttagtgggcatgagaaacactggcagagcttctaccagaaacactggtagatagctgygctcttccccagagaatctgattcagcaggtctgtggtgggaaatatgactttgcaggttttttttttttttttttttttttgagacagggtctcattct

SEQ ID NO: 10160 - DNA, 201 bp, Homo sapiens
cctcccaaagtgctgggattgcaggcatgagccactgtgcccggccttttctttattttttgagacagagtctcattctgtcacccaggctggagtgcagyagcgtggtctcggctcactgcaagctccgcctcccgggttcacgccattctcctgcctcagccttctgagtagctgggactacaggtgcccactaccacg

SEQ ID NO: 10161 - DNA, 201 bp, Homo sapiens
aagggttcacaactaaatgcttcttatgctgagcaaatgtatacactgctaaaaccatatactcactccttgtggtgtgtttgttaggaagctgccacttstgtcttctccattctttggaaaaggctgtgagtaaacacagagcactggctatttacatacctagctcctgcttgctttttcaaagctctttgttcaagt

SEQ ID NO: 10162 - DNA, 201 bp, Homo sapiens
cttcttctttgttcttctcttaattcagcccatgagcacatggtagattatgaatggatgctttaggaaccatgtagatggaggtttgtgaaaatttccayggaacatggcagttgagaattggtgactgatatggtctagctctgtgtccctacccaaatctcaccttgaattgtaataatccccatgtatcaagggtga

SEQ ID NO: 10163 - DNA, 201 bp, Homo sapiens
tgagaattggtgactgatatggtctagctctgtgtccctacccaaatctcaccttgaattgtaataatccccatgtatcaagggtgagactaggtggagayaattaaaaaatgggattggtttctgccattctgttctcgtgatagtgagtgagttctcacaagatccgatggtataagggggtataagaggctacccctt

SEQ ID NO: 10164 - DNA, 201 bp, Homo sapiens
ccagaatgctaatagtgatataaacaatgaagtcctcagatggggatgaggaacttggtgggaactggaataaaagtaattcttgctatactttagcaaasagactaaatttgcatttcacccctgccctagacatctatggaactttgaacttgagagagatgatttaaggtatctggtggaagaaatttctaagcagca

SEQ ID NO: 10165 - DNA, 201 bp, Homo sapiens
agatcttcatggcagtccctcccattacaggactagaggccaaggaggaaaaaatggtttcatggattgggcccagggccttgctgctttgtgcagtctcrgaacttggtgctctgcatcccagctgtggctaaaaggggccaatgtagagctcaggccattgcttcagagggtacaagccccaagccttggcagcttaca

SEQ ID NO: 10166 - DNA, 201 bp, Homo sapiens
gaacctctgctagggcagtgcagaagggaaatgtggggtctgagctcccacacagagtccccactggggcactgcctagtgaagctgtgagtagaggactrgcatcctccagacttcagaatggtagattctctaataggttacaccatacacttggaaaagctgcagggactcaatgccagccaatgaaagcagccgaaa

SEQ ID NO: 10167 - DNA, 201 bp, Homo sapiens
atggtttgcctctggggccccacccaaatctcaccttgaattataataattcccacatgtcaagggtgggaccaggtggagacaattgaatcatgagggtkgtttctgccatgctgttttcatgatagtgagtgagttctcatgatatctgatggttttataaggggcttccctgtttgcttggcactcattctgtcccct

SEQ ID NO: 10168 - DNA, 201 bp, Homo sapiens
ttcctgaggccttctcagccatgtggaactgtgagtcaattaaacctcttttctttgtacatttataaattacctagtctcaggtatttcctcatagtagygcaagcacagactaatacaatggccaagaagtgatcataggatggtaatataataaacacatggaggggaaagtgagtgtagttgcaggttttcaggaga

SEQ ID NO: 10169 - DNA, 201 bp, Homo sapiens
gtacatttataaattacctagtctcaggtatttcctcatagtagcgcaagcacagactaatacaatggccaagaagtgatcataggatggtaatataatawacacatggaggggaaagtgagtgtagttgcaggttttcaggagaaaatctgaaaggggtgaccaaaaatgagtacctgaatgatgcagctttttgaaaaa

SEQ ID NO: 10170 - DNA, 201 bp, Homo sapiens
acaaatgccaagtatgttgtagaattattttaggtgctaggaaaacagcagtggataaaacaaaaattccttagagtttatattctaatggcgagtcatargtaatctacaaaataaataaatatacagtattctagatgatggtaagtgttttaaaggaaaaatgaaacaacaaatagtgatagtacaagcgggggtggt

SEQ ID NO: 10171 - DNA, 201 bp, Homo sapiens
tattttaggtgctaggaaaacagcagtggataaaacaaaaattccttagagtttatattctaatggcgagtcataagtaatctacaaaataaataaatatmcagtattctagatgatggtaagtgttttaaaggaaaaatgaaacaacaaatagtgatagtacaagcgggggtggtggtgataatttcaagtttaggtagg

SEQ ID NO: 10172 - DNA, 201 bp, Homo sapiens
attaataatacagctgtcctttttctcccaatcataagttaaaagggaggaaatagaggcaagtgaaagagcagctctcatcctgatcagaccttttctcytggcatttgtctcttcctctgcccagccatttctgtggcattggcttctgatcagtatcagtcttgatttatccatctcagttcttccttcacctttcat

SEQ ID NO: 10173 - DNA, 201 bp, Homo sapiens
agtctctatttgtgtcacattcactaacatcacaaagcaaatcatgtgattaagcccagtgtcaaggggcggaacattctgtcctacccatagttggaagrtactgcagggttatgtggcaaagggaagggtgaaaacttggggcaaaatttgcgacttcctatactgggtcaaaagacacccttgtttcaaggcttatga

SEQ ID NO: 10174 - DNA, 201 bp, Homo sapiens
tgttaatatgctagtatacatctgtatatgggaattataggtgaattttttttttgcgatggagttttgctcttgttgcccaggttggagtgcaatggcaygatccctgctcactacaaccgccacctcccaggttcaagcgatcctcctgcctcagcctcccaaatagctgggattacaggcttgtagtaccacgcccag

SEQ ID NO: 10175 - DNA, 201 bp, Homo sapiens
gagtcatctaagtcagctatgtaaatgtatatatatatatacacacatatatgtaatatctgtatgcataaattaccatgacttcaaaatttgacaaatgkttcaggtaaatagtggattttatcttttaaatcacattaaggctcccaagtggatgcatcctgagttctggacacataatttatcataggcatcacatgg

SEQ ID NO: 10176 - DNA, 201 bp, Homo sapiens
tgcttgttctttatttctttttcacctgaatgctctttcaagaatattcaaaaacacaaaaacaaaaacttttcccctggagagtggggattagctcaagwatcaccatgatgatgagaagcagaaaacctggtttggagagtcctggacctggagaacaccaaaaagatgttagcatcttgagtatattgttctgatcta

SEQ ID NO: 10177 - DNA, 201 bp, Homo sapiens
gacacattctctcacggcaagtacatctgcacctggatgccttctactagtatgacatacttaaaagtatcttggatatgccttaaagatcattgttggckgcttcttgatggcaaagtgctcagttagagccagtttaaacacatgtcaccagaactgaataaatagattttgataaaactgattcagtgaatatctccc

SEQ ID NO: 10178 - DNA, 201 bp, Homo sapiens
agaggtgggagcatgaaagttcacctaatagcttagttttgttaagtctcattgccacagtctgcaccttatcctgatgttctcactggaaaataactagmctagttcctgagaaggaattgtgaacagggcattgcctgtttgtcaaaaagttatttaaagtcactccagctcctcacttaacctctctatgcctgtttc

SEQ ID NO: 10179 - DNA, 201 bp, Homo sapiens
tatctcagtccatttgtgctgctggaacaaaataccacagactgaataatttataaataatggaaacttatttctcacagtcctggagtctgggaagtccragatccaggtgctggcacgtttcatgtctgctgagggctgctctctgcttccgggacgacagcttgttgctacttcctcctaaggggaggcatactgtgt

SEQ ID NO: 10180 - DNA, 201 bp, Homo sapiens
gggacgacagcttgttgctacttcctcctaaggggaggcatactgtgtcctcacatagctgaccttttatagaggttgctaatgccactcacgagggttcygccctcatggtttaactacttccccaaagccccacctcttaatacttatcacattggtgattaagtttcaacacatggattttaggcgacaatcagacca

SEQ ID NO: 10181 - DNA, 201 bp, Homo sapiens
tgttgttctgtccattatctgtaaggctcaaatatagaaagaaagtgcatccatatcagtgagagacagttcagagtgattgtgggtgagctcatggtttyctgcagctgcaggactagagagagctacttcatgatgttggagatctggagtttaggaagcctaggaggtattcaagcagcagtcagtcagcttgccttg

SEQ ID NO: 10182 - DNA, 201 bp, Homo sapiens
cctcctgtcaggtgccctgtggttctcattagggcctctgggatactaacattcacacaggcaatgtactttcccttcctgacgcctctggggcccacccrggaccgtcaaacagaccctgcaaagcttaggagatcaattccaacagaagtccagagccatggtgctcttggaaaaatcacaaaccaaaatatagaagta

SEQ ID NO: 10183 - DNA, 201 bp, Homo sapiens
gtctggagggaagaggctgctggtgcctatggccctgaggaccagctttctccttcccccatgtccccaggccaccccacccagagcatgccctcggcacscaacaagcggcatgttccaggttgttccagggccagagagagtgacatgaggcaatgtctgtggcaagcgaaaaatgtgtgctgagccttgggaggcgcc

SEQ ID NO: 10184 - DNA, 201 bp, Homo sapiens
taactacctattgtcttctagtgtcagtaccacaggagtaactccacatctttgagttaataaataaatttacttacttattcaataaatattctggactmtttacggcagttctgacaatgttctaaatgtataggctatggtggtgagcagaacaaagtccttggtctcatgaagctaacattgtaaagggagatacag

SEQ ID NO: 10185 - DNA, 201 bp, Homo sapiens
cctattgtcttctagtgtcagtaccacaggagtaactccacatctttgagttaataaataaatttacttacttattcaataaatattctggactctttackgcagttctgacaatgttctaaatgtataggctatggtggtgagcagaacaaagtccttggtctcatgaagctaacattgtaaagggagatacagacaaaa

SEQ ID NO: 10186 - DNA, 201 bp, Homo sapiens
ctattcctgggaaagggggtggcagaggagagagagatattgagacaggctacatatcataatatcatgggttaaaccaacagcaattttagaccccaagrggacaattcgcatagctgcagacgtttttccttgtcacactggggatgggtggggagcgctactgacatctagtgggtagagacctgggatgaggttcta

SEQ ID NO: 10187 - DNA, 201 bp, Homo sapiens
gggttacttacacactggatctctagatacaggactaaagtcataatggaaatttaagattccatttggatgctgatttttttcccaagctctcttcactrtttattaaatggttagtgaagggaggtggaaagcttgatctccaggcaagtgagtcccttggacgtggggtggggagggtgaagctctggtgtggtactg

SEQ ID NO: 10188 - DNA, 201 bp, Homo sapiens
ttggactggatatctccaagggccctactaacaataagattatggactggggatggcttttcttctttccattttgttcaaggaagcctcctcttcgtcayttctcacctaccacccagctctgtattttcccatatttcaatgtcctttcatgaagacatataaacagtggccatgagtcaaggggatgcaagggtatct

SEQ ID NO: 10189 - DNA, 201 bp, Homo sapiens
ctctgggccaccttgaagggcaagttgacaaaataaagcaaagcccagacagccttacagagtagtagattctgcattcctcattttcatggataattacygtagccttcaatttgaggaacatggcagtgatttgtgtgcagtttactcttctttcaggtgatggaaccagagccagaggcgtggatgtgactctgttgc

SEQ ID NO: 10190 - DNA, 201 bp, Homo sapiens
cattctcctgcctcagcctcccaagtagctgggactacaggtacccgccaccacgcccggctaattttttgtatatttttagtagacacagggtttcaccrtgttagccaggatggtctctatctcctgacctcgtgatccacccacctcggcctcccaaagtgctgggattacaggtgtgagccactgtgcctggccttg

SEQ ID NO: 10191 - DNA, 201 bp, Homo sapiens
cagctgtggggttcccagccaactgccttgtcctctgagggataaattccctttgaccgtgccacttgtgaaaacacagagcaagtgtagagtattttacrtataatttagaaagagagaggacttatcggtgggtggtaggaaaggacagaagatggattaatattttttctttatcacttggcatgttaaacttaatta

SEQ ID NO: 10192 - DNA, 201 bp, Homo sapiens
gagccatggccttcataggctagatggtcattggaaatgaagttgttggcaccgacagtcacagttatgaaaataagaatttggatctcagatttttctgytccctcttctcctgtgtattagtccgttcttatgctgctaataaagacatacccgagactgagtaatttataaaggaaagaggtttaatggactcacagt

SEQ ID NO: 10193 - DNA, 201 bp, Homo sapiens
agagagaattagagccaagtgaaagaggaaacccattataaaatcatcagatcttgtgagacttattcactaccacaagaacagtatgagggaaactgccyccataattcaattatctcctaccgggtttctctcacaacacttgggaattatgggagctacaattcaagatgagatttgggtggggacacagccaaacca

SEQ ID NO: 10194 - DNA, 201 bp, Homo sapiens
ctcataatttctatgatcacagccccattgtctgttggagctgagggcattgtaagtttttgtaagcagcctttgataagttttagaggtgtagagaaagmgctctgtctcctccctgggagaatactcctttccctacacctcagaggaccaaatcatgtctttattaatatgaagcattcattccagtggcatatttta

SEQ ID NO: 10195 - DNA, 201 bp, Homo sapiens
gcacaatgttccaggatgcagaattgaatagcctagcctgggtcgctcccctctgagaagattacagtgtaatatgataattattaccatagtgctacccytggggcagaggacactcagagaaggggtatctgatttagacatggggatcactacagctgcctggaggagaggaagcttaaactgtgttgggaagtgtga

SEQ ID NO: 10196 - DNA, 201 bp, Homo sapiens
ttttgttccctcatttccatgccagtttctccctcctcctggtttctctcccattcctcccttctatagcttctcttttttgtacttcctttccctcctcttttttttttttccttctctctgaatcacttatggatataccagaaagcatacatatataatgcaattatttgcatgatgacttacaagttccaaagcaca

SEQ ID NO: 10197 - DNA, 201 bp, Homo sapiens
gaacatactgaccaggattttggctctgccacttgccagatttgtagctttagaaaaattacttacactcttcagggcttagatttttgaactagtctggkactcagttgagatttgctattctgtattgtttcttttctgtctgtaatgctttgttctcattcctgcatactgaaactcttcctgcaggtttttctctct

SEQ ID NO: 10198 - DNA, 201 bp, Homo sapiens
gaggtaggtagggaggtaattaggtttagatgaggacatggggatagagcccccttatgggataagaaaatgattataagaagagtgctcgatatggttargctttgtgtcccacccgaatctcatcttgaattgagattcccataatccccataatccccatgtgtcaagggagagaccaggtggaggtaattgaatcat

SEQ ID NO: 10199 - DNA, 201 bp, Homo sapiens
gcccccttatgggataagaaaatgattataagaagagtgctcgatatggttaagctttgtgtcccacccgaatctcatcttgaattgagattcccataatscccataatccccatgtgtcaagggagagaccaggtggaggtaattgaatcatgggggttgctccctcatactgctcttgtgatagtgagtgagttctaat

SEQ ID NO: 10200 - DNA, 201 bp, Homo sapiens
tgtctccctggccctttatgtaatatttggatagcgcaatccttagctgcatgcagataatgtgttaggcagctagaaaaataacctgcttgtactgtttmtgatttattccccctcctccctcacgtctttgttcacagtaaacacatcactgcagagtagctagcaaatgaatgcctttttatcagaggtacatgccca

SEQ ID NO: 10201 - DNA, 201 bp, Homo sapiens
gcctcttaaagtgtcttcttaaagtggcacaaagagagcacctctgtgagtgcagggtgattgggcacgcagtaggagaagcactcagggttagcaagtgrttttcctgacacaaaaccatttgttggcaagatctgtgggagaaacattctggattttgtatttcttgacctttccgtgctttcatttggtaaactttgc

SEQ ID NO: 10202 - DNA, 201 bp, Homo sapiens
tgggagccctggctctgcatctggctagctttgtaacccagtcccacgtctactgaccccttgacttcctgttcctttgtgtgtgtgtgtgtgtgtgtgtktgtttgtttgtttgtttgtttgttttgagaaggagtctcgctgtgtcacccaggctggagtgcagtggtgcgatcttggttcactgcaacctccgcctcc

SEQ ID NO: 10203 - DNA, 201 bp, Homo sapiens
cccaggttcaagcgattctcttgcctcagcctcctgagtagctgggactacaggcgtgtgccaccatgcccggctaatttttgtatttttagtagagacgsggtttcaccttattggtcaggctggtcttgaactcctgacctcaagatccacccgccttggcctcccaaagtgttgggattacaggcgtgagccaccgca

SEQ ID NO: 10204 - DNA, 201 bp, Homo sapiens
ttttttaaaattgtactggaatcttatgagaaacacgagggattattctttttgcttttaagatttatccatgatagagtataagataagccatgggactygcttctctcccaactcaccatacccaaaagatattaatcttggtaagatcccacaaccaacactatgcttttgcaagagcatccaaagttgtgattttgg

SEQ ID NO: 10205 - DNA, 201 bp, Homo sapiens
cttttccagaggcaggtgctgcccagtgccagctccagtgactctgggacgttgatggaaatgtgaatctggatgaggcacacatgcaggaggcttggagkaaggactcaactgggaattaggaatctaacatcctggaaatcaaagttgtcccctgttaatatatctgcttcatggttattttacaactaatgaacttat

SEQ ID NO: 10206 - DNA, 201 bp, Homo sapiens
aacccgggaggcagagcttgcagtgagccaagatcgcgccactgcactcagcctgggctacagagcgagactctgtcaaaaaaaaaaaaaaaaagagactrgtaatagcctgagatgaagaaatgacaaaaatgaaataaatactttcttctagttttatgcaccatattagtactataattgaatatgcaatcactaaag

SEQ ID NO: 10207 - DNA, 201 bp, Homo sapiens
gcccctcatcatttatattcattattctctatatattctgggctgaaggaaggacatgttaagtaaaattctttaataccttatacttccctgttcatcayccaagcaaaacttggtaccacctctagatcccactttcctgttttaggatcagaaagcatttggctcctaaaatatctgtaggaagtttcacataatatc

SEQ ID NO: 10208 - DNA, 201 bp, Homo sapiens
tcccaaattctgtaaaccttcatgacttctatattattttctaaacatgtatgtgtgaatatagtgagtatctaattttggtagcaattagtgttgatatstgtgctactgtatataaaaaacatttcagatgctctactttgggctctagattcattgtggatatttttcattattattaattttgtttgtatgaaaatt

SEQ ID NO: 10209 - DNA, 201 bp, Homo sapiens
gcattttgtttctgcagcttcgtagattttcctcattctttgaatatatgtttttctttttaattaagttagccattgccacgatgccataattttaattycttccagaaaaagtcttccttttcctcttttaatttactaccctttcccaactatttttttcttttatgttaacctctagctttggaattaattagccgg

SEQ ID NO: 10210 - DNA, 201 bp, Homo sapiens
atggcatccaggctttattaaccagaaaacactatactttctgaagtgcttatcaaaaagtgcttaccaaattttcttctgccacatgattgatttaatgycttctaatgtcaatgtgaaagcgtaagaaatgataggtgtctgcctacgttttctgtttgataaaagtgtaactccttacgaatactaaacaaatggtat

SEQ ID NO: 10211 - DNA, 201 bp, Homo sapiens
cggacacgctatggtaaacaaactacattgtctggtagatatcattcttattgtctctttttttgggtttgccgtgtgttgccccccttttcctctccaacccccccttttatcctctttagactcatttcttcttttaagattttgttacattaaatgcaagcctttctttttcttaaaaaaaaaatggaaggggatgca

SEQ ID NO: 10212 - DNA, 201 bp, Homo sapiens
tgacatgtctaaatcaatgactggatctgtcctcaaatctatgagatgatagattgcagcagaaacaaccttgaacttggaagtaggtgtcctacgttttyattcccgcttaagctggttgcatgacttggggtttgtcactttagtactgtattagtctgtttgcatgctgctgataaagacatacccaagactgggtaa

SEQ ID NO: 10213 - DNA, 201 bp, Homo sapiens
tcttatgagacttattcactatcatgagaacagcatgggaaagacctgaccccatgatttaattacctcccactggcttcctcccactggctccctcccaygacatgtgggaattgtgggagctacaattcaagatgaaatttgggtggggacacagccaaaccatgtcaagtaccctgtagttctatttcctcatctaac

SEQ ID NO: 10214 - DNA, 201 bp, Homo sapiens
tggaagctcttatcccacagatggctgtgtttataaattaaatgcagtcacacaggtgaaaggccattgaaatcacaaggaactagatgagtgcaaagttkgattttgtgattttgacctggcaaataggaaagctctagctaaaagtggctcaatctgttgttgtgtaccctgtctaaaatataacatatgtattatttt

SEQ ID NO: 10215 - DNA, 201 bp, Homo sapiens
aggtcaattgttgaggcaaaaagaatcagactaaatttggtagagctctttcagaacactgtggcatcaaagcagtgcactgcacattttaagctaagctycattgccgaagatatctataccatctccctggggatgttacttgagaagcaaacagtgttccttcttgtagataacaatcccttgtgacatcttatgagt

SEQ ID NO: 10216 - DNA, 201 bp, Homo sapiens
acaacttctctggatatccttgtcttgatctgtaaaatgaggatagtaatccctgctaatccaaatgcacactactgtagagaccttcttgtaaatgtagyatagaacacacattattgctttgggtagcaaggtaaacatcttgctgtacatctttattccattaaggaagatgtacggaaaagcactctgtgggtttgg

SEQ ID NO: 10217 - DNA, 201 bp, Homo sapiens
gccccagagggttagtttgctgactcttgctatagttaaatggcaggcaaaacttgataattataatgcaacatattaaactctatctatctatctatctrtctgtctgtctgtctgtctgtctgtctatctatctacctacctacctagatctatctgtctacctagatagatagatcagtcaaagttttcacaggttta

SEQ ID NO: 10218 - DNA, 201 bp, Homo sapiens
gaccccaatagagagttcttggaccaagaaaaaattcagggtgagtccataaagtgaaagcaaatttttaagagagtaaaggaatgggaataaaagaatgkctactccgtaggcagagcagccctgacggctgctggttggctattttatggttgtttcttgatgatatgctaaacaagaggtatatatttattaaatacc

SEQ ID NO: 10219 - DNA, 201 bp, Homo sapiens
gtattccatggtgtatatgtgccataatttcttaatccagtctatcactgatggacatctgcgttggttccaagtccttgctattgtgaatagtgccgcartaaacatacgtgtgcatgtgtctttatcgtagaatgatttatagtcctttgggtatattggccggcttctttaccacattctgttttatcagcaaggtct

SEQ ID NO: 10220 - DNA, 201 bp, Homo sapiens
gcaagtgatgaagaaccaagggacaagcaaaggcatcaatatattgtttgctatttgaggaccaactgtatttatttatctttgtatctccagggccaggyactatggctaccatgtattaagtacatgcagtcagtgctgaattgattacttctggtcattagattagcacagctgagctgaggtagcttggaccatgtg

SEQ ID NO: 10221 - DNA, 201 bp, Homo sapiens
cattgtgagtgtttatgtggctggggcaaaagaagttgtggtttcggtgctgatccattagcagtgagtgtggtaggtgaaagttccttaattgttccccrgagtaaaaacatcccagtatttatagactattaggggagagggggttggagaggcaggtgacttttcagccctacactgatgacttttatgtcttccagg

SEQ ID NO: 10222 - DNA, 201 bp, Homo sapiens
gaattaataaagaaatgagtggaatctaaaagtctctaaacataaagaaatacctgtaagatgtctcttctgagagcccattatatagaaaggagtcaaargaagaagagaagccaagtgcatggatccaggagagtaactggtccagtgcatttctgtttaccatacctttattcctctaaattttttcagcagttctgg

SEQ ID NO: 10223 - DNA, 201 bp, Homo sapiens
tatgctgaatctactctgcctgtactctgtaagttgaacaacaaagtctggatgagagcccatctgtttacagcatggtttactgaatatttcaagccaawttttgagacctactactcagaaaacaaagtattttatgtaaaaatattactgttcatcgacaatgcacttagttaccaaagagctttgataaaaatgttc

SEQ ID NO: 10224 - DNA, 201 bp, Homo sapiens
ccttattatttaagaaatacagtttgtaaggctatagcttccatagatagtgatttctctgatggatcacaaagccttttagaaaggattcaccattctaratgccattatgaacatttgtgattaatgaggaaaggtcaaaatatcaacattaacaggaatttggaagaagttgattccagctctcatggatgactttga

SEQ ID NO: 10225 - DNA, 201 bp, Homo sapiens
tattacataacttaattggtaaaggaatgataaggtttgagaagattgactccaattttgtaagaagttcagctgaaggtaaaatgctgtcaaacagcatyacatgctacaaagaaatcttttgtgaaaggaagagtcaatcaatgtggcaaacttcgttgttgttttattttaggaaattgcacagccaccccaacattc

SEQ ID NO: 10226 - DNA, 201 bp, Homo sapiens
cacactggggcctgtaggaagacagagggtgggaagagggagaggatcatcaaaaataactaatgagtgctaggcttaatacttggtgatgaaataatctstacaacaaatccccatgacacaagtttacctacgtaacaaacctgcacttgtacccctgaagttaaaagttaaataaagaaaagaagcaccttttctatt

SEQ ID NO: 10227 - DNA, 201 bp, Homo sapiens
cctaaaggaaaatgactacacctcccaaagcagatgactaattttcagaaattgttttttggaaaagtgggtctcctttttaatttcccattcgcaccccwtgtatgttctcttatcagtgaaggagatgagaagccactctggggaaaagacacgtagaagatcaagaaagctcttttcctcattgcgtgattgatactc

SEQ ID NO: 10228 - DNA, 201 bp, Homo sapiens
cagtgaaggagatgagaagccactctggggaaaagacacgtagaagatcaagaaagctcttttcctcattgcgtgattgatactcggttttgttttttttkttgttgttgctgttgttttatgggagtcttgctctgttgtcaggctggagtccagtggcacaacctcggcccactgcaacctctgcctcccgggttcaag

SEQ ID NO: 10229 - DNA, 201 bp, Homo sapiens
gccaccatgcccggctaatttttgtatttttagtagagatgcggtttcaccatgttggccaggatgatctcgatctcttgaccttgtgatccacctgcctyggcctcccaaagtgctgggattacaggcgtgagccaccacacctggccgattgatacttttttgttggttcattccagtgctgaaaattgggctggattt

SEQ ID NO: 10230 - DNA, 201 bp, Homo sapiens
atgattgtatcactatacttcagtttgggagacagagcaagaccttgtctcaaaaacaacaacaaaatatcctactccctctcattttttccccaagagtrttgaaagctgaatttgtgtaagttatacataaatatcatgcaacttcattgtactgcttattttcctaataagttaattgacttgtattatgctttacat

SEQ ID NO: 10231 - DNA, 201 bp, Homo sapiens
aagggataaataaaatttaaagggtttcaccctgggagtgattaagcatttggcctcgacatgacacataacacttctgctcaaactaattggccagaagyaatcatatggctccatcctgcacaaggggccgataaatacaatcctgtcttgtgccaggagacaaaggactagagcctactcagacagcaacaccaatga

SEQ ID NO: 10232 - DNA, 201 bp, Homo sapiens
ctatctctcacttctccaactcagttctttctatcagtgtcttgacatctaactagttaccctagagacctcaaagcaattattctttccttaaacattcyttcaaaacccagtcgttccttaggcatattgacttgaatcatgtctatctttgccattgctaccttcttagttctaatattcatcattattttctgggtt

SEQ ID NO: 10233 - DNA, 201 bp, Homo sapiens
gaagttagattgtacttgtcaatgagagacttaatccagattccatctctctaggacagaatagaccatttctatctacatggagtatcccttacatgatrtccatatttctctcttaacatcattgtacacatatgtttacatgtgtaacacttctactaaattgtaagctccttaaggtcagagaccatgtcctaacat

SEQ ID NO: 10234 - DNA, 201 bp, Homo sapiens
ttagagtgctgcagagacaaggttgtaaaaattctctcctatatcatcggtggttgaataaaattcctttattggtttttcttggaactgtaccctctagmcaaacagcccagtggaatccagtgatagaagccaaagaaataaaagctaagtgtctcaatttatcctgttgtcactttcagctttctctgctcattatta

SEQ ID NO: 10235 - DNA, 201 bp, Homo sapiens
aaatcttgcctctgccacataaaagctttgtgagcttggacaagtcatttacttctctcagcctcagttttctcatctgtaaaatgagataattatggcawcttatagaattgttgcgataatttcagatagtctaaatataaagcatttggcaggccaggcgcagtggctcacgcctgtaatcccagcactttgggaggc

SEQ ID NO: 10236 - DNA, 201 bp, Homo sapiens
tccgtgctatttcttttaccttcctatttcaaaacctggctaatgccactcatttatcaggtctcaccttagtactccatcctttcaaaggcatttctgaytgccccttccctctgcccacagcttgaattaagagctcatccctgatttcatggtagtttggaaatatctttttagaaacctttatcatgcaaattgctc

SEQ ID NO: 10237 - DNA, 201 bp, Homo sapiens
caagtcgcagaacaagaatttcaactcagagtatatgcttcaactcagaatatacttcaactcagcatatttgctgttaactatattttatgctgcttctygtgcctcagattgtgaggatcaaatagggtggccatctattccaggtcaccttggaaagttctgggtaatatctcctgtccaggtgaattattaatagtg

SEQ ID NO: 10238 - DNA, 201 bp, Homo sapiens
agtctgggacccttagggttaggggattaacccaagttctgcaaaggcatgtcatgggagccactgttcccagttcccacacccgtagcagacattgctcrttgatcacagtacaacagtcttccttacttagtgtcatagacaaccattcgtgatagatcacgtttgagatgtgaaattaaaattatttatcacacctag

SEQ ID NO: 10239 - DNA, 201 bp, Homo sapiens
tcttagaggatcttactggagtttgtgattgagcttttacttcttctgttagtgttctgctgagacatatacactaatgatagctgccactctggggtgcrgaactttccatatagattgccttaaaaataaaagcaaattttctatgcatacatgccggggaaaactctactaaatattcagtggttccaagaaatgcct

SEQ ID NO: 10240 - DNA, 201 bp, Homo sapiens
ataaaagcaaattttctatgcatacatgccggggaaaactctactaaatattcagtggttccaagaaatgccttttaaccatttgtaatactttagctttytaccttttcatctcattacttattttcaggcagaatagatatagaggcttctttctgcattatagtcttcacagacttaaaggcatcaggaagtagccct

SEQ ID NO: 10241 - DNA, 201 bp, Homo sapiens
acatggctctaagaaatgggagagctgctatccagttgtgtctgaaaagattaactggcagctagaaacttttaaaactacccattgactagttctatctyggagaactacaccccctacttgccagttcatgtcttatgtctctgcctgggtctgtctatgtcaagttcttatttgttaacttagtagaagcttagtgga

SEQ ID NO: 10242 - DNA, 201 bp, Homo sapiens
tgcttaacttcttactgttcacatctgtaactgggcataaacctataggatcattttcctttcacaaagaatccatcaaataaatacttgttaaagcctaygcttaacttgagcaccggtagtaatgactcgcattatcagcggggcttttgggcttgcactcatggctctgtgattcatgagggcagaaaaactgactgg

SEQ ID NO: 10243 - DNA, 201 bp, Homo sapiens
tgtttggtgtgtgtgcatctcataaatgtcacattaggcaattaagtatatacaatttataaataagtatatgtaatttataaatacatatatgaagttcataaataaataatatataacttataaataaatatataaagttatgattttatagtttattaaatccagagtttttcttttgttgtagccctgcctcttagg

SEQ ID NO: 10244 - DNA, 201 bp, Homo sapiens
gtttggtgtgtgtgcatctcataaatgtcacattaggcaattaagtatatacaatttataaataagtatatgtaatttataaatacatatatgaagttcataaataaataatatataacttataaataaatatataaagttatgattttatagtttattaaatccagagtttttcttttgttgtagccctgcctcttaggc

SEQ ID NO: 10245 - DNA, 201 bp, Homo sapiens
tttggtgtgtgtgcatctcataaatgtcacattaggcaattaagtatatacaatttataaataagtatatgtaatttataaatacatatatgaagttcataaataaataatatataacttataaataaatatataaagttatgattttatagtttattaaatccagagtttttcttttgttgtagccctgcctcttaggct

SEQ ID NO: 10246 - DNA, 201 bp, Homo sapiens
ttggtgtgtgtgcatctcataaatgtcacattaggcaattaagtatatacaatttataaataagtatatgtaatttataaatacatatatgaagttcataaataaataatatataacttataaataaatatataaagttatgattttatagtttattaaatccagagtttttcttttgttgtagccctgcctcttaggctt

SEQ ID NO: 10247 - DNA, 201 bp, Homo sapiens
aataaatatataaagttatgattttatagtttattaaatccagagtttttcttttgttgtagccctgcctcttaggcttggcaattggcttagaagttatyctcaagagagaatctttctttttcttttcttttctttttttttttttttttttgagatggagtctcactctgtcacccaggctggagtgcagtggtgcga

SEQ ID NO: 10248 - DNA, 201 bp, Homo sapiens
tagaagttatcctcaagagagaatctttctttttcttttcttttctttttttttttttttttttgagatggagtctcactctgtcacccaggctggagtgyagtggtgcgatatcagctcactgcaacctccatctccggagttcaagtgattctcccactgcaggatcccgagtagctgggattacaggcataccgcacc

SEQ ID NO: 10249 - DNA, 201 bp, Homo sapiens
ctttctttttcttttcttttctttttttttttttttttttgagatggagtctcactctgtcacccaggctggagtgcagtggtgcgatatcagctcactgmaacctccatctccggagttcaagtgattctcccactgcaggatcccgagtagctgggattacaggcataccgcaccatacctgctaatttctgtattttt

SEQ ID NO: 10250 - DNA, 201 bp, Homo sapiens
tgtggaacagatatcgaggctcttacctttggaataaataaaatgggactcagaagggttattcagctgtcagtgagagtggtgttggctttttattcacracagtgaaaactccatataaatagacaggtaatttcagggccatggagtagatagagcactcaccctcaaagagcctttgagagaagtctggttatctct

SEQ ID NO: 10251 - DNA, 201 bp, Homo sapiens
tctcagttaggtacccttctcacagaagagttcctcttcactgctcttgtatcttgttaaaaggcttttttttccctcctttttattctgtccccagcctsctgtaggaatgcctgatctctctttctatttattgttccatggagccaaacctccttctgtccctttgggatgacctattgttatacattaataattaac

SEQ ID NO: 10252 - DNA, 201 bp, Homo sapiens
taggtacccttctcacagaagagttcctcttcactgctcttgtatcttgttaaaaggcttttttttccctcctttttattctgtccccagcctcctgtagsaatgcctgatctctctttctatttattgttccatggagccaaacctccttctgtccctttgggatgacctattgttatacattaataattaacctttact

SEQ ID NO: 10253 - DNA, 201 bp, Homo sapiens
cataacagatttttttcccataggttattggggttcaggtggtgtttggttacatgaataagttcttaagtggttatttgtgagattttggtgcactcatsacccaagcagtatacactgcaccctatttgtagtcttttattcctcaccctcatcacacccttcccctcaagtccccaaagtccatgtatcattcttatg

SEQ ID NO: 10254 - DNA, 201 bp, Homo sapiens
tcacattttcttgatccacttgttgattgatgaacgtttgggttggttccacaattttgcaattggaaattgtgctgctatacacatgcctgtgcaagtayctttttcttataatgacttcttttcctctgggtagatacccagtagtgggattgctggatcaaatggtagttctacttttagttctttaagggatctcca

SEQ ID NO: 10255 - DNA, 201 bp, Homo sapiens
cctgcctaatattccattataacgctgtgccatctgctattgatggtcatttaggttgtttctggtgttttactaagggtgcttcagtaaatcactttgtwtgaagtatgtgaatccatgcaactcgatctctcttgatttttatttgcaagcttatgttgtataactttctgacaacacaagaaattggccaggagacaa

SEQ ID NO: 10256 - DNA, 201 bp, Homo sapiens
ggccagtaagagagagcaataagttccccaaaaggctgaaactgggagtgactgagctttggtgggttggcttttctgcataattccaaagctaggctgayggcagagatagcaatattgcccttaggaagagctggatgggttctttgcagagggcagatgggtggcagattgcagccctggctattttattgcccagta

SEQ ID NO: 10257 - DNA, 201 bp, Homo sapiens
ccagtaagagagagcaataagttccccaaaaggctgaaactgggagtgactgagctttggtgggttggcttttctgcataattccaaagctaggctgacgrcagagatagcaatattgcccttaggaagagctggatgggttctttgcagagggcagatgggtggcagattgcagccctggctattttattgcccagtagg

SEQ ID NO: 10258 - DNA, 201 bp, Homo sapiens
agttccccaaaaggctgaaactgggagtgactgagctttggtgggttggcttttctgcataattccaaagctaggctgacggcagagatagcaatattgcycttaggaagagctggatgggttctttgcagagggcagatgggtggcagattgcagccctggctattttattgcccagtaggaatctttactggttgtctg

SEQ ID NO: 10259 - DNA, 201 bp, Homo sapiens
ctttggtgggttggcttttctgcataattccaaagctaggctgacggcagagatagcaatattgcccttaggaagagctggatgggttctttgcagagggyagatgggtggcagattgcagccctggctattttattgcccagtaggaatctttactggttgtctgaaatctgatcagaaccaagagccttcaaattaaat

SEQ ID NO: 10260 - DNA, 201 bp, Homo sapiens
caagagcagagtcagaaagctgttccagaattataaagaaaacactgctgttggtttttaagagcatgtgtttgggatctctgaggttaggtcacggtggrcgggttttgtgtctgactaacctagaccttggcacagcataaaagttaccttacccgtgtctcaggcaggctaaaacacacaaaattgccatttgttcat

SEQ ID NO: 10261 - DNA, 201 bp, Homo sapiens
atatgtttgaatttcagaagtcttaaatttcatacctgggagctaaagcactggctaattcttttctcttttttttttttttttttttttttgagacagartttctctcttgctgcccaggctggagtgcaatggcgcagtctcggctcactgcaaactctaccttccaggttcaagtgattctcctgccttacctcccaa

SEQ ID NO: 10262 - DNA, 201 bp, Homo sapiens
catcaggaccaagtttttgctaagggtatagctctagggctttgagaatgctgtacctgtatagttcttgccctcaagaagtttatcatttatttagctgmggagttgagacatctatataataagctgtaataagatgatgtaagacagtagcatgttagtggacagaaaagaaggacatggagattcagagacagaaga

SEQ ID NO: 10263 - DNA, 201 bp, Homo sapiens
atcagaagataggtgatgtggatggatcctgggccaggtctagaacaagggctgaatgaccagttttcaaggcctgtttttttgtaaggccaactgtgggrccaactgtgttactagctaaggtatatttcaagagaactacaaaccctttttacagtcagatcagaaatagaatacaggacatgaggacaaaggaagaaa

SEQ ID NO: 10264 - DNA, 201 bp, Homo sapiens
ctgattgttttgttcccctactaattgttttttgcccctggattgttcctgacaccatgttcagaatgaatcagtggagtgtaaaaattataggactcttctctgctagcaaagaaaagttgagattcccaatgacattgtttttctttatggaaactgattccttagtggagactcttttgagtatcttttgttcatttt

SEQ ID NO: 10265 - DNA, 201 bp, Homo sapiens
tgattgttttgttcccctactaattgttttttgcccctggattgttcctgacaccatgttcagaatgaatcagtggagtgtaaaaattataggactcttctctgctagcaaagaaaagttgagattcccaatgacattgtttttctttatggaaactgattccttagtggagactcttttgagtatcttttgttcattttt

SEQ ID NO: 10266 - DNA, 201 bp, Homo sapiens
gattgttttgttcccctactaattgttttttgcccctggattgttcctgacaccatgttcagaatgaatcagtggagtgtaaaaattataggactcttctctgctagcaaagaaaagttgagattcccaatgacattgtttttctttatggaaactgattccttagtggagactcttttgagtatcttttgttcatttttc

SEQ ID NO: 10267 - DNA, 201 bp, Homo sapiens
tctgacatatgcaccagctgaacacgaagaatacaagtatttttacttctctccagtgactcttgttccagtgggaaaggcatgcaggcagcagctgctgytcctctccattcggggcctccctttttaggcaacctcctatgtgatcctgggtagcagcagcagcagcagcaaaagcaaatgattctgcctggaaagggt

SEQ ID NO: 10268 - DNA, 201 bp, Homo sapiens
accagctgaacacgaagaatacaagtatttttacttctctccagtgactcttgttccagtgggaaaggcatgcaggcagcagctgctgctcctctccattyggggcctccctttttaggcaacctcctatgtgatcctgggtagcagcagcagcagcagcaaaagcaaatgattctgcctggaaagggtgagataccaatc

SEQ ID NO: 10269 - DNA, 201 bp, Homo sapiens
gggttggcagaggccaggcgtggtggctcatgcctgtaatcccagcactttgggaggctgaggtgggtgggtcacctgaggtcaggagttcaagaccagcytgtccaacatggcaaaaccccgtctctactaaaaatacaaaaattagctgggcttggtggtgcatgcctgcaatcccagctactcaggaggctgaggcat

SEQ ID NO: 10270 - DNA, 201 bp, Homo sapiens
tgacagagtgactccgtctcaagaaaaagaaaagaaaatagtgaaaatagtagggttggcagataccgttagtgttacctgcacctcattcctgttttggyaaatgaggaattggaagccctgagaagttaagtcaacatcagtttagcttggaattgctatagaatggttagaatttatgattcctgattcctaatgcat

SEQ ID NO: 10271 - DNA, 201 bp, Homo sapiens
cagcctttccttcatatatactgttatatacatatactagatggttattaaatgtgggagggctccagggtttctgttttaggtctcttcttggcctgcayggttcccttggtgctcttattctttgccacgatattaaaggtcatctatatgttagtgacttccaaattgaggtctcttgcctagaactctccctgaaat

SEQ ID NO: 10272 - DNA, 201 bp, Homo sapiens
atatactagatggttattaaatgtgggagggctccagggtttctgttttaggtctcttcttggcctgcacggttcccttggtgctcttattctttgccacratattaaaggtcatctatatgttagtgacttccaaattgaggtctcttgcctagaactctccctgaaatctcagattcttatgtccctagttgtctactt

SEQ ID NO: 10273 - DNA, 201 bp, Homo sapiens
cttaatcatatcattgaaaagcagaaatcttgaggtcttccttcctgccccagacttcttttactttcagtttttccccttcttggtaaatggcatccctrctgtccttgggcattttcttttatttttgtcctatgatattcaatctatctcagcaagtctcatccatttctcttataaacccatcctgcatctgtccac

SEQ ID NO: 10274 - DNA, 201 bp, Homo sapiens
tcactggtgtgggaataagagaaacctgggcttccaaggtcaaatataataatggtggttgctttcactggtctcagtgctattgaggaggggaatctgcrttatggctgtgccctcatccctcgtaggtttccagatcctttatttaaatgtctgacctggagatggatcctctgacctttcttttctgcaagaataaaa

SEQ ID NO: 10275 - DNA, 201 bp, Homo sapiens
tttcaactctaaaactctgattctcaaatgtcatcagcttggcaatgctttctcttatcccaaggagagagagaaaggtgaatgaagggcagcaatgtgartccttgttccttacaatccgcagaactgtctggattaggactcggtttagttatatcagcactgcaatcaaattttcatctccctgattcattcatccaa

SEQ ID NO: 10276 - DNA, 201 bp, Homo sapiens
gaatcgaaccttagatttctaaagagcattaaaaggctgtttcctctttggtccattgtttactctttttgatagataatgacatgtatctgagaaagggrcttcccaagaaatgtgcaattcatttacataaatcaaactgtctccttttttttttgtttgtttttttgcttttctgttgttgcttaagtcatacaaatg

SEQ ID NO: 10277 - DNA, 201 bp, Homo sapiens
tggttcttaatatatactgagtcatttaaccctcacatccactctgcagactgcatattattatcctcactttctacgtgaagaaattaagggccacccarttcattctgaatacctactgagtgctacgtgccagggactgtgttgagcacttgggacacaaaggcattgactgtggttctcataaatgtgctattatat

SEQ ID NO: 10278 - DNA, 201 bp, Homo sapiens
gtagctgagagtcaaacctacacctgctttggtcccactcggaacatatgtatttaccttctcaccttctctctgtgcctccgtttcaatatttgccatgrcaatattggcagtgggtgtttaactggcttattgtgaggctccattgtagaatcaaagtgtataatgtgctcacatagataacaaagttaatattcccct

SEQ ID NO: 10279 - DNA, 201 bp, Homo sapiens
accttctcaccttctctctgtgcctccgtttcaatatttgccatgacaatattggcagtgggtgtttaactggcttattgtgaggctccattgtagaatcaaagtgtataatgtgctcacatagataacaaagttaatattcccctttcagaatctggagtttagcaatgcaagaattgaaaaaatgatctggctggtgtt

SEQ ID NO: 10280 - DNA, 201 bp, Homo sapiens
ccttctcaccttctctctgtgcctccgtttcaatatttgccatgacaatattggcagtgggtgtttaactggcttattgtgaggctccattgtagaatcaaagtgtataatgtgctcacatagataacaaagttaatattcccctttcagaatctggagtttagcaatgcaagaattgaaaaaatgatctggctggtgttt

SEQ ID NO: 10281 - DNA, 201 bp, Homo sapiens
acatagataacaaagttaatattcccctttcagaatctggagtttagcaatgcaagaattgaaaaaatgatctggctggtgtttttactccatttttttttcttgtgtggtggaaatgacccaggtcttatttctgtgtttaaggcatatgatacaggttagagtttaaaattgagaaggttggaccataagagaacatac

SEQ ID NO: 10282 - DNA, 201 bp, Homo sapiens
ctgttttatcatgggttctgttttaatcccaccaaggactgttaagaggaaaaagcagcaaacatgtagtaatcaagaatagaagtcccaaacttaaaacytaaaacttgactgacccaacaaaaaccaggcagagtataaagagttgtgtaattacttatcttgccagtagaatagatgctcagatactatctagcaaaa

SEQ ID NO: 10283 - DNA, 201 bp, Homo sapiens
tcttgccagtagaatagatgctcagatactatctagcaaaaccacccacccccaattttagatgaagaaactgaggcctccaggtgggaaatgagtggtcaatagaatagaatagaatagaatgttcttagtccctcgttttggttcctatttattggctttttcaaagaaatatacatgcatctgtgcatctgtgcatat

SEQ ID NO: 10284 - DNA, 201 bp, Homo sapiens
cttgccagtagaatagatgctcagatactatctagcaaaaccacccacccccaattttagatgaagaaactgaggcctccaggtgggaaatgagtggtcaatagaatagaatagaatagaatgttcttagtccctcgttttggttcctatttattggctttttcaaagaaatatacatgcatctgtgcatctgtgcatatt

SEQ ID NO: 10285 - DNA, 201 bp, Homo sapiens
ttgccagtagaatagatgctcagatactatctagcaaaaccacccacccccaattttagatgaagaaactgaggcctccaggtgggaaatgagtggtcaatagaatagaatagaatagaatgttcttagtccctcgttttggttcctatttattggctttttcaaagaaatatacatgcatctgtgcatctgtgcatattt

SEQ ID NO: 10286 - DNA, 201 bp, Homo sapiens
tgccagtagaatagatgctcagatactatctagcaaaaccacccacccccaattttagatgaagaaactgaggcctccaggtgggaaatgagtggtcaatagaatagaatagaatagaatgttcttagtccctcgttttggttcctatttattggctttttcaaagaaatatacatgcatctgtgcatctgtgcatatttg

SEQ ID NO: 10287 - DNA, 201 bp, Homo sapiens
gccagtagaatagatgctcagatactatctagcaaaaccacccacccccaattttagatgaagaaactgaggcctccaggtgggaaatgagtggtcaatagaatagaatagaatagaatgttcttagtccctcgttttggttcctatttattggctttttcaaagaaatatacatgcatctgtgcatctgtgcatatttgt

SEQ ID NO: 10288 - DNA, 201 bp, Homo sapiens
aaaaccacccacccccaattttagatgaagaaactgaggcctccaggtgggaaatgagtggtcaatagaatagaatagaatagaatgttcttagtccctcrttttggttcctatttattggctttttcaaagaaatatacatgcatctgtgcatctgtgcatatttgtgaagatatacttttatgtctcatgatcttctag

SEQ ID NO: 10289 - DNA, 201 bp, Homo sapiens
cgttttggttcctatttattggctttttcaaagaaatatacatgcatctgtgcatctgtgcatatttgtgaagatatacttttatgtctcatgatcttctmggcagtagtcatgccgttatagcaaagccatttggtaaatctccagtaatttgttctaactgataaattttatttgaaatgttggcaactgatttagagg

SEQ ID NO: 10290 - DNA, 201 bp, Homo sapiens
aaattcctaaattgctgtgtagagtctataggaatatgtactcttatctacatatgatgtactaaatgcttagcagtggttagcttatttaatctttgcartaactacataagatatgtgctattttcattcttaatttatatctgaggaattggggttaaggataggttaagtaacttgctcaaggtcacccaagaatac

SEQ ID NO: 10291 - DNA, 201 bp, Homo sapiens
cctttttttattatactttaagttctgggatacatgtgcagaacgtgcagtttttttacataggtatacatgtgccatggtggtttgctgcacccatcaayccatcacttacattaggtatttctcctaatgctgtcccttccctagacccccaccccctaacaggcccagtgtgtgatgttcccctccctgtgtccatgt

SEQ ID NO: 10292 - DNA, 201 bp, Homo sapiens
tccctagacccccaccccctaacaggcccagtgtgtgatgttcccctccctgtgtccatgtgttctcatttttcaactcccacttatgagtgagaacatgyggtatttggttttctgttcttgtaaacactcttttttattgtgataaaatacacataacataacatttaccattttagcttttttttttttttttttttg

SEQ ID NO: 10293 - DNA, 201 bp, Homo sapiens
gatggcttccagtacttcacaggggtctttgtgaagcaggccatgcccttccaaggagaaagcatgtattgttaatgcagtaactcacatgaatatcagakatagtgacacatatggactatgggtttgtgtagttggcaggattcactggtacatttatggtggtggtggggtgagtgcttttgttagtttcttatcctg

SEQ ID NO: 10294 - DNA, 201 bp, Homo sapiens
aaaccccatctctcctgaaaattagccaggcatggtggtgcttgcctgtaatcccagctacttgggaggctgagataggagaatcacctaaacccaggagrcagaggttgtggtgagccaagatcgcgccattgtactgcagcctgggcaacaagagcgaaaactccgtctcaaaaaaaaatgctgtgggcccacttcagg

SEQ ID NO: 10295 - DNA, 201 bp, Homo sapiens
actggatttgtgggggcggtggggaggtgcacagtggctcatgcctgtaatcccagtgctttgggagatagaggtgggcggatcacgaggtcataagttcragaccagcctggccaacatagtgaaaaccccgtctctactaaaaataccaaaaaaattagccaggcatggtggcaggtgcctgtaatcccacttctcagg

SEQ ID NO: 10296 - DNA, 201 bp, Homo sapiens
aatatggctgaggaatgcagaagagtgcactggtatatcaatctctaattggggaaatgatttggctgcagcacaaaggagcccctctctgtctaacattrggtttgccccttgagctttctgcaggcggagattgatggtggtggcgtgatggtcaaggaatgtgtcctcagatgaggctgagcagaattatttctttgt

SEQ ID NO: 10297 - DNA, 201 bp, Homo sapiens
aaaacctgtggtggttctacaaaacccatttcatgataaacaaaaataaatataattgagcataactgtaccaagcagaaatggttattattaacatatckgtatgctttattctattattttgggaatgtgtatatatatatgtgtgtgtgtgtgtgtgtgtctctgtgtgtgtgtgtgtgtattctattcttgaatata

SEQ ID NO: 10298 - DNA, 201 bp, Homo sapiens
ttataagaagcagtatttaatttctatacttacagatttgtggataggttgaggtggctctgttccaagctgtggagggctggaaatagctgcaagtttcragttagattcattaactccctcattactacattccttttggctccctcattaccacattctttttggaccagaggctacccaggggatattctcctatta

SEQ ID NO: 10299 - DNA, 201 bp, Homo sapiens
caaagtcacaagcaaaggctgtgggtatataattcagaaacaggggaggtgcaactaattatgaacaataaaacagtctactatagtagactacctgataytttgttatcactaatgtccataggttgatccaagaagactagttttttatcctttctgttaacctctaatgtgccccaatattgataaatgccatgagac

SEQ ID NO: 10300 - DNA, 201 bp, Homo sapiens
caactaattatgaacaataaaacagtctactatagtagactacctgatattttgttatcactaatgtccataggttgatccaagaagactagttttttatyctttctgttaacctctaatgtgccccaatattgataaatgccatgagacctttttccaaacacataggcttcagaagacatcagagtcttctccactgcc

SEQ ID NO: 10301 - DNA, 201 bp, Homo sapiens
tttagtttgtatttattttttgaaataataatctggttactgaattagacaccaagctcatggaaagcttggaccatgcctgctgcactattttctgcctyatgcctgggatatagaacgtgctcaacacattgttgttgacggtgataggttcagggcacaggtatcctgtatcctcagtctttgcatccaaaacttgac

SEQ ID NO: 10302 - DNA, 201 bp, Homo sapiens
gctgtgtgtagtgtagggaggtcatggatgtgaccatcgattgaaaatatattttatcatttcagaaaagacttcctggtagattacatgaactgttaagytaatttgctttttgggaaaatttagcacttggtatatcctctcattcttccctttccccttcctccttcccttcctctcttaatgcctcacacatttgtg

SEQ ID NO: 10303 - DNA, 201 bp, Homo sapiens
ttcccttcctctcttaatgcctcacacatttgtgatattggctgtgttagttgctgagaatgtaaagaggaatgtttcttttatctgcttgtctacctacmgttcttcctacttaatcccctatttgttccacaaaggattaagacacatacaaacaaataggaatggtccagccttctaattcctctgctcgggctgtgc

SEQ ID NO: 10304 - DNA, 201 bp, Homo sapiens
aaaggtaccagtaggggtccaaacacagttcccaagtgcactataggaaatccggatagagttggccctaaggcaccttaccctgcaccccaagatgaacwctaaaaatctgttcagctcattaaggggcctcccagcagggtggctccagtctgtgatctttgcagagcaaagtgatgggtgccctcattactgatgtag

SEQ ID NO: 10305 - DNA, 201 bp, Homo sapiens
tgacccgtgagctgcagctgcacacagacagctctgctgcccaacacactctcatcccagtcctcaggtggaggagggatagagtttactgggaaatggcmaaaaagggggggaggggtagaaatgggaacattttcaaattaatttcagaaatccagtcttagctctaaacgacagctgtgagtttaatcactgaaactc

SEQ ID NO: 10306 - DNA, 201 bp, Homo sapiens
gaatgtcagctgatatgaaagctttaccctcccctcccatttacctctcagaccccaccctcaggacagtggtatctgtccgtggctcccatctgtgtgtygctgcccatcacttcagaggaaccagaagcacctgccagagagctttatgtcatcagccatgggaacttcttccatgctgtttgttgcactggcctattt

SEQ ID NO: 10307 - DNA, 201 bp, Homo sapiens
gaagaatgatttttgagtaaagcccaggcccagtggaatctgccttgaccatgtggtgctcgtgtgggcccacagaaaaaaacccagaacattgcagtagyaaagtgaaagctctgtggactgtgaatgcagattagaattaaaagatgtgcttaccacactgtctctgtctctgtcccagagcctgcctgtgaacgccaa

SEQ ID NO: 10308 - DNA, 201 bp, Homo sapiens
ctcctgagtagctgggattacaggtgcctgccaccatgcctgggtatttttgtattttttagtagagatggggtttcgctatgttggccaggctgctctcraacccctgacctcaggtgatccaaagtgttgggattgcaggtgtgagccaccacatccagccatctccttgtatcttatgttcccatcccaaaaccaatc

SEQ ID NO: 10309 - DNA, 201 bp, Homo sapiens
ggatagagatgtagttatcaattagcagtgactgttgtaggtttcatggaaagaggagaagtgtgatatctttcaaggacacaattttcctccagaaaatycaggaatcctcattttatatccatgctgaaggctcctagagtagcattcctcctcttccctccctctccctctttttttgctgtaacaacacgtggggag

SEQ ID NO: 10310 - DNA, 201 bp, Homo sapiens
tctgggatgggagaaaatctggccagagtgtgtcttgtaggttgatcacaaattcctaatgttcatcaagagtggaattttgacggtataatgaaagcctrttttaactatgtaatactattcttattccattatgtaggtaatgaaagtttgtatgtaaataaaagtttaagcttctctttataataatttatcacagga

SEQ ID NO: 10311 - DNA, 201 bp, Homo sapiens
aatgttcatcaagagtggaattttgacggtataatgaaagcctattttaactatgtaatactattcttattccattatgtaggtaatgaaagtttgtatgyaaataaaagtttaagcttctctttataataatttatcacaggaactgcctgcaaatagattctaacgataagaatgttcttcttttagctataaatcctt

SEQ ID NO: 10312 - DNA, 201 bp, Homo sapiens
ttaatcataatcacttttttatttgaattgagctttacttagtttattgcctctattattgtctgagaggagcactcttatattgtctgctttatgcaggsaagtgtggttttaagatgagcttgggtcaaacatcaaagcaaaaaagatttgactataaatcctagcttcctcattaaccagcttggtcacctatcacaa

SEQ ID NO: 10313 - DNA, 201 bp, Homo sapiens
aaatatgtaagatactactttatctactttgttcatagtagttattgctgacatgggacaagatgatctttatgctctatttggtgtttgaattatagaaygcttcatgaattggattaattaatgtaaagtttttgaatgttggtgtttgtttaatcagtattctataatactgccaatctcttactccttgctatccac

SEQ ID NO: 10314 - DNA, 201 bp, Homo sapiens
atagtttcttaagaccaaggcacaaaatatttgtgtagaggagacatggggcaaaggagagaagaaaagcaagaacgaggttgtaaagaaccttgtatgcygagtaggaaatgttcatctttattccgaaggcaatggagggatccttcattgaaagccttctgagcaagggtgtaacatggtcagatttaagtcttatta

SEQ ID NO: 10315 - DNA, 201 bp, Homo sapiens
gcccaaagtgactcagctggcagatggcaagtaccaggctgatatcctgcaggttttttgtttgtttgtttgaaatggaggagtctcactctgccacctargctggagtgcagtgacgcgatctcagttcactgcagcctccgcctcccgggttcaaggaattctcctgcctgtctcctgagtagctgggattacagcata

SEQ ID NO: 10316 - DNA, 201 bp, Homo sapiens
ggtatgaacctcaccattttagagaggaagaaatctcagtgtcaggatgttaagttagttgccaagacctcaaaactcataaatagcagagccaggaccagggttgaaagtctggtgtttcacattctgccacacctctctggccagtgttgttcgtgaacttcgggactaagactccagctcaaatcctatgcggatgta

SEQ ID NO: 10317 - DNA, 201 bp, Homo sapiens
tcattttcattttacatgaaagagaacacttgggtactggtgaaatgcttaggtcagcaatccttttgggaagatacacatgaggggtattatgtatctcrtctttccctctttcaacattttctaattcaattctatataataaatatttactgagtatctactctctgctgggtattgtgctaggttcaggggatatat

SEQ ID NO: 10318 - DNA, 201 bp, Homo sapiens
atcagactctgcagtagaaccaaatccaggacatccgtgtacagcctactcacatcacagcatctaactgtgttcacataaaaggcagtgtgaggcataaygacccaactcagaaatgccttttttttctggatgttcttttcctcacaaaacatcaaataagagagtctggccacattctgatgatttctcttagaaact

SEQ ID NO: 10319 - DNA, 201 bp, Homo sapiens
agtatgctgacaagatattattaaggctacaataaggcaattgaggaagctgtatgtcaataaggtcttgagatactcagagagattagacaaagcagagkaatattttcacctgcttaccctcctcttcccccaaaccataccaatgaacaacatgggccccagccctaaattcacaatctctgatgtaagagcctgact

SEQ ID NO: 10320 - DNA, 201 bp, Homo sapiens
gaagaagcagtgtggatagaggcccagggataggaagagccttgccctcagggctagttcagattggctgcaatgtggggcctgaccagagagagatggtkcttggctgcaagggtgggccagggtcatttcacgcagggggttgtaagcctggtcattaggagctttattctaaggacatcaggaagctgatgaattttt

SEQ ID NO: 10321 - DNA, 201 bp, Homo sapiens
agcattccaccgactctgcccttagatacagtgaccccagatgtcaattcagaaaccacacacccacgttacacagtctgtaagtgaccagccactcaggygaaacaggagacttgagtgatggcagcaaaatgaattgcctccaaattcaactgaatatgaaaacatggatgggttctcatttcccttcaacaaggaagt

SEQ ID NO: 10322 - DNA, 201 bp, Homo sapiens
aagtactgcatgtgatacatttagtcagtccccacaaacctgattagaaaggaattacctccagcattttacagaagaggaaatggaagcttagagcagtgggtaacttacccaggttgaaattggcagagctgaggtccaaatcagagaaattcagcatcgatggtgcaatagactctaggaagtggcctcatatatggt

SEQ ID NO: 10323 - DNA, 201 bp, Homo sapiens
ctactctgagttgggttttggtttgcttaggtaggaacccaccacactggagctgactcagcctaatggtctcccagttaattattttaacactatggtgkggttacaaggctctgtaccagttggcctccgtttctttgttcagccccagtcctgggtactccccaccccacaccgttctcctcactcccagccacacag

SEQ ID NO: 10324 - DNA, 201 bp, Homo sapiens
atcatagctcactgtcacccccgggctaaattctcccacctcagacttccaagtagctgggactatgggtgtgcaccaccatgcctggctagtttttgtatttttttttttttttttttagaaatggggtcttgctatgtcgcccagactgttttcaaactcctagcctcaagcaattctcccaccttggcctcccaaagt

SEQ ID NO: 10325 - DNA, 201 bp, Homo sapiens
catggaaagtatgagagatatttctcacaaggctgcttatagcaagtaaaataccattagggtagtctctttttcattgaattattcatccagagtcattragggcttccctagacaatgtttatgtattttgtgtggaaagtataatatccaagaaaaaccattttcatattttttaacacttttaaatggttcactagc

SEQ ID NO: 10326 - DNA, 201 bp, Homo sapiens
gaaagcgaatgctgtttaagtgtttaacaggctgttttctctactcagctgatgactgttatatttcacatttactctgaatttgaaaactagctttgcartctcagcagaacttgttactctcatctgaatgtgccttgcctccaccttaaaacaaacctgaatcttaagactgatggttcagattttcataacaatgat

SEQ ID NO: 10327 - DNA, 201 bp, Homo sapiens
taacaggctgttttctctactcagctgatgactgttatatttcacatttactctgaatttgaaaactagctttgcaatctcagcagaacttgttactctcmtctgaatgtgccttgcctccaccttaaaacaaacctgaatcttaagactgatggttcagattttcataacaatgattaaaataggattctgggtggagca

SEQ ID NO: 10328 - DNA, 201 bp, Homo sapiens
cacatctggagaattggtacctgctcaccactttataattgtgtggcttcgggtcagttaatgtatctgagcctcaggttttttaatctgtacaatgaacrtattgttttgcttatgcagacaatgggactactctaatagcgaatttaaaataatgttgtaaaagtgctgtaatcactgtgctctaaaaatgtaagaaag

SEQ ID NO: 10329 - DNA, 201 bp, Homo sapiens
tgttcaaggcaaagccaggacccagagcctgcagtcttttttttttttttttttttttttgagacggagtttcgctcttgttgccctggctggagtgcaayggaacaatcttggctcactgcaacaacctctttctcccaggttctagtgattcttctgcctcagcctcctgagtagctgggactaggcgcccaccaccac

SEQ ID NO: 10330 - DNA, 201 bp, Homo sapiens
ctttatatatagcgaatgaataaaaataccctctttctttggtaaaataaaagaggaaaggcattctagatggggaaaatagcaaaagcaatgatgaagarataccaatgatttgttagtgataaatggatttttatacagcaagaattgaacatacatttggcaaggcggattggagccagcctaaagagtttagacttt

SEQ ID NO: 10331 - DNA, 201 bp, Homo sapiens
atgatttgttagtgataaatggatttttatacagcaagaattgaacatacatttggcaaggcggattggagccagcctaaagagtttagactttttgtttwgctctcattatcagaaatcgtcacttcctacctgtccaggtttgcataaaccatggatgctctgttttatggtcccatataatgaagattatgtgtaatt

SEQ ID NO: 10332 - DNA, 201 bp, Homo sapiens
gttttatggtcccatataatgaagattatgtgtaattacttcatagtggattgcactctagcaaaattaactgtccatatttcttctcatgagccctttgygttaataaatgatgcatttgaggaggcaaaaatggttgggattttctgtgggggaattcctcatgaggagataggaggaatcatggaaaatacctggttc

SEQ ID NO: 10333 - DNA, 201 bp, Homo sapiens
tcctctgtctcagaaagtggaattaatccaggtaatattttgactggattttgactggtaatatcagctgttgctgataaagtcaagattaatgattcctkggctaccagtgggctgagagtgtgaaagtcaaaacctgttagaaaccaggggaattgcccatgaaataagatggctttgtgaatgcgtaggtgactctga

SEQ ID NO: 10334 - DNA, 201 bp, Homo sapiens
ccctgatggctgatttcataaataagcttaagtgcaatgtgtaggaaaattggagtgaaagttggcaatggcgggagtgctggtatgtgttggagtaaggrtggcagggactacaatgtcactgccaacaaatggcaaattttatggaaattaaaatatcctgcaaagtgcggattcaaggcaatgctgtcccctttgcta

SEQ ID NO: 10335 - DNA, 201 bp, Homo sapiens
cacacagccagtacatggaaacattaggatctaaacatgatctaagtgttcctaatgaccatgccatatccagttaagaattgaattgtgcatacaatttrcaaactagttaagagtagagggaggaaagccaaacatcaacttccaaagcaacagaagttagatattctataataaagttatcggttgcatgttgccggc

SEQ ID NO: 10336 - DNA, 201 bp, Homo sapiens
gtgaagggagtgggtagaagaattatttaacctgcagctgggcaggttaactagagagaggaagctaaatgtatgctatggtcacctctgtagaggaagaragcacagaaaattttaccttttcctggattaccttcccttcttgtttgcctggtgtcctttttttgttttgtttgtttgaaatggagtttcactcttgtt

SEQ ID NO: 10337 - DNA, 201 bp, Homo sapiens
agtgaataaatgttgatatatatatatatacacacacacacacatacatatatacatatatatctttatatattctcaccttcccccatccattatttctktggctaaggccacctggattttctctgttttcatctccatatctatagactgcatagacctctcacacaaatttgcattgctagttgaggtgttctttga

SEQ ID NO: 10338 - DNA, 201 bp, Homo sapiens
tcaagaggtgaagaggaccgtgtcaccctagggtctatctaccacactgtcaacgtgcaatacccctggcatgtgtcgcagagcgccctcttgtctgtgtkggttactaattgttacagtgaaattagattcctctttccaaagaagtcagagttgtgaaatgcttgggaaactatgagctgtttccccatcccttactgg

SEQ ID NO: 10339 - DNA, 201 bp, Homo sapiens
aagtgcaattttggcaagaccttgtttctctagttgcataaggaatcactacatgataagaaacaagaaaagtttactggcagaaatagagaaaagatatrtacatctattttatctacctaaacataagtagataaaaatatgtgtaaatagttccttatgtcaggaaactgtgtctgaatatctttctatccttaaagg

SEQ ID NO: 10340 - DNA, 201 bp, Homo sapiens
agtgtattttctattttgttaaaaaagtaaaagtaaattgcaaagaagatacttggagaggaggaacaaagtaagtaaggcaaggacatgatggatacagrgggattaactggggagggaatgtctgtaaagtgtataaattttggggttggggggggtacagctaaaaggagctgtcctaaatcctggcaaaggccctcc

SEQ ID NO: 10341 - DNA, 201 bp, Homo sapiens
agctaaaaggagctgtcctaaatcctggcaaaggccctccactttaataagcgttgtaactttctctttcattgttggaggtaacacgtatgaaaggaaarcagcaatcagaacaatgcagtttcccagagggctctttagcagaagtctcctgtggttccatgctgttgttaatgctccccttattttagtctcctggac

SEQ ID NO: 10342 - DNA, 201 bp, Homo sapiens
ctttctctttcattgttggaggtaacacgtatgaaaggaaagcagcaatcagaacaatgcagtttcccagagggctctttagcagaagtctcctgtggttycatgctgttgttaatgctccccttattttagtctcctggactccctaaatgctttggaccacttgagcaaggccacgttgctaattgtgcagaacccctt

SEQ ID NO: 10343 - DNA, 201 bp, Homo sapiens
gttacactgtaatgggcaaaactgctttgcaaactcaagttctctaattctggatgcttttgtgtgatgacttattgctattcccatgtctctataccaaygacaaaacctttcaaccctctgagtttttcccctagctcctgggactatgggtgggagagtctgagggtcatctattgatattgaatgtggcaggagtga

SEQ ID NO: 10344 - DNA, 201 bp, Homo sapiens
tggacctcgtgatcaaccctcctcggcctcccaaagtgctgggattacaggcatgagccaccgcgcccggccacttattttcttatttgcatgctttatamctgctattacttagttcctgtgatgtttcccagaaatatggaattagctgtgccagacactatggccagaagactcaacagtcacatagcgttatgatgg

SEQ ID NO: 10345 - DNA, 201 bp, Homo sapiens
aatacaaaattagctgagtgtggtagtgcacacctgtagtcccacctacttgggaggctgagacagaaggattgcttgagccaagggtttgaggctacagkgagctatgatcatgccactacacgctagcctgggtgacagagtgaaaccctgtctctaaaaaaaaagaataaaaaatagaggttaaataactcatgggta

SEQ ID NO: 10346 - DNA, 201 bp, Homo sapiens
tgttgtcagatgatgctgatgttgctggtctcagagccctactttgaaaaccactggtctattgtaaggctttctttttacctatgagaaaactgaggacrtgagggaggccattcatgtacatatattattcaaatcctgttcctttccatccaaaagccctcatgtggtatcctgttgaagtttgaataaaatcccaaa

SEQ ID NO: 10347 - DNA, 201 bp, Homo sapiens
cccatccttccatatcagagtctccatagagccttacttactttcactgcagttattcaatggacacattcttatttcagcatgaaaaacaactaatatgrgcacatggcacagaacaaaagtgaaggtttgacttacagagaatttcaattccatttttcaattcctgccattttcttgggggctccaaatacagctaat

SEQ ID NO: 10348 - DNA, 201 bp, Homo sapiens
ctctattatatactgaaataatagtgatgtttgtctaaacaaccctagctggtcaaacaatggcaaccccttcccctggctgctgttttactcaccatttracaaaaaattaggtggtgcctttggaggaagagaagggagatttaggcggaaggatttttttttaaaaatttatttttgagacagagtctcgttctgtca

SEQ ID NO: 10349 - DNA, 201 bp, Homo sapiens
aaccccttcccctggctgctgttttactcaccatttaacaaaaaattaggtggtgcctttggaggaagagaagggagatttaggcggaaggattttttttwaaaaatttatttttgagacagagtctcgttctgtcacccaggctggagtgcagtggcaccatctcagctcactgcaacctttgcttcctgggttcaagtg

SEQ ID NO: 10350 - DNA, 201 bp, Homo sapiens
tgatccgcccacctcagcctcccaaagtgctgggattacaggcatgagccaccacacccagctgaggttgaagggattcttacaaagacatgtgaagagartaaattgaaaataaatatgattacattaaaactaagctcagtactttaagatgtcatgttctctgacttgataactgaagaatttgtgtgagtcatgaga

SEQ ID NO: 10351 - DNA, 201 bp, Homo sapiens
acctcagcctcccaaagtgctgggattacaggcatgagccaccacacccagctgaggttgaagggattcttacaaagacatgtgaagagaataaattgaarataaatatgattacattaaaactaagctcagtactttaagatgtcatgttctctgacttgataactgaagaatttgtgtgagtcatgagaagaaggtaat

SEQ ID NO: 10352 - DNA, 201 bp, Homo sapiens
caatgtgcctgtcatatttattttaaatattgaaactcactagaaccaaagtccaaatatggatgctctgtcgtggtgagtccacttgttacaaggacccyggaaaatgaaatcaacttggatagaaaccaacatagacccaattttatatcattaaaccatcttctattctaaagaacaactgtatgtgtattacatata

SEQ ID NO: 10353 - DNA, 201 bp, Homo sapiens
ataaagtcctgaataagtcatcaacattgaccatatttatgtatgggtagactcaataacatgaagatgccaattttttctaaattcttctataaatccayacatttccactcaaaactccaacagaactgttcatggaatttgacaagctaactctaaaactcatgtatgatcacggggccaaaaatagccaagacaact

SEQ ID NO: 10354 - DNA, 201 bp, Homo sapiens
agcacattggtattagccttgcaggcctcacctcccagagctagcaataacatttaccagctacagttttctccattttcaaatatttcctctggcccacrtgccagtgatccagctcctccatagagtagaacctgaaaggagtggtttaaagaaaggagagccctcctgtaagaacttttaacatttacctttcattaa

SEQ ID NO: 10355 - DNA, 201 bp, Homo sapiens
agaaaatacatttgtccttccagtttgcttacagaattgagagagtcaaatatgtaaactaaactaaagtacacacaaaaaacagtcctgtaggcaccgcygataataaatgtatgtaccagatagaaggccatggaaaagggtggtcatcttacctgggaagagagcacaggtagcactcaggataggcttcatagagaa

SEQ ID NO: 10356 - DNA, 201 bp, Homo sapiens
gcttcatagagaagacgatgctcaaagatttcttatttatccaccatctgttttatagagcatctactatggaccaggcactcttctagaacatagctacrtcatggtaaacaaaaaagaaaaggtatctgcattcttggagcttacagcctagaagaagtcagataacacatgagaaaaaaaaaaaaaaaacaacaccaa

SEQ ID NO: 10357 - DNA, 201 bp, Homo sapiens
ggcactcttctagaacatagctacatcatggtaaacaaaaaagaaaaggtatctgcattcttggagcttacagcctagaagaagtcagataacacatgagaaaaaaaaaaaaaaaacaacaccaaacaaaattaattagatattttcggtgttgtcatgaaaaataaatgagctgatgtgatagaatatgctcagggagat

SEQ ID NO: 10358 - DNA, 201 bp, Homo sapiens
gtcaccaggtggctctaagtccaaactggcacacttttgagtaaaaggtggtgctattaataattacaccaggacaacagaagtgaaatgagactgtctgrccaaacctggacataagatcatcctttagcaaggaaagaaatcacgtaggacttggtgagccagccaaggagtatgaagttattcccagtgcattaggaa

SEQ ID NO: 10359 - DNA, 201 bp, Homo sapiens
tattgaatgactcaagaaaaattgaattcatgtcacaagaactcaaagaaaaaaaaaaacaaattatctgaaaggaaaagggagattgtagactaaaggcaaaaaaaaaaaaaaaaaaaaaaagggaaagccaaaacaatgtgatcacataactaatttgaaataattagtaacaacagggggtggaaaagatatggctaa

SEQ ID NO: 10360 - DNA, 201 bp, Homo sapiens
attgaatgactcaagaaaaattgaattcatgtcacaagaactcaaagaaaaaaaaaaacaaattatctgaaaggaaaagggagattgtagactaaaggcaaaaaaaaaaaaaaaaaaaaaaagggaaagccaaaacaatgtgatcacataactaatttgaaataattagtaacaacagggggtggaaaagatatggctaaa

SEQ ID NO: 10361 - DNA, 201 bp, Homo sapiens
agtacctcataaaaagtagttgaaattcggagttttttcttttgctaactttgtgtaatattaaagtttagtttaattaaagtagtacatatagattttcytctaaagagtttgtctattctatttgtgtgtgtgtgtgtgtgtgtgtgtgtgtatataatatatatatgcttagaaaagtacctagaaatatgcctctct

SEQ ID NO: 10362 - DNA, 201 bp, Homo sapiens
attcggagttttttcttttgctaactttgtgtaatattaaagtttagtttaattaaagtagtacatatagattttcttctaaagagtttgtctattctatttgtgtgtgtgtgtgtgtgtgtgtgtgtgtatataatatatatatgcttagaaaagtacctagaaatatgcctctctactgttaatgatggcatgatttga

SEQ ID NO: 10363 - DNA, 201 bp, Homo sapiens
ttcggagttttttcttttgctaactttgtgtaatattaaagtttagtttaattaaagtagtacatatagattttcttctaaagagtttgtctattctatttgtgtgtgtgtgtgtgtgtgtgtgtgtgtatataatatatatatgcttagaaaagtacctagaaatatgcctctctactgttaatgatggcatgatttgaa

SEQ ID NO: 10364 - DNA, 201 bp, Homo sapiens
tcggagttttttcttttgctaactttgtgtaatattaaagtttagtttaattaaagtagtacatatagattttcttctaaagagtttgtctattctatttgtgtgtgtgtgtgtgtgtgtgtgtgtgtatataatatatatatgcttagaaaagtacctagaaatatgcctctctactgttaatgatggcatgatttgaaa

SEQ ID NO: 10365 - DNA, 201 bp, Homo sapiens
ggagttttttcttttgctaactttgtgtaatattaaagtttagtttaattaaagtagtacatatagattttcttctaaagagtttgtctattctatttgtgtgtgtgtgtgtgtgtgtgtgtgtgtatataatatatatatgcttagaaaagtacctagaaatatgcctctctactgttaatgatggcatgatttgaaaag

SEQ ID NO: 10366 - DNA, 201 bp, Homo sapiens
tctgtaatcccagcactttgggaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttg

SEQ ID NO: 10367 - DNA, 201 bp, Homo sapiens
ctgtaatcccagcactttgggaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttga

SEQ ID NO: 10368 - DNA, 201 bp, Homo sapiens
tgtaatcccagcactttgggaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgag

SEQ ID NO: 10369 - DNA, 201 bp, Homo sapiens
gtaatcccagcactttgggaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagc

SEQ ID NO: 10370 - DNA, 201 bp, Homo sapiens
gaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagcccaggaattcaaggttaa

SEQ ID NO: 10371 - DNA, 201 bp, Homo sapiens
aggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagcccaggaattcaaggttaag

SEQ ID NO: 10372 - DNA, 201 bp, Homo sapiens
ggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagcccaggaattcaaggttaagt

SEQ ID NO: 10373 - DNA, 201 bp, Homo sapiens
gccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagcccaggaattcaaggttaagtg

SEQ ID NO: 10374 - DNA, 201 bp, Homo sapiens
caaacaaacaaacaaacaaacaaaaaaaaaagtagccaggtgtggtggtgctcctgtagtcctagctacttgggaggctgaggtgagagaattatttgagyccaggaattcaaggttaagtgagctatgattgtgccactgcactccagcctgtgtaacagagcaagactctgtctcaaaaaaagaaaaaagttcttaatt

SEQ ID NO: 10375 - DNA, 201 bp, Homo sapiens
tgtattatctaaagtccagctttcaataaaaaattaggagaatgcaaataaacaggaaatgtgacccatacacagaaataaatgcaggcaatagaaactgsctttgagtgggctcatatgttggacttaatagacaaagaatacaagtaactattataaatatgttcaaataactaaaggaaattatgcttaaaaattaaa

SEQ ID NO: 10376 - DNA, 201 bp, Homo sapiens
tggctttgggcagctccacccctgtgggtttgcagagtacaattcctctcctggcagctttcatgggctggttttgagtttgtatggcttttctaggtgcrcagtgcaagctgtcagtggatttaccattctggggtttggaggacagtggccttcttctcacggctccactaggcagtgccccagtggggactctgtgtg

SEQ ID NO: 10377 - DNA, 201 bp, Homo sapiens
tacaattcctctcctggcagctttcatgggctggttttgagtttgtatggcttttctaggtgcacagtgcaagctgtcagtggatttaccattctggggtytggaggacagtggccttcttctcacggctccactaggcagtgccccagtggggactctgtgtgggggctcacaccccacatttcccttcggcactgccct

SEQ ID NO: 10378 - DNA, 201 bp, Homo sapiens
tgggacacagggcaccaagtccctaggctgcacacagcgaggggtttgggggtgtggctcagccacaaacaaaaccattgtttcctcctagcctctggggygcctgcagttggagaggctgccataaaggtctctgacataccctggaaatatttgcctcattgtcttggccattaacatttggccccttattacttatgt

SEQ ID NO: 10379 - DNA, 201 bp, Homo sapiens
gggacacagggcaccaagtccctaggctgcacacagcgaggggtttgggggtgtggctcagccacaaacaaaaccattgtttcctcctagcctctggggcrcctgcagttggagaggctgccataaaggtctctgacataccctggaaatatttgcctcattgtcttggccattaacatttggccccttattacttatgta

SEQ ID NO: 10380 - DNA, 201 bp, Homo sapiens
aaaccattgtttcctcctagcctctggggcgcctgcagttggagaggctgccataaaggtctctgacataccctggaaatatttgcctcattgtcttggcsattaacatttggccccttattacttatgtaaatttatgcagctggcttgaatttctcctcagaaagtgggtttttcttttctatcacattgtcaggctgc

SEQ ID NO: 10381 - DNA, 201 bp, Homo sapiens
agttccatgtggctggggacacctcacaatcacaatcatggcggaagtcaaaaggcctgtcttatatcatggtagacaagagagaaaatgagagctaagcraaaggggtttttcgttataaaaccatcagatcttatgagacttattcactaccatgagagcagtatgggggaaactgcccccatgattcaattatttccc

SEQ ID NO: 10382 - DNA, 201 bp, Homo sapiens
aaagagcatgtgaagggaggaactgtcaaacacttacaaaaccatcagatagtgtgagaactcatgagaacagcatgggggaaaccacccccatgatccarttatctcccactaggcccctccttcgacacatagggattatgaaaattacaatttgagatgagatttgggtggggacacagagccaaaccacatcagatg

SEQ ID NO: 10383 - DNA, 201 bp, Homo sapiens
gtttgattcctaggaatgtgagtgatattctcttcctgtgttttctaaaattatttgcctagtgaatatttaaacaaattcacatgttgaacatcatagtrtttcaaaacagcccctggacttggtatcagatatattgagtcaaatccagagatgctgtgtgactttgggatgataacatacccctttaagagtcttggt

SEQ ID NO: 10384 - DNA, 201 bp, Homo sapiens
agtgatattctcttcctgtgttttctaaaattatttgcctagtgaatatttaaacaaattcacatgttgaacatcatagtgtttcaaaacagcccctggayttggtatcagatatattgagtcaaatccagagatgctgtgtgactttgggatgataacatacccctttaagagtcttggttttcccaaacaccacatgtt

SEQ ID NO: 10385 - DNA, 201 bp, Homo sapiens
ttgatcaatcatattcccataagtccaactcctcagtcaccactcaaaacagtcacagctgaggtcagggacagggcaggaagtggaggcaaaatgttgayggtggggttgtaggaaattaaactttgtgggtagggtgagaagtacattgtttctagctccacagctactattcaaatggagaattctggtggccttgat

SEQ ID NO: 10386 - DNA, 201 bp, Homo sapiens
ataactagctcactgaaaaagatgatgaagacaatttttatctctggatctatttcaaagtcagagagagacaaacatatgagaatgattcagccccacgsgatcctgagggagtgtacacagtgtcattaaacagacatttttttccccattaggtgttgtttagtaaagattagagtgtcaactttgacaggtctcaca

SEQ ID NO: 10387 - DNA, 201 bp, Homo sapiens
tgagttggtcatacatcccacatgcatttctagaagcattatttttgtattttaaactctagtcaaagtctgagagatgtgcttttccaatagactttgctttttttttttttttttccccctttggcttcttttgttgcaatttcaatctagctcctgctgcgttgaaccatctcaggcaaaggagaggtagcctctctg

SEQ ID NO: 10388 - DNA, 201 bp, Homo sapiens
ccacatgcatttctagaagcattatttttgtattttaaactctagtcaaagtctgagagatgtgcttttccaatagactttgctttttttttttttttttccccctttggcttcttttgttgcaatttcaatctagctcctgctgcgttgaaccatctcaggcaaaggagaggtagcctctctgtagagagcactgtgctt

SEQ ID NO: 10389 - DNA, 201 bp, Homo sapiens
cttctaccttttagtatctaacggtaaacaaatccttattggaatttccaccatgataaaccaaccttaggctgaaccgggcagcttggtaacaactaacytgagacctttctctgaccttttctgcccagtcccctactatgcccactgattctactcaaggacttctatgttgtgtgtccatgactcccaagcagagat

SEQ ID NO: 10390 - DNA, 201 bp, Homo sapiens
gacttctatgttgtgtgtccatgactcccaagcagagattaatacaatgatagatatgctgatctctggcacagaataccttgtctgattactagctctgsccagttggtcactcttttcttccctccctttcccatttaaaaaagtgaaacaaaaaccaaaaaattttctctcctcaagatgtggaatcacagagtgaaa

SEQ ID NO: 10391 - DNA, 201 bp, Homo sapiens
atggcaagtctgcctatgcaaatttctatagcatttggggcccaacctaaggagagggtggagggagtttgattttagaaaaagagaaagggttaagtacktcactgagcaacttcatgggcagattttttaaatgatacaatcagtcagactggtgatatgtctttggaatactaatacaaaaattgtgttaatgctact

SEQ ID NO: 10392 - DNA, 201 bp, Homo sapiens
tttggtggggggaattattgcctatttttccaagtttgacaaaattaatatttcaaagtccaggtttgaaatactttatataaaagaatagctttttttgaaaaaaaaaaaatgtttggtgtctactgtggatatatatgtataccagtatatatctctatacatatgtgtatatatatgtgtgtgtgtgtatatatatat

SEQ ID NO: 10393 - DNA, 201 bp, Homo sapiens
agatatattataggcatgacaaactaataaagcccaattctactttttggggggcaaatgttccatctaagttaacacaaaaagaagaaatttaaaatatygatataagcaactgcttactaaatagagtgctttatccttgtcttggcatcacttacagttattttaagcaatggcctattttctgtgtttaaatatttc

SEQ ID NO: 10394 - DNA, 201 bp, Homo sapiens
tattttctctttccttttgcattggttttcagaaggaaataaggtggaaacccagcatgaaggtggaaagcctcgtatccgaagctacatctagcatcttstagcttcagagacttatttggagaacagggaactgaggcagttatttaatcaggatatcagaatttgcttttgctgttctatccacactttctcatgaag

SEQ ID NO: 10395 - DNA, 201 bp, Homo sapiens
ctttttcagtcattcttttttagaatgcctgtcctctgaaaagtcacttgggtaaaatactgaatgacatcagctatttttttttcctgttcatctgctataaatgttgtttgttctgggaaatggctatttccaaggcattctgtgacactctttaatggagacaagagcatgaaaaagaaggatgatcttccagcatcg

SEQ ID NO: 10396 - DNA, 201 bp, Homo sapiens
tttcattttaggggggtgctatattttattaaatcagcaccgtacatttaaatttttctcagctttttactactaaaaatgtaagaagtatatacttttgytcattagttaatgcatacatgtataagaagatctattggataaattcctaaaagtagaattgctgagtcaaaagataagtgcattataaatattgatata

SEQ ID NO: 10397 - DNA, 201 bp, Homo sapiens
aaggaagaagcagaggaaacagcaaaagaggaggagaaaaagaacttgttcaaagcacaagccttcataagttatgtcttagtccatttggtgttgctatratagaatacttggggctaggtaatttataaagataagaggattatttggctcttgattctggtggctgaaagtttcaagagcgggcagttgcatttggcg

SEQ ID NO: 10398 - DNA, 201 bp, Homo sapiens
tgtaatccatcaaatattttctttgctttactcgcctatttatcctataaaagcctgctatttgcattccctcagtggagctcctgagccacttttgattyagagcttccctgtccaattcatgaatcactgtttgttaataaagtccttaaaatttttattgtgcctcagtttatcttttaaccgtttgacctctatgcg

SEQ ID NO: 10399 - DNA, 201 bp, Homo sapiens
ttagccacaaaatgaaagtctgtttactgattcaaagcatctcaggaaacacagtttccaattttgggaagaaaactttacagaccaggagatgttatttytaaaaaaaaaaaaaaaaaaaaaaatggagtaattttctggctgttctgttgacttactagaatcacatagctttttaactctgagtttatttgaagttag

SEQ ID NO: 10400 - DNA, 201 bp, Homo sapiens
cccactgaccagagtgacaatgcccataggactgaaggggtaagagcaacagaaacggaatgcttgaaaggagcagaaacagtgtatggcagcagcaaatrtgtgtcagatagaaagacaaagggaaagggacacaaagaagtattcacaatggagcaacacacatgtagtgtgttttataatgctggaaaaattctgtac

SEQ ID NO: 10401 - DNA, 201 bp, Homo sapiens
aaccaatttacaaaactttccggtcatcataaatagaaaagccagatatggtaacaccgcgatgactagttaagtactcaggtacttatccatgactttgwttatccatcctcctacatatctgatagaaaacacaaggagtaggaatctcatggttaacatttcaaaggcatgaaaattgaatactaagtgaagatacaa

SEQ ID NO: 10402 - DNA, 201 bp, Homo sapiens
acaacttcattctttcccctcttcatatcttcctggaccctttttctcctttgtcacagcaaaataatataggctactaagtctatgcacaaggatatttrcaataaacatttgacagtctttgctattgctatatgaagtgcatgcacttgacaggtggctactaattattatagtaaaaacaatagcattgagtgattt

SEQ ID NO: 10403 - DNA, 201 bp, Homo sapiens
gtgtcattaccctcattttagaaatgagacttgttcatatggaggctgggtgtggtgtctcaggtctgtaatcccagcactttgggaggccgaggtgggtrgatcacttgaggtcaggagttcgagaccatcctggccaacatggtgaaaccctgtctctgctaaaaatacaaaaattacccgggcatggctttggacacc

SEQ ID NO: 10404 - DNA, 201 bp, Homo sapiens
gtgaaactgattaactgtcacatcaatactgtaaagagggagagagagtctggttgtggcctcaggtgattggctaaagacaataaagaaatgggtcacckgcttctttttttttttttttttttttttccagagctggtttctgttgctccttaggaaagaatcctggttaaaggtgaataaggaaggggtatactgagg

SEQ ID NO: 10405 - DNA, 201 bp, Homo sapiens
gtatcaaaatatttcatatactcaataaatatatacacctactatgtacccataaaaattaaaaatataacagtaaaaatcggatccatcttttccctaamtagtggttgttcaaagagacatttaaggcacaagtgttgtttgtgcagtattgttttgcacatatcaaattctaggttttatgtcttacccaccctggat

SEQ ID NO: 10406 - DNA, 201 bp, Homo sapiens
ctaggttttatgtcttacccaccctggatagaaatttatatccattccaggaggcggaggttgcagtgagccgagattgcaacactgcactccagcctgcrtgacagagcgagactctgcctcaaaaaaaaaaaaaaaaaaaagaaaaagaaaaagaaaaatttgcacccattcctgtattctttttataggcttctgtaa

SEQ ID NO: 10407 - DNA, 201 bp, Homo sapiens
tgtattagatcctttaattctcacaaggatgatatggaggatacaggaccatttacattatttgtgtgatctagtgccaaataaaaatgtaagctccttgytctaaaggcagaatgaaagctttttcctttctttctcaattttttagttaacctgtcaaacatagggatactcagggagcaactgtagacccccacaggc

SEQ ID NO: 10408 - DNA, 201 bp, Homo sapiens
tttctgttgctgatcatcagcaactagaagacagaatttggatattctcacaccaatgtactattgctgcagaaatcctttgggctaactgagaggaccgaaaaaaaaaaaaaaatacaaaagaacattccagaaataattacctattcaccatctttagtacaatgctgtacaaataattaatttttggttcgttattct

SEQ ID NO: 10409 - DNA, 201 bp, Homo sapiens
cattttttagttctagatgctggtaatgcaatgctgaacaagaccaacatggtttctctccttataagatttgcattaacatttgtgaatgcataaagacktaagtgagttcaagtaatgccaaatgcaataaataaaattaaacagagtaaagtaaatgcctggatgtgggaggaagtataactttagataaaactgccc

SEQ ID NO: 10410 - DNA, 201 bp, Homo sapiens
ctgtgcagagacattgacaaaggtgaagggcttatggaagatacatacttggtgtgtttgaggaataggaagacaccagtacggttgagaagggaaagggmctgttatctctatcttgaactgtccccattaaactgatctataatcagaattttaagtgagttaaattctctttctgatttacaatcatcctttcttttg

SEQ ID NO: 10411 - DNA, 201 bp, Homo sapiens
aaatcagtctgaattcataaaatagtatatcatggattttttaaaaaataaaattgcttcgaaatacatacaataactcgcccaagatgtgtatgggtgcrtgtgtgtgttatctccatcccaataaatgctattgggaatatataaggctgacattatcattttagttgattaaaataaaatatctaagttactcgtatc

SEQ ID NO: 10412 - DNA, 201 bp, Homo sapiens
cagcctggccaagatggtgaaaccccgtctctactaaaaatacaaaaattagccgggcgtggttgtaggcgcctgtaatcccagctacttgggatactgasgcagagaattgcttgaacccaggaggcggacgttgcagtgagccaagattgtgccactacactccagcctgggtgacagagggagactccatgtcaaaaa

SEQ ID NO: 10413 - DNA, 201 bp, Homo sapiens
caaaataaatattttacaaaattatttctaagtcgaaaaagacttagtgtcttggtgtacaagagtggggtaataccagcatgtttctcagtggggagtgrggtaaaagaggaggacaaaaaggttaattaatgcataaaagtgcctagatcaaaggcaggcaccactgtaagcaaaagacatctccttgaatatttccta

SEQ ID NO: 10414 - DNA, 201 bp, Homo sapiens
tgtttagttgttcttgccaagaaagaaagaaataattccagattccaggtgttactacttagctggatgttttactttataaggaggcagcaattcatgaraaacagctgtaattacacagcattcaggtatttcataattaaactaacagctgattttaaggtggcacatggcatgagattttgcaactaggctaagtaa

SEQ ID NO: 10415 - DNA, 201 bp, Homo sapiens
tatcactcctgtatctatctacttatgtcagttgtttaccagttcccttcagctgtctgctttttatcatattattgatcagtcagtcttgggcgtcttakgttggaggggagagagagagaaccggcaaagggaagcacgagtagagaatagcggtggcggacaatcagttaagatggttccaaaaatagctcagctctg

SEQ ID NO: 10416 - DNA, 201 bp, Homo sapiens
cagttcccttcagctgtctgctttttatcatattattgatcagtcagtcttgggcgtcttaggttggaggggagagagagagaaccggcaaagggaagcasgagtagagaatagcggtggcggacaatcagttaagatggttccaaaaatagctcagctctgctgatgacagctctgcttgcagccaccccgtatgggatt

SEQ ID NO: 10417 - DNA, 201 bp, Homo sapiens
catctgtgttctttgtacactatgctctgggcacttggcatccagtttctttttgtccctatctcttttgaatgagatgagggagtaagtgatgagaaatkgttatatttctcacccactgtgtctattttgttgctattgctctagtttattatatacataggctttttttccctactgcactttctgttgggagactca

SEQ ID NO: 10418 - DNA, 201 bp, Homo sapiens
gagttgggactgatatacattttcataagcatgtgcagtaattctgatgtagctcgtctgtggaccacaactcaggaaccctagtcttttaaatgtatatwtttttaataacatggtgctctaatttggagccctcagaaagaaaggaaaataaaacagcataacctgtgtcctccatgatagtttagtgggctctagtat

SEQ ID NO: 10419 - DNA, 201 bp, Homo sapiens
ctttgggcctggtgagtgatcctggaatttgtcaaacaagtttatggaaggaaacctgaaaatgcttcaccctagtcctttgcctctttatttttgtgggktttttttttttctctttgagaatgttttctatttgagtggagaatgctctcatatggtacttttctctgatccttttggaaagagcaagtgtcctttgag

SEQ ID NO: 10420 - DNA, 201 bp, Homo sapiens
tctttagtgaaaagccacctttgcgtgttgttatgccacattacagtgttccagaaaacatattggtgtagatgcaaaatcttgccttcataatttttagycttatgttggattagagagcatattttcaagttgatctcttggaacctcagcatgaatctatattagaagcccagagaatgctaaacagagttttcactg

SEQ ID NO: 10421 - DNA, 201 bp, Homo sapiens
acttatgatgatgttttcccaaatcattttttatcaattctatttttggtttctctcacttatgaattgtttctgtctccttcattttggaacatttttctagttcattgtttttttgttttttcactctccctccagtgtctagcaaaagcctaacacacattacttggatattcatatcttaaaaatgaaagaataaat

SEQ ID NO: 10422 - DNA, 201 bp, Homo sapiens
gatttccaaaaggggagggagtgtacgaatagggtgtgggtcacagagatcacatgcttcacaaggtaataagatatcacaaggtaaatggaggcagggcragatcacaggaccacaggactggggcaaaattaaaattgctaatgaagtttcaggcatgcattgtcattgataacatcttatcaggagacagggtttgag

SEQ ID NO: 10423 - DNA, 201 bp, Homo sapiens
agagatcacatgcttcacaaggtaataagatatcacaaggtaaatggaggcagggcgagatcacaggaccacaggactggggcaaaattaaaattgctaaygaagtttcaggcatgcattgtcattgataacatcttatcaggagacagggtttgagagcagacaaccagtctgactaaaatttattaggtgggaatttcc

SEQ ID NO: 10424 - DNA, 201 bp, Homo sapiens
tcacaaggtaataagatatcacaaggtaaatggaggcagggcgagatcacaggaccacaggactggggcaaaattaaaattgctaatgaagtttcaggcaygcattgtcattgataacatcttatcaggagacagggtttgagagcagacaaccagtctgactaaaatttattaggtgggaatttcctcatcctaataagc

SEQ ID NO: 10425 - DNA, 201 bp, Homo sapiens
tatgtaaagttacctaacccagttcttagcataattagttgctgtagttccaggcattcaatagatagaacagattttaaactactttaaagactagtgtraggctggcctatacttagttaagaatttgttaaagtttgatgatttggttgaaaaaatattctggagtgtgatggttaatccctctggagaaccctgact

SEQ ID NO: 10426 - DNA, 201 bp, Homo sapiens
tttgtctttctgtgcctggcttatttcacttaacataatgacccccagttccatccatattgatgcaaatgacagaatctcattcatttttatggctgaayagtactccattgtatacatgtatcatacggttttttttactattatactttaagttttagggtacacatgcacaacgtgcaggtttgttacatatgtata

SEQ ID NO: 10427 - DNA, 201 bp, Homo sapiens
atgacagaatctcattcatttttatggctgaatagtactccattgtatacatgtatcatacggttttttttactattatactttaagttttagggtacacrtgcacaacgtgcaggtttgttacatatgtatacatgtgccatgttggtgtgctgcacccattaactcatcatttacatgaggtatatctcctaatgctat

SEQ ID NO: 10428 - DNA, 201 bp, Homo sapiens
tccctcacctcttcccctaccccacaacaggccccggtgtgtgatgttccccttcctctgtccaagagttctcattgttcaattcctacctatgagtgagracatgcggtgtttggttttttgtccttgtgatagtttactgagaatgatatcatacattctttattcattcatctgttgatggacacatagtttgcaggg

SEQ ID NO: 10429 - DNA, 201 bp, Homo sapiens
ttgtccttgtgatagtttactgagaatgatatcatacattctttattcattcatctgttgatggacacatagtttgcaggggtacatgtgcaggtttgttrcatagctaaatatgtgttatgggagtttgttgtcagattatttcatcacccaggtattaagcctagtacccattagttatacagtaatttcttaatacat

SEQ ID NO: 10430 - DNA, 201 bp, Homo sapiens
cacttgaacctgggaggccgaggttgcagtgatccgagatcacgctgctgcactccagcttggggacagagcgagactgcatctcaaaaaaaaaaaaacayacaaaaaaggtatatatgactatagccctttttcttcataaggtttatagtcttcaacgatagagtgacttttatgtttttctaccagaagattcgaagt

SEQ ID NO: 10431 - DNA, 201 bp, Homo sapiens
tgatgctcaactttcatgctgttttatttgtttttttcttgagacagagtctcagtcattctgttgcccaggccggagtgcaatggtgtgatcttggcttwctgcaacctctgcctcccaggttcaagtgattctcctgccttggcctcccgagtagctgggattacaggcgtgtgtcacaatgccaagctaatttttgta

SEQ ID NO: 10432 - DNA, 201 bp, Homo sapiens
tgcagaaggtgagtgacaggccggtggtgctggtaaagtctgtgctgaggcagtaggagagctgatgtcaatgacaaggcaacccttgactgcagccctgrcacctgtctggggaatttagactttagtgacaatccttgacctgccatgcaaatctggagctataccattgaattattgcccgtgattgggtgtggaaat

SEQ ID NO: 10433 - DNA, 201 bp, Homo sapiens
tgatgtcaatgacaaggcaacccttgactgcagccctgacacctgtctggggaatttagactttagtgacaatccttgacctgccatgcaaatctggagctataccattgaattattgcccgtgattgggtgtggaaatggagagctttgtgggccaggaagcaggcagtttgtaatgtgtggatttttagcccggcaagc

SEQ ID NO: 10434 - DNA, 201 bp, Homo sapiens
tagcaattccctgtttgccactttcaactctttgttgatctaattattggtatgtctacccaagaaaatcttaagcttatttggggactgtggtcttgttwtatatatcatctcccgagatactagaatagcttaagtacccaattattattcagtaagtgcctgtttactgttggactttcttgaaaattcatatagaat

SEQ ID NO: 10435 - DNA, 201 bp, Homo sapiens
aaaagtttataaatttaaattaatggaaattgctgttgatgaaaccctctagaggataatacatttctgatatgcctatagggctccgtatttaagctaawctcctgcccaagatgcaggatgatgaagtcctttatttcggccatcagacctattaaaaccacgagtatccctgtgagtccacaagtcaggctacaatac

SEQ ID NO: 10436 - DNA, 201 bp, Homo sapiens
tatggagctatccagggtgctgaacgtgctctgcaactcagtccccttagtctctgggcttgacctattttttccattgttgtttcttatcttcacctttkattccctacccatactgcctgctctgattgctctttgtatgatctcatcaatcatatgtgacagatttttgtcccgacccttgctatgccctacattcta

SEQ ID NO: 10437 - DNA, 201 bp, Homo sapiens
aaatttgcaaattgagaataataaaacatcctcacactgaagattcctgccagaattatatgagataatgcatatccaaagtttagggcagaaactgaaasctagccaacattttaaaaatgtgaattattgtcattaacttatcctttcggtgcttcacctctccatacattttaagatactctggtcattatgagtact

SEQ ID NO: 10438 - DNA, 201 bp, Homo sapiens
aggattattttatggtctgcttcaggggagaagagtgagagaaagtcaaagagatctttctgcttctgctgctttctcaaatgccaagttgctgtattttrgggtagtatgtcctgaaccccatcaggtacttgacatttcatgaaggtaagctgatcaatctttcatccatggcactcattaatgtctcaatttgaaatg

SEQ ID NO: 10439 - DNA, 201 bp, Homo sapiens
cactttataataagacagataaggcagtcagtatacagaggtttggttttatggccagaactaacatttattcaatcaatgagagagatcaattagagcarcattacttctacagtgggaaaatttcagagcccctgaaatagaacattattgttaaattatcaaatatgttacagttgttgctagtataatgaccctttc

SEQ ID NO: 10440 - DNA, 201 bp, Homo sapiens
attttcaaaataagcaataacatttaaagcatatttgaatatacagatgtttggatcactgatatcctaagaattctatagtctctgctgattttaaagtygagattagattgttcttgtatacccagagaagcatagctctaaagggaaggtgttctggggaaagaaaagaaaaaaatgacgttttcatcatcacactga

SEQ ID NO: 10441 - DNA, 201 bp, Homo sapiens
tcactccatctgttttcagccccactgctggctctgccttcagaaatatgtgatgcctccaagttctctaactttatagggttctacagcaaaatatcctkgtttactactggcttctttctctgtaaaaacttagctttccacttttttctgtcctactgtcaattaccacacatctatacacttttcatcttccaaatc

SEQ ID NO: 10442 - DNA, 201 bp, Homo sapiens
aatgtacagtatggaatatgttcattatctcagtaccatgtttgggctcataaaaataaaaatagcagacatgagtgtggcctttattcatttgttcaacrggcttttactgcttgcctatcatgggaatggcaagaaacatcatttcagttaactgaaaggacaaatacaatattcttagtgatctccttccttcagttc

SEQ ID NO: 10443 - DNA, 201 bp, Homo sapiens
aaaaagtgaaccttcttttatcccacctagggttaatgcataggaattttatctgtagtcaagatcataggcaccatgtgaagtgattttcttttctttctttttttttttttttgagacaatgtctcactgtgacccaggctgaagtgcagtggcacgatctcagctcactgcaacctctgcctcccaggttcaagtggt

SEQ ID NO: 10444 - DNA, 201 bp, Homo sapiens
acaatgtctcactgtgacccaggctgaagtgcagtggcacgatctcagctcactgcaacctctgcctcccaggttcaagtggttctcctgcctcagcctcrtgagtagctgggattacaggaatgcaccaccatgtccggctaatttttgtatttttagtagagataggatatcaccatgttggccaggctggtcttgaac

SEQ ID NO: 10445 - DNA, 201 bp, Homo sapiens
gttctgacactgatttggggtcaagtctggggttctgaatcaggagcctgtgtttgatggggagtagatgccagaaggcattgacaagtggcaccatgcargcgaataatgcaagaagagtcaccttgtgggaaaattgatgcctgataatctgtcccaccagggtgtcaagtccgagagtgagaatccatcaattaaact

SEQ ID NO: 10446 - DNA, 201 bp, Homo sapiens
ctgtgggacggactttagagaggacagacttgagcacaggggtgtggagaattggttatggaagaaattcccaagcgaaatgaatatagttggaggaaatktgaagagggtggggagtttcctgggcctctgctggaagagcagaatgtaagagttgagaatgttaaaccagcttgcataacgttttgctgaacagtttaa

SEQ ID NO: 10447 - DNA, 201 bp, Homo sapiens
acttaaagcatacagtgccgtaataaaaatacactttggaagtcagttattcacttttttccataggctgttagatgagaaattatagaatatatggtacyctgttgggaatttatactaaaggattttgttttaaagataccaactctccatttgaataccatttctcagctcattttaaacatttacccaattaaaaaa

SEQ ID NO: 10448 - DNA, 201 bp, Homo sapiens
tttattgcttgcattggtcactgaaacctctaattagattcatagtgtacttagtgtattgtaattatatgtggcagagcacgtttgatgaaggtggatataagtagatgaatatttagacccagcaataccactaatgactcacatgccaggtaacatttctttacttgtaggacttattaagaagtggctgtgaattgt

SEQ ID NO: 10449 - DNA, 201 bp, Homo sapiens
tcctaatgacacttaccacatggggttgttgtgaggattaaataagagcatgcaagtaaggttttacatagtgcattccacataaaaagcactcaataaakgttagctattattactgttttcagtcactccaggcgagctatattgtaaaaaaccatacttccattgcttcttcactagagcctagcaaatcattgtttt

SEQ ID NO: 10450 - DNA, 201 bp, Homo sapiens
agtatcttgcctgtaataatgctcaacaaatatttgattaatgaatagacaggcttttatgaatccatgtgtaatgttaagttctatgaattatgtagaartagtaaaagcaaataaagactcaattacaattttaactcttcaacaagatgatcaaatccttgaggattagaaattaattaaaaatgaactcatccttta

SEQ ID NO: 10451 - DNA, 201 bp, Homo sapiens
attgttccatctaactggaattttgtaccctttggtcaaacatctctctaatcccacccgcctacaccacctcagcacctggtaaccaccattctactctytcctgctatgagtttgttttttttttagatttcatatataagcgaggtcgtgcagtatttgtcttcctgagcatggcttattttacttaacataatatcc

SEQ ID NO: 10452 - DNA, 201 bp, Homo sapiens
gccgtctgtatgtctccctgtaggaaatgtctatttagatcctttgcttattttttaattgggttatttgtttacttgctatgaagttgtttgaattcttyatatattttagatattaaccccttatcatagaatgacgcattttaagacaaggaatgaatcttgtgaaagcttaattccctgtcctaattcctcaccctt

SEQ ID NO: 10453 - DNA, 201 bp, Homo sapiens
ctggatacttgttgaatggctttgaccaaaatgctgatactgacatggacaatgaagtccaaactgaggtggtctcagatggagatgaggaacttgttggsaactggagtaaaggtgactcttgctatgctctaaaaaagagactggtggcattttgcccctgctctagagatctgtggaactttgaacttgagagagatg

SEQ ID NO: 10454 - DNA, 201 bp, Homo sapiens
cattttctgaagagaaattcaagccagctgcagaaatttgcataagtaatgaaccaaatgttaatcaccatgataatggggaaaatgtctccagggcatgycagagaccacaacagtccctcccatcacaaacctggaggcctaggagggaaaaatggtttcctgggccaggtccagggctcccctgctgtgtgcaacttg

SEQ ID NO: 10455 - DNA, 201 bp, Homo sapiens
tcctccagaacccagaatggtagatccactgacagcttgcattatgtggctggaaaagctgcagacactcaacagcagccatgaaagcagccaggaggggsactgtaccctacaaagccacaggggcagtgctgtccaagccatgggagcccacctcttgcatcagcatgccctggatgtgagacatgtagtctaaggaga

SEQ ID NO: 10456 - DNA, 201 bp, Homo sapiens
cgtgatcatgttttgaattgtgagggcatgagatttgtgaggggccaggggcagaataatatggtttggctatgtttgcacctaaatctcatcttgaattktagttcccataatccccatgtgttatgggagggacccagtgggaggtacttgaatcatgggagtggttaccctcatgctgttctcatgatagtgagtgag

SEQ ID NO: 10457 - DNA, 201 bp, Homo sapiens
gtttacagacatcttctttattccagctcaacagcccaaattcttttcaccttctgtaaagaagagtgactggaagagagactaagttaattgagataatkaataagtgagtgagagaataaatgaattatagaggaggaaccaaaagcacagagctggaagtggaacaggaggttctcagcaattttaaaagtgaaggca

SEQ ID NO: 10458 - DNA, 201 bp, Homo sapiens
ccaaaagcacagagctggaagtggaacaggaggttctcagcaattttaaaagtgaaggcaccgtagcagtggaagtatataaagggagtaaagtcaggctkggaaaacagaaggcaaaaatagtgttcatctagactgtgtgtcagattacttctaatatccttcaaggtacttgagtgaggaataatttcctcttatgtt

SEQ ID NO: 10459 - DNA, 201 bp, Homo sapiens
tatataaattatgtatgtaaaatatataaatataaattacatatgtaaaaagtacatagccatgttttgactcataaagagcattcattaaatgtggttayaatttttagaagacattatcagtaatattatcagtaatagaataagacctacaaaaaagggtaggggagagagtttcatgttgtataaggggagtgttga

SEQ ID NO: 10460 - DNA, 201 bp, Homo sapiens
gttgtctttccaaatttgtatgatgtcatcagcagcttaatagagcattagatgagaatgtctgagcattactatgctgactttgtaaaattgtaatccaraagcaaagaatcttgacagcttagacagttggtttgatcttattattaatgaacagaagatatatcttaggctattttaaaagtgaatttataataagat

SEQ ID NO: 10461 - DNA, 201 bp, Homo sapiens
atatttcattggtcagaagttagtcagagggtacctagttgcaagggaagctgggaaatgtagtctggctggcattgctttgttgcactaactcagtcctrtggaaaaggagcacaaatatttggtggacagtaaatgatctgtgtcatatccttattactcagatccatagtaataatgtctgtttttatctccttttct

SEQ ID NO: 10462 - DNA, 201 bp, Homo sapiens
gcctgatacagagttcagtatatattcagtatatatagtacctgatacagagttcatgatattcaataaatatcatgagtgatcaaacacatattctctgycttcttctcttcctcccttccttttttctctttttcttgcttcttttatatctctttctttttttctgatcccaaacactttagagtctttaatttgagc

SEQ ID NO: 10463 - DNA, 201 bp, Homo sapiens
cacatattctctgccttcttctcttcctcccttccttttttctctttttcttgcttcttttatatctctttctttttttctgatcccaaacactttagagkctttaatttgagctagattctatgataagtgattgaagaatcaaagacatatttaaccttggggaaagtcataatgggaataaaggaaaaaacattaata

SEQ ID NO: 10464 - DNA, 201 bp, Homo sapiens
ttaaccttggggaaagtcataatgggaataaaggaaaaaacattaatataaagtattagtaaacatttctaaattactgatttcattaaaatatttaacartcttatgaaagactaaagaatcattttgagttcatctactaggcatggacaagccacttcaggaagtttaatatccttctttgtgcctttgggtttaatc

SEQ ID NO: 10465 - DNA, 201 bp, Homo sapiens
aactggatactgtagtggtggaggatgtctaacttcgttttgtgtttcacagagtttcaagagttttcctgtaagcctctttagtctttgtatatttaatrtgctccaatcctacttacatctcaactgtgttctttctgatggcgatggtgatgatagtgccaatcatttatttagcactaacaactgtgtgctcgacac

SEQ ID NO: 10466 - DNA, 201 bp, Homo sapiens
gtgacaaaaacaggagttacttttgcaccaacctgataactcttcaaaatgtttggtgaggctggactcaaacataagtgcatggatgcctgatttttttyccccagtattcaagaacctcagggttttcctgaatgtgctatagacattccagggacctcctaagttttgaacattgcattattatgaagattaggtcca

SEQ ID NO: 10467 - DNA, 201 bp, Homo sapiens
acacacacaccccagatttggcatgagaagaacaacgctgaagtcgatatctgcctattttgtttataatggtgtgaccttgggcaagtcacttaattttkcaatgtattttctcatctataagatgggagatatcttatatcctaaggctattgattatgtcagatggaatctcatctgagaaaataccttagaaattgt

SEQ ID NO: 10468 - DNA, 201 bp, Homo sapiens
ctgtaaatcctttaaaattttattatccatctcttcactggggaaatgtctagatacattttcctaagtggttccatctttctgtaaatggctattgaccygctgagtgcagttttgctttcagagaagcattgcacttggtgtgtgatttgagtttgggatcatgaccttatttcctttgcacttgattgctttacttca

SEQ ID NO: 10469 - DNA, 201 bp, Homo sapiens
aaaaaatttctgttgttttaagccagtgagtttgtggtaattttttaatggcagccatgagaaacgaatacaacaaggaacaggataatctacaaaatacrtgaattatacaagagcatcagaagtttgtggaaatttagtataaaaaacacctcttattgaaagtgtgattgttactatacagtcagtccagaagcactg

SEQ ID NO: 10470 - DNA, 201 bp, Homo sapiens
tggtaattttttaatggcagccatgagaaacgaatacaacaaggaacaggataatctacaaaatacatgaattatacaagagcatcagaagtttgtggaartttagtataaaaaacacctcttattgaaagtgtgattgttactatacagtcagtccagaagcactgaattatgaaaatatcattgcctggtatgtgtcag

SEQ ID NO: 10471 - DNA, 201 bp, Homo sapiens
tctcaatgtatttactccttcagtatttataacaatcaggaagctgtaattattgtccatattttactaatgaagtaactaaaacttagagaagataagcmatttgtctgaggtcatgctctagtagtgagcagagccagaatctgaactctggcatgatgactatagcgtctgtgtttttatgcattactgataggtatg

SEQ ID NO: 10472 - DNA, 201 bp, Homo sapiens
ttatggctggaatcatgttatctctgctctttcttgactattctgacacagcaggcaacttaatttcaacaactcggtaatgcccccatcttctgtgtgtgtgtgtgtgtgtgtgtgtgtgtgtgtgtgtggtgtttgctaagaaggagtcacacggctgcttttgaattcagctgggctttaggaagctgcataaaaaca

SEQ ID NO: 10473 - DNA, 201 bp, Homo sapiens
tatggctggaatcatgttatctctgctctttcttgactattctgacacagcaggcaacttaatttcaacaactcggtaatgcccccatcttctgtgtgtgtgtgtgtgtgtgtgtgtgtgtgtgtgtgtggtgtttgctaagaaggagtcacacggctgcttttgaattcagctgggctttaggaagctgcataaaaacaa

SEQ ID NO: 10474 - DNA, 201 bp, Homo sapiens
atggctggaatcatgttatctctgctctttcttgactattctgacacagcaggcaacttaatttcaacaactcggtaatgcccccatcttctgtgtgtgtgtgtgtgtgtgtgtgtgtgtgtgtgtgtggtgtttgctaagaaggagtcacacggctgcttttgaattcagctgggctttaggaagctgcataaaaacaaa

SEQ ID NO: 10475 - DNA, 201 bp, Homo sapiens
tggctggaatcatgttatctctgctctttcttgactattctgacacagcaggcaacttaatttcaacaactcggtaatgcccccatcttctgtgtgtgtgtgtgtgtgtgtgtgtgtgtgtgtgtgtggtgtttgctaagaaggagtcacacggctgcttttgaattcagctgggctttaggaagctgcataaaaacaaag

SEQ ID NO: 10476 - DNA, 201 bp, Homo sapiens
ggctggaatcatgttatctctgctctttcttgactattctgacacagcaggcaacttaatttcaacaactcggtaatgcccccatcttctgtgtgtgtgtktgtgtgtgtgtgtgtgtgtgtgtgtggtgtttgctaagaaggagtcacacggctgcttttgaattcagctgggctttaggaagctgcataaaaacaaaga

SEQ ID NO: 10477 - DNA, 201 bp, Homo sapiens
aagcacttgccgctttaccttgtgcttttatgttatagagatgatttctctccttaaacctcatgaaccaatatcttctagctttaaacttttttctgcakcttcctcacctctcttagccttcatagaattggaaatagtttgggccttgctctgggttaggctttggcttaagggaatgttgtggctggtttgatcttc

SEQ ID NO: 10478 - DNA, 201 bp, Homo sapiens
gacatgatttgtgttgccttcaaagaattacaataatgacatcaaagatcactcatcaaagatcaccatctcagatataataataatgaaaaagttttacrtgttgagagaattaccaaaatgtgatgtagtgacatgaatcaggcacatgcagttagaaaaatggtgtggattgacttgctcaaccaacggttgccccaa

SEQ ID NO: 10479 - DNA, 201 bp, Homo sapiens
agcacaagaatgagaaaagaaaggagacaggaaccatttacattaagcagagatgcataagtttcttaagtggtgctttccagagcacagctgggtttcgtgtgtgtgtgtgtgtgtgtgtgtgtgtgtgtgtgtgtgtgtgtgtgtctgatatatcaagctgtcggttatattccatagattcatagtattttcctcctc

SEQ ID NO: 10480 - DNA, 201 bp, Homo sapiens
gcacaagaatgagaaaagaaaggagacaggaaccatttacattaagcagagatgcataagtttcttaagtggtgctttccagagcacagctgggtttcgtgtgtgtgtgtgtgtgtgtgtgtgtgtgtgtgtgtgtgtgtgtgtgtctgatatatcaagctgtcggttatattccatagattcatagtattttcctcctct

SEQ ID NO: 10481 - DNA, 201 bp, Homo sapiens
cacaagaatgagaaaagaaaggagacaggaaccatttacattaagcagagatgcataagtttcttaagtggtgctttccagagcacagctgggtttcgtgtgtgtgtgtgtgtgtgtgtgtgtgtgtgtgtgtgtgtgtgtgtgtctgatatatcaagctgtcggttatattccatagattcatagtattttcctcctctc

SEQ ID NO: 10482 - DNA, 201 bp, Homo sapiens
actgacactaacatttttgaacccatctatgcccatttccatttttagttctacaaatgttctgacaccattttttaaaaaatcacaacaccccaaacagkgggttctatttttttttctattgttatagatgagtaaactgacacctaaagagggcccttagcttgtggctggcatctcaggaccaaaatgcctgcgttt

SEQ ID NO: 10483 - DNA, 201 bp, Homo sapiens
acaagtccaaggacatcaaatgactcgcccaacatcactagggcatgtgggctgaatgaggatgttcagtctggtcacatcaaaagccctagctcttttcsctataagctagaaataatattccatcccttttctcacctacctcccagcaaaaacaaatgacataaaaatatttttttctatctgcttctgctcatgata

SEQ ID NO: 10484 - DNA, 201 bp, Homo sapiens
ccaacatcactagggcatgtgggctgaatgaggatgttcagtctggtcacatcaaaagccctagctcttttccctataagctagaaataatattccatccyttttctcacctacctcccagcaaaaacaaatgacataaaaatatttttttctatctgcttctgctcatgatacctttaaaatgccttattcatcaattca

SEQ ID NO: 10485 - DNA, 201 bp, Homo sapiens
ttaaagatgaagcctactatggcagaccatccacatccacttgtgaagaaaacattcatcttgttcatttcctaattgaaaagcctaggttattaacagcrgaaacagtagctaacaccacagacatctcaactggttcagcctacacaattcttactgaaaaatttaagttgagcacactttctagttgatgggtgccaa

SEQ ID NO: 10486 - DNA, 201 bp, Homo sapiens
ctgcttggatttatactctgcctccacctctcactggcaatgtagctttgggcaagtcacatatcctctgtatataatttttctcatttgtggggtgcagrtataagtggtggctatcttggagggttgcaaagaagagcacttccttggccaatagtgtgccctctgtcatgaatatttccctgctatcattgtaactta

SEQ ID NO: 10487 - DNA, 201 bp, Homo sapiens
atcacttctgggcctttaaagttgctgcttttcccacctagagcattttcccccaagatagtcacagggctggcaacctctaatcttttagcagcttgaaygtcattcctcaaaaaagcctccctgactgctggttctgcccttgccctggtcactctctagccctgggctttatttcattttctttatggatcctatcac

SEQ ID NO: 10488 - DNA, 201 bp, Homo sapiens
ggatggtctgagagagagataaatatttaggccttaaggaaccacacacagttcccctggttgagccacaaattggtatgtttttttccttatgtacaggttttttttttattatactttaagttttagggtacatgtgcacaacgtgcaggtttgttacatatgtatacatgtgccatgttggtgtgctgcacccattaa

SEQ ID NO: 10489 - DNA, 201 bp, Homo sapiens
ggaaccacacacagttcccctggttgagccacaaattggtatgtttttttccttatgtacaggttttttttttattatactttaagttttagggtacatgkgcacaacgtgcaggtttgttacatatgtatacatgtgccatgttggtgtgctgcacccattaactcgtcatttagcattaggtatatctcctaatgctat

SEQ ID NO: 10490 - DNA, 201 bp, Homo sapiens
tccatttttacagcttccttacattatagatgatgttacctctaagatttttttcttttttcttttcctttcttttctttctttctttctttctttctttyttttttttttttttttttttttttgagacagagtcttgctgtgttgctaggctggagtgtagtggcgcaatctcagtccactgcaacctccacctcccgg

SEQ ID NO: 10491 - DNA, 201 bp, Homo sapiens
ggtataaattaaagcagtctggggaaacccaaacatatggtcaacctaatgatacctgttttcctgcataaaggggttataattgtactaatttatggtgyaaactgggtgctaaagctagtgatgagtttctctgctagaaaaatgttccaaagaaataaaccaagacagttaatgcagagttttggtagaagggataac

SEQ ID NO: 10492 - DNA, 201 bp, Homo sapiens
ggaacaaaaaacactggggcttacttcaggagggatggtagaaggagaaagaggagcagaaaaaataactattggatactagggttattaccttggtgatkaactgatctgtgcaacaaatcctatgataggagttcacctatacaacagacctgcacatgtacccttaaaccgaaaattaaagttaaaaaaaggaaagaa

SEQ ID NO: 10493 - DNA, 201 bp, Homo sapiens
ctgtgtgtaacagtcttgagctgctgatgaaagaaggtgtagaagagtgttggtgccaagatctggagtggagtggtaggatcctgacctggagcacccargaatgactgtcctttgtgcacaggtgatagacaaaactgggggaatgaggagttgaacatggaggtatatgaggaaggctcatccgctcttcagaaatcc

SEQ ID NO: 10494 - DNA, 201 bp, Homo sapiens
gaaggtgtagaagagtgttggtgccaagatctggagtggagtggtaggatcctgacctggagcacccaggaatgactgtcctttgtgcacaggtgatagayaaaactgggggaatgaggagttgaacatggaggtatatgaggaaggctcatccgctcttcagaaatccagaaacctaagtgtgaaaacacagatttgagg

SEQ ID NO: 10495 - DNA, 201 bp, Homo sapiens
tttgggaggccaaggcaggcagatcacctgaggtggagagttcaagacaagcctgacaaacatggagaaacctcgtctctactaaaaatacaaaattagcygggcgtggtggcgcatgcccgtaatcccagctattcaggaggctgaggcgggagaatcgcttgaacctgggaggcagaggttgcagtaggccgagatcac

SEQ ID NO: 10496 - DNA, 201 bp, Homo sapiens
ctgggaggcagaggttgcagtaggccgagatcacgccattgcactccagcgtgggcaacaagagcgaaactccatctcaaaaaaaaaaaaaaaaaaaaaaragagagagagagaaaagaaatatctgtgttaggaaaaaagctaggaaaagctaaattctggtcatttcataataaaacgaataatgaaacaaacagaaaa

SEQ ID NO: 10497 - DNA, 201 bp, Homo sapiens
atgccattctctgaaaatggcaatatacgcttacaattatttgtagcatagcattctacactaaaaagatgaaataaagaagttgaaattttctttatcarttaggatagctaatgatcttctgtggcaacaatcagcatgtcttacagcttaaaacaacaacgtttacttctcatccaccttacatcctatctttggtgt

SEQ ID NO: 10498 - DNA, 201 bp, Homo sapiens
tttttattttagttttacttgaaaaaagtataaattttgattttctgtattaaatcacttattcaaacaatgatttattcaacagaaagcattgaacactrtatttcttttctgacaaccacttctccaattctctgacaccaactgggtgcccaacaattttattcaattctgatactacctggagttagcacagatccc

SEQ ID NO: 10499 - DNA, 201 bp, Homo sapiens
tggagttagcacagatcccccaggttaaggactcagtctcacaagacttctgctactctagacaccagacactgtacatggagtgctcgggctacccacasttttgtgcagctgaccacaaattgggggttctcatgaccccctccacccctcagtttccataattcagtagagccactcacagaaccacgacatgttctt

SEQ ID NO: 10500 - DNA, 201 bp, Homo sapiens
ttcaaaggaatagcctttggccttgagtgctgcctcgagcccacaagcaccttctcatggttgagcacaccctattgcttgactcagtgaaatacattgawtatcctgccaacactttttgttgtacatctctttgccctcaggctagctacagaaagaaaaagagagagagaatacatttttacatttcctgttcttcat

SEQ ID NO: 10501 - DNA, 201 bp, Homo sapiens
aagaaaaagagagagagaatacatttttacatttcctgttcttcatgttgaatgaggcagtttatcttctgaacagctgctttgaaggtttgagtatgttmgatgcactaaacataacagcatagaaatgaaaaaaggaggttggcaaactaccttcttatcttcttttaaggcttttgaaggatttaagttgtttcacct

SEQ ID NO: 10502 - DNA, 201 bp, Homo sapiens
aggcagtttatcttctgaacagctgctttgaaggtttgagtatgttcgatgcactaaacataacagcatagaaatgaaaaaaggaggttggcaaactaccytcttatcttcttttaaggcttttgaaggatttaagttgtttcaccttttagtggcatcacagagaggttgagatttcacttagagagaatggctttgatg

SEQ ID NO: 10503 - DNA, 201 bp, Homo sapiens
agtctaaagatttgaaatttaaaagttttcaggctagagaacagaacttgatgtaatttctagaagtgaaataactcttgttaaaatcagatgctgctggyacgcaatccaaaagggattgtttagaccctagaagcttcaaataaattgagtctcagaaataggggggaattgagtcacacagttctgattgtttttgtc

SEQ ID NO: 10504 - DNA, 201 bp, Homo sapiens
tcaattgttaagcaacctatagagtttagagcagaaaaagctacaaaatgaagtaaatttttatagtggtttctagtgagaaacaatgtatgccctaggtrcagtgggccatggagaacatttattacattcttcttgtatgaacactgatatacgaagaaaataaaagctcagcttttgccttataacactacacttgcc

SEQ ID NO: 10505 - DNA, 201 bp, Homo sapiens
gcttggtgcactgaatcttgagaaatgatcttgaatgacctccaggatttaaatatagttattgaaaggggccgaaccaatgagatgattcacagcttccrcatggagccatctctatatgctaagtacgaggccagtcctcataaaaacccgccaaggagggcagtagcaccattgttaccagcacagactcctcccttt

SEQ ID NO: 10506 - DNA, 201 bp, Homo sapiens
ttaaatatagttattgaaaggggccgaaccaatgagatgattcacagcttccgcatggagccatctctatatgctaagtacgaggccagtcctcataaaarcccgccaaggagggcagtagcaccattgttaccagcacagactcctccctttcctagctgtgtgaccttaaggagaaatatacactccagaaatctgctg

SEQ ID NO: 10507 - DNA, 201 bp, Homo sapiens
ccagcacagactcctccctttcctagctgtgtgaccttaaggagaaatatacactccagaaatctgctgcttcttctctgaaaagggcacaacaatagtcrcccattgtagagaggattaatgggataattatattatgtaaaactcactgaagtattttgtttacatagggactattcaataaacataaaaattataatt

SEQ ID NO: 10508 - DNA, 201 bp, Homo sapiens
gctcatgcattttatgatcctatgtgggttatttaagctttttgtgcctcatctataagattgagaccattatgatattgatttcataggtactttgcagrcaggattacctatctgagagaaacttgatttatttctttgatgcatgcaaacttaagcttgccaatgctcatatttgtgcatttttccccacacaggaca

SEQ ID NO: 10509 - DNA, 201 bp, Homo sapiens
tttcataggtactttgcaggcaggattacctatctgagagaaacttgatttatttctttgatgcatgcaaacttaagcttgccaatgctcatatttgtgcrtttttccccacacaggacagtgcagtcgttaaggcaccatggttagtgtcatctctacatgcctcagcctatctcaaggtctcctttggacagtttgcaa

SEQ ID NO: 10510 - DNA, 201 bp, Homo sapiens
tccccacacaggacagtgcagtcgttaaggcaccatggttagtgtcatctctacatgcctcagcctatctcaaggtctcctttggacagtttgcaaatgartgcctgcctgagtctctatatctgagggagtcctctgcctgggggagcttatctgcccatgctcaagacatgagggctagaatttgtagataaatacaac

SEQ ID NO: 10511 - DNA, 201 bp, Homo sapiens
ccacagcaatagtggggttgttaaccagctttcctcccttctctgtctcactgccccacttcctcaatttgctctctgggatcttcccccaaataaatgayatgctcccaaatccttgtctcaaggtcttgttttaggaggaaccccaggcaaaggtagttacagattttagagcaggacttcctcctgcaaattctgact

SEQ ID NO: 10512 - DNA, 201 bp, Homo sapiens
atgtcatggaggtttgttatacagattatttcatcacccaataattaagcctagtacccattagttatttttcctgatcctcttcctcctcccaccctctrccctccaaaaggccccagtgtgtgttgttcccctctatttattcatatgttcacataatttagctcccacttataagtgagaacatgcagtattcagttt

SEQ ID NO: 10513 - DNA, 201 bp, Homo sapiens
ttctctctgtatatagtcacagagctccagggcatgtagtacttagaattttgtttttgctcattgcacaggaaatggtatgaaactgaggtaattcatasacacataatttgaatataaagaagaaaatgatagaggcatctggatgacctgatatttaatatagtaaaaggaaaatgttttcctaagcaaaatgagtgg

SEQ ID NO: 10514 - DNA, 201 bp, Homo sapiens
attaattaatttttttaaaaagccaaggaaatcatttggctagagagtgtgagcttgagaattggatagaagtaggggaagttaggctctgtggcactggstggtggaaagtctgcagtcagcactttgatcaggtcaaacccagtaatatttttgaactcttatttttctctgtcaggtgccagcaagcaaaactgagta

SEQ ID NO: 10515 - DNA, 201 bp, Homo sapiens
tttgatcaggtcaaacccagtaatatttttgaactcttatttttctctgtcaggtgccagcaagcaaaactgagtaaggaaataatagtttatggccttayattttagttagtttgagtacctgttgacaggtggtccaatttttgtgtttaatttagaagaaattctgaaggatgaggtttaataatcacaattgaagta

SEQ ID NO: 10516 - DNA, 201 bp, Homo sapiens
aaggaaataatagtttatggccttatattttagttagtttgagtacctgttgacaggtggtccaatttttgtgtttaatttagaagaaattctgaaggatraggtttaataatcacaattgaagtagtggatatgggatcagagtctgattgcattggatacaatattccaagatcactgaatgatacaactcctgcaaaa

SEQ ID NO: 10517 - DNA, 201 bp, Homo sapiens
acttgtacagtaggactaaagcagacaagcatagaatgcatgccattaattcttagccttgaggcataccttctcaataattaggagaatgaaaagaggtrttttttatatatccttccacctttatatatattttttattgttcaatgaagtagaaccctgtataaagaggagttcagggaatctattaaaaatccaggg

SEQ ID NO: 10518 - DNA, 201 bp, Homo sapiens
ttgtgtgttgcctgagggcaggagcaatgtcatcctttttgactttctggcacttaaaacagaatgtggctcatagttggaggtcagtacatatttgaatrgaagaatgcatgaaaatataaacgttagactcttcccttatggttattgttttagtttataaagtagatgtaaatatagcccaagataacatagcaattt

SEQ ID NO: 10519 - DNA, 201 bp, Homo sapiens
gcaatgtcatcctttttgactttctggcacttaaaacagaatgtggctcatagttggaggtcagtacatatttgaatggaagaatgcatgaaaatataaaygttagactcttcccttatggttattgttttagtttataaagtagatgtaaatatagcccaagataacatagcaatttggcaattctccatgaattttctg

SEQ ID NO: 10520 - DNA, 201 bp, Homo sapiens
cagaatgtggctcatagttggaggtcagtacatatttgaatggaagaatgcatgaaaatataaacgttagactcttcccttatggttattgttttagtttrtaaagtagatgtaaatatagcccaagataacatagcaatttggcaattctccatgaattttctgtaatagaatatttcagtaagcacagtatacttcctg

SEQ ID NO: 10521 - DNA, 201 bp, Homo sapiens
tgttttttattttaagtggtaaagttgctcttttaattcaaatttgttttttaattgacttataaacttgtatgtatttatagtgtacaacatgatgcttygaagtgtcaataatcaaatggttaaatctagctaatttaatcataatttaaatagctagatctaaccattttgttattgacacttcaaaacacacaaaca

SEQ ID NO: 10522 - DNA, 201 bp, Homo sapiens
tgtatttatagtgtacaacatgatgcttcgaagtgtcaataatcaaatggttaaatctagctaatttaatcataatttaaatagctagatctaaccatttygttattgacacttcaaaacacacaaacacacataatgaaatggtcaaatctagctaattaacaaatacattacctcacatagttatcatctttatggtga

SEQ ID NO: 10523 - DNA, 201 bp, Homo sapiens
cactgaacttctggctctagaatagagaccctgctaaatgtatcatctctcagcagtccatttctattaagtcttattctttaaaggccatgaggtatttktaaacacgagagctttccaaactttcattaaaggaaagtgtccctttcccagacaatgcttccagctcagtcagatgcccaagcatgaccagaaggagac

SEQ ID NO: 10524 - DNA, 201 bp, Homo sapiens
catggatgaagagaacccagggggtgtctttgcacacatgatgctctaaagcattttcagatctcctctatgggcccagcaagagtgctgtttctgaggargaaggcagattgctggacggattcacaaaccacggcagctccaactctcctaccgatgcctttactccaggtgcctcagccagtagcaacaggtctccct

SEQ ID NO: 10525 - DNA, 201 bp, Homo sapiens
gctaaatgatgagttaatgggtgcagcacaccaacatggcacatgtatacatatgtaacagacctacacgttgtgcacatgtaccctaaaacttaaagtgtaataataataataataataataataaaagaagaaatagacaatgggcttaagtgttcactcacctcctgtgcttccctgggcctacggttatggctccta

SEQ ID NO: 10526 - DNA, 201 bp, Homo sapiens
ctaaatgatgagttaatgggtgcagcacaccaacatggcacatgtatacatatgtaacagacctacacgttgtgcacatgtaccctaaaacttaaagtgtaataataataataataataataataaaagaagaaatagacaatgggcttaagtgttcactcacctcctgtgcttccctgggcctacggttatggctcctag

SEQ ID NO: 10527 - DNA, 201 bp, Homo sapiens
taaatgatgagttaatgggtgcagcacaccaacatggcacatgtatacatatgtaacagacctacacgttgtgcacatgtaccctaaaacttaaagtgtaataataataataataataataataaaagaagaaatagacaatgggcttaagtgttcactcacctcctgtgcttccctgggcctacggttatggctcctagg

SEQ ID NO: 10528 - DNA, 201 bp, Homo sapiens
aaacttaaagtgtaataataataataataataataataaaagaagaaatagacaatgggcttaagtgttcactcacctcctgtgcttccctgggcctacgkttatggctcctaggcatatgggagaggttgagtcagtcactgtggcttagaggctgcagtgccttatcaatttctggcattgaattatgactagaatttg

SEQ ID NO: 10529 - DNA, 201 bp, Homo sapiens
tggttccagaacttcaaaggaactcaaatttgaggatgctcaaatccctgacaaaatggcatagtatttgcatgtaacctatgcccaccctctcacatacygtaaaatcatctctagattacttgtaataaataatacaatgaaaatgctatgtacacagttgttactgtttcgagaatattgacaaggaaaaagttctgc

SEQ ID NO: 10530 - DNA, 201 bp, Homo sapiens
tcactataaaagacgccagaggaaaaaagagtacatattgtatggttacatttatataaatctaaaaaatgcaaactaatctctagtgacagaaaacagawccctggctgctagaggagcagggagaggaagggagtacaaagagccatgagaaaacttttgaggataatgtatatgttgcttatcttgattgtgttgatg

SEQ ID NO: 10531 - DNA, 201 bp, Homo sapiens
ttactaaaaatacaaaaaattagccaggtgtggtggcaggcacccgtaatcccagctactcgggaggctgaggcaggagaatcacttgaacccaagaggcrtaggttgcagtaagtccagatcgtgccattgaaaaaaaaaaaaaaaaagaaacaaagaaaagaaaagaaaaagaaaaaaatttctagtctctctgatctc

SEQ ID NO: 10532 - DNA, 201 bp, Homo sapiens
acctgatgtttttagtttgctggcttcagtttcttagaggcaccctattgggccacatgagagattatagaattatgttgtgatcatggtgggctattatytctgcaaactctcctgacaccatcagtgcaccaggaaggttggataatcctacgtggatgtggagaaatctcaacctttttttatttgacattaggattt

SEQ ID NO: 10533 - DNA, 201 bp, Homo sapiens
agtttaacagtcaagaatgtggttctttaggacattttctctttagtgtgcctggagcttctaaatcttatttaaaccttctttttgaaatagatgttgcrtatctttggctgtaagaggaagtcaggacttgttctctctgcttccagacccactccccagccatgtagactttatatttgaaggtccagagtgattttt

SEQ ID NO: 10534 - DNA, 201 bp, Homo sapiens
ggacattttctctttagtgtgcctggagcttctaaatcttatttaaaccttctttttgaaatagatgttgcatatctttggctgtaagaggaagtcaggasttgttctctctgcttccagacccactccccagccatgtagactttatatttgaaggtccagagtgatttttcttttttttttttttttgagatggagtct

SEQ ID NO: 10535 - DNA, 201 bp, Homo sapiens
gtggcgcaatctcggctcactgcaggctccgccccctggggttcacgccattctcctgcctcagcctccggagtagctgggactacaggcgcccgccacckcgcccggctaattttttgtatttttagtagagacggggtttcaccgtgttagccaggatggtctcgatctcctgacctcgtgatccgcccgcctcggcct

SEQ ID NO: 10536 - DNA, 201 bp, Homo sapiens
ctcggctcactgcaggctccgccccctggggttcacgccattctcctgcctcagcctccggagtagctgggactacaggcgcccgccacctcgcccggctrattttttgtatttttagtagagacggggtttcaccgtgttagccaggatggtctcgatctcctgacctcgtgatccgcccgcctcggcctcccaaagtgc

SEQ ID NO: 10537 - DNA, 201 bp, Homo sapiens
gaaacactggtcctgttacaccattgccctcctggggagacacaagggcaagtatatctggccatagctatcacttgccaattagcctggtgactagatayatgttttatctctatgtatcaaccagagcaaatgtggggccagaatgggaccaaaatggatgtcaccaatgggttgaccagtttagggatgaaggagtca

SEQ ID NO: 10538 - DNA, 201 bp, Homo sapiens
ctttttatctttgttcagcacacacgtgctctttttattttctctatgtctcacagctctcagagattatcaatttgctccctacgctttaatccattctrtaagttccatccaactttttgttgcttgctatgacaaaatcgaataatcttaaataatgcagcaaacacacgttgcagcctgtttaagatattttaagag

SEQ ID NO: 10539 - DNA, 201 bp, Homo sapiens
tttattttctctatgtctcacagctctcagagattatcaatttgctccctacgctttaatccattctataagttccatccaactttttgttgcttgctatracaaaatcgaataatcttaaataatgcagcaaacacacgttgcagcctgtttaagatattttaagagttctttttgatctaggagataaaacacaaagtt

SEQ ID NO: 10540 - DNA, 201 bp, Homo sapiens
cagtacagcaggttcttgtaagcaggttcttaaaatctcctcctggctacatctttagactcatttcctacctctcataaaaatgccctccactaccctaygacacggaagtactcgacatttgctgaacttgcatgctctcttaatctctatacgtggcagtttttaaaatctcttgtctacctggagcactagttctgc

SEQ ID NO: 10541 - DNA, 201 bp, Homo sapiens
aaaaagcataagctttgctttctctaacaagtattacttgaacaccactatcttcttaaccccaaactcagacccaaatgtgcatgtatatatgcacacayacactcccaatagcttctctctttccctgtgttccttaggtataatgcaaagaactcatagtagtattaaagcacttaaaacattgtattacatttttat

SEQ ID NO: 10542 - DNA, 201 bp, Homo sapiens
agccaacataagaagagttaccctaacagaatatagaccacagagttcttcccttcaagtatggattcatcatacatccttcaaacctgccaagtacttcrctttctttctctctaccaacctgcttcttaccaaccttctaaagtcctgttcttgattcaccctaggctcacctataaccttcagaagccctgtctctga

SEQ ID NO: 10543 - DNA, 201 bp, Homo sapiens
aggaaatttgaaatagaaaaacagagctgaggaaagaaataaagatgaatcaaaaattaaattggagttatatgatggttcagggagcaacacatgtgtaragaaggaaatgagaggctggaactttggggaatcccagagttaagtaatagacaggggaagaggcagggaggggaggttgctcatgaaagttcatacatg

SEQ ID NO: 10544 - DNA, 201 bp, Homo sapiens
gcttctgtgagtggagtgaaatttaaggtgcctaaagaaagctaacaggaaaagtctgaaggttgagaaaagaagcaagatcactgttaaaaaaaaaaaatatatatatatatatatatatatctcaaagaatctagaaaaaggataggaagtggagtcagaggagagtttagtcttggacaaggtggcagggtccttact

SEQ ID NO: 10545 - DNA, 201 bp, Homo sapiens
gacattccagagtttccttgtgagttacaggtttggttaggagggaagtggagctaactgttgaagaatagagattggccaaatctctggaatttcagaarcatcaactttgggaaacggaatttgctaatggagtggagtctgatgcagttcttcacttattttcttctggtatgcagaccaaaattatctgagaatgat

SEQ ID NO: 10546 - DNA, 201 bp, Homo sapiens
agtaaaatgaagggttattctttattgttctcagaaaggtggtttgagaatcacctgtgtggtgggctaagtattgtttcctaaaaatttgatgtctaccyggaacctcagcattgtgacctgatttgtaaatagtgtctttgcacatgcaattagttaagatgaggtcacactggattatggtgctccctgattcctatg

SEQ ID NO: 10547 - DNA, 201 bp, Homo sapiens
aactaggaagggacaaaaatgattctcccctggagcctttatgacctgctcacaacttgattttagacttctcaccagaactgaaagataacatattttcrttgaaagctactaagtttgtgataatttgctacagcatccctaggaaagtaataccacctgcatccggaatatcaggaatcttattaaaatgccacttca

SEQ ID NO: 10548 - DNA, 201 bp, Homo sapiens
aatcttattaaaatgccacttcatagtatccatcccagatcttctgaatcagaaatactgagactagagccctgagatttaaactattaacattatttatstttcttatgaagttttaaatgtgagaaccactggcctaaatgatgccttaacagctctgaacaatctgaaagttaaaatgacaggactattttatgcata

SEQ ID NO: 10549 - DNA, 201 bp, Homo sapiens
gaatcagaaatactgagactagagccctgagatttaaactattaacattatttatgtttcttatgaagttttaaatgtgagaaccactggcctaaatgatrccttaacagctctgaacaatctgaaagttaaaatgacaggactattttatgcatatagacgacatctcccccggtgaagtgtgttacttcccatcctata

SEQ ID NO: 10550 - DNA, 201 bp, Homo sapiens
gcaattaggttatgcaacattgggcaattgactgaacttctttctgtgtcagttttctcaagggtaaaatgtggttgttaatgggacccatgtgttagtcmgctctgctcagttatgctgcagtaacagatgcctccctggaatcctagtgacttaaatgagcagagctttatttcccaccggcattaatattcatcctag

SEQ ID NO: 10551 - DNA, 201 bp, Homo sapiens
taatattcatcctagttctgctgcagtgcttcttcatgcctcttcatttctggaccctgcctgaagaggcagctctgatttgtcgcatcctggatttgtgrccaagggaagagagctagcagagccatgtggtggccctcagaccttctaagtggttcacactatttctgctcacattttcttggctgtgaagcacataag

SEQ ID NO: 10552 - DNA, 201 bp, Homo sapiens
tcacattttcttggctgtgaagcacataaggcaaaatgcctgacataagaggcagaaaatgtaaccctccagaaagggtggacctattcggaagaggctgrtaggaaaagacagcaaatattgtcaaaaataatgtaatcaaccacagcaactttatgggattgacgtgagtattaagtaagttaacataggtaaagcact

SEQ ID NO: 10553 - DNA, 201 bp, Homo sapiens
tttcttggctgtgaagcacataaggcaaaatgcctgacataagaggcagaaaatgtaaccctccagaaagggtggacctattcggaagaggctggtaggaraagacagcaaatattgtcaaaaataatgtaatcaaccacagcaactttatgggattgacgtgagtattaagtaagttaacataggtaaagcacttagaat

SEQ ID NO: 10554 - DNA, 201 bp, Homo sapiens
cagaaagggtggacctattcggaagaggctggtaggaaaagacagcaaatattgtcaaaaataatgtaatcaaccacagcaactttatgggattgacgtgmgtattaagtaagttaacataggtaaagcacttagaatagtgtcttatgactattgtctggtggtctattattaacggggtcttgtgcaagtatgtgaaga

SEQ ID NO: 10555 - DNA, 201 bp, Homo sapiens
gaatatgatgccaggcggcacgtgatgcagggtctgctggaagcgcatacaaatatgatatttttcatactcactttcatttacaatatacacatttaacttttttttttttttttttttttttgctttattaataggttctgtatgctaggcctgtaccctggtcttacaaatactttaaagaaagcccaggttatactc

SEQ ID NO: 10556 - DNA, 201 bp, Homo sapiens
aatatgatgccaggcggcacgtgatgcagggtctgctggaagcgcatacaaatatgatatttttcatactcactttcatttacaatatacacatttaacttttttttttttttttttttttttgctttattaataggttctgtatgctaggcctgtaccctggtcttacaaatactttaaagaaagcccaggttatactct

SEQ ID NO: 10557 - DNA, 201 bp, Homo sapiens
ctgtgagaacaaaccagagaggaaggatttttcagacaggctgactagggtttgagtcccacagctgtatgaccttgacaggtcacagagctttgctctgyctcttgattcctaaagctggggtatagtagatcagctgcatgctacaaaactaaatgagaccacgtatgcaaagcaactggtacttctttatatatggta

SEQ ID NO: 10558 - DNA, 201 bp, Homo sapiens
aaccagagaggaaggatttttcagacaggctgactagggtttgagtcccacagctgtatgaccttgacaggtcacagagctttgctctgtctcttgattcstaaagctggggtatagtagatcagctgcatgctacaaaactaaatgagaccacgtatgcaaagcaactggtacttctttatatatggtactttcattccc

SEQ ID NO: 10559 - DNA, 201 bp, Homo sapiens
ccctccatttcttctctccccctcaacccatccactcatttgtttatttaatttattcagttttatttatttgctcactagtttttttccaatacattgarcaccctcttggtgcaatgtgccatgcttagttgttggggattacaaaggtagaatattctacctcaaagggcatagaagtgaatttttttttttaaaaaa

SEQ ID NO: 10560 - DNA, 201 bp, Homo sapiens
caaaaaggtcaattcacaagaatacagacttaaattagaaatgtattaggggatggtaggcagcaggtcttatggcatatcctcgttagaatctctttagytcaatcacattcagcttcaaaatctgtgactttagtgataaacagtaagatcacacgatcagactcaaaagcactataatacctaaaaatcattgtaaga

SEQ ID NO: 10561 - DNA, 201 bp, Homo sapiens
aaacaagagtagaatcaatatccacaaaaggatcttcctgcctatccctgagaaaattgcccttatctcttgaaaagtggtttcatggagagagattatcrcaagaaagcttgagcctgtccccagcttaccactgctgagcactgctgtaaatttatggcttgaggtagaggtttggcaatacattggggacaatattct

SEQ ID NO: 10562 - DNA, 201 bp, Homo sapiens
agagcttccagtatgtgttgaagagctttcaggtttgtaccatgtcattaggacttcatgtgatctggactctgcctacatcaccagctttgcatgattgrctccttcctaaatgcaccttctcagagaagccttctctgatcatctcatttagtatctttctacccaaccaactgctcaggacaagagtagagaagtcac

SEQ ID NO: 10563 - DNA, 201 bp, Homo sapiens
agaagtcacctcaaagaggccttcctggaacattctacaaagtagccagtcctcagtcctcactccctacccccaactgcttttcatcgtattaccctgcyttattttagatagggttgacagaactcaaccctatctaaaattatctcatgttccttaatttgtgtattgtctatcagattttctcaccccaaagtagac

SEQ ID NO: 10564 - DNA, 201 bp, Homo sapiens
tcatgttccttaatttgtgtattgtctatcagattttctcaccccaaagtagactgtaaaccatgtaaggcaggacccgttctgtcttgtttatctttttrtcctccacaatgaggatcagaatgagcatcagaatgtgaccacagtgcctggttgccttctgatgctcaattagcatttgtgaaagatgtgaatagatag

SEQ ID NO: 10565 - DNA, 201 bp, Homo sapiens
tgtagaagacttcaagaaaaatccctgcaccttccacacctgttgtaggaggtatggcagctattcctgagccttaagtactccagtaagaatgaaatgawctatttgaggtgttctgccaaacgggctctaaaaataattatgatttaaaatgttttttttttccagtgaatatgaacgctttaaaactaagtttgtaaa

SEQ ID NO: 10566 - DNA, 201 bp, Homo sapiens
cctctttgaataaatagaaagatgttcaggtaaaaccaagtgattatgatacagatctcaccccctccctccccaacctccacccaagcaaaagtttccartggttccccatacacttttggaaacagagctttgtggcatatggaaggaatttctaccccctgcgtatgagcaaacccatctggtttagttggtttggcc

SEQ ID NO: 10567 - DNA, 201 bp, Homo sapiens
ttactattgtgatttctatggtcgtgaatcctagtaggaccctgtgttaatggaaatgtcaagttaaggcatatgtgttgcaaagttcttttctcgtcctrttggtggatactctctaaaagccagactggtgtatcatgccaaatggccaaattattctatagaaaaaatactatggtaaatttcctatatcttaaagga

SEQ ID NO: 10568 - DNA, 201 bp, Homo sapiens
aaatactatggtaaatttcctatatcttaaaggaattcgtctggattctaaaactttgagagattaatgactgctaactacagcttcctgtaaatgattgyttactgccattggcatttgaaaaccttatatctaagataaaagaaggcactatttttttcattactgtaccattatcctttatgtttgaattgagacttt

SEQ ID NO: 10569 - DNA, 201 bp, Homo sapiens
tctttggcctggtgggatttacatttagaatgtggaaagaaacattcagagctccacacaatcaataagtatttcctaagagtctgttctatgtcagcagyatgctagaattgcagaagataaaatggaaacagatgagattacctgtttcctcaaataatgaaccaattaagcagatcagataggactctggtatttgaa

SEQ ID NO: 10570 - DNA, 201 bp, Homo sapiens
agtatgctagaattgcagaagataaaatggaaacagatgagattacctgtttcctcaaataatgaaccaattaagcagatcagataggactctggtatttsaaaacaggaccaaaatatataatgagattctaattttgatgggtgagattacaatttgtcaatcagaagagagaattacccatttgggctggagaaatca

SEQ ID NO: 10571 - DNA, 201 bp, Homo sapiens
ccaccacgcctggctaattttttgtatttttagtagagatggcgtttcaccgtgttagccaggatggtctccatctcctgacctcctgatccacccgcctyggcctcccaaagtgctgggattacaggcgtgagccatcgcgccaggccttacatgctatatcttataagtcttccctctctgatattctagagcaggaca

SEQ ID NO: 10572 - DNA, 201 bp, Homo sapiens
agcatgaatattctgtaatttggggtcttataatttaattttatattcatgagcctgagtttctatacttctggaatcaggaaatatagtaagatatgtaygtgcatgtacaggtgtgtgtgtgtagagaaggatagcctgtggattaaggaagagcgtctaggcacatatccagtgcccagtaggcattagaaactgtta

SEQ ID NO: 10573 - DNA, 201 bp, Homo sapiens
tttgtaaattgcactttcttttaccactaataattaaaaagcagggccaagtcacgaaatgccattatccagtaatttgattttttgaaattaatgaaackctttcattttcagacgtgtccccccaaccccccgaacttcactgctgatggaagaaagcagccagaaggataaagaaatttgagaggggaaaagtgctgt

SEQ ID NO: 10574 - DNA, 201 bp, Homo sapiens
ttgctgagctcttagttttgaccaggaacctcatgtgtggaaatggtgaggacccaaaccttgaccccaaagcaaatgtctcaaatacaagcccctccccscagaagttaggaatgctggctgtgctcagacccctctggtagccactgggggacatatagaagacacaagaggtggcctctacttaaaaagagcccacat

SEQ ID NO: 10575 - DNA, 201 bp, Homo sapiens
agcacagtgcttgccttatatggaattttcagtagtcttggttttggcttgttatctttctccccagttacttctctttcccctgaagtttgaaagaagckgctgtgaggtatgaatatatttgccccttaagtagaaaggaggttcagtttgcagacagcattcagaggagatgagtgaaaggtttccatcactactatt

SEQ ID NO: 10576 - DNA, 201 bp, Homo sapiens
gcaataatatacttattttttgaagtcttcatcaacaaaggagtaaattcgtttagcacacagtgaagccaattctttttctttcctttttctttctttctttttttttgagacggactcttgctttgtcacccaggctggagtgcggtggcatgatgtcgactcactgcagcctctgcctcctgggttcaagcagttctt

SEQ ID NO: 10577 - DNA, 201 bp, Homo sapiens
tctttttctttcctttttctttctttctttttttttgagacggactcttgctttgtcacccaggctggagtgcggtggcatgatgtcgactcactgcagcytctgcctcctgggttcaagcagttcttctgcctcagcctcccaagtagctgggactacaggcgtgtgccaccacgccaggctaatttttgtatttttagt

SEQ ID NO: 10578 - DNA, 201 bp, Homo sapiens
cccatcattttccagcccagctccccttcctggtaggagtagctatagccaatttgacagtagatgtttctttcagtcactttattaatttagagcatgcraatttagattatgttgctttgtattttcacagcctgtctgatttttaacactaagcaattttatttcctagttatttgttagcagatttatgttgcattt

SEQ ID NO: 10579 - DNA, 201 bp, Homo sapiens
tttccagcccagctccccttcctggtaggagtagctatagccaatttgacagtagatgtttctttcagtcactttattaatttagagcatgcaaatttagrttatgttgctttgtattttcacagcctgtctgatttttaacactaagcaattttatttcctagttatttgttagcagatttatgttgcattttgattttt

SEQ ID NO: 10580 - DNA, 201 bp, Homo sapiens
ggagtagctatagccaatttgacagtagatgtttctttcagtcactttattaatttagagcatgcaaatttagattatgttgctttgtattttcacagcckgtctgatttttaacactaagcaattttatttcctagttatttgttagcagatttatgttgcattttgatttttatatttaagttaaccaacatctttttt

SEQ ID NO: 10581 - DNA, 201 bp, Homo sapiens
taacatgtaaatctaatttttgtgcttatagggaatataagaaattttatttttatttttttagagacagcatctcgctgtgttacctaggctggagtgcrgcctcaaactcctgggctccagtgatcctcctaccttagcctcctgaatagttagcactataggtacatacctctatgcctggctaatatttttttttta

SEQ ID NO: 10582 - DNA, 201 bp, Homo sapiens
gaaaagcttatttttgcaaaagagggctatgatttgtattgcatctaattcttgagtattactaactacaaccacccaatttataccaaaagatgaaacayaaatattttaaatcctaccattagcccatatatgcaagtttttagaagctgccctttcctcaagacattttactaccatgtattagaaaatagtcaaaac

SEQ ID NO: 10583 - DNA, 201 bp, Homo sapiens
atttataccaaaagatgaaacataaatattttaaatcctaccattagcccatatatgcaagtttttagaagctgccctttcctcaagacattttactaccrtgtattagaaaatagtcaaaacaaaaaaccaaaacaaaaaccaaaacagattaatggttgatgatgaatttaaaagtcacccccttatgttttgtagtgt

SEQ ID NO: 10584 - DNA, 201 bp, Homo sapiens
aatttttgagatggtatatataaaatgaatgacacataataaatattggtttcctttttttgcagggtagaaactcaggtgcttatctcatttatgctgtyccccccccccccccagctatcttattccttatctgatgaattatctcaagtgtatcaaactagttgacatggtcaccacatcctttactcattctctttt

SEQ ID NO: 10585 - DNA, 201 bp, Homo sapiens
atttttgagatggtatatataaaatgaatgacacataataaatattggtttcctttttttgcagggtagaaactcaggtgcttatctcatttatgctgtcycccccccccccccagctatcttattccttatctgatgaattatctcaagtgtatcaaactagttgacatggtcaccacatcctttactcattctcttttg

SEQ ID NO: 10586 - DNA, 201 bp, Homo sapiens
gatggtatatataaaatgaatgacacataataaatattggtttcctttttttgcagggtagaaactcaggtgcttatctcatttatgctgtcccccccccycccccagctatcttattccttatctgatgaattatctcaagtgtatcaaactagttgacatggtcaccacatcctttactcattctcttttgctaattac

SEQ ID NO: 10587 - DNA, 201 bp, Homo sapiens
tagtaggtactcgataaatggtaggcttattgtttacaaatattattttatgtcaaacatctaataatactgcatgtctacccatgcagcacaacaaaccrtgctcagcctgttcctgtagatgatccactgtctcttgagatactaaatgaattttacaggtcttcctgaatccaacaattctttgcagtgtaaacaatc

SEQ ID NO: 10588 - DNA, 201 bp, Homo sapiens
tatagtgtttagaagattgtagaatggcagtaattccatttatcctggaataattaatcatatgaagtcaaatcacaatataagagcacatattagaaagygtaagatactggtcaaatgttacagaatttttattatgccatcagttcttcagatttaaaagttaacaggaatcatccattaactctatgtcagtgtttt

SEQ ID NO: 10589 - DNA, 201 bp, Homo sapiens
acctcacttaagagagttttaagagaagcagtaagagcatcagcaaaaagaaattacataacgagttggggaaaatgtccctatccctatctacagctctrtgtgcagtttggcattactcatcacatgcattacagagagctccgaccttcctctgagtatggttgattgttcaaagccggatattgtggcttgatggct

SEQ ID NO: 10590 - DNA, 201 bp, Homo sapiens
tgtcattggaagtttgtaccactgtgaataagcccttgcaagagatcccaggagcattttagggttctgtgtaagatggtggggaggtaaagggagagcamaaaacactggagacactgcaaaaaggcatcatttttattctgaatctcttgtgtagagcatgagacccccaagaaggcctttgagcattaggtagtatga

SEQ ID NO: 10591 - DNA, 201 bp, Homo sapiens
actgcaacctccacctcccagcttcaagcgaatctgctgcctcagcctcccaagtagctgggattacaggtgcccaccaccatacctggctaatttttgtrtttttagtagagatggggttttaccatgttggccaggctggtctcgacctcttgatctcaggtgatccacccacctcggcctcccaaagtggtagcaaaa

SEQ ID NO: 10592 - DNA, 201 bp, Homo sapiens
aagcgaatctgctgcctcagcctcccaagtagctgggattacaggtgcccaccaccatacctggctaatttttgtgtttttagtagagatggggttttacyatgttggccaggctggtctcgacctcttgatctcaggtgatccacccacctcggcctcccaaagtggtagcaaaattatttaaaaacttgctaatttagt

SEQ ID NO: 10593 - DNA, 201 bp, Homo sapiens
atttttgtgtttttagtagagatggggttttaccatgttggccaggctggtctcgacctcttgatctcaggtgatccacccacctcggcctcccaaagtgstagcaaaattatttaaaaacttgctaatttagtactcttcagctctcaagtatgagtagcaaaaaagaaaaaaatcttgaaactagtatttgattttatg

SEQ ID NO: 10594 - DNA, 201 bp, Homo sapiens
aaagaatatacactagttaggacttaaagtcagaggaagctttacaatagctttcagtttcaaagtatagagggcccttgtggcaatactgttgttttagwcattatgtttaattgtcaagaaagatccactatgtatttctctgtaaatggaagagagagagaagggggcaggactcaatctgaatgcaagacaatccaa

SEQ ID NO: 10595 - DNA, 201 bp, Homo sapiens
ccttgtggcaatactgttgttttagacattatgtttaattgtcaagaaagatccactatgtatttctctgtaaatggaagagagagagaagggggcaggaytcaatctgaatgcaagacaatccaaggagattgaagctccttaggactggatttagcggattaaactagacaactacatctcttccctgactttactatc

SEQ ID NO: 10596 - DNA, 201 bp, Homo sapiens
attcttgtaatgacttgacagtctctttgtttgtggcaggagctgctttttttttcgattatttggggccgtcttactctttccctgttttataggaaaarcttttagttttttgtttcctaacattggggtgtggactattactcacaagctggctttttcagctacaacctgtgagtatagatagtactaattaccatg

SEQ ID NO: 10597 - DNA, 201 bp, Homo sapiens
acaagtatgttttagatggatgaacgatggaagcacattcgagagcttggcttaattgggaatctacaagaagctcaatgtggctgaaataatgtgtgtgkggggatatgatagcacatgaaatgggagtggtaggatagagacaggtaatgacagacttttcctgtaaggagttggactttatcccaaggatgctgtgag

SEQ ID NO: 10598 - DNA, 201 bp, Homo sapiens
ataaattatgagaaataaaagaataactcttttttgtattaggtgattaattagaatcttcctattccatctttaattataacttctcttagcaggttttrtttctgatgtttaatgactttttttctagaaatgtaaggtgtccctctgcccagatggtgaacacgtggtcaggggatccaggatccattggatctgggt

SEQ ID NO: 10599 - DNA, 201 bp, Homo sapiens
tgtttaatgactttttttctagaaatgtaaggtgtccctctgcccagatggtgaacacgtggtcaggggatccaggatccattggatctgggtgctaagtrctggctattttgagaaagtcaatcaatgtattgggttcagatgccttggaaatctcaagattctttaaaggcattttagaacagagttagaattagtcaa

SEQ ID NO: 10600 - DNA, 201 bp, Homo sapiens
ttgtatcacattctccattgtattttttgttataaaatatagtacttgacctactataagttcctcaaaatgctttctattgtggaaaataataagagagwcataaattgcagtgaacttcccattattgttcttgtgtccttttcctccacattatacgagagaggcgtacaacacaactgtgtcagtgtggcacactac

SEQ ID NO: 10601 - DNA, 201 bp, Homo sapiens
attctccattgtattttttgttataaaatatagtacttgacctactataagttcctcaaaatgctttctattgtggaaaataataagagagacataaattrcagtgaacttcccattattgttcttgtgtccttttcctccacattatacgagagaggcgtacaacacaactgtgtcagtgtggcacactaccaaaatgca

SEQ ID NO: 10602 - DNA, 201 bp, Homo sapiens
tgattattgtcctttctagcagaattgctgatgatctttattgagagtctccttgatgaaggcatacactaaggacttggcaggttgtatctccattgtgrctacaaccttagctgatagatactgttgtctgtttcataggtgactttataggtcttgcatatgttctttcatttaatcttcacaccatatgatgcagta

SEQ ID NO: 10603 - DNA, 201 bp, Homo sapiens
atttatatacatatgtataaaaataggaattggctcacatgattatggaggccaagaaactccacagtccgctgtctgtatgctggagaataaaacagttkgattctaaagccctgggaatgggggtggcaggggcagaagtggcatgatagtgtaagttctgctctgattcgaaaagcccaagaaccaggagcacaagtg

SEQ ID NO: 10604 - DNA, 201 bp, Homo sapiens
gctatctcacctcaagcaaagaaagcgaattcctccttcctctgcctttttcttctattcagaataggaccacaacagattggatgatgcctactcacacyggggaccatctgctttattctcttcaccagttaaaatgctaatctcatttgtaaataccctcaaagacatacctggaaataatatttcattattattata

SEQ ID NO: 10605 - DNA, 201 bp, Homo sapiens
gagcaaagtcacgtcttacatggaggcaggcaagagagaacttgtgtaggggaactcccctttataaacccatcagatctcatgagacttattcactatcrtgagaacagcatgggaaagacctacccccatgattcaattacctcccaccgggcccctcccacaacatgtgggaattaagggagctacaattcaagatga

SEQ ID NO: 10606 - DNA, 201 bp, Homo sapiens
ctaacaccattgacatcttattcagtctttccagacacatttctgttgtcttgtcactttctgtagtatacaaagaaagtcaccatcttttctcaaagggwtatgtgactattttcgtgagagttattcacatatcaagagcaaaaataacttataccattcctatacaggaacttcctaaggcctttggatgttttaaga

SEQ ID NO: 10607 - DNA, 201 bp, Homo sapiens
tattttgaatagaaccctcacgctataccaaatacaatatcagaaattagagatgtaaaggtgaccaagacagacaaggcttctgcccttgagaggcttayggtccagtaggatttgaaagacagtgaggaacttaatagttctgacaaaaaacggatgcactgaccagtggaacaggatagagacccccaaaataaactt

SEQ ID NO: 10608 - DNA, 201 bp, Homo sapiens
atggaaaacagaatggaggttcctcagaaaactaaaaatagaattaccatatgattcagcaatcctgcttctgggtttcagtccaaaataattgaaggcastacgccaaagagatatctgcattcccatgttcattgcagcattaatcacaatagctaaaaattagaagaaacctgggtgttcatcctcagatgaatggat

SEQ ID NO: 10609 - DNA, 201 bp, Homo sapiens
tttgttttcttactattgagttgtttgagtttcttacatattttagataatagtcccttaacagattgttttattcagccttaaaaaaaagtgggaaggcygggtgtggtggctcatgcctgtaatcccagcactttgggaggccgaggcaggtagatcacgaggtcaagagactgagaccatcctggccaacatggtgaa

SEQ ID NO: 10610 - DNA, 201 bp, Homo sapiens
gcttgaacccaggatgcagaggttgcagtgagccgagatcatgccactgcactccagcctggtgacagagcaagattccatttaaaaaaaaaaaaaaaaargaaaaaaaaagaaaaaaaggctggaaattctcttatttgcaacaacatggatgaacccggaggatattatgccaagtgaaataagccaggcacagaaaga

SEQ ID NO: 10611 - DNA, 201 bp, Homo sapiens
gccaagggtccagcaggaagcgcaaaggaactcgaagataggggtgggcatgaagtattaaggcagtggtccaggaatatgagcaggcatctgaaccaccyggagggcttgttacaactcagattcctcaattctgcccccagtcagtaggtctgggtacagccttaaagtgtttttctcataagcttccaggagatgcag

SEQ ID NO: 10612 - DNA, 201 bp, Homo sapiens
ggagatgcagatgctgctggtttaggagcaacactctgggaatcattgtgttaggaactaaaaacaggagagggctgtagcactgtgagctagggacatayggtaagaaatgagactggagaaggaggcaggggctcctaggagctcaatcttgaaaggaggttcaaggttagttccagattgttgagaagttgaaagttc

SEQ ID NO: 10613 - DNA, 201 bp, Homo sapiens
gggaatcattgtgttaggaactaaaaacaggagagggctgtagcactgtgagctagggacatatggtaagaaatgagactggagaaggaggcaggggctcytaggagctcaatcttgaaaggaggttcaaggttagttccagattgttgagaagttgaaagttctattaagtccttagtgacaatactgttgttcttggat

SEQ ID NO: 10614 - DNA, 201 bp, Homo sapiens
aagatatggaaaaggcttcgtctttagattcaatcaacattcaaagaattattgtgttttcccagagtttttgctgttttactgccttttacagtaaaacyttccataaaccttccatgtgtttctgattattgagtacaattgaattactagccaattgtatggtgagagctgtttggccagggagcccctgtggacttc

SEQ ID NO: 10615 - DNA, 201 bp, Homo sapiens
gtctcaaaaaaaaaaaaaaaaaaaaaaaagaattcatttttagaatacctagagcagcagtgtgctgtagtgcaacggctttcaaacttcagactgcattygaatgtcctggaagcttgtaaaaacagatgtgtgcctccctgcaaaagtttctaattcaatgggtctggggtgagctccaagcgtttgcattcctgacac

SEQ ID NO: 10616 - DNA, 201 bp, Homo sapiens
cttatgagaagagtgaagagatgtgtcttgcttaacaacactaaatattctcccacttgctcactccctgtgttttttctttagattagaatagcgactgrgaaacaataaccacagcagcaaaccatttcaggcaatatttttgttgtaagggcttcagttcttcatgaattaaatcaccttatcttattgaatttaact

SEQ ID NO: 10617 - DNA, 201 bp, Homo sapiens
taaatcttttcattatagcagacttgggaaactgcctctctaacaggagctacttgcctagtcccccacctggagattggaccacggcttctgtgattggwtagatacatagatacatgcaaatgatgaagttcacatctattttttttttttttttttttttttttgagacggagtctcattctgctattgcccgggctg

SEQ ID NO: 10618 - DNA, 201 bp, Homo sapiens
atgaaaacacttcagtttattactacatatccaaaaactgaaacttactcaacagggaaatagctaggtcttatattttccaaaataaggtactaaatccrtcatgtgtaaaaaagttaatcatatgtaggcatgacttgtaaggctctaaaaatgtctgcattttagggtattcctttttcctagcattggttcttttat

SEQ ID NO: 10619 - DNA, 201 bp, Homo sapiens
aacatagctgtgcaaagctgatattctttagagctgattgtcttgtataagagtgactcccttgtatggggttaggaaacaaaaatcctctgattggaaayccaagtgtaattgatttgctaattgtcttacatagttttagatatgaccttccacaatgttatgtaatggtaaagtcatggggagtttcttttgggttga

SEQ ID NO: 10620 - DNA, 201 bp, Homo sapiens
ttttgggttgacttttagggctgttttgattctgcaatctaatcatcccagaagaaatgttgagttaatgtagaagtcagtatgatctgtggaagaaaacrtaagtaacattctccaagataatcttcagttctcgtgaaacatttaaaattgagggagctggctattcagagggtgagcaccacctgaaaatcaacttaa

SEQ ID NO: 10621 - DNA, 201 bp, Homo sapiens
aatattgtcactgtcagcctgctgttgagtttttctttccttcaaacatcgaaaaatgttgtgtagaatagaaccctcctgcatgcacccacacatgtgcraaagggttgtcatttttatggactttgtgaaaatagcagttttaaacatttcatacctatccttaacaacattgttggcttttaccatgtacatgacaac

SEQ ID NO: 10622 - DNA, 201 bp, Homo sapiens
ggctttgtggggtgaagtaaagggaatgaacgtgggtcctcagcccacccttaggagctggccaccctgtgctacattgctggtcacacactgcaggatgyctgttggagaaattcctaggttcacactggcatgtggtaatagatgttctttgcttgcaacaaatcaatagcaagcagctgtggatagtgcagatagtgg

SEQ ID NO: 10623 - DNA, 201 bp, Homo sapiens
tagaaacatgaacagtgtatagcgaggagtcataaggtggagtaatggcagctgtccccagggttgagactctatgaagagcagctgcttttaggatggtkttcattgaagatgagccttgaaatttttttttttttttttttttttttttttttttgagacagaatctctctctgttgcccaggctggattgcagtggtg

SEQ ID NO: 10624 - DNA, 201 bp, Homo sapiens
ttttttttttttttttttttttttttttgagacagaatctctctctgttgcccaggctggattgcagtggtgcgatctcagttcactgcaacctccgcctyttgggttcaagtgattctcttgcctcagtctcctgagtagctgggattacaggtgtgtgccacacaccacgtccagctaatttttgtatttttttagtag

SEQ ID NO: 10625 - DNA, 201 bp, Homo sapiens
gaaaatatatgctgcagtcactgttaacattctgcatgtttccttccggtcttcattttaagcattagcatggttcagatcacattctgtttgacattttygccctgctttgtttggtttaacactataggctatgcatttttcaagatataaaaaaaaattagatttcccaacttctttcaatagaatgcatgttatggt

SEQ ID NO: 10626 - DNA, 201 bp, Homo sapiens
ttgaaatcattgctgagtcctaaatgtaggcctcatagggctcaaatctggatttatttcattgagtcgttggtggagatcgatcttgaaaatttatttataaagaatccaatttttaaaagtttgatttgtaatgtgtataacttattaaatgataaaagaaatcaaagcatagtcattaatttaattggctctagaatc

SEQ ID NO: 10627 - DNA, 201 bp, Homo sapiens
ataacagtttaacatctgtactgatattagactaggatgcttaattccatgtgggcaagtcttcacagacaatcaaactgcataaaaacatagaactgggmaagggaaattgtgttcttgatgattatttgcatcatattgtggaattcagaacatttcaggtcttccttcttaacactcagatgaggccatttagaatta

SEQ ID NO: 10628 - DNA, 201 bp, Homo sapiens
tctatggaacatctgtgctgaacaaaaatctacaggttcagagggcatcttctgtactctgggcccccgctaacaataaatgtcagtgccagtcacaggtwcttctcccatagagctaaatgtttctcgggtgggcctgttaaacagtgtccttttataacattagaaagacacatgatttttttcccctaacttttgccc

SEQ ID NO: 10629 - DNA, 201 bp, Homo sapiens
gtgacggcaataatccacttagagcctattgcttcacagaagacaatttttgtattaccatgttagtcacatacaggtgcaattccaacatatttttcaayatggacataatttcctatagttatttccacatctaaaggcacaagaaagatctaaattactttactttgtcttgtaaaatagaaataataaatataattt

SEQ ID NO: 10630 - DNA, 201 bp, Homo sapiens
ttcttgcctggaatgaagaaaattactggtctgtgaatctttggctcttgtcattgtaagacttagggaacaatgctgcaatttttgcagcctctgtaatgaccagaactttcaatacacaatcttaactttgtagatattaacttatttttaaatctgctcatttaaagccataaaatgtaatctaatttagtctttaca

SEQ ID NO: 10631 - DNA, 201 bp, Homo sapiens
acctccaccccttgggttaaactgattctcctgcctcagcctcccgagtagctgggattataggcgcccaccaccacacctggctaatttttgtatttttrgtagagatggggtttcaccatcttggccaggctggtcttgaactcctgacctcatgatccacccgccttggcctcccaaagtgctaggattaaagacgtg

SEQ ID NO: 10632 - DNA, 201 bp, Homo sapiens
cataatcagacaggggtatttcatatcatccatttccagtgagaactgtggtaaaattctgtcctttttcccatttttggctgctgtgattgaaacccgtyttataaacagaaaagggtagtttgagttattttaaaaaataagaatccttcagtctctgttgcccattttctcctctatgaataatttctgcagacaggt

SEQ ID NO: 10633 - DNA, 201 bp, Homo sapiens
ctgctcttttctcttaaagggcactctaaagtgccttcccagtgtgtaggaacaggactgaaagggccgtttttcttggctgctggtgactttccaaagcragtgtctttcccttctcaccttgtccatggccccttgtgccctttatttgctctttctgcctgatgtagcagccacaagctgagagggctttctgtgaag

SEQ ID NO: 10634 - DNA, 201 bp, Homo sapiens
agcagctttgtgcagtgggaaggaaatgtttatgttattatacacctgggacctctaagtccacaaggttcactttttattgtacacctgggacatccttwtctacacttctggctcaatttgtttttggtttggtttagaaggttttcttctccctaaaatctcccttaagtcttaggccctttttatgcagaaatgcct

SEQ ID NO: 10635 - DNA, 201 bp, Homo sapiens
aaaatgtttggtaaatagagaaaaaggggccaggcatggtggctcatgactgtaatcctcgcactttgggaggctgaggcgggaggatcacctgaggtcakgagttcaagaccagcctggctaacatggtgaaaccccatctctactaaaaatacaaaaattagctgtgcatggtggtaggcacctgaaatcccagctact

SEQ ID NO: 10636 - DNA, 201 bp, Homo sapiens
aacccctaaccacattgtccatattgcagggtttcctaagttcacaccaatgaaccaatctctgtttatgaaatgcgctctgcctgtgcttgcattttacmcacacacacacacacacacacacacacacacaccactctacatctttgccaattcataaccaatcacctcaattatggagggtgatagtcttttctttct

SEQ ID NO: 10637 - DNA, 201 bp, Homo sapiens
tctaatactagattgaatgtaataagtaccatcagaagtggcccaaactgtggttttttaattctgaaatgcaaggttatgtgactaattagaaaattggyttggcagtgcctaaacaccggaagcatcacacaatagaactcttataaagggtctttatttcaaacatgattatgcatttgttcaaatctatggcataca

SEQ ID NO: 10638 - DNA, 201 bp, Homo sapiens
tgtatttctgggcacctctcctgctaagcactttggttgatggagggcagcgggtggctttgaggtcatcaggatggacactcagtaacagccctttgcctttttttttttttttttaacttcttttttgcttccagggtgacattatctgggtctagggactgaaacagtttgggaaatgttgtcttctgaaaatggaag

SEQ ID NO: 10639 - DNA, 201 bp, Homo sapiens
atcaggttcctcccacaacacatggggattagggaactacaattcaaaatgagatttggatggggatgcagccaaaccattatcaggaggggtgcccagcrttgtaagaagggccttctgtgcagagggaacagccagtgcagaattcattcttcaagtggctatgttccttttatttattttatattttgcacttcctaa

SEQ ID NO: 10640 - DNA, 201 bp, Homo sapiens
agctgcttcctttcaatgtgcaactcaagaaaatgacttgccatccattcttacatacagagggtggctaccatttgccactgaaacaccatattctatarcttcaggccatcaatgggaagcatcttccttttgcttccctctctcctttctctctttttttcttctcacctgtgtgctgaaacacaagtgcctcaaatt

SEQ ID NO: 10641 - DNA, 201 bp, Homo sapiens
tcagtgttcaaaatcccaaaatattattctcatcagcaaaatattgctcctacacacaaggtacctcttctccttttttcacttgctaataataatggcargtattaatataaggtatttgttgagcaattattaaatatgtcatctctaacacaacagtccaaaaagacaggcctaagttcttctactttatagatattg

SEQ ID NO: 10642 - DNA, 201 bp, Homo sapiens
gaatggcagagtgaaatccaattagcaagatctgcaaaagaggcacatgtgccagaatcatgcgtgatcccagaaaaaaaagtatatatatatatatatatactatatatatatatatatatatatatattatatatatatatatatatatcatagcacattcttagcctacccacctcccactaccccaaaaagcaggac

SEQ ID NO: 10643 - DNA, 201 bp, Homo sapiens
tcatgcgtgatcccagaaaaaaaagtatatatatatatatatatactatatatatatatatatatatatatattatatatatatatatatatatcatagcmcattcttagcctacccacctcccactaccccaaaaagcaggacaacattttccatatattctattgaagtttttttttttttttaaacttgttggcacag

SEQ ID NO: 10644 - DNA, 201 bp, Homo sapiens
ctaatttatacaatggggatgataatattgtttatcctattccataatgttttatgaggaaaatttgaaataatatatgtaaatcgttttactgtaacatrtacgaaggatccaataaatattggctcttattattatgttgaggtatgctgaaagttagtggcagaaacaggaccagaacattgatacccaactcactac

SEQ ID NO: 10645 - DNA, 201 bp, Homo sapiens
ggatggggatgaggctatgctcagccagtctgggagatctctaggggaaaatgacataggaaaaaatagtgataaatatgcttaaaagaaggcaaggaagmaagcaaggaaggaagaaataaagaaaaagagagagaggaagaaagagagaatgaaaagaagggggttgggagggaggaaataaaagaaaaaagaatagaa

SEQ ID NO: 10646 - DNA, 201 bp, Homo sapiens
aagcaagcaaggaaggaagaaataaagaaaaagagagagaggaagaaagagagaatgaaaagaagggggttgggagggaggaaataaaagaaaaaagaatrgaaaggaagaaaggaaagagagaggaaatatggtatatcagttattctgcatgatatgtttgagttgagtttgtggtggttacttgccccagggtatcaa

SEQ ID NO: 10647 - DNA, 201 bp, Homo sapiens
caaaagaagtctccaattaatttgtagccagtgtaaccatatagcatctatttgcttagttttcaataataataatactggttctgattaaataaggcatrttgtcaaacttattatttgcaaacatattactgttgtaactggtaattgctcagatctctttcggttcctgccccgacacccaaaagtcaagagggtgga

SEQ ID NO: 10648 - DNA, 201 bp, Homo sapiens
ccacctgcctcagcctcccaaagaatagaattgcaggtgtgagccaccacgcctggcccattatagaacatttagcagcattcttagcctctacatagtaratgccagtagtagcccccccaacataattgtcacaataaaaaaatctctaaactttgccaaatgtcttttggagagggccacaattgttcccagttgaga

SEQ ID NO: 10649 - DNA, 201 bp, Homo sapiens
tggtaatcctaaggggaggtcagggaatggacttttcagttaactgctcagaggcaattgtttgttttactttatataatcgaacttttataaaacttagmatattaaatccagcaaggttaaatatttagccttttgttaactttgtaaaataaaaatagaacttaaatgattcattataaagcaattatcttagaaaat

SEQ ID NO: 10650 - DNA, 201 bp, Homo sapiens
cactataaggttcacaaggactgaaaactatttgatcttctcatttttggaagaaagtgagaatcgtaatatacttgcgaaacagattggattccatctgrtgtagccaaattaatccttctttaatgattgtttatattgtgtatccaaaatcaaactcagtatcaagagttaatcaattacaatttataatcattttgg

SEQ ID NO: 10651 - DNA, 201 bp, Homo sapiens
aacagtgtagcatagctcatattaccaaatatctgcatgttagaggcttatgtgtttatgagtaggcaggtgtcttcatggaactctggtatcttccagawgttcataggtatatctggaacgatgagtatctggccaagtaatatatggaatcaggaatatgtctctcctaaagagttatattttgatcaacctcactct

SEQ ID NO: 10652 - DNA, 201 bp, Homo sapiens
gtagcatagctcatattaccaaatatctgcatgttagaggcttatgtgtttatgagtaggcaggtgtcttcatggaactctggtatcttccagatgttcayaggtatatctggaacgatgagtatctggccaagtaatatatggaatcaggaatatgtctctcctaaagagttatattttgatcaacctcactcttactgc

SEQ ID NO: 10653 - DNA, 201 bp, Homo sapiens
tatgtctctcctaaagagttatattttgatcaacctcactcttactgcagtgggcaagcaggtacaacctagagttttccaaaccgttcagattatgaaayctgtcgttagtaatatattggaaaactcaattatagtgccctaaagagctataataagaaacacagtttggaaaatacaagtctgagttagtaaccaaga

SEQ ID NO: 10654 - DNA, 201 bp, Homo sapiens
aggtaaaatcaaagttttattcatgtacagtggttaagaatgaagatattaagataaattattttaagtgaggactgtccttttaataggcctcactctayagccttgtctcatttttcattttcacaaggttcttgatgtattcttttcattatataaaacgtgccatatttggtcttttcatgaaatgtatctgatatt

SEQ ID NO: 10655 - DNA, 201 bp, Homo sapiens
attttaagtgaggactgtccttttaataggcctcactctatagccttgtctcatttttcattttcacaaggttcttgatgtattcttttcattatataaarcgtgccatatttggtcttttcatgaaatgtatctgatattctcctttgacagccattcacgtgaaaagaaaaggtcctatttctgtccatcacctacatg

SEQ ID NO: 10656 - DNA, 201 bp, Homo sapiens
tgtccttttaataggcctcactctatagccttgtctcatttttcattttcacaaggttcttgatgtattcttttcattatataaaacgtgccatatttggycttttcatgaaatgtatctgatattctcctttgacagccattcacgtgaaaagaaaaggtcctatttctgtccatcacctacatgcacatattcatagaa

SEQ ID NO: 10657 - DNA, 201 bp, Homo sapiens
catatttggtcttttcatgaaatgtatctgatattctcctttgacagccattcacgtgaaaagaaaaggtcctatttctgtccatcacctacatgcacatrttcatagaaatcatagatttttggtaaaatatgctatatacttatacagcatcttaatctcagaaacccaaagggtttagatccataactgtaccatatt

SEQ ID NO: 10658 - DNA, 201 bp, Homo sapiens
cctctacttctatatctaagtattgctacttctagttggatgtaaaatgcatccttctcaatttatttttgtttgtgggggatggatggaactaactgttyccccactactttataaacaaatataaaatgtggatgtgtaggtattttaaatgctaacagtagaattttagtatctagttaataaccctattggttggaa

SEQ ID NO: 10659 - DNA, 201 bp, Homo sapiens
cattaggccatgtaagagaaatataattctgtaattattcagaactcagttggttgtttatatggtattcagcaagatacttcccccccacctccaacttyttataacacaatttcaaagcaccaatcgtcttcctcttttaaagtaacaccatgactgattgccttaaatttatatatgatcttgttctaatgtcctttc

SEQ ID NO: 10660 - DNA, 201 bp, Homo sapiens
atttatatatgatcttgttctaatgtcctttctaaaaataagaaaaaaatattccacaagtaaaacgagagtatgatagatacttcaccatggtgctggtrtatgtagacttgcgtgagggggaggacatggaatggtatgttctccattcatctctagttttatttcctagatgagttatgggtgaatactgtgacaaaa

SEQ ID NO: 10661 - DNA, 201 bp, Homo sapiens
ttccaaatttctgagtttacttctaataatgggtatgctctccttgctatttttatctctagataattgttgactgcttgtagttttttcttgttgggcaygaatgactggcttcatcttccaaaagtgttacaaaacaccagttatttctttgagctttagacttttcctttgcagaaaggagccttatttacatccaaa

SEQ ID NO: 10662 - DNA, 201 bp, Homo sapiens
taggaaatttacactgcttctgagggacaaggcagcttttggacccaattatgcatgcctctgaaacacatgttctgcaccacaccattttttctgttatrtttgagagataaaaagttgtccgtctgtctacctctccaggctaatgtctcaccacattcaatcaaacttctccttccccaggccaggattcatgcagtc

SEQ ID NO: 10663 - DNA, 201 bp, Homo sapiens
ggaaaagtctcttgttgtgaggcattacccagagttctttgtcttaaaaccaagagaattaaggagcatggacagaaagggtgaggttggagtgaaagttwaataagtgaagaaagaaagctttccaccacagagaggggtcccggaagagggttgccatttttacagttgaatgcaaaagaaactgatgagggctgggtg

SEQ ID NO: 10664 - DNA, 201 bp, Homo sapiens
tatctaaccaaacattccactcctcagtgatggggtagctgctctttgaaagacaagcaactgtgatggggacctgtcagtcttccttacatgcagctggttctctaaatattccaacgattcctatcattttctgtaggagtacctgcaaaactggaaggctaggctgatggctttttctccattaagcagtaaacacgt

SEQ ID NO: 10665 - DNA, 201 bp, Homo sapiens
tggttctctaaatattccaacgattcctatcattttctgtaggagtacctgcaaaactggaaggctaggctgatggctttttctccattaagcagtaaacrcgttaagcaagcttgagccaggttctggaggaggtcatcttgcaaggataaaaaacattgcatttattggatgaatacttaatgcacggtttgccttatc

SEQ ID NO: 10666 - DNA, 201 bp, Homo sapiens
cactcctgctataaccattctcagcattttcttccagttttttccttctagaactactgccaggtgaactacaaattattttcttgatttgcagcccatgyaccaatgagaaaatgcctatggtgtcttttgattttatggttcattgcttaggccttgtcataaaaaccatggcgtctctaaaaagaaaatataaaacaa

SEQ ID NO: 10667 - DNA, 201 bp, Homo sapiens
aattattttcttgatttgcagcccatgcaccaatgagaaaatgcctatggtgtcttttgattttatggttcattgcttaggccttgtcataaaaaccatgrcgtctctaaaaagaaaatataaaacaaaaacaacttcctcttggccagagtttatcaaacctatgcccataatggcatagaaatataggaaatgagacaa

SEQ ID NO: 10668 - DNA, 201 bp, Homo sapiens
tcttgatttgcagcccatgcaccaatgagaaaatgcctatggtgtcttttgattttatggttcattgcttaggccttgtcataaaaaccatggcgtctctwaaaagaaaatataaaacaaaaacaacttcctcttggccagagtttatcaaacctatgcccataatggcatagaaatataggaaatgagacaatcctactc

SEQ ID NO: 10669 - DNA, 201 bp, Homo sapiens
aaaatgcctatggtgtcttttgattttatggttcattgcttaggccttgtcataaaaaccatggcgtctctaaaaagaaaatataaaacaaaaacaacttyctcttggccagagtttatcaaacctatgcccataatggcatagaaatataggaaatgagacaatcctactcccccaatccccgttttctgtttatttgtt

SEQ ID NO: 10670 - DNA, 201 bp, Homo sapiens
ttatcaaacctatgcccataatggcatagaaatataggaaatgagacaatcctactcccccaatccccgttttctgtttatttgtttgattcctgccaaarcaaagtgaccttgagggggcaccggctcagtgtttgctttttctggcgttacccacacccctccttcttcatctcctactgctccccattcagctcctca

SEQ ID NO: 10671 - DNA, 201 bp, Homo sapiens
tcctactcccccaatccccgttttctgtttatttgtttgattcctgccaaagcaaagtgaccttgagggggcaccggctcagtgtttgctttttctggcgytacccacacccctccttcttcatctcctactgctccccattcagctcctcaacaatcggcaatcactctgcccttctgctccaaatttatgaccgggagc

SEQ ID NO: 10672 - DNA, 201 bp, Homo sapiens
tatgatggtccctgagaaaggacaatgagtagaagaagcaaggtgcagagaggatctaacaatttttgcatggacatgagatttggagcaaggtctagaarctcatatcagcaaggagtaagtatgcttgtggcttaaagattatggtcctcaagacttgctcctggactggaaatattcccctaattttttgcctaaatg

SEQ ID NO: 10673 - DNA, 201 bp, Homo sapiens
gaggatctaacaatttttgcatggacatgagatttggagcaaggtctagaagctcatatcagcaaggagtaagtatgcttgtggcttaaagattatggtcytcaagacttgctcctggactggaaatattcccctaattttttgcctaaatgaaatgtgctacaggcctgagtatacctaaatcagcttcatttttctgtc

SEQ ID NO: 10674 - DNA, 201 bp, Homo sapiens
tggactggaaatattcccctaattttttgcctaaatgaaatgtgctacaggcctgagtatacctaaatcagcttcatttttctgtcaaatccctccctgtwtgcttcttccagtgatatgtcatgcagatgtccacaggggacataggatcttgtagtgcaaaaaacatgagactttcatcagacaatcagtcttgactct

SEQ ID NO: 10675 - DNA, 201 bp, Homo sapiens
taataagtgttcccaatatatagattttatttcatctagttgaatttagagagtagcaagccactcccttcctgccccacccccgaaaaaaaaaaaaaacrcaccaccaccaacaacccacttttagtgtggcaccatatctaagaaggtattctccaagacttctttatgtgaagtagttcagccttggcagagttaaaa

SEQ ID NO: 10676 - DNA, 201 bp, Homo sapiens
tatatatctaaaaaaggacctgtattcacaacatatgaggatctcctgcaaatcaaaaataaacacaaacaataaaaataggcactttataaaaaagataygtgaatggtcaatagtcccatgcaaagatattccacatctttagtaatcaagaaattgtatattaaaatcacagtgatgtatcattttataccaactaaa

SEQ ID NO: 10677 - DNA, 201 bp, Homo sapiens
ttctgctatgattagattattccagaagcctcttctggaggaatctcttacatttgcccttcatctatgggattctgcactttcgcctttctgtttctgtsttgtcctgagatatctcatgtagaaatgaattgatggccctttatactgcggttggactcttcattcagattttttcaaagcacattataaactctaatt

SEQ ID NO: 10678 - DNA, 201 bp, Homo sapiens
aattaaaataatcttcttgtagtcacacatcaaatcaatgtcagtgcaaacacttgaaccaccagttaatgcagccccatttctttttatattgacaacarcacagtggttgaagctgaaatagaacctcagttcatacttatagaatatgccatgctgcacttaacacatggatctacagggagaaggaaacagaagtga

SEQ ID NO: 10679 - DNA, 201 bp, Homo sapiens
atgaaggactagagactttagttaactttcctagggtcacacaggtaggaagtgacagagctgggatttgatccagggctccctggctccaaagctcttgmttttagccatgatactataatgcattgaataatgggcgatatctacctttccttgatggtcaggaagaaaggtcaaaagaaaggttgttagagctaaaat

SEQ ID NO: 10680 - DNA, 201 bp, Homo sapiens
cctactccagcaggtttcccagtcaaaatatgcctttgggaatgcagagaactgaaggccctggctgagcaaaccccagctggagagacagactggggatyctatctgtgtatagcatgaagaatttattctaaacacttggatatagagccaatgccacttacaagctttcctttaagaatcctaggccagttgttaaca

SEQ ID NO: 10681 - DNA, 201 bp, Homo sapiens
caagaactttgtaccttatgggtactgaagaagtgaaatgtttaaagaagccgaattatatgatttcttttgacttcaaaatggaaaatacatgtcgataytgggggagaaattaggaggttcttgccataatacaggtggcatatgatggtagtcttcaggtaatggcagtaggaatgcatagaagaacacagatatgaa

SEQ ID NO: 10682 - DNA, 201 bp, Homo sapiens
cacattagccagcaaggcataaaaggcaaagagagagataagaaagatgatgttaatctagagcctaatgaaaatgtgggagttcataaggagtgatcaamtacgtaaggtgataattgtggatatgtttcgatatcagaaaacattgcttttctgtgtgatagtgctttctttataattaatgtggatttagtgtgtgtt

SEQ ID NO: 10683 - DNA, 201 bp, Homo sapiens
tgaaaatggcactataaacaaaatggtttaggaaccagtgtagagagcaggagccaaagatggaatccagagtcacagcatgagggatgagtaaggaagaygactaaactggtagattttagaatgagctatagcagtatcaccaaaaccaagagtggagagaacttcaagaggaaagacacatttggaccttttaggtaa

SEQ ID NO: 10684 - DNA, 201 bp, Homo sapiens
cccccagccttgacctcccaaagtgctgggattacaggcatgagccaccgcgcctggcctcaggccctattctaataaaacttccaggtagatgcttgttstccttctctgtgagtccaaacaaggtctctagttattgattctcatattattgcagcttctacaaatttcaccctcaagtcagctttttggcttttctga

SEQ ID NO: 10685 - DNA, 201 bp, Homo sapiens
tatgtcggtggactaacgcagcatgcctaatgccagagtgggcagaaagaataatagctgttgtttcagtttacctgtactaatttatcacaccttacccrgagactccagctccactttctgagttttctctgtctggaggtgaaacacacaagcacataaataagtaggaagctgttaggaaatcctctttgtcactac

SEQ ID NO: 10686 - DNA, 201 bp, Homo sapiens
gctcttattgcccaggctggagtccaatggcatgatcttggctcactgcaacctctgcctcccgggttcaagctcttcttttgtctcagcttcctgagtarctgggattacaggtgcataccaccatgcccggctaatttttgtatttttagtagagatgaggtttcatcatgttggtcaggctggtctcgaactcctgac

SEQ ID NO: 10687 - DNA, 201 bp, Homo sapiens
acttcttctcttcctctagctttagggactggactcagcattttggtttcatttcttttttgaaaagtaaaaagaaaatttacaaaactataaaacaagttatatatatgtatatataaaactagcatattaacaaatatatatgggtaattatataaaattatttatacatatataattacccatatatatttttcataa

SEQ ID NO: 10688 - DNA, 201 bp, Homo sapiens
cttcttctcttcctctagctttagggactggactcagcattttggtttcatttcttttttgaaaagtaaaaagaaaatttacaaaactataaaacaagttatatatatgtatatataaaactagcatattaacaaatatatatgggtaattatataaaattatttatacatatataattacccatatatatttttcataat

SEQ ID NO: 10689 - DNA, 201 bp, Homo sapiens
actagcatattaacaaatatatatgggtaattatataaaattatttatacatatataattacccatatatatttttcataattacccatatatatgtatakgtatatatatataattacccatatatatgtatgtgtgtatatatatataattacccatatatatgtgtgtgtgtgtgtgtgtgtgtgtatataattaccc

SEQ ID NO: 10690 - DNA, 201 bp, Homo sapiens
tagcatattaacaaatatatatgggtaattatataaaattatttatacatatataattacccatatatatttttcataattacccatatatatgtatatgwatatatatataattacccatatatatgtatgtgtgtatatatatataattacccatatatatgtgtgtgtgtgtgtgtgtgtgtgtatataattacccag

SEQ ID NO: 10691 - DNA, 201 bp, Homo sapiens
ccatatatatgtatatgtatatatatataattacccatatatatgtatgtgtgtatatatatataattacccatatatatgtgtgtgtgtgtgtgtgtgtrtgtatataattacccagaattaaacacctttaggtgtaattagagtacattaaaatttggcatactttcctttagttcttttctaaattataaaagtaac

SEQ ID NO: 10692 - DNA, 201 bp, Homo sapiens
cttgcttttttctttcaacactgcatttttgatgtataggtccctgatacactgggtattcttcagacggataacatttgatttagattctgaaagagggrtaagattttgccaggtcaagaaaggaaccggtcaggtagaacattagtttacgtattagcacttacttcataaaggcatggaatagactgcggaaaatca

SEQ ID NO: 10693 - DNA, 201 bp, Homo sapiens
agcctggcatccattagctcttctttctgatgctctccctctgcctccccttttgctgtgcagaagctctttagcttaattagatcccatttgtcaatttytgctttggttgcaattgcttttggcgtttttgtcatgaaatttttgcccacgcctaattcctgaatggtattgcctagattttcttctagagtttttata

SEQ ID NO: 10694 - DNA, 201 bp, Homo sapiens
ctttttgcttaggattgacttggctattcaggctcttttttggttccatataaatttaaattttttttctaattctgtgaagaatgtcaatggtagtttartgggaatagcattgaatctataaattactttgggcagtatggccattttcatgatattgattctccctagtcgtttatttttatcctctctgatttctca

SEQ ID NO: 10695 - DNA, 201 bp, Homo sapiens
gtattctttctgtagtaattgtgaatgggagttcattcatgatttggctctctgcttgccttttattggtgtataggaatgctagcaatttttgcacattsattttatattctgagactttactgaaattgcttatcagcttacgaagcctttgagctgagccgatggggttttctgggtgtaggatcaatgtcatctgca

SEQ ID NO: 10696 - DNA, 201 bp, Homo sapiens
gccagttttcagggggaatgtttccagcttttgcccttcagtatgatattgactgtgggtttgtcatatatgactcttactattttgagatatgtttcttyaatagctagtttattgagaattttaaacatgaagggatgttgaattttttgaagtacttttctgcatctattgagataatcatgtgatttttgtctttag

SEQ ID NO: 10697 - DNA, 201 bp, Homo sapiens
ggaatttaacacatgaacccattcaacacatgaacctttgggggcaggacttaatttgacccttaacatgaagtgataaaaatattttttagacttgatamttgtagctcttgtttgatggctgaagtatcaagaagattatgagaacagacatgaggctatgaatatgttgaaggattggaattttggatcactcaaatg

SEQ ID NO: 10698 - DNA, 201 bp, Homo sapiens
ttgtttgatggctgaagtatcaagaagattatgagaacagacatgaggctatgaatatgttgaaggattggaattttggatcactcaaatgtgatccaaamcctctggacacccttaccctttctagatatattttttccccttaaagaactcaaaggagaacaaagacctggaaaaatatctgtggatatctggaagtaa

SEQ ID NO: 10699 - DNA, 201 bp, Homo sapiens
aactcaaaggagaacaaagacctggaaaaatatctgtggatatctggaagtaagcactgtactagaggttatcttgtatttgtctctagtttttatgttcsattctcagaggcaggtatttcattgtacaaggtgcaataattatggagtatacattttatttaatcacataggaagtggtttattataaaagagaaagaa

SEQ ID NO: 10700 - DNA, 201 bp, Homo sapiens
aaagttagaaaagagggaaagactgagaccctcaatgttaaataacattttataatgatcacatgctgagtcaaaggcaaaagcaatttctaagtcgcctrcttaattctctagaccatgcctgctatcttatatttatatcttaataaatgtacatatgctgccttgctgttttggggacaatgggaagtataaatttga

SEQ ID NO: 10701 - DNA, 201 bp, Homo sapiens
atgcctgctatcttatatttatatcttaataaatgtacatatgctgccttgctgttttggggacaatgggaagtataaatttgatctttcttgaattctcyacatttaaagtctccacttgtcacttgaattaacatagtattttagcatttaatttcctggggataccagatgttttattttgtgagtttgttttattta

SEQ ID NO: 10702 - DNA, 201 bp, Homo sapiens
ccacctttgctcaaattggctcagtgatatgattttaatactaagcccacacccagttggtatgaagacattaagtaattaattaattcaataactatttrctgatctgaacaaagtggacaaaaaaccctgtctctgtggaattttcttccaggcatgaggggcttgggaatgggtaacaagtaagtaaattatgtaact

SEQ ID NO: 10703 - DNA, 201 bp, Homo sapiens
tacattaggtatttctcctaatgctatccctctgctagccccccactacccaacaggccccagcgtgtgaggttcccctccctgtgtccatgtgttctcaytgagaaacacattttttaaatacataaataaatatcacccttttgtcatgtatcttcataagcaattgacccaaccaatggatttgcagtcagtgaaaac

SEQ ID NO: 10704 - DNA, 201 bp, Homo sapiens
gactatatgactaagatgatcatcctttgtactctgtctccccatctctcctccctcccttgtttttccatgtggtatgtgttttctctctctctctctcttttttttttttttgagacggatagtttcattcctgtcgcccaggctggagtgcagtggtgcaatctcggctcactgcaacctccccctcccagggttcaa

SEQ ID NO: 10705 - DNA, 201 bp, Homo sapiens
gtttagaatgcacaaaatctagacatggcattgaggcatctagatattgcctttacctatttcctgtaggaacttgctccagattagtatcttaaagacamattggcatttatttttcttacacacattgcattgtgccatgtaagaaaattacagattaaatcagcattttcctcctgcttgatgtgaataaaatcaatg

SEQ ID NO: 10706 - DNA, 201 bp, Homo sapiens
cttctcttcattgcagctggcatatcttgttgtgtttatgagtctgacaggcaaacatatctgaagcatatctcatatgctgatctgtgagggagataagycccttgttttgcttgactggaaacaaaataagcaggtggcagaaaaccctgcattgatttctgcttgggctaaaacacccagaataagatcaagtccccc

SEQ ID NO: 10707 - DNA, 201 bp, Homo sapiens
gcctctgctatttgatcattgatcatttgacttaagtttgcaaattgttgtagggaagtgtaagtttctttctgctttaacaaagctacttttacttattwtaattttataagctattagcactattttgtgatagaaaaaactaaaaatcaaatggtgtcagagcttaaaaatctcttacttcatttgccgtgtaatctt

SEQ ID NO: 10708 - DNA, 201 bp, Homo sapiens
gtatttatattggttgaaatggcaagataatgagtctaaaagattttcccttctgatgttattttttttgttgttcagaatgacacttgaaagatgcctargatttctactgctgctcttagaatcacaggatctcagggtaaaatcaaactttagaggtcattaatttcaaccagccataaaggtctttttgtcaaactt

SEQ ID NO: 10709 - DNA, 201 bp, Homo sapiens
gagaaaccgtatctctactaaaatacaaaaaagcagccaggtgtggtggcatgcacttgtagtatcagctactcaggaggctgaggcagaggaatcacttaaaccctgcccagaggcagaggttgcagtgagccaagatcgccactgcactccagcctgggcgacagagtgagactttatctcaaaaaaaaaaaaaaaaaa

SEQ ID NO: 10710 - DNA, 201 bp, Homo sapiens
aggcagaggaatcacttaaaccctgcccagaggcagaggttgcagtgagccaagatcgccactgcactccagcctgggcgacagagtgagactttatctcaaaaaaaaaaaaaaaaaaatgatatgatgtgtccaagctctttgtctaatgaaggagacagatgtcaaaaagataaattactatacggtacaaaaatgctc

SEQ ID NO: 10711 - DNA, 201 bp, Homo sapiens
atttgaatttaatgttcaagagaggggaaggcataaatatataaacatatatgtttcatacatatgtgtatacatatatatgtttcatacatatatatatmcatatatacacatacttatatatacatacataaatatatttatatatccacttaaaacatatacaaaactacctatacatatatacatctatatatcaca

SEQ ID NO: 10712 - DNA, 201 bp, Homo sapiens
tttttccaccattgctggcatgtgtgcaagtgggggacccagggaatagagactacaatgtaaaaaatggtttcgctgttatcgttgtcatgttttcctaygtaaaaaataggataatgtgacttttgctgttgatagatgtttcttcaagatcccagtagagtattttgtgactggaaaatttctagaatcttgaaggca

SEQ ID NO: 10713 - DNA, 201 bp, Homo sapiens
ccttttgcaagtggttctcctgtctagcctgctacctctggactctctcccctgtatgcaaggccccagtaaaaccccaggtctcatttgctggctctggktctctccttcagcctcttgaacatgctgccatccccggtggagtcaataggaagtcggcacaacagacaaggaagagctgtcaccttgcctgataaaata

SEQ ID NO: 10714 - DNA, 201 bp, Homo sapiens
tatgtcatgttgaaaatgtgccttcctggttaaaaggatggatatttggaaacaaggcagtttgaatcacagcacaactatttaattttaaaagacacttytttctaacctatataattcttaattgttctggacatgtaggctatttcagtgaaatttagaaagcaaggccatttcctacagctaagccctttaatgata

SEQ ID NO: 10715 - DNA, 201 bp, Homo sapiens
ggttctagattagctatgataatactcatccccttatgcagaaaagctgcttttagacttctcattgcttcccagttaatataacatagggattattaaastctctgagtatgcatttctagatgtgtatagcattagatgaaaattccttaggcctttggaaattcttcctttcccttttagagaagaagatattatcct

SEQ ID NO: 10716 - DNA, 201 bp, Homo sapiens
ggaatgtcaagataagaaatttgcattgatctaacaggtaataagaagctccataccatattctttttacctgtatgtaaaaatcaagaggagttaatacragtagtattttattaccaaaatagaagttgcatctggctcagactcagcctctgattcctcaggaggtttttcccacccctttccctattcctgctttcc

SEQ ID NO: 10717 - DNA, 201 bp, Homo sapiens
gaagtaaggtggcaccatttaccaagtaggaacaaaagtgaatgattagggagaactgtttgttccagtgctctggggacaaaaaaaaaatccatgttaatcttttctaaagtgtccacttttgttatgtttatatttttgttgaggttctttgttcacttgcaactaaaccaacacgtagaactgaatgtgatttctact

SEQ ID NO: 10718 - DNA, 201 bp, Homo sapiens
ctgtatgtgtgcatttttaaagcaaccctttgtaagaatgagtggatttagcaaagtagatgcgattgaatcacaatggaatacatgcctcttactcggtytaaagtcccttggttctgcaaagttttttattctcttttcaaaccttatgcaattgtgacttcatctaaattattgatacagttctaagggattagtatc

SEQ ID NO: 10719 - DNA, 201 bp, Homo sapiens
tcgatgattaaaaaaatgagcctttttaaacaagaaattcctgctcatacatttggcttctgagagagagaaagagagagagagagagagagagagagagwgtgtgtgtgtgtgtgtgtgtgtgtgtgtgtgtgtgtgaaatggggaaaaatatcaatgcatcaaaatggacaggtcattttgttgaatgtaactgaactc

SEQ ID NO: 10720 - DNA, 201 bp, Homo sapiens
ttttgattttttaattttattctattcttttttttttttgtagagccagaatctccctctgtcacccaggctggagtgcagtggcaccatctcggctcackgcaacctctgcctcccgggttcaagcagttctcctgcctcagcctcctgagtagctgggattacaggcacatgctgccacaacctgctaatttcttttgt

SEQ ID NO: 10721 - DNA, 201 bp, Homo sapiens
gaatctccctctgtcacccaggctggagtgcagtggcaccatctcggctcactgcaacctctgcctcccgggttcaagcagttctcctgcctcagcctccygagtagctgggattacaggcacatgctgccacaacctgctaatttcttttgtattttagtagaggcggggtttcactgtgttgcccaggctggtctctaa

SEQ ID NO: 10722 - DNA, 201 bp, Homo sapiens
ctcttttttttaatgagcaatcataagttattatcaactagcatgcaggtaataattttcttatcttgttacttgtgttccaccactaataactatgagaytgcaggcagtttttaacttctctgagccatggctccttccctgtagaattatgcagtacttcttgtgaaaattgagataatgtgtaaaaataaaaaaaaa

SEQ ID NO: 10723 - DNA, 201 bp, Homo sapiens
ccactgacaaatctagttctgagagtgtgcttcagagaaatttagatttttgagataattttgatatatagtaatgagaatctcagccttatggcagcctktatgctttcagccaaggtggaatcctggccaaaatgattttttttttttttttactttctgccatggtgcctggaatttcttcaatatagactcatttct

SEQ ID NO: 10724 - DNA, 201 bp, Homo sapiens
taacttggcttgagagtgtctgatacttacactcacaaacaaaactatagagttttagaactcagagcagtgcttcccattgagatttctggatgccacartggtgcctgcaagaggaaactcatcggagtgctttcatcagcaaggaactggaattcctgaccagtgataagacaagatgactgtggcagcttcagatat

SEQ ID NO: 10725 - DNA, 201 bp, Homo sapiens
actcagagcagtgcttcccattgagatttctggatgccacaatggtgcctgcaagaggaaactcatcggagtgctttcatcagcaaggaactggaattccygaccagtgataagacaagatgactgtggcagcttcagatatatttacaatttgacattcaaaggccaaaggggaaaaaagatttttcccctgtatctcac

SEQ ID NO: 10726 - DNA, 201 bp, Homo sapiens
ccaaatttatatgaaactttttcatgtataattttgtttaaatcctaagtcttatgagacatgagacattgactgtaataaaaagtgcaaaaacctctcagatcttataggtattctatgataaatttggaaagtgtaatattagcatctataaaatcaaaatattgcctgttggtttctgttcactggaaaattataaat

SEQ ID NO: 10727 - DNA, 201 bp, Homo sapiens
aagacacctacacatgttcacatctagggtagtattttcaaaaaatggagttactttgaatccccgatcgtctctttcttttactcaatttcaagttaatrtctaatgtaaaacttttataaatagcaaagagacttatacttctctagctttgcaatatttagtcttgctttttcttgttggcacggtgtgccctttacc

SEQ ID NO: 10728 - DNA, 201 bp, Homo sapiens
aaatgagttgttaataaatatcagctttacatcaagagtttaacagaaacatattcctgaacaaatttccattgccttctaaaagggttatttcttggtcygcagagctgctaatctgtaggttgcattcagtctaggctatcagaataggtcaccccatgggacttgatgatagtattgtcacttagatggcaaacaagg

SEQ ID NO: 10729 - DNA, 201 bp, Homo sapiens
atattcctgaacaaatttccattgccttctaaaagggttatttcttggtctgcagagctgctaatctgtaggttgcattcagtctaggctatcagaatagktcaccccatgggacttgatgatagtattgtcacttagatggcaaacaaggcatgaaataccttttcatagaactaaacaccctcaaatggggacatgaaa

SEQ ID NO: 10730 - DNA, 201 bp, Homo sapiens
atcactttcctatttatcacttaaaggaaattcacctttcccccagttatcacatcctaatttttctggggtttgtaaaattttaatcttatgatagggcttttttttttttcctttgggtaagcctttagcaattgctatatccaacatttcaaagaagctgtgttttagtggactgaggaatttactcatcaagatttt

SEQ ID NO: 10731 - DNA, 201 bp, Homo sapiens
tttccccatgtttccttccacccccaaattcttaccccatttcaggcagagctgagcaaacataagccttctctgaagtattgagggaaagtctgctaaayggctaaactacttaaggagctaacagaaaaggttgtatcagagaaacagtggagaaacacaggtttctaattatatctggcactggagagaatgtcaaag

SEQ ID NO: 10732 - DNA, 201 bp, Homo sapiens
gtgaaagtaagagatttaaaataggttctcaactcctgataaaaacacgaatatttatttatttagtctagcttttctttcttctcttatcgttatgattrttattactactactacttttctgacttttcttttcctaacctactagtgtttaaacctcccgaagacagaggtcagttctgctttgatcaccactatata

SEQ ID NO: 10733 - DNA, 201 bp, Homo sapiens
gacaatgtaaggtagccctgtattttcaagggtgatttttagaaaatcctaatcatttttcctgaagtactttgtgtgaatactcatgaaattatagacaraccaattctcttttgcttagaatgaaaatcatctgttatgccttcatcatcagtgaatgttttgggaacttcaagactatatccatcatccagagttttg

SEQ ID NO: 10734 - DNA, 201 bp, Homo sapiens
gccattctcctgcctcagcctcccaaatagctgggactacaggcacctgccaccacacctggctaattttttgttcttttagtagagatggggtttcaccrtgttagccaggatggtcttgatctcctgacctcgtggtctgcccgcctcggcctcccaaagtgctgggagtacaggcgtgagccactgtgcctagccaga

SEQ ID NO: 10735 - DNA, 201 bp, Homo sapiens
ttcaaaaccagaagccaaaagaagttatagtttattttaagcaatatccacaaaacctaatatagtccacttctgagtaatcatttaattatggtattctrtcattttatttttaaaaaatatgctgagtacataaacatgactaaaatatcaacacattctttcttcctacacataactattaatcttaaatgttccaag

SEQ ID NO: 10736 - DNA, 201 bp, Homo sapiens
gcagtcatgagtattgtagcatgtaggagtggactgctgagagaagggaagaaggatgcattttgcattcacttgtacatcagccttgaagcctggctggyggcaatattgtggacaatagatctttcaaacaaatagacccttgtctgttccttccttctgtaattgttggcagagttctttgttatgtgtctggtttct

SEQ ID NO: 10737 - DNA, 201 bp, Homo sapiens
aaatttaaacaatgtgaaatgcagtaccttgaaaaaagccaggctagtctctggactctgtagtttactttctaaataaaaaatatcctattgaccataarcaaatgaacaattcacctgttagcatatggaccaaatataggccaagatatgtagtggtagagttacaagtaaattttttgatgtgaagtgtcatagaat

SEQ ID NO: 10738 - DNA, 201 bp, Homo sapiens
accccctcttgactttttgtgtctttagtctcttaatcggcctcgacttcttttccttgacctttaaattgtctcctttatcctaaagcaaatcaaaattrctcctgataatgcaaaggtataaaattactatgatgtcttcacatcactactaacttttttgaaaagtagtcttcattctctacctctacttcctcactg

SEQ ID NO: 10739 - DNA, 201 bp, Homo sapiens
tatctttgacttccatgcaacttttgatactcttaatcaatggttctgaaactttttttgtgcatcaggatcactggtgagttattaatagttaaaatacrgatttctgaattcaacacccagagttcctaattccgtcgggctaggatgtagactgaggatttgcatttctaacgagttcccagatactgtccacgctgc

SEQ ID NO: 10740 - DNA, 201 bp, Homo sapiens
aatggttctgaaactttttttgtgcatcaggatcactggtgagttattaatagttaaaatacagatttctgaattcaacacccagagttcctaattccgtygggctaggatgtagactgaggatttgcatttctaacgagttcccagatactgtccacgctgctagtctgggggatcacaaatcaagagccatgccttgat

SEQ ID NO: 10741 - DNA, 201 bp, Homo sapiens
tcgcttgaacctgggagacggaggctgcggtcagccgagattgcgccattgcactccagcctgggcaagaagaacgaaactctgtctcaaaaaaaaaaaaraaagaaaaaaagcccaaactaaacatatccttccagtaagagaatcctttattgccagtaatggtaattatttgataaggtgtgtctctacccccttttg

SEQ ID NO: 10742 - DNA, 201 bp, Homo sapiens
atctgcagacctctaactctctcctgcatgccctttctctttcatagcttccatctctaagctgtaatggatgcaaaattactgcagcattttgttctgcygggctgaccccattacgcatacaccacagtcataaagctctggcttagttactgtttgcatgttcaagactactctgaggcagggaggtgtgaagtttgg

SEQ ID NO: 10743 - DNA, 201 bp, Homo sapiens
ttttcacaaacttagcttgttttaatcaacagtaaaaatgaagagtgatgttgttgttagcaatcttatttagtgttcaaattattatcaaatggccagcragatctcttttaaatgggctccttattctttcagcactttatttgatatttgtggccacatacttgtattttgcaataaaaaaaaatttagattctttgc

SEQ ID NO: 10744 - DNA, 201 bp, Homo sapiens
tctactctcccagcacaatcggtggtcattttgagtgaccacatcatttatctccaaaccaggacaccttggagaacacaagaggatactgttaaataaaygtgagtgtataataaacacacagtgggacttccccaggcaaacagggactcttaggggatgtatgatcaccttaacatgttttctgtctggagggaaatt

SEQ ID NO: 10745 - DNA, 201 bp, Homo sapiens
acacttcaccactggattgttgcaatgcagtcttaaatagccctcgaatatggactcaaccacatcttgcaacaagattgtcatcagcacccctttcactmtgcttggcctctatatactttactcttagccttctcctgaattagtcttagcccagtaacatcttgtgctgatgtcagtcttctggttgaccaagtaaac

SEQ ID NO: 10746 - DNA, 201 bp, Homo sapiens
gccttctcctgaattagtcttagcccagtaacatcttgtgctgatgtcagtcttctggttgaccaagtaaacgtattttttcatttcctctttttttgctygtctttttcatctctcgctgatgattgtcaactgcaatgacaccgtacttttatacactgcatgatgtatacttactcagaatttttcttattgccaaat

SEQ ID NO: 10747 - DNA, 201 bp, Homo sapiens
gctttgtttacctaagcaagcctgggcaatggcgagtgcccctcccccagccttgctgccaccttgcagtttgatctcagactgctgtgctagcaatcagrgagactccgtgggcgtaggaccctctgagccaggtgtgggatataatctcctggtgtgccgttttttaagcctgtcggaaaaacacagtattcgggtggg

SEQ ID NO: 10748 - DNA, 201 bp, Homo sapiens
atagcacatttacaattttaaattttgatcacattttgaagtaatattttgaatatattgggttaagttaaatatattattaaagttaattatacctattwctccttttttggggtggctgctagaaaatttaaaattatatatttgctttgcattatattcctcttggactgtgttggcctagatcgtttattagcttag

SEQ ID NO: 10749 - DNA, 201 bp, Homo sapiens
ccaggaggtggagcttgcagtgagcagagatcgtgctgctgcactccagcttgggcgacagagcaagattccatctcaaaaaaaagaaaaaaaaaaaaaargaaagaaaaaagaaactgaacaaatacgttatttactgaaggagtaaatatgtgtgacaaccagtggtgtcctcattccgtatctccatcttcagagaat

SEQ ID NO: 10750 - DNA, 201 bp, Homo sapiens
aaggagtaaatatgtgtgacaaccagtggtgtcctcattccgtatctccatcttcagagaatgcttgtgtgccttcaaatttatgacattttcctctcacsccttagtggtgaagaaactgaaatattgaccccatccccaaaaattaataagttaagtgtaagtggtacctgtggtccatttgaaagggaatatctgaat

SEQ ID NO: 10751 - DNA, 201 bp, Homo sapiens
ttaaagacatagtgtcatttggactttttatgatgcagtactatcttgtcacagaagacttcaggatttctcttggttagcaagtcaacagagacctgtgyatctaggcctgcatatatgcatgcatattgttacttgatgtattcggttataagaaaaggaagtcagtcctagttaataacaccatccatatgagattta

SEQ ID NO: 10752 - DNA, 201 bp, Homo sapiens
tggcatatatacatatatatgagatatatatgtatataatgtatatgtatatataaaactggcaacagaaacacaggaaatgatatgaaaaaattattttkttcatttggaacgctgtatttgttgtcatttttgaagacaataaaattgtcattcgaaccaaacccatttgtttcattatctattaatttctatctcttc

SEQ ID NO: 10753 - DNA, 201 bp, Homo sapiens
gttggttcacccccattatacctcctgagtataagtggataatgatttttttaaatcataagagcgccatgttgcaattgttattatcaccccacctcactgtgtgtgtgtgtgtgtgtgtgtgtgtgtgtgtgtgtgaagttaaatgatctttaatagtggtttgttaccaaaaaatccatgtaagctcaagtcacctaa

SEQ ID NO: 10754 - DNA, 201 bp, Homo sapiens
ttggttcacccccattatacctcctgagtataagtggataatgatttttttaaatcataagagcgccatgttgcaattgttattatcaccccacctcactgtgtgtgtgtgtgtgtgtgtgtgtgtgtgtgtgtgtgaagttaaatgatctttaatagtggtttgttaccaaaaaatccatgtaagctcaagtcacctaaa

SEQ ID NO: 10755 - DNA, 201 bp, Homo sapiens
tggttcacccccattatacctcctgagtataagtggataatgatttttttaaatcataagagcgccatgttgcaattgttattatcaccccacctcactgkgtgtgtgtgtgtgtgtgtgtgtgtgtgtgtgtgtgaagttaaatgatctttaatagtggtttgttaccaaaaaatccatgtaagctcaagtcacctaaat

SEQ ID NO: 10756 - DNA, 201 bp, Homo sapiens
tttacttttggcccttttcctcttttaggccatttccttcctttccctctaccttggacagctagtttcaataaacaaaaccttgtccttattactaccayttttagaatgccttaacttgcccttaatgcctagcctttcaacaggtggattcttgtgtgtcctgaataaacatacaaacacatagaaacacacatacac

SEQ ID NO: 10757 - DNA, 201 bp, Homo sapiens
gggtgagtggcaagagtggctgttggcaacctgtgaagtggcatgcatgccaggttaagaagttggagataatttggtagcatttgagctgcaatagatcrtgtcagagagaactatgccatgaccagatgtatgacttagataaccctgacagccatggggtggacaaatggctagggttgagactgcagccaaactctt

SEQ ID NO: 10758 - DNA, 201 bp, Homo sapiens
catataaaagcagttacggcagccctctgcactgtattttcatagggttctgtttttatcttacttaactgtaaggtccttgagggcaaaaacagtcaagyctttctcattcatcctttgcaaacccagcaccctgattcccaacagagtagaactcagcacatatttgatgaattagattgaatttaaatctatatatag

SEQ ID NO: 10759 - DNA, 201 bp, Homo sapiens
tcttaaatcaagcttgaagggaaattgattgaaaagaaaacaccattatgggaaaacaattcattttcttccccatgacagaaggtagacttttgtctatrctgcagaataaatatgatctggctgattgctttaagatctggaagctcagaggagtcataatggctttgctcactctttagagggaaattaccttccatt

SEQ ID NO: 10760 - DNA, 201 bp, Homo sapiens
taccttccattttggagacatttgatacaaaggttttggttagctttcaaaaagtaatattttttctccctgtgtgattatttatattagctagatatagrtgcatgaaaacttgcaaatatttctgtgtgcagttgtgtgtttctactgaagtaccctccagacagggagtaagcagattttttttaaaacttttctata

SEQ ID NO: 10761 - DNA, 201 bp, Homo sapiens
cttgcaaaaaactcggatgcatgtctcctgagattggaatggacaaggaacaaatgtacttgtttgtagtacttctagaatgtctccctaaatcatcttaraagcagaaatcttacccaaaatatgatgcttgccaatatattgtttaccacccatcatgctctgaaccatcatgcctcttgtctgggtagccttgctcta

SEQ ID NO: 10762 - DNA, 201 bp, Homo sapiens
tggatgctggaagtgggcgatcttgggaaagcctcattgcctcagtgccctatttaatttcgcccatttaagataggagagaataagcttctatacttgasgaacctagtttcttgtgaagagtgattgttaggaatcttttctcttttagcacttagttaacgaatacctttcaaaccaaatcaagaggcaagaccccct

SEQ ID NO: 10763 - DNA, 201 bp, Homo sapiens
tttcaaaccaaatcaagaggcaagaccccctccaactttgtccagaagccttcacaagcagaggcatattttgttttgtatcaaatgcttctcattgtccrtattcaggaggcaggcaacagtggggtcctttttgaagtgaccagggatggatgcaggcagcaaggcatcgttgctttccagatgccacctttactataa

SEQ ID NO: 10764 - DNA, 201 bp, Homo sapiens
taggcctcagttctttccctagattgagattaaaatagctttccttgcaatcatccagatgccaatttaataaacattctctggccccttccacatataamccctggactgccttactaatttcttagcattcttctccttttctccacaaatcctccctttaaagagtgtttttttcccatgcctttcttattctttttt

SEQ ID NO: 10765 - DNA, 201 bp, Homo sapiens
ctactgagaagatcagacctcccagtaggagatccaccacataagctaaaaataagagctgctacttctctgcagataccattaacccaattagataaataaaaaaaaaaaagaaaaagaaattacagcttcattaagtaacaccagaataaactccaagaaggcaaaccaaatcagttatacaatttaaaactttactca

SEQ ID NO: 10766 - DNA, 201 bp, Homo sapiens
ttacagcttcattaagtaacaccagaataaactccaagaaggcaaaccaaatcagttatacaatttaaaactttactcaaaaatcaaaatgatttgaaacsaatggtcacttaaatgaaggcagaagctgcatggcagccattattggagccagcaattcagcagaagtccaaaggtccagtgcagcagtacatgtgacag

SEQ ID NO: 10767 - DNA, 201 bp, Homo sapiens
gagaccctgaaatgacacctgtgggcttgcattttattcttggtcactgctaaaccatttttcacttccctctgtttcagtaacctaaaaatctagggttsacaaaacaatgagattaaggaagccaactgataactattgtaataggataggaaatgtttcctgatttgggaaggatgggcaaggaggtggagaatgagc

SEQ ID NO: 10768 - DNA, 201 bp, Homo sapiens
agagaagaaggtgaaagaacaaaatgactgtgaagctaagaaatccagatttggaaggagtagcatcctcacagatgctcacagaagtccatatgacactscttgcattgcctggggctttatggaagaagcagggtcacgcaggattagtcattgcccaaagagcgaagagcatggaactcgccaatagcctgcaaactc

SEQ ID NO: 10769 - DNA, 201 bp, Homo sapiens
gaaaatgaaattttacaatttggattgctgttcaggaagcaaggttaaacaaataaacaaaaataaacaatgacaaaagccttttaatgaccattctggattttttttttcattttaaaaatgaatgctcaatgtttcttcctcctagtgtattgctttacttccttaacagaatcctattttattaagaagactgtgaag

SEQ ID NO: 10770 - DNA, 201 bp, Homo sapiens
agccagagaaaaatgaaaaattccagaagtctacagaatccaagtaaagaagactttgtttggaattggcagcaatgacttccactagtagcttaccatgytagtgtaattaatctcactcccatttctacttctttttatggcagaatttcttaacctcagcactgctgacatagtgggtcatatacttcttcattgtga

SEQ ID NO: 10771 - DNA, 201 bp, Homo sapiens
gtgatacttttctgcttattttggtgttaattggtatctgccattgttgctggtggtcatgttattgttgttgctttgtcctttagtaaaggttccttctytgcttagagacaggacatgcttagaaccctttgggtcttaataaaacctcttttaatattcaaggtatagcagtgagatataaaaatgattgcatattga

SEQ ID NO: 10772 - DNA, 201 bp, Homo sapiens
gcattgaatcaacatctctatcagcttgtcttcctggagaaggatattttttggaggttctggtcaagctcagtggttactgaagctgtcgggagtcttaycaccttggggtcactgtggaaaccagaaaataaatggacaaagctgggattgctttttggctagtataatatttccagaatccctgaggcttgcttttaa

SEQ ID NO: 10773 - DNA, 201 bp, Homo sapiens
tacctgttagactggtgagagaactctaggtactttgttgggaaggatgatggagaagagagaagtgaaaatatgaaggattacttataacaaaagacttkagaaatattttaggcttgagaagcattttataagggaaagatatttgtgatggggactagtaagtaccacttttcacctattgccatttgaaaattgact

SEQ ID NO: 10774 - DNA, 201 bp, Homo sapiens
aaggtcctgaaaatataaccatactaatgcattctttttgacattattacctgaagaaaactgggtgccctttaaagaggttttaagattaggaaacaaarttaggaggagcaaaatcagggctgcaagatggttgcctaattatttcccatcaaaactctcacaaaattgctcgtgtttgatgagaagaatgagcaggag

SEQ ID NO: 10775 - DNA, 201 bp, Homo sapiens
gaacatcccccaaaactgttgccatgacctttgttcttgactaatctgcttttgctttgatttgaccacttctacctcttggtagccattgctttgattgygctttgtttttagaatcatagtgatgaagccatgtttcatctcctgttacaatttttcaaagacatgcttcaggatgttgatctcacttgtttaaaattt

SEQ ID NO: 10776 - DNA, 201 bp, Homo sapiens
ttgtttcaattttagcagaatttgtattgctctgataggagcacttttaaaacaaatgccttttctcttactccctcaaactagatcatgttcagacatgytataacaagttagtacaagtttattttgctacaaagccaaatagaaatttatgcatttttttcttatatgcgttttccacgaacttttggaagacccctc

SEQ ID NO: 10777 - DNA, 201 bp, Homo sapiens
tcttgggaagaggtcatgacaacgcttcaaccagagataattaattatttgctatattctgtaactagcctgtttatacaaatagctggtgtgctcagtayaacatagcagtgaatctatggaaaaggaatctgtaaataataatgcaagggaacttctcttacgtctattgctaaggggattatcatagcattcaatttt

SEQ ID NO: 10778 - DNA, 201 bp, Homo sapiens
gggattatcatagcattcaattttaagccatgtaacctggaatgcttactaaatgtgtaattcttgttcttcctcttcatataatgcacagacttgaattsctatattgagagaataacttacctcttttaaataataccataatttgccttgaaggtagggaagaaagagagtgaagtggggaaaatttcaaaattctgt

SEQ ID NO: 10779 - DNA, 201 bp, Homo sapiens
gcttatctcaagacagtaactttcaaaggggggtttgaatagtctttccaactgtagctacattacctgaggcaattagtttacttattttttgtttttgttttttttttgtggttagcttttctttttttttaatttattattattatactttaagttttagggtacatgtgcacaatgtgcaggttagttacatatgta

SEQ ID NO: 10780 - DNA, 201 bp, Homo sapiens
attaaaaagtcaggaaacaacaggtgctggagaagatgtggagaaatagtttacttattttttaaggcaagcaaggtgggcctgattgttacatgaattaycaaatctaatgacaaagccaggtgccctggtactgaggctgtgtctcctctactccccatttcctcccctttccatcactattttctccaccctgcctat

SEQ ID NO: 10781 - DNA, 201 bp, Homo sapiens
ctcctctttttccttctactctcttctatcctcccattcttttatttctcctctcttacatcccttccactccctttccttctcttcctttttttcttctstctgtctctctgcatgtgtctgaattaactcttgagtcagcatttaaatttggtaattgaatgttatgggtctttatgggcttcactttgggagaactgc

SEQ ID NO: 10782 - DNA, 201 bp, Homo sapiens
ggtacagtgaggataaaaatcatgtcctttcccatgttatttatagtacttttttctaaaaataattgttataataaaaaataatgccaacaacaacaacaataatattttcttcctcgtctgtttttgtgtgattcctttaaactgttaattcatgctgaacttgttcaaccaagattccataaagtaatcctcttcaac

SEQ ID NO: 10783 - DNA, 201 bp, Homo sapiens
gtacagtgaggataaaaatcatgtcctttcccatgttatttatagtacttttttctaaaaataattgttataataaaaaataatgccaacaacaacaacaataatattttcttcctcgtctgtttttgtgtgattcctttaaactgttaattcatgctgaacttgttcaaccaagattccataaagtaatcctcttcaacc

SEQ ID NO: 10784 - DNA, 201 bp, Homo sapiens
tacagtgaggataaaaatcatgtcctttcccatgttatttatagtacttttttctaaaaataattgttataataaaaaataatgccaacaacaacaacaataatattttcttcctcgtctgtttttgtgtgattcctttaaactgttaattcatgctgaacttgttcaaccaagattccataaagtaatcctcttcaacct

SEQ ID NO: 10785 - DNA, 201 bp, Homo sapiens
agtgtttctgatcaaaacattctttcttatctgttctgcttttttaaaattgcttttacttttcttcctttttttgttattcctaccaggttttgttgttattttttttcttcaatgatgtctaattgcaggttaccatttcatctgctactttattttttatgcctcaacatttggtcttctcacctctggttcacttct

SEQ ID NO: 10786 - DNA, 201 bp, Homo sapiens
cattatctgcagatatatcaggtaccatctgggtcctacccttctcatatagatccaccccaaatctacctgccttttcttttctttctttctttccttgttttttttttttttttaccttcaggacttatgattctcagagaaaagagatggagaaaccagcccgtaacttatctatctgagctgaaacagaatcaatga

SEQ ID NO: 10787 - DNA, 201 bp, Homo sapiens
ctcctgtttcttccctccactctacctaggctggtttcctccctgttgactgtcctatcatgcgtgttcatctttgtattcttcttgaagcctgtgatgaytttcactacattctctaccttcgcaaatgcagcatttccttcaaaagtcagttccaagtctttcctggacacaaaaatcaccacttatgtttctgtatgt

SEQ ID NO: 10788 - DNA, 201 bp, Homo sapiens
ggtgcctgttttactccaatgacaaaaaaaatccaatctaatattttttcaccttttctttctctgcctcagagttgataatacttacctttgtcactttygtctcacctaggtccaggcatgagcatagccctgcttcatttcaacttagcctatctttatggccttcaggtctcctctcatctggaattgagttctgta

SEQ ID NO: 10789 - DNA, 201 bp, Homo sapiens
gaaaatatatggggaaaaaatggcaaaagaaataggccctacatctgaattttaagttcctgttttttgagagaaagaaatattttgtttattttatttgttttttttttctttcccattagtaaaataattccaactaaggtaaagtttagtggaactaaacttttactgtgtgcaactctgactttcaagagtaaaagg

SEQ ID NO: 10790 - DNA, 201 bp, Homo sapiens
aattgctataaagaaacaataacttgctagggaaaaaaaaaaacaattaactgtgaagcatgtatccctgaatctgaatcatggccataatacttattagwcccccaaatttgagcttccattgccttacttgtagaatggagaaaaaaaattcctcttgaggtgtcagtaaaagaagatgaatgtatccctcatgtttat

SEQ ID NO: 10791 - DNA, 201 bp, Homo sapiens
caggaggtaaaggctacagtgggccgtgttcatgcccctgcactccagcctaggtgacagagcaagaccttgtctcaaaaaaaaaaaaaaaaaaaaaattmcaataaaagatatcattgccaaattcaatatgtaaattatatatttggaaatgtaataaaatgtgtccatgagaattacaagtagttataaccaaaaacc

SEQ ID NO: 10792 - DNA, 201 bp, Homo sapiens
ataagaagttggaaggtaggcaatccagacctcatacaatgactccatgtggtaatcacaaactgagctcattctacctgtctccttagctgtcctgactrtataggctttcatcctcatatttgtcacttcatgttcactgaatggcttctccaccttaaggcaggaaataaaagaaaacaggaaggtgaaagcaaaaaa

SEQ ID NO: 10793 - DNA, 201 bp, Homo sapiens
agatgttttgtattcatatgattggcatgaatttaaaagtgtggtaactcctattgccgtttgagatgtagaaaaattttaaattgttacagctttttttwaaaaaagattaacttttgaatggcagtttctattgaaagttttatatatatatatatatatatatatacacacacatatatatgctttgatcagaaatcc

SEQ ID NO: 10794 - DNA, 201 bp, Homo sapiens
taactcctattgccgtttgagatgtagaaaaattttaaattgttacagcttttttttaaaaaagattaacttttgaatggcagtttctattgaaagttttwtatatatatatatatatatatatacacacacatatatatgctttgatcagaaatcctaattatgagactctcatagaaataaaaataccagtatctagct

SEQ ID NO: 10795 - DNA, 201 bp, Homo sapiens
actcctattgccgtttgagatgtagaaaaattttaaattgttacagcttttttttaaaaaagattaacttttgaatggcagtttctattgaaagttttatatatatatatatatatatatatacacacacatatatatgctttgatcagaaatcctaattatgagactctcatagaaataaaaataccagtatctagctat

SEQ ID NO: 10796 - DNA, 201 bp, Homo sapiens
tcctattgccgtttgagatgtagaaaaattttaaattgttacagcttttttttaaaaaagattaacttttgaatggcagtttctattgaaagttttatatatatatatatatatatatatacacacacatatatatgctttgatcagaaatcctaattatgagactctcatagaaataaaaataccagtatctagctatac

SEQ ID NO: 10797 - DNA, 201 bp, Homo sapiens
ctattgccgtttgagatgtagaaaaattttaaattgttacagcttttttttaaaaaagattaacttttgaatggcagtttctattgaaagttttatatatatatatatatatatatatacacacacatatatatgctttgatcagaaatcctaattatgagactctcatagaaataaaaataccagtatctagctatacat

SEQ ID NO: 10798 - DNA, 201 bp, Homo sapiens
ttatatatatatatatatatatatatacacacacatatatatgctttgatcagaaatcctaattatgagactctcatagaaataaaaataccagtatctarctatacatacccaatattgcatcatattttgcggtggtttaaaaaaaaaaaaagaggaaagattaagtaaatgttcactaatagaaaaatggaattaagt

SEQ ID NO: 10799 - DNA, 201 bp, Homo sapiens
atttccttttttttttttttttctgaggcggagtctctctctgttgcccaggctggagtgcagtggtgccatctcggctcactgcaagctccgtctcccgsgttcacgccattctcctgcctcagcctcccgagtagctgggactacaggcgcccaccaccatatgcggctaattttttgtatttgtactagagacagggt

SEQ ID NO: 10800 - DNA, 201 bp, Homo sapiens
ctcacattttctgtggtatcgtagaacagaaattgttctaaaggaatggaaaaacaacatttactttcatcaaattgttgtctagcctcttgattgagttrtagctattgttactaatttattgctagtttttacaacatgcccatgatttttttctgtttcagactgaaagtaaatctgaatagatgaaatctaatttaa

SEQ ID NO: 10801 - DNA, 201 bp, Homo sapiens
gaggaacccagcaatttgcgtttcaacaagccctcccagatgattctgatgttatagcaattcttaacttgcttaagaatttggaaagtcttacaaataarggcaggactgggtggagaaaatggagaggtctgattatctttcatgtaatccccacataatttggtgtctgcaggagacacttttatttgtttgctataa

SEQ ID NO: 10802 - DNA, 201 bp, Homo sapiens
ggtattgattgtgcattatcagtttagctcacacactgacaattacatgtagcgccaaggtagccgtgacaatgtagtccagttgccatagcaatgaaagraggcctattgctgctacctgcaacctgctttatagtgataaacgtgctgcttatttcattttaattgaaatttgaaatcatagtctctagcaagaaataa

SEQ ID NO: 10803 - DNA, 201 bp, Homo sapiens
gtattgattgtgcattatcagtttagctcacacactgacaattacatgtagcgccaaggtagccgtgacaatgtagtccagttgccatagcaatgaaagamggcctattgctgctacctgcaacctgctttatagtgataaacgtgctgcttatttcattttaattgaaatttgaaatcatagtctctagcaagaaataaa

SEQ ID NO: 10804 - DNA, 201 bp, Homo sapiens
aattagctctcatgtttttgcattcttaattaactgctattttttatttccctaagtccctcatcttaacagcttaccctgcatggtgtactttatataayagagactttaatggatttacttgctgagtttagttcatatctaaaaactcacagcagatatcataaggtacttgaaaattagaatcacagggcgctgtgg

SEQ ID NO: 10805 - DNA, 201 bp, Homo sapiens
acctcagaaaatgtgcacagggtggggcatctcatgtgaaaagcatctcaatcattgattccagccacatgccatcataagctctttaaggagagatcctrtattttatattaccctcattaaatcttactccccaccataggtttctctctgtcctaaatatctgcttttagaaggagtaaacatgacttgggaattaga

SEQ ID NO: 10806 - DNA, 201 bp, Homo sapiens
tctttctgtttcgtccttgccttgactgttaattagctcagtggatttttatgtcatgaatgcatttgttttctaatacatcttcattttaatgtaagatrgttgaaaagaaggaccaagtcctctgagaaccccatagtacaaagtaaaatgcctcacatctgacaaatgctcagtaaacatgagtagtgggaaatcttg

SEQ ID NO: 10807 - DNA, 201 bp, Homo sapiens
ttgcctagagctctaacaacctaccctccacatagaagctgctctctgcttcaggcttcagatccttaaatatgggtggggtccttcatttagtgtcaaakaattgattagaaagctcctgcaatgtaagctcattaatgaaaccattttggcaggccagatgatataattagcccaaacaagatatgaaatctacagtgt

SEQ ID NO: 10808 - DNA, 201 bp, Homo sapiens
gatacacatggtgaaacattctaattgtaaaagattcatagagcaaacaattctgtaacatctatttccatatgatttgagcaatttcacacttgggaattttttttttttttttttagatggagtcttgcactgttgcccaggctggagtgcagtggcacaatcttggctcactgcaagctccagctcctgggttcacgc

SEQ ID NO: 10809 - DNA, 201 bp, Homo sapiens
gggttcacgccattctcctgcctcagcctcccgagtagctgggactacaggcgcccgccaccacgcccggctaattttttgtatttttagtagagacaggstttcaccatgttagccaggatggtctcgatctcctgacctcgtgatccgcccaccttggcctcccaaaatgctgggattacaggcgtgagccaccaccgt

SEQ ID NO: 10810 - DNA, 201 bp, Homo sapiens
agtagctgggactacaggcgcccgccaccacgcccggctaattttttgtatttttagtagagacagggtttcaccatgttagccaggatggtctcgatctyctgacctcgtgatccgcccaccttggcctcccaaaatgctgggattacaggcgtgagccaccaccgtacccggcccatacttgggaatttttactacagc

SEQ ID NO: 10811 - DNA, 201 bp, Homo sapiens
agtaaattatagccattctattttattccattccatgttaatggttcaacatgaaatagaattgcatccaaacaaatcgtgacgtcaagggtgttacctgaaaaaaaaaggtgtttcttacttaaatatattaagtaaatatagggttgtgtacaaattttaaaattttgctttactgtgggacttttagaccttttcata

SEQ ID NO: 10812 - DNA, 201 bp, Homo sapiens
atctccattttagagatagcagttatagaagaggcatctggagctaaaacagattaaatgaccttttccctcaggttcagagtaagtgtcatattgcaccmcagaataattctgtgctcaccataatgatttacccttctaaaaggtaatataatgcaatttcagaaattaatgattcttaaaaatgtgtaagcataagaa

SEQ ID NO: 10813 - DNA, 201 bp, Homo sapiens
caggaagacccttttgagattttcagcaatggacttttcttggatgagacggaagatgctctcagctggtgtgactaaattgtttgcgacttgaggacatrggtcatgccctctgtgtgtaccactcactatatcctcatcacagttcctgcataaagcagagattcagaagggtcagtcgagaacatggatgacaaccca

SEQ ID NO: 10814 - DNA, 201 bp, Homo sapiens
taaattgtttgcgacttgaggacatgggtcatgccctctgtgtgtaccactcactatatcctcatcacagttcctgcataaagcagagattcagaagggtyagtcgagaacatggatgacaacccaacactgtaacccagcagcttgtgtcttggtgtaacattggtaggttttgtttgcctttacatttttaccataaga

SEQ ID NO: 10815 - DNA, 201 bp, Homo sapiens
ccataagaggtcaactagagtttctatcttgttacaagttcattacacaggtatcccttattccttcattcaacattgcaaagaaaacatctgtaacatgmtttgagtcattaagagacattgcatacagtcaaaaaatagcatgaatttattaaattcagtactttggctgataaattgagaggaaacctttattgcaat

SEQ ID NO: 10816 - DNA, 201 bp, Homo sapiens
tctgtaacatgctttgagtcattaagagacattgcatacagtcaaaaaatagcatgaatttattaaattcagtactttggctgataaattgagaggaaacytttattgcaatttggtggtgatagtggagagtctctttccaaatataagacctagcattaagaagtatttccaagtctcctattttaggaatctcaaatc

SEQ ID NO: 10817 - DNA, 201 bp, Homo sapiens
tttaggaatctcaaatctctaaattcgagatatgtggaaaaaataggcaattttcaagaaaatttgtgttgctgctagccctttggcttgtacaatacatatttttttttttagaatatactggaaagatgaaatctctaataggtatctttctggagaacagtctttatagcaaggttttctttacacagagcaaccatg

SEQ ID NO: 10818 - DNA, 201 bp, Homo sapiens
ttaggaatctcaaatctctaaattcgagatatgtggaaaaaataggcaattttcaagaaaatttgtgttgctgctagccctttggcttgtacaatacatatttttttttttagaatatactggaaagatgaaatctctaataggtatctttctggagaacagtctttatagcaaggttttctttacacagagcaaccatgc

SEQ ID NO: 10819 - DNA, 201 bp, Homo sapiens
gagaacagtctttatagcaaggttttctttacacagagcaaccatgcacatgtagttaatggatctccagacaaaggccatttcttccctaaaacaaagcyaacaaggcaattgagccaagtaacttcaaactccccagaggggacagcagccattcttaaatccaccatacttttgaatagctatcattggtcattatct

SEQ ID NO: 10820 - DNA, 201 bp, Homo sapiens
gccatttcttccctaaaacaaagccaacaaggcaattgagccaagtaacttcaaactccccagaggggacagcagccattcttaaatccaccatacttttkaatagctatcattggtcattatcttccaaatggctttgtaagtgtctaggcataatgtgattgctttggaaattctccatttttcagggtgctgggaagg

SEQ ID NO: 10821 - DNA, 201 bp, Homo sapiens
atttcttccctaaaacaaagccaacaaggcaattgagccaagtaacttcaaactccccagaggggacagcagccattcttaaatccaccatacttttgaayagctatcattggtcattatcttccaaatggctttgtaagtgtctaggcataatgtgattgctttggaaattctccatttttcagggtgctgggaaggaca

SEQ ID NO: 10822 - DNA, 201 bp, Homo sapiens
aagtaacttcaaactccccagaggggacagcagccattcttaaatccaccatacttttgaatagctatcattggtcattatcttccaaatggctttgtaartgtctaggcataatgtgattgctttggaaattctccatttttcagggtgctgggaaggacatgaacagacacttctcaaaagaagacatttatgcagcca

SEQ ID NO: 10823 - DNA, 201 bp, Homo sapiens
gcacatatacaccatggaatactatgcagccataaaaaatgatgagttcacgtcctttgtagggacatggatgaaactggaaatcatcattctcagtaaastatcacaagaacaaaaaaccaaacaccgtgtattctcactcataggtggtaattgaacaatgagaacacatgaacacaggaaggggaacatcacactctg

SEQ ID NO: 10824 - DNA, 201 bp, Homo sapiens
ccataaaaaatgatgagttcacgtcctttgtagggacatggatgaaactggaaatcatcattctcagtaaactatcacaagaacaaaaaaccaaacaccgygtattctcactcataggtggtaattgaacaatgagaacacatgaacacaggaaggggaacatcacactctggggactgttgtggggtggggggagggggg

SEQ ID NO: 10825 - DNA, 201 bp, Homo sapiens
acgtacacatacataattgtctcattgagtttcccatctccactaagtcatggtcactgttttgccttggttatggcaactaaaagccaatggagattaayggaaagccccccaggagaaaatactcttttgcggtctttggatgaaggcctgagtatcagcaggactggagttctaaagaaactgctatgcccattgcat

SEQ ID NO: 10826 - DNA, 201 bp, Homo sapiens
ttctttagagatagttgtcaagattaaagtgcttagctcagtgcttgacatagggtaaatattcaacctatagtcaatcatcttaagtactcttgtctcaycgaggaaccatcaggaggtgtaggtaatatgcaaccttgaattagatgtaataaaatggaccccacaggaagtatttggggatattttaggcatattttc

SEQ ID NO: 10827 - DNA, 201 bp, Homo sapiens
cagtggcatgatctcagctcactgcaaactccacctcccgggttcaagagattctcctgccccagcctcctgagtagctgggagtacaggcacctgccacyacacctggctagtatttgtatttttagtagagacagggtttcaccatattggccaggctggtctcaaactcctgaccttgtaatctgcctgcctcggcct

SEQ ID NO: 10828 - DNA, 201 bp, Homo sapiens
tcctgaccttgtaatctgcctgcctcggcctcccaaagtgctgggattacaggcgtgagccaccacgcctggctatgtacaattcttaaaataagctaaartgataaacttaccctatggctttgtcatagaagggttttaaagacaaaaaaaaaattgaaaaaaattgaacttctgagaagaatggtgatattatagata

SEQ ID NO: 10829 - DNA, 201 bp, Homo sapiens
tgtaattagcgcaattttcagaggatatgtttatatcaagaatattcctgtgggagaaatagaaacttttaaggagaggtttctaggattcttagacaacyaaaactttcgtttgactcagaccctgatattacattttcccaggattcctctcacttgtgctgttttcagtgattgctcaggttatttcgaatgatggca

SEQ ID NO: 10830 - DNA, 201 bp, Homo sapiens
ttcctccctctgttcccagaaagaactaagaacggtctagctttgagctaaattgtacagctgactgtttgttttgggaacttccaaatgaacatatttgrtgttgcactggtgcatcccaggaacagaactgtctgaccagaagagcaattctgcttctggaaatttctagcacataagaagatagctggagggtatgtt

SEQ ID NO: 10831 - DNA, 201 bp, Homo sapiens
tcccagaaagaactaagaacggtctagctttgagctaaattgtacagctgactgtttgttttgggaacttccaaatgaacatatttggtgttgcactggtkcatcccaggaacagaactgtctgaccagaagagcaattctgcttctggaaatttctagcacataagaagatagctggagggtatgtttgtctgtatagtt

SEQ ID NO: 10832 - DNA, 201 bp, Homo sapiens
ctttgagctaaattgtacagctgactgtttgttttgggaacttccaaatgaacatatttggtgttgcactggtgcatcccaggaacagaactgtctgaccrgaagagcaattctgcttctggaaatttctagcacataagaagatagctggagggtatgtttgtctgtatagtttagaggctggctggtgctataaaggaa

SEQ ID NO: 10833 - DNA, 201 bp, Homo sapiens
ctgtttgttttgggaacttccaaatgaacatatttggtgttgcactggtgcatcccaggaacagaactgtctgaccagaagagcaattctgcttctggaartttctagcacataagaagatagctggagggtatgtttgtctgtatagtttagaggctggctggtgctataaaggaaagtaagaaaagggcaaagatatcc

SEQ ID NO: 10834 - DNA, 201 bp, Homo sapiens
accagaagagcaattctgcttctggaaatttctagcacataagaagatagctggagggtatgtttgtctgtatagtttagaggctggctggtgctataaasgaaagtaagaaaagggcaaagatatccttcagaggattcccccagaagaaagtagcagttatgaagttttattcctgaggtaggacaggcagtcagaccc

SEQ ID NO: 10835 - DNA, 201 bp, Homo sapiens
ctaggtagaatgaagatacaatataagctaatcgatgatatcctcctataaattcctttggcagatctatttactatggagatccctagtggagaggatgrccttaaggaattgggaaataaaatagttaacttgagataggttgaaagagaaaataattcctgagaaaggaacacaatactgcttgaaaatagtactaat

SEQ ID NO: 10836 - DNA, 201 bp, Homo sapiens
agattaaatgaggcaaaagtgactgcatcacatttcactgtctatagaggctattggcagatttatgcaggctgagttaagtgaatgacttgatagcctgkatcacatctatatgtgtttttcacaggcatcatgtcttagttagttttatgttgccataacagaatgccccagactgggtaactcaaaatgaacagaaat

SEQ ID NO: 10837 - DNA, 201 bp, Homo sapiens
acttgatagcctggatcacatctatatgtgtttttcacaggcatcatgtcttagttagttttatgttgccataacagaatgccccagactgggtaactcamaatgaacagaaatttatttggctcacagttctggaggctgggaagtcttagtgcatgaaactgacatctgacatgggcctttgtgctacatgatcccatg

SEQ ID NO: 10838 - DNA, 201 bp, Homo sapiens
ggtgcatggtagtcaggggatgaggtcaaattaggcaaatgtgacttcatagccctgctgtaaccagctggaaaataagagaatgaacagacaaaaatagwcttgtaccacattaatgacatactgattatttgaattagttaattttgctaggagtagagataataagagtgtggttctcagttgctgcttaccccgaac

SEQ ID NO: 10839 - DNA, 201 bp, Homo sapiens
ttcatgaaagacttctttgtagcatgcgatgctatttgatagcattttacccactgtaggacagctttcaaaattgtagtcaatcctctcaaaccctgccrttgctttttcaactaagtttatgtaatattctaaatcatttgttgtgatttcaacaatgttcacaacatcttcaccaggagtagattccatctgaagaaa

SEQ ID NO: 10840 - DNA, 201 bp, Homo sapiens
cacttctgattccactctgccacacatttctctgtgagtctgttaaaatatggataatccaaataacttctttctaatgtgatttatatgaaatggaagcrtgttctccttcccccttatgtgctcttgttttgaattgcaaatattcagttttgcatatatttaaaagttattttgacagtatgtaatgtagatttaaaa

SEQ ID NO: 10841 - DNA, 201 bp, Homo sapiens
caatatgtggaatagtgagggtctcagaacagacagaggacctgggccttgaaggccagctgcgtcatctggagatgaagatggaaggaaatggggatcaytgaggatgaagaagaaaaggagccctaaaggtctcttacagtcatcattttgtccgtagaaacacatctctgggaaggaatgagttaggtttttcttatt

SEQ ID NO: 10842 - DNA, 201 bp, Homo sapiens
ttgaaggccagctgcgtcatctggagatgaagatggaaggaaatggggatcactgaggatgaagaagaaaaggagccctaaaggtctcttacagtcatcaytttgtccgtagaaacacatctctgggaaggaatgagttaggtttttcttattctttcttcattaataaaaatagaaaaacaggtggtgaaacaaattgga

SEQ ID NO: 10843 - DNA, 201 bp, Homo sapiens
gtgtcctgctaacctgttctgatattcaatggcacttgttacccaggagttcttttttaaatcactatctgaaatccctattgctctcctgtgagctgtatttttttttttttttttttttttttggctttcctctgtttatcctcaggggacagaaagaacatatggcaactatctctcaagtaataatccttcaatttt

SEQ ID NO: 10844 - DNA, 201 bp, Homo sapiens
tttaaacttgggtccaaatcctgtatgcttaaccattactgcaccagagaggtcctccaggcttcccttgagtaatctgaggaatgaggtgtgtgttatcttttttttttttttcctcaatcaattgaggttttattgagctagagcttgagggtgtgcccaagataaacaagagtcacagaaatcctctgtggcttatgt

SEQ ID NO: 10845 - DNA, 201 bp, Homo sapiens
gttgttgatttggggaagaggtatgagccaaatggacattggacaaggaattaaaatttataattgccgcgaatagtaacttttccttagctgctgcttcrtacttgaaaatggaatgccctgtagcttgggaaccgaattttatggtggctctgcttttgtgatatttcattcaatccatttaacagttagttgtatttt

SEQ ID NO: 10846 - DNA, 201 bp, Homo sapiens
ttcagtaggtctgcaatggatctcaggaatctgagaacccccaccccgccccaagcgaacatgacacttctcttcgaaaaacactagcttcaattgtagaraaaaccaaaagtgcacatgaatggaaatctgggacatagtaagacaaaagagactgaagtaggaatagcaagcatttcaaaggaaaatgaggctgtccct

SEQ ID NO: 10847 - DNA, 201 bp, Homo sapiens
ggtactcaaccttgtagatgaagataagtgaggaagaaccagttattagagtatcaatggcattggtcatttggttataagcgtaagtgaatttccccttsaatttaccctgtgagttgctatttaatggtgttggacagttacagataagtttggtagaacttttctctttgtttccttaagggttttgcctttgggtaa

SEQ ID NO: 10848 - DNA, 201 bp, Homo sapiens
cctcagttttctcatctttaaaatggggctattaagagtacttctctgtattgtcattgtgaattatgaatcaatacataaaatgagtttagaagaatgaytggcacttcacaagtgctcaatgttaaattgtttttattgggaagaaatgaaaatacttccttgcttaatgttggagaaaagaatcactaacccatcgca

SEQ ID NO: 10849 - DNA, 201 bp, Homo sapiens
tgaactttccattaacattcaatctttcacttatatgaaaaatattttccttcctcctctttttcctcttccgtactttctccaaattcaggaggcagatratggtaattgaaagttctagggacacactgtgagctcaaggtccagaaaggttagggaaagtctttattttgaactgtaggtatgttttaattccttctg

SEQ ID NO: 10850 - DNA, 201 bp, Homo sapiens
aaaggttagggaaagtctttattttgaactgtaggtatgttttaattccttctggagactagcactcctcagggatgctgagactggcactggtgctaccrgatattaaacagaatggatttaaagtattctcctgtattaagaagattattttcaaaagaaagctctattttgtagttattgtcactttcctaaagatat

SEQ ID NO: 10851 - DNA, 201 bp, Homo sapiens
tcggtttctgatagaagctgggataaaaaaaggaggtagcaaaaaagtgtgaataggacaagtctgagactcaaatgataaaaggtagctctgcaaggacsagacaagcacatctaagtcagagaattgttaatacaaaagagtcttatggcaaaaataagattggtttatttgagaacaacaacaaaaaaggtcagagag

SEQ ID NO: 10852 - DNA, 201 bp, Homo sapiens
atctgttttggtaccagtaccatgctgttttggttactgtagccttgtagtatagtttgaagtcaggtagtgtgatgcccccagctttgttctttttgctygggattgtcttggctatacgggctcttttttggttccatatgaaatatgaagtagttttttctaattctgtgaagaaattcaatggtagcttgatgggga

SEQ ID NO: 10853 - DNA, 201 bp, Homo sapiens
cagaaccttgggactagctgaagggccgctagacctaatggcaggggtaactatttttgcaattgtgaatattcagcatgcacaggcttcctatcagctcycccaggagctctctgagagatggaccctgtgaggaaacatctttaaatgaacaccttagtagagaatgatcctgttaggtgaataaaaggctgattacat

SEQ ID NO: 10854 - DNA, 201 bp, Homo sapiens
ttcctatcagctctcccaggagctctctgagagatggaccctgtgaggaaacatctttaaatgaacaccttagtagagaatgatcctgttaggtgaataamaggctgattacatacccagaggtgagccataatgaggctcagagtaactaaatgcagcaatctgctgcactttgtatctggacttgagcctgagcatttc

SEQ ID NO: 10855 - DNA, 201 bp, Homo sapiens
gagatttcaacagctaagtgcaaaagaaaattttaaaatacttagtattaaaatttttaacttgctactactttattggtctcatataaggacatgaacamctggggaagtaattggaaagggaaggaacataaaaaatattttatattctgtgaggtaaaaactgaggctaaaacataaataatttggcccaggtcatat

SEQ ID NO: 10856 - DNA, 201 bp, Homo sapiens
ctgtaatccgtgatttggttctaagagcctataatgaactccagttaattcagatgccatttagagaaacttggtcatattctaccttagaaaactcttgraataactttagttcttttgaaaattgcagtggtccagacatttttactctagtataactgctgtgtgtgtgtgtgtgtgtgtgtgtgtgtgtctgttgat

SEQ ID NO: 10857 - DNA, 201 bp, Homo sapiens
tactgcaacctccacctcctgaggttcaagccattctcccgcctcagcctcccgagtatctgggattacaagcacctgccatcacgcctggctaagttttrtatttttagtagaaacagggtttcaccatgttggccaggatggtctcaaattcctgccctcgagtgatctgccttcgacctcccaacatgctgggattat

SEQ ID NO: 10858 - DNA, 201 bp, Homo sapiens
ataggtgtaagccagggtagctttttaatactgctccctctctcttaggtattcacagtgcatattagcaaattaaatgttctgtgaagtcttgtattaartacatcttttaatattttatttaagacttcccaaattcacttgaccattcactttgtaatattccttgacagaatacttgttaatatccagctcctggga

SEQ ID NO: 10859 - DNA, 201 bp, Homo sapiens
tagtttcaaatccagacacccaatacacacacttccactcaccttcacgttctcacaaacttatacaagaaagtactcaatgatgtatttctaggcattaratatttatatggtgtatataggtaggtatatatatatatgtatgtgtatttatgtgtgtgtatatgtacatatgttcacatacatttatgtatatgtatg

SEQ ID NO: 10860 - DNA, 201 bp, Homo sapiens
ctagggaggctgaggtgggaggatcactttaacctggggatcaaggctgcagtgaaccagattgtgccagtgcactttagcctgggtgatagagtaagacmctctctaaaaatatatatatttttaaaagtgtgttagatctgcatattataaaatgacatgaattaagattcttcctccgtcatttatttctgttaaaaa

SEQ ID NO: 10861 - DNA, 201 bp, Homo sapiens
taaatattactatattactaatgtatcttaattttcttttttacaaagatcctataatatcagtaggtctagaattaggtcaagaatctgcatttttaaaraggcattccagcggcttctaaggcaggtggtttctagacaaactttccaaatactgagtgaaaagtttattcatgttgtgtttccattatttatgtgtaa

SEQ ID NO: 10862 - DNA, 201 bp, Homo sapiens
tacttgaggatttatcttgtaccagaaacttttacatgctttacattcatgttgaaaattaaatgctggccaggtatggtggctcacgcctgtaatcccarcactttgggaggctgaggcagacagatcacttgaggtcaggagttcaagaccagcctgggcaacatggtgaaacctcatctctactaaaaatacaaaaat

SEQ ID NO: 10863 - DNA, 201 bp, Homo sapiens
tttcctgtatttcagatgaacaaaatgagataatgcattcatatactgattcagcaaacatttattatgacttcccatgtactgggtactatatagatatkcgagattaaaacaaagaaatacaatgtaaaaattcagattcttttaaggattccaccgtctactaggggaaacagatgcaatgatgtcatctataatata

SEQ ID NO: 10864 - DNA, 201 bp, Homo sapiens
tacatggagttaaatacaatacccttagtggaattgtttggtacaaattgtggtggcattgactctgtccgaggttctgcttacattctgtatgcctggakgctagccgatcctctccatccagtggaatccagccttgtctttatctagcataaacctcacccttcccttgtgatctccaaacatgtgaacagccttttt

SEQ ID NO: 10865 - DNA, 201 bp, Homo sapiens
atttcattatattatctcttttttctcccttctacacttttcatttaccaccactccccaccccctgctacctaaatatctttatcccaatggaagatgcrttaccaaagattcacagtttatggaccagaagaaaaatgtggcttctaagtaagtcctgcagtcttatttctcacttctgtcattgacagccactaaatc

SEQ ID NO: 10866 - DNA, 201 bp, Homo sapiens
agttgaagtccacatatgataacatttctgcctccacttaaaaccctccagacagcccttcaatgacctcggcttacaatacaaatgtgttatgattttcyaggcccttcttcatctgctctcccttccttttgagcattatcccatttcatgcccccacacagattctagccataccccatgacttacaatttcccacaa

SEQ ID NO: 10867 - DNA, 201 bp, Homo sapiens
tgagggctggggcagtcagcaacacaatttttccactcacttgtggagctagaacataccttccctctgttttgtaaagatgagcctcctccctttcttasaacatttggagaacttcataactttcaatataacattcaagacatacttcaagagttgcccagccacatccattagtctaggtggcacctatgtggttca

SEQ ID NO: 10868 - DNA, 201 bp, Homo sapiens
gtaataaatgaagtaataaatggttcttcaacatttctgggtcacgaagttctttaaaaatataaagaaatctttggactttttttccagaaaaaaaatgyatacccaaagtaaattgaatatagttttggaaaggagtttttatcttatcctaccatagatattatgtactacacaactccgggggcacaattcacagac

SEQ ID NO: 10869 - DNA, 201 bp, Homo sapiens
gtagtgataattaaggatatagaattattttctaaacacgcataaatttatagttaagagaaagcatctcatttcaatgataaaatgagagatcatttaattttttttttttttttgagacagagtctctctctatttcccaggctggagtgtagtggtgcaatcttggctcactgcaacctgcacctcccaggctcaacc

SEQ ID NO: 10870 - DNA, 201 bp, Homo sapiens
ggaaaatgccctctcagatcacagaaacagtagctgtgtaggtgttgctagtggagaaaaaaaaatgtttggtatttaaaatagaaacataaaattgttartaagtctacagacaacttgtattgcatgcagaaataaaaaatgaagtcctagtacaacaatactgcttagtcttggattcattttacagaagtttaagat

SEQ ID NO: 10871 - DNA, 201 bp, Homo sapiens
ctctttattgcctagcagagaattaattggaaggtccatctaagcttcccacacatcctcagaatgaagtcaaagcagtctccaatgctcaatgccaattaaaaaaaaaaaaaaaaaagaaaaacagtaagtgggtaggtggtcagtttatcaactctggaaaagcttgtctttgaggattcacactgctaaagccagaca

SEQ ID NO: 10872 - DNA, 201 bp, Homo sapiens
gcagagaattaattggaaggtccatctaagcttcccacacatcctcagaatgaagtcaaagcagtctccaatgctcaatgccaattaaaaaaaaaaaaaaraaagaaaaacagtaagtgggtaggtggtcagtttatcaactctggaaaagcttgtctttgaggattcacactgctaaagccagacaaacgcatcagcaaa

SEQ ID NO: 10873 - DNA, 201 bp, Homo sapiens
tgcaggtagtgtcaaaggtgggaagggaatttaaaaaaaatgaatttaaaatgatgaaaagcatcgtatgtccatgagggaagcaaatttctactttctcmtaaaggttagtgttttctgcccctagcctccgacaaccatctccacttttctctaaagggttcttttccccttagctccctcattcatagctgcacagac

SEQ ID NO: 10874 - DNA, 201 bp, Homo sapiens
tctctcttttgcaaccttctactctctccacccccacggagacaggcaacttatcaggtgagtcccagtgctgtacttggagaaatattcattcaccttgytttcacccttctttgctgtggtcttgcttgggagctagtgggggtggggtgggaatagctgacaacaggaatcaggttttcagcctgaagttgattgaac

SEQ ID NO: 10875 - DNA, 201 bp, Homo sapiens
tggggtgggaatagctgacaacaggaatcaggttttcagcctgaagttgattgaactgttataaagtagcctgtgtggtaatggtcagggaaaagtagccraatataagaaggcagaaaatataattaacaacccgtggccatttgtgttggttttggcagctttatgtttgcaggaacagccctccagggaacatgagcg

SEQ ID NO: 10876 - DNA, 201 bp, Homo sapiens
ccagacctatagagagattcatgctaagacagatggaagaaacagaaatcctccaaatagctgatattttacctacacttttgcctgtgcttggttccaarctttagaaaattggttatattatagatttgcttaaagcctttatcccaggacagcctagaggatgctgggattctttgtaaattagggagactaaggcca

SEQ ID NO: 10877 - DNA, 201 bp, Homo sapiens
tcctagcactttgggaggccgaggtggggggatcacctgaggtcaagagtttgagacctgcctggccaacatggggaaaccccgtctctactaaaaatacwtatatatatatatatatatatatatatatatatatatatatatatgtatctccaatgtacatctgcctaaaaaatgcttcagtatttatagtttaaatgc

SEQ ID NO: 10878 - DNA, 201 bp, Homo sapiens
attcagggagttgaataattcatagtgttggttgacagatcaaatgataagatttatatatctttggccttggtgatgaattaattagattggtttctccrtctttggctcctctagatgcgttgtttttcttctttaaaattcactggtgagtggtgggtctggagattaacttgttcttgagagaccaccataggatga

SEQ ID NO: 10879 - DNA, 201 bp, Homo sapiens
taaacctgtgcagaattcaaacattcctacatggttctcagtgtccattgtaaactaagatttttaatctggtttgtgctgggaagaagcaggtgtttttrgggacaactaccttcagatgtggaagtgaagtacttcttttaatgcaatttcttaggcttactagggctcaaagtttgtagagcagataggagcacaata

SEQ ID NO: 10880 - DNA, 201 bp, Homo sapiens
aagcactttgattaatgcagctaacacacctttccaaagcatctacaagactttccaattcctaataagtatttgaatgttttccaatctgcctgaacccrtttcaacccaaggagatagtaaataaaaggagcagactgatgaaacactcacacttgatatgtctttttttttgaatgaatgaatcaatgaataaatgat

SEQ ID NO: 10881 - DNA, 201 bp, Homo sapiens
gtctctttctactgcatcacaatgttagcactcaggctttccaggtgtcatctgttttgctgtggactgggaaactgggattgtctccagcaccacttggrtaacaaatgagcacagaaggagcagagagcagcatgacaaccaagatactccaaacactcgcactgtttcctgtaattaccatccagagagcagctccca

SEQ ID NO: 10882 - DNA, 201 bp, Homo sapiens
gttcaaacaaatcatttgggcttgcagaaaataatatgagattaatatccaagtgtgtgtgtgtatgtatttgtggggtgtgtgtgtgtgtgtgcgcgcgygtgcatatatgacaactacgtggctcctcacttgaagttttggaattagctactaatatatgtgtatgtttaagggatgcatttgtggacttgaagttga

SEQ ID NO: 10883 - DNA, 201 bp, Homo sapiens
tgattgtaagtttcctgaggcttcccaagacatatggaactgtgagtcaattatacctcatttctttataaattacccagtctcaggtagttctttatagsagtgtggaaacagaccacacagaccaccaagccattcatgagggatctgccctcaggatccaaacacttccctccaagccccacctccaatgttggggat

SEQ ID NO: 10884 - DNA, 201 bp, Homo sapiens
caggtagttctttatagcagtgtggaaacagaccacacagaccaccaagccattcatgagggatctgccctcaggatccaaacacttccctccaagccccwcctccaatgttggggatcacatttcaccatgaaatttggaggggacaaacatccaaaccgtatcaacagggaactatagctcagggaggttaagtaactt

SEQ ID NO: 10885 - DNA, 201 bp, Homo sapiens
gcattggagttaatgggaatggggaatgccttctttgcttcttgacatttctcctccacaacactgcacatcccttgtgaaataatttactattttttagrcatcatgtcaaagactgaagtgaaagccaccctcttgtgatcaactgaggtcagaagttggcaaatttttttgttgggggtggggggctaaagggccaga

SEQ ID NO: 10886 - DNA, 201 bp, Homo sapiens
aataatttactattttttagacatcatgtcaaagactgaagtgaaagccaccctcttgtgatcaactgaggtcagaagttggcaaatttttttgttggggrtggggggctaaagggccagataataaatatttttggcttttcacaccagaaagatctccattgccactagtcaattctgcatttataactgagaagcaac

SEQ ID NO: 10887 - DNA, 201 bp, Homo sapiens
ttacaaaaggcaaagagggctggatttggcttcccaatctctgccttaggcctttaaagatatagcttccctggggaaatctctacactttgagatttatrctccagtactaataacatagtaagagaatagtaatggtggtggtaataatagcagtagtggcatcagcagcaacaacaatggcaccttttaacatttgct

SEQ ID NO: 10888 - DNA, 201 bp, Homo sapiens
cagttcagataagatacaatcctaacaaataaagtggggtcggagtggaatgttcttgaaatcctggtatcaatgggactgggatattactctaaatctayggaaacttcaagaacaatatatttgttttaacctgaaaagacagttgcgttccagtgtgaaatagccaccaggctggatgaaaatgtgtgatgtgattcc

SEQ ID NO: 10889 - DNA, 201 bp, Homo sapiens
ttctcgcttcatttcattcatttcatcttccattgctgataccctttcttccagttgatcgcatcggctcctgaggcttctgcattcttcacgtagttctsgagccttggttttcagctccatcagctcctttaagcacttctctgtattggttattctagttatacattcttctaaatttttttcaaagttttcaacttc

SEQ ID NO: 10890 - DNA, 201 bp, Homo sapiens
acgcagctggagatctgaggacgggcagactgcctcctcaagtgggtccctgacccctgacccccaagcagcctaactgggaggcaccccccagcaggggyacactgacacctcacacggcagggtattccaacagacctgcagctgagggtcctgtctgttagaaggaaaactaacaaccagaaaggacatctacactga

SEQ ID NO: 10891 - DNA, 201 bp, Homo sapiens
ttgccctgcatattgataattttaccatgcagactccactcctcaggtaactcttgttctattacactggactttatcatcatgtaatctgtcctgtcccyctctctctctctctctctctctctctctctattgaattctgggggtgtagtagtccattgtttagagggaatttagaagttttcctatattaggaagtgt

SEQ ID NO: 10892 - DNA, 201 bp, Homo sapiens
ccgggcgtggcggtgtgcgcctgtaatcccagctacttgggaggctgaggcaggagaatcacttgaaccaggaggcagaggttgcagtgagcctagattgygccactgcactacagcctgggcaacagagtgagacttcatctcaaaaaaaaaaaattatatagtataattctaataatgggatgctccacttcacttgca

SEQ ID NO: 10893 - DNA, 201 bp, Homo sapiens
gaaatagtgggtccctttttcaaaaagcaataacgaagtgccatgagaagtacttaaaacataaagctctttttcctttttccatggtttctctctctaarcttgtcatgttgttttatatttgctcttcagtgtcattctaaggaaagaaaatgttaaattattagcatgaattttgccattcatctttatattatgcca

SEQ ID NO: 10894 - DNA, 201 bp, Homo sapiens
ttgatccctagttaggcaaaaacatggagatgagaatatgtgagccttgtttgagaattgcttagctagtgtgaggtaagtcagggaatttcagaagaaasccaattatgaaagcatggattggactgtttgaatattttcctctagttgataaagtgactgatggctttagctactgaattaacgtgatcaaaagagttt

SEQ ID NO: 10895 - DNA, 201 bp, Homo sapiens
aagccaattatgaaagcatggattggactgtttgaatattttcctctagttgataaagtgactgatggctttagctactgaattaacgtgatcaaaagagttttttttttttttggagatggagtcttgctctgtcaccaagctggagtgcagtggcatgatcttggctcactgcaacctctgcatcctgggttcaagcaa

SEQ ID NO: 10896 - DNA, 201 bp, Homo sapiens
tcatcatgttggccaggatgatcttgatctcttgacctcatgatctgcccgcctcggcctcccaaagtgctgggattacaggtgtgagccaccgtgcctcrcccatcaaaagagatttttagtgaattaatatggaagtgtcctatcacagagataggaaggggtggatctgttaatagacagatgaacaagggagctatt

SEQ ID NO: 10897 - DNA, 201 bp, Homo sapiens
cctcactatattattttgtgtatgagtgacagctgtagagatatataatggtttgagtttgccaagtcacagccccctcgtttgacctctgaatttaagggtgtgtgtgtgtgtgtgtgtgtgtgtgtatgtgtgtgagagagagagagaaagagatacagatagacatttcgttggaggaggagtgtgagggaaaaccta

SEQ ID NO: 10898 - DNA, 201 bp, Homo sapiens
ctcactatattattttgtgtatgagtgacagctgtagagatatataatggtttgagtttgccaagtcacagccccctcgtttgacctctgaatttaagggtgtgtgtgtgtgtgtgtgtgtgtgtgtatgtgtgtgagagagagagagaaagagatacagatagacatttcgttggaggaggagtgtgagggaaaacctag

SEQ ID NO: 10899 - DNA, 201 bp, Homo sapiens
gcgcctggcctgacattgtttaattttttaaagtacagcccttagtgataatttttccttttctgtagccagagaggattctagtattttggcagttggamgatatcttatctctctcaatgccctcatcagttgagaaataagcctctttcttttagtattttatattctcaaagctcagaacatttcagagtcatgtta

SEQ ID NO: 10900 - DNA, 201 bp, Homo sapiens
ggatttttaattatttagttgacgcttattcaactatatgatgtaagtaggccttttctccctaatgttttattaccagttaaagcacagacaggtatttyactttaatttagatatagagtaggtaacagagagctgaaattttaaaaattagataaattttttggtagttagttttatagttaatcttctctctttttt

SEQ ID NO: 10901 - DNA, 201 bp, Homo sapiens
aaagtgaaaggagtaaattgctttatggatttcctagtgcatagtacacatagaacttttctaaatatacatcctcttcagcagttagtttgtgccagatytcaattcctacgctacaagttctccagcaaactagaggtgtccatgtccaagtggacatgctaaaaaattcaaattttacagaaattttacagagacctt

SEQ ID NO: 10902 - DNA, 201 bp, Homo sapiens
tatgaataagtcatcaatagttaatgataaggaatcagtctgctgtgccatattggtagatgaaatgctgctactcctcctattcctgggcttttctgccycccacccccttccttccctccttcctctgtccctccaactcttcttcacatctcccaactcccccaattcacttcttttccactgcatgccatgttaccc

SEQ ID NO: 10903 - DNA, 201 bp, Homo sapiens
tcagactgactttttgcaggttatgctgaaagatgaatgctcagtaatagctcgtgccttaagacgtggccgagcaagctttggaggtaaaatagctcatrgagtttttatttatttatttattctttaaaaatggtcacaaagatttcagataaacaatctgagtatggctaaattatttttcttaggtaaacataggag

SEQ ID NO: 10904 - DNA, 201 bp, Homo sapiens
ccttaagacgtggccgagcaagctttggaggtaaaatagctcatagagtttttatttatttatttattctttaaaaatggtcacaaagatttcagataaamaatctgagtatggctaaattatttttcttaggtaaacataggaggcaagagattaaaagggtgggagaaacattaattaggctatgctcttatcaagtag

SEQ ID NO: 10905 - DNA, 201 bp, Homo sapiens
ttatttatttatttattctttaaaaatggtcacaaagatttcagataaacaatctgagtatggctaaattatttttcttaggtaaacataggaggcaagarattaaaagggtgggagaaacattaattaggctatgctcttatcaagtagtgtgaccttagcgaatttacctaatctttttgaacctcagtgtcctcattt

SEQ ID NO: 10906 - DNA, 201 bp, Homo sapiens
atctttttgaacctcagtgtcctcatttataaaatggaggcataactttttatgaagattaagataatgtgtgaacaatctgtgcagtagtagttgctcartaaatggtagtgattttcacatgtatttggactattgtagaatatagaaaagaatatcatgcaaactctagtcctttaaatatgagtgaggaagaggaat

SEQ ID NO: 10907 - DNA, 201 bp, Homo sapiens
taggtatatctcctaatgctatccctcccctctccccccaccccaccacaggccccagtgtaagaaatacaataaacaaagtatcttttattttggctacrtagttatgttgagggtcattcatcgtcctccagtttagcctatttggaacggtactggttaatctcaataaacaaataacattgtcagtttaattgttca

SEQ ID NO: 10908 - DNA, 201 bp, Homo sapiens
gcttggatttgggcaatagataaaaacacatagagagtatttgcagatgcatgtgatagatagaaatggtgagtgaccatttagaaatttagaattggaattttttttttttttttgagtctcgttctgtcacccaggctggagtagtgcaatggtgtgatcttggctcactgcaacctccacctcctgggttcaagcaat

SEQ ID NO: 10909 - DNA, 201 bp, Homo sapiens
acgtaggaacagttccaggcagctaaaagagcttcttcctcacttgccactatcttaaatggtatctggtgtctacagttgctccttctactttcttaagaaaaaaaaaaaaaatccaaatggaaaagaggactctgaagacaaattagtcctttacaattataattttatttgatttcaaagcagtacttggtatagcac

SEQ ID NO: 10910 - DNA, 201 bp, Homo sapiens
taggaacattccaattccacttttttaatttttaaaaatatgcaatacataattgttgactatagtcaccctgttgtgctatcaaatgctagattttattyattctatcaatgtttttgcacccgctaactgtctctacctttcccttctctccccaatacccttcccagcttctggtaactgtcattctactctctatct

SEQ ID NO: 10911 - DNA, 201 bp, Homo sapiens
acacagaaatagcttctcaataactgaatcagtaatccatttttaaaatctttttcaattcattaaaattaaatagaattaaaaactcagtcccttagtcttttttttttttttttttttggagatggagtcttgctctgtcacccaggctggagtgcagtggcgcattcttggctcactgcaagctctgcctcctgggtt

SEQ ID NO: 10912 - DNA, 201 bp, Homo sapiens
aggcatgcgctaccatgcctggctaattttgtttttttagtagagacagggtttctccatgtcggtcaggctggtctcgaactcctgacctcaggtgatcygcctgcctcagcctcccaaagtgctgggattacaggcatgagccaccgtgcctggccaagtttatgttaaataactcgtccagaaggtgtagtgggatgt

SEQ ID NO: 10913 - DNA, 201 bp, Homo sapiens
ggattacaggcatgagccaccgtgcctggccaagtttatgttaaataactcgtccagaaggtgtagtgggatgtttgactccaaaatacatgcttttaccrcctcaactgactgagcttgggactacctctaactttcattagaaacacaaatctttttctaataaactttcttcttcttttcaataaaaacatttcccac

SEQ ID NO: 10914 - DNA, 201 bp, Homo sapiens
atggaagcgaggtcagaaacgcctcattacatgccctttatgttagagtttaggcacaactgaccagcattaacattaaaatagagatcataagattaackaaagggactcattgtgacactaaaataccacattctaaataagacctaaggccatgcaaagcaagggttaaggcatgctctgcaaaccgtaaaatctttt

SEQ ID NO: 10915 - DNA, 201 bp, Homo sapiens
ggcagatagcagaccccttatcttgacttaagcatccctttgtattgacctcaagtctttagacaaagcttaactctttcaatcaattgccaactaaagtrtctctaaaactcacccatgacttgtaagcccatgcttcaagatgtcccaccttttcaggccaaaccaatgtatacttttcatgtactgatttataatttt

SEQ ID NO: 10916 - DNA, 201 bp, Homo sapiens
tttttttttccttaaacacaaaactacacccccgcctccagctcccaccccctcccacacatatacccttttttcatagaacaaaatttggaataaatggmctttaaatgaatgcattgttttgactctgcagggaaatgacatagagaaaataaggaatggatcgtacatgctcatgcactgtctggggcactcctgctg

SEQ ID NO: 10917 - DNA, 201 bp, Homo sapiens
tcctcatcctccaattaattagctgaaaaactgactgcatctctgattctctaagaagcatggaagagaaagaaatgggaaaccagctagcagctcattasatgaattcaaacagttccctttgaagggaaactttttcctggcatagatgatgtcattgatgagattgcaagggtaggcattgtataaagatgagatcct

SEQ ID NO: 10918 - DNA, 201 bp, Homo sapiens
taaaatgtctctttaaagcctgggagctctccaaggtgtggtgtgtttcctatttgctaggtacatgattacgatgcatatggatagatgtttctgaagtrtttccttctaagtgcactattgccagtcagatttacacccaagtagcaaagatgttaatgccatgcaatcctattaatctaacatgttgcttttgtggat

SEQ ID NO: 10919 - DNA, 201 bp, Homo sapiens
tactaagtagaagatacttgaatattccattggctgactgatgtgtttattaggcacttactctgtgcccaacacaatgataaacattctcagcaatatcktgaaagtttaacacaggattcctggcttccagaaatatgatgtttacttaagaagagataggaacatatgtgaaaaagttaagcttcatgtagtatctta

SEQ ID NO: 10920 - DNA, 201 bp, Homo sapiens
cagaagttgtggagtagtgtttttgagttatccgctgtttaggatcctgtattaaaagaagtatgtcggctgtgcatagtggctcatgcctgtaatcctarcactttgggaggccgaggcaggcagatcacctgaggtcaggagttcaagaccagcctggccaacatagcgaaactctgtctctactaaaaatacaaaaaa

SEQ ID NO: 10921 - DNA, 201 bp, Homo sapiens
tcctagcactttgggaggccgaggcaggcagatcacctgaggtcaggagttcaagaccagcctggccaacatagcgaaactctgtctctactaaaaatacaaaaaaattagtcaagcatggtgtcgtgcacctgtaatcccagctactcaggaggctgaggcaggagaatcacttgaacccaggaggcagaggttgcagtg

SEQ ID NO: 10922 - DNA, 201 bp, Homo sapiens
agatcacctgaggtcaggagttcaagaccagcctggccaacatagcgaaactctgtctctactaaaaatacaaaaaaattagtcaagcatggtgtcgtgcrcctgtaatcccagctactcaggaggctgaggcaggagaatcacttgaacccaggaggcagaggttgcagtgagccaagatagtgccaccgcactccagcc

SEQ ID NO: 10923 - DNA, 201 bp, Homo sapiens
aaaattgaggtttttatctcttgattatggagcttaactcattgtgagcccattgacatcctgaaatacttgctgaatgagagaataaatgaacagatttaaaaaaaaaaaaaaaccctgaagagctaagcttaagccactatttaggctttgaagttgatccatgtggtcttttgttttggattgattgtagggactaaa

SEQ ID NO: 10924 - DNA, 201 bp, Homo sapiens
gctttgaagttgatccatgtggtcttttgttttggattgattgtagggactaaagaagtacttcatacgttgtgttatctttctgctcaggtcactgtggrcgatagatagcctttacttctccgctttctcaattttcagccactggtattcaactgcaggccttctttaaaaatgtacctctttctttcaaaattttct

SEQ ID NO: 10925 - DNA, 201 bp, Homo sapiens
gagttcacctgtgaagcatcctgaagggaaacaccggtgcactgggcagggaacaggagacctagatatacttcttcttttttttttttttttttggtagmtatatttatttatttatttatttttattttattattattatactttaagttttagggtacatgtgcacagtgtgcaggttagttacatatgtatacatgt

SEQ ID NO: 10926 - DNA, 201 bp, Homo sapiens
gggactgtaaactagttcaaccattgtggaagtcagtgtggcgattcctcagggatctagaactagacctagatatacttctaacataatctgtgactgtrtgcaggtcatgctaagtatgtcagactgccattttctccttgaggctggaagtgtggggagaaggggataatgtagttgagaatccattactggccccac

SEQ ID NO: 10927 - DNA, 201 bp, Homo sapiens
agggtacacatgtgcctggatggtgctgctactggactcttgtttacattaatgtgtcaacagtgtgctccaaggttctattaggtgttaacaggtgtctyaagaaaaaaatgtttcttaatgagatcagtttgtaagaattctgggtgaacacgttaattagtttattcttttaatgcgttgaatgtttttttttttttt

SEQ ID NO: 10928 - DNA, 201 bp, Homo sapiens
tgtttacattaatgtgtcaacagtgtgctccaaggttctattaggtgttaacaggtgtctcaagaaaaaaatgtttcttaatgagatcagtttgtaagaaytctgggtgaacacgttaattagtttattcttttaatgcgttgaatgttttttttttttttgaaaaataatagaatcccttcagaattcttaatatgatat

SEQ ID NO: 10929 - DNA, 201 bp, Homo sapiens
ttaacaggtgtctcaagaaaaaaatgtttcttaatgagatcagtttgtaagaattctgggtgaacacgttaattagtttattcttttaatgcgttgaatgttttttttttttttgaaaaataatagaatcccttcagaattcttaatatgatatggtgttctgtatattttcaagaggagaggtatatagtgtttctcaaa

SEQ ID NO: 10930 - DNA, 201 bp, Homo sapiens
ttctccccaatctggggccccttcttcattcttgcttatcttattaggactccacattaactattgttgttattatcatacacagactatctctgaaaggwtatataagatatagataccagccataacctctgcaaaaagatacaaagagactagggagccggaaagcaaagatagaggagtgggcttacttttccctac

SEQ ID NO: 10931 - DNA, 201 bp, Homo sapiens
agactatctctgaaaggatatataagatatagataccagccataacctctgcaaaaagatacaaagagactagggagccggaaagcaaagatagaggagtrggcttacttttccctacatatgaatttactctattgaatattttaaaatcacctgtgttttaccatcaaaaaaataaaataaaacaagcatcaatattta

SEQ ID NO: 10932 - DNA, 201 bp, Homo sapiens
gtaccaaaacagagatatagatcaatggaacagaacagagccctcagaaataatgccgcttatctacaaccatctgatctttgacaaacctgagaaaaacragcaatggggaaaggattccctatttaataaatggtgctgggaaaactggctagccatatgtagaaagctgacactggaccacttccttacaccttatac

SEQ ID NO: 10933 - DNA, 201 bp, Homo sapiens
cagccaaaagaaacatgaaaaaatgctcatcatcactggccatcagagaaatgcaaatcaaaaccacaatgagataccatctcacaccagttagaatggcratcattaaaaagttaggaaacaacagatgctagagaggatgtggagaaataggaacacttttacactgttggtgggactgtaaactagttcaaccattgt

SEQ ID NO: 10934 - DNA, 201 bp, Homo sapiens
atctagaactagaaataccatttgacccaaccatcccattactgggtatatacctaaaggattataaatcatgttgctataaagacacatgcacatgtatrttttattgcagcactattcacaagagcaaagacttggaaccaagccaaatgtccaacaatgatagactggattaagaaaatgtggcacatatacaccatg

SEQ ID NO: 10935 - DNA, 201 bp, Homo sapiens
ataccatttgacccaaccatcccattactgggtatatacctaaaggattataaatcatgttgctataaagacacatgcacatgtatattttattgcagcaytattcacaagagcaaagacttggaaccaagccaaatgtccaacaatgatagactggattaagaaaatgtggcacatatacaccatggaatactatgcagc

SEQ ID NO: 10936 - DNA, 201 bp, Homo sapiens
attttatatttagatgctactattagcagatgatttgtgcgtatgtcttgccctgttcagctttgaggagtccaggcccttatgggactccttctgagagyggggttcctattttccttaggaacccaagacagttctttcagaggatttcattgatctgttgccccatggtgctttgtggcacataatgacaaagcatga

SEQ ID NO: 10937 - DNA, 201 bp, Homo sapiens
gtggcacataatgacaaagcatgacaggcaggctcacagccctcgactcatgctagatctcggttcattctgtatccagggactccagttcatcatatccmttacccaggcctctctcctagctatgtctgtgtggctcacagatactctagagggagaggcaattaatttctttttggcggtgagatggtttgcctgggt

SEQ ID NO: 10938 - DNA, 201 bp, Homo sapiens
gtccccactccaatcttatcttgaattgtagctcccataatgcccgaatgttgtaggagggacccagtgggaggtaattgaatcatggagatgggaattcmtgttctgttgtcatgatagtaagtctcacgagatctggcggttttataaatgagagttcccttgcacatgctctcttgcctgcaaccacgtaggttatgc

SEQ ID NO: 10939 - DNA, 201 bp, Homo sapiens
gttttataaatgagagttcccttgcacatgctctcttgcctgcaaccacgtaggttatgcctttcttctccttagccttctgccatgattgtgaggcctcyccagctatgtggaactgtgagtcaattaaacctctttttctttataaattacctagtctcaggtatgtctttattagcagcatgagaactgactaatgca

SEQ ID NO: 10940 - DNA, 201 bp, Homo sapiens
gttgtgtcttccttggtgtcttagttttttctgtgctgctataacagaatacctgagactgggtaatttgtaaagaacagagatttatttcttatagttcyagaggctgagaagtccagatcagttgggtggcatctggcaaaggctttcttgctgttttgttctatgatgaaaggtggaaaacaagagagagaacaaaag

SEQ ID NO: 10941 - DNA, 201 bp, Homo sapiens
tggcaaaggctttcttgctgttttgttctatgatgaaaggtggaaaacaagagagagaacaaaaggtgtctaaatttggttttatagcagatccattcctkgataaccaacaaactcccaggatgataatattaatccattcatgacggcagagcccttgtgacctagtcaccacttaatgctcccacctctcaccactgt

SEQ ID NO: 10942 - DNA, 201 bp, Homo sapiens
aaacccttctttcctcatctgataattgggaaaataatagcaactaccttgtggatactttgtgagaatcccatgcttcatgcaataaggacttaataatygtaagttgttaaattgtcatacatgctccttttagttatgaaaacctgtggcttttgtctaagagttgaatatgagaaggttcaaggactagggctttta

SEQ ID NO: 10943 - DNA, 201 bp, Homo sapiens
actagtactagtgaaagtcaggtttgaacaattctgtgaagaatggatttggaaggaaaatatgaggcaagaattttaaaaagttgtttctgagttgaatktgatttacatttgctaactggaaaaagatcagggtataatcagtccataatattgaaagcagtttggaaataccattgcagatacaggtaatttaaaaaa

SEQ ID NO: 10944 - DNA, 201 bp, Homo sapiens
aaaaagatcagggtataatcagtccataatattgaaagcagtttggaaataccattgcagatacaggtaatttaaaaaatctacatgaattaggtccaggmgcggtggctcacgcctgtaatcccagcgctttgggaggccgaggctggtggatcacgaggtcaggagatccagaccatcctggctaacacagtgaaaccc

SEQ ID NO: 10945 - DNA, 201 bp, Homo sapiens
ctggtggatcacgaggtcaggagatccagaccatcctggctaacacagtgaaaccccgtctctactaagaatacaaaaaattaggcgggcgcggtggcggrcacctgtagtcccagctactcgggaggctgaggcaggagaatggcatgaacccaggaggtggaacttgcagtgagtagagatcgcgccactgcactccag

SEQ ID NO: 10946 - DNA, 201 bp, Homo sapiens
gaaaactgtagaacattctacaaatattatctaacaaaatatatgaatgcataattagtgtcttcaagggatgtcataaatatcgtaaaactaaagggtgrgctgtatcaaaacttggaagggattgggatgaaaatcaaactgtctaaaatagaatggccaaatacattgggacttggctccagaaagaattaatgagaa

SEQ ID NO: 10947 - DNA, 201 bp, Homo sapiens
tttctcattgttcaactcccacttatgagtgagaacatgtggtatttggttttctgttcttgtgttagtttgctgagaatgatgatttccagcttcatccrtgtccctgcaaagtacacgaactcatccttttttatggctgcaaaatattccatggtgtatataccacattttctttatccagtctgtcatcagtaggca

SEQ ID NO: 10948 - DNA, 201 bp, Homo sapiens
ccctgtctttactaaaaatacaaaaattagctgggtgtggtggcatgcacctgtagtcccagctacttgggagtctgaggcaggagaattgcttgaacccragaggcagaggttgcagtgagccaagatcctgccactgcactctaggctgggtgacagagtgaggctccatctcaaaaaaaaaaaaaaaaaaaaaaaaat

SEQ ID NO: 10949 - DNA, 201 bp, Homo sapiens
tgaggcaggagaattgcttgaacccgagaggcagaggttgcagtgagccaagatcctgccactgcactctaggctgggtgacagagtgaggctccatctcaaaaaaaaaaaaaaaaaaaaaaaaattcaggaaacaacaggtgctggagaggatgtggagaaataggaacgcttttatactgttggtgggagtgtaaatta

SEQ ID NO: 10950 - DNA, 201 bp, Homo sapiens
gaggcaggagaattgcttgaacccgagaggcagaggttgcagtgagccaagatcctgccactgcactctaggctgggtgacagagtgaggctccatctcaaaaaaaaaaaaaaaaaaaaaaaaattcaggaaacaacaggtgctggagaggatgtggagaaataggaacgcttttatactgttggtgggagtgtaaattag

SEQ ID NO: 10951 - DNA, 201 bp, Homo sapiens
aagaggtaaagaggaacttttaaaagcacatattgattaaaacaaaagttatacactttgggaggccgaggcgggcggatcatgaggtcagaagatcgagmccatcctggctaacacggtgaaaccctggctctactaaaaatacaaaaaaattaaccgggcgtggtggcgggcgcctatagtcccagctactcgggaggc

SEQ ID NO: 10952 - DNA, 201 bp, Homo sapiens
gcgggcggatcatgaggtcagaagatcgagaccatcctggctaacacggtgaaaccctggctctactaaaaatacaaaaaaattaaccgggcgtggtggcsggcgcctatagtcccagctactcgggaggctgaggcaggagaatggcgtgaacccaggaggcagagcttgcagtgagcccagattgctgccactgcactc

SEQ ID NO: 10953 - DNA, 201 bp, Homo sapiens
tggctgggcgtggttgttcatgcctgtaatcccagcactttggaaggccaagtcaggcagatcacctgaggtcaggagttcaagaccagcctggccaaaayggtgaaaccctgtctctactaaaaatacaaaaattagtcaggcatggtggtacatgcctgtagtcccagctactcgggacactgaggcaggagaatcact

SEQ ID NO: 10954 - DNA, 201 bp, Homo sapiens
ttcaagaccagcctggccaaaacggtgaaaccctgtctctactaaaaatacaaaaattagtcaggcatggtggtacatgcctgtagtcccagctactcggkacactgaggcaggagaatcacttgaacctgggaagtggagttgcagtgagccaagattgtgccactgcactccagcctgggctactgagtgagactccat

SEQ ID NO: 10955 - DNA, 201 bp, Homo sapiens
ttgcagtgagccaagattgtgccactgcactccagcctgggctactgagtgagactccatctcaaaaaaaaaaaaaaaaaaaagaagaagaaaaaaaaaargctgggagtttcattattcctcaaagaaggcacctcagaccaggttccatagggcacgcccctaaagagcccaaccttctcagggttctaaaatgtatct

SEQ ID NO: 10956 - DNA, 201 bp, Homo sapiens
tcatgaaatcaataatcatttattgagtactgactattcactgtggggccagatattgagaatattggagagcaattagatgtggtctctgactccagggktctacaaacggcatggtggggaacaagctcattagatgaggagaaaaaataataatataagtgagtataaactcaagaactataattatgcattgattaa

SEQ ID NO: 10957 - DNA, 201 bp, Homo sapiens
gtatggttcctggacaggcagcaccagcatcaccagggaactttttagaagtgcaaatcctctagtcccacaccagacttactgactcagaaactctgacrtggggcctgtaatctgtgttttaacaagccttctggttgattctgatgtgcattgtcctaggagaaccactgacttagagataagttaagaaactcttcc

SEQ ID NO: 10958 - DNA, 201 bp, Homo sapiens
ccagagatgtgcggtggcttgttccaggtgttatatgacaggacaatggacctcaaactcaagattctttttcctctacacttcactactttaactctccygattattttgtggactgatgaataagtacgtgtaaactgattttagtttttctggtaatgaaaaaaaaaaaaaacaatgagtattgttactcttgtaata

SEQ ID NO: 10959 - DNA, 201 bp, Homo sapiens
atctgccctggcagatatgcatacatgtgcaggcccgtgtgttcgtgcacacatatgcacacagataaagtgggaacagagagaagccagtgggtggtggwgagagatgggggcagaattgatgcatcagggggcctaaatccatgcaatgatcaagttcatagcaatttccccaggagactgtatcatattccagtgaag

SEQ ID NO: 10960 - DNA, 201 bp, Homo sapiens
atggaagcaagattcttgggcagttgaatccttctcaaactcattcttggtgagtactgtcactttctaggtgtgccttaggcaagttatttaactgcttygtgccccagagagtggtgggggaatcaagggtaggacacatgtgagtcactcagaacagtgcctagtctttagtgaatggaacttcgggtgttcattatt

SEQ ID NO: 10961 - DNA, 201 bp, Homo sapiens
attcacacactcctatcatggattggagggaagttgaatattggttcatatcttgttttaggttctggtttacttgctgcctgaactaggaatataattcrggatttgcagctagtaagttgaaattaagaagaactcaggcctttagattaatcaagtacatatacagtattgaaattatgtctttttatcagtatcttt

SEQ ID NO: 10962 - DNA, 201 bp, Homo sapiens
atgtttgcattttagacactccaaatacagatataaaaactttatgtctcctcctccagctctaccttcaactttcttttcactttctttcctactaagarcacatatttccaggctcattcttcatccctaaactctgtccctctccttactcctttgttccgtcttttgtcctctccctggaatttctggtcatttgca

SEQ ID NO: 10963 - DNA, 201 bp, Homo sapiens
ttcttcatccctaaactctgtccctctccttactcctttgttccgtcttttgtcctctccctggaatttctggtcatttgcattaactacacttataagtmaaactttctttgttcctttgtgggtgtactcagaacatcattacattcaagtaaattcatgtgttttttttctttttttgcccttttatttaaaagcacc

SEQ ID NO: 10964 - DNA, 201 bp, Homo sapiens
aaaactttctttgttcctttgtgggtgtactcagaacatcattacattcaagtaaattcatgtgttttttttctttttttgcccttttatttaaaagcacycctactggccattagaatagttaccagaaatctcctttggtctatggataagaaattctgcagaacttttcaaccaagtaattagatcatattatgtcta

SEQ ID NO: 10965 - DNA, 201 bp, Homo sapiens
acacatatatattcacatatatatacatgtatatatgtagtctgttgtcctgagctcctgttgtttgtcaattgaaaaatgtgttaccctgtcttagcaagtgtgtgtgtgtgtgtgtgtgtctatatatatatatatatatatatatatcctcaaaattttacctagagtaaaaaaatgaaatgcctacattacataaag

SEQ ID NO: 10966 - DNA, 201 bp, Homo sapiens
cacatatatattcacatatatatacatgtatatatgtagtctgttgtcctgagctcctgttgtttgtcaattgaaaaatgtgttaccctgtcttagcaagtgtgtgtgtgtgtgtgtgtgtctatatatatatatatatatatatatatcctcaaaattttacctagagtaaaaaaatgaaatgcctacattacataaaga

SEQ ID NO: 10967 - DNA, 201 bp, Homo sapiens
acatgtatatatgtagtctgttgtcctgagctcctgttgtttgtcaattgaaaaatgtgttaccctgtcttagcaagtgtgtgtgtgtgtgtgtgtgtctwtatatatatatatatatatatatatcctcaaaattttacctagagtaaaaaaatgaaatgcctacattacataaagacccatatgacaatattaattctg

SEQ ID NO: 10968 - DNA, 201 bp, Homo sapiens
accacagaacttctctcgtcccactccttcttgttttgtctttgggtaaaaggaataaattatatatttatcataaattttaactctacaaaatggccatwtttatactttcttcagatttctctcagttctagttaaggtttttttttggcttccatttgccccttatttgattattatactccaagtggctgaagaaaa

SEQ ID NO: 10969 - DNA, 201 bp, Homo sapiens
atattgtcaataactattcccagaaggttttttttttttcagatctactagagaacttaaagctttttcttttccaggaatggccaaaatatccagaaggrcaatatcaagtaataattaaagttataagctcttggtttgaattcttgctccactagttatgtgaccttgagcaaattacttaacttctctgtgccttac

SEQ ID NO: 10970 - DNA, 201 bp, Homo sapiens
aaaaaaaaaaaagcttatggctctttttgtgccacaatggcagaattgagtcattgctacaggcagtgcatggcctgcaaaacctgtgatattattctctkctctgatattaacatagctggaatgtgccccaaatgtatttcaatcaagagctttcatgtattttttgaaataacctggataagaaaatccagattttag

SEQ ID NO: 10971 - DNA, 201 bp, Homo sapiens
ttacatttatgaattcaaccaactgtggatcaaaaatatttgaaaaaaatgtgtctgtactaaacatgtacagtttttttcttgtcattattccctaaacratacagtgtaacaactatttacttagcatttacattgtattaggaacttaagtatcttaaagatgatttaaagtatatggaaagatatgcttaggtttta

SEQ ID NO: 10972 - DNA, 201 bp, Homo sapiens
aagccttatttttttgcctagttctagcttctgtatgagtggagactttattaacaaaggtaggtttggagcactcaacagaagcgtagagaatatatggaaaaaaaaaaagaagaagaaaaaagataaaagggaaccaaacaaaacaggtttacaactgttttactaataagagggaaaagtctgctcatgagttaaacc

SEQ ID NO: 10973 - DNA, 201 bp, Homo sapiens
aatgacaaatatgggtctcgccgcactaagatattttaatatacttcagtgggaaaggctctgatccagaaatttgcagttgtgctattgataaaatttawgagaaactttcttctgtgggcctcagttttcacatctattaaatgtgctgatttaactaaactatctttatttcctttaggctcagacatttcctatttc

SEQ ID NO: 10974 - DNA, 201 bp, Homo sapiens
catggctcactgtagcctcgacattctgggctcaagtgatctcctgcctcagcctcccaagtagctgggaccacagatacatgccaccacccccagcaattttttttttgtcttttttgtagagatggaggtctcaccatgttgcctaggctgggcttgaactcctgggctcaagcattcctccctcctcagcctcccaaa

SEQ ID NO: 10975 - DNA, 201 bp, Homo sapiens
aacaaatattaattcctcaaagtttaattcttaacaaatattaattctacaaagagctaaaaggctctatgtaggtagataacggcattcagatttacctyctaatctttacagtaattggttttaagggttggagaaagaagtaaaggaggtaaaagaatgtacatagacaataataattatgaataacatttactaagc

SEQ ID NO: 10976 - DNA, 201 bp, Homo sapiens
acaaatattaattcctcaaagtttaattcttaacaaatattaattctacaaagagctaaaaggctctatgtaggtagataacggcattcagatttacctcytaatctttacagtaattggttttaagggttggagaaagaagtaaaggaggtaaaagaatgtacatagacaataataattatgaataacatttactaagca

SEQ ID NO: 10977 - DNA, 201 bp, Homo sapiens
tgtgggtataagttttttcttacatatattatatatacatatataagtgtaacacttttaagaattttattgaccatctaaatatatagcaaaatcagctrggggtacaagagtgtaactacttccttttttcctaagttgtggaaaatgtgagaaatgagaagtaagcaagacggaggattagaatcacaaggtaggttt

SEQ ID NO: 10978 - DNA, 201 bp, Homo sapiens
tgactagccaagactcaaggtgaaagtttggcctgcagctttggcaaacaaaggagaagctaatgaatcataaaggtcacatcttcttgaattttcttctstttcttcactgttctgattacttttaaaaaatctctattccttatatattctgagtacaaaaactcattagcaagatttggttctgttgtctggagaatt

SEQ ID NO: 10979 - DNA, 201 bp, Homo sapiens
cccctcagtgtaatatctcatctcaatcatttttttctttagttttgcagatagcacctgccatttctaaatatgtgtctttaattcatcttaaccacttyggattatgacatcctaaaattgccatatatttttatatttccatacttttgctcaggatcttctttggttaaaataatctttcctacttcacctttgacc

SEQ ID NO: 10980 - DNA, 201 bp, Homo sapiens
cttgttaccttttggttttccccggcacctaacaatgtaatcttcacaaagcagtgctacattctaaatttatagtgcagtaaatgaaagaggttggatcyattgtgcttcataattcagagggaagaatgtctgcagaaagaaacgtgggtattctttggaatgccatatgtgcaataattgaaacattttgaggaattt

SEQ ID NO: 10981 - DNA, 201 bp, Homo sapiens
aaaggttttgcccctcttaactctcctgaccactagcattctctctaccttagtgtgtgggtaggtctttgttatgtctccagactcacactagttttttwaaaaaaatacttaggtaaatagcagtgggaccccaattctctttttcttgtattccagatgaaaaagaaaaaaactcaccagtttaaagtgctcgtttca

SEQ ID NO: 10982 - DNA, 201 bp, Homo sapiens
tactgtgaaatctctggcactggttacccaatatccacacataccccacttagctctagattagaaaataaagaatgagattcagcccagaggcagccatrcgcacaggtgcacaatttggaaaaaatgagaccaattcttaaaaaaaaaatcaagctgaagtcaaagaagcttaataaaaatgtaaatcctctttcaact

SEQ ID NO: 10983 - DNA, 201 bp, Homo sapiens
tgagatgacctaaattgcataaacggatctgagtctttgtacctcccgtgcccatccaaacatccagtcaccatatgaggccacacccattgactgaatcyggttctggagagggactgaggtttggtgcaagttgtccgcagccaggacttccaacatctggaggatgagcaccctaatcttgaaggctgaattcagtag

SEQ ID NO: 10984 - DNA, 201 bp, Homo sapiens
tgaaggctgaattcagtagcacatccactgcaactgaatatctgattcaaggccaaaaattgtggagctcagagccacaacgggcttctgatcttccacasgctgctgaatgcccctggcagtccactgaagtgataatgttaaggaaggaaatgattagaagtaatttgctgagggatcagagttgcatttggagctatc

SEQ ID NO: 10985 - DNA, 201 bp, Homo sapiens
aactttctgtgttgcaaaccttgttgtggctccccctgtgtaaaaaccttttagtgtttctcatctccatgaatcactaatccatggtgcttagtagcatstcaaaggcccttccgaatctatctctagcctacctctgtggaccttatctcttggctctcccacctgcccccacccacacctctaccccttgctttttgc

SEQ ID NO: 10986 - DNA, 201 bp, Homo sapiens
tcagattgatacatcatgttgttaagacccccatctgtctctagggtagtagaaaagatgcagctacggaagagaacagaactgtgctcctgaacatggcrtggctgccgaacctcacagataatcctgaagcaggcaatctctgcagacttctggggtgatttgagcatgtgtagcttttgctggcagctgagagaaatg

SEQ ID NO: 10987 - DNA, 201 bp, Homo sapiens
tacatcatgttgttaagacccccatctgtctctagggtagtagaaaagatgcagctacggaagagaacagaactgtgctcctgaacatggcatggctgcckaacctcacagataatcctgaagcaggcaatctctgcagacttctggggtgatttgagcatgtgtagcttttgctggcagctgagagaaatgggaagtccc

SEQ ID NO: 10988 - DNA, 201 bp, Homo sapiens
tattgcctctggctggaaaaactcgggtaggtgcaaggtgtccaccagcattttctcctgggatcgggctgctgccagctctggcactttgcctgggactrtagccttgtctggactcccctttccctctgcgtgggagtgcttccttatcaatcatttgccctcgaatccatgtcttaggatctgcttatgggttggact

SEQ ID NO: 10989 - DNA, 201 bp, Homo sapiens
tgccttgtttcctaaattgtgtttgataaagtgcttaataagggcggcttccaaagtggttccaggtaaagaagtactaaaaaggcctctttattaatgtrtggattttctgtcactgatgtttgtctgcctatgaatagtttagactagatttttcaagtaagcactttataatatctgtaactctttctaggtgtttta

SEQ ID NO: 10990 - DNA, 201 bp, Homo sapiens
aaagcattaaattttgaggtttaagtagacattaaacatttataatttaatatacatttaataaaattaatatttatgaacacatttgccttgggaattaraagtggaaaacagtgtcatttacttgctaatggccaccacggtgccatgcagttacagatttgatggcctgcatcccagtgacattgctccaagaccaga

SEQ ID NO: 10991 - DNA, 201 bp, Homo sapiens
aagtggatggttttagcatttaccctatggaagcttatagcctggatggcaagatcaaattaacatgagaaggcagtttggtgtaatggttaagagccttyggattcagccaaggcagaaagtgatttgaattctaattgagcccctttttagctgtacaactttgtaaaagccctttaccttctatacctcagttttctt

SEQ ID NO: 10992 - DNA, 201 bp, Homo sapiens
tgaagtcgaagaaatgcttaggttaacccaacaactctgataattgaccaatgtggcaagggccattctgttccaaaaataattaacaatatgatcagtastgaattaatgttgttacggattataggtttcaaattttcccttgttaggaaaatcaccttttaaataatctcatagggttttgaacaaagagcacagtgt

SEQ ID NO: 10993 - DNA, 201 bp, Homo sapiens
ccaccgcacccggctaatttgtttgtatttttagtagagacggggtttcaccgtgttagccaggatggtctcgatctcctgacctcgtgatctgcccgcckcggcctcccaaagtgctgggattacaggcgtgagccaccacacccgaccgacaaacagaaaatcttagaggggcatcaaagcaaatcatatggatggaga

SEQ ID NO: 10994 - DNA, 201 bp, Homo sapiens
tgttcatggggagtttgtgcatatgatttatcagaaagagctgcttctaccagggctcataataataatggttcccctgaactggatgctaaatttatcamctggttattttgggcttctcttgccagtaagcctatagaaaacaaaaacaaaaacttttgctataaccttgattattcagagaaaataaggtttctgcta

SEQ ID NO: 10995 - DNA, 201 bp, Homo sapiens
ataagcaacagcataaaggactttgagaaatcaacagatcttatttttaaaaatgaattttcttaaacatgtattcactcagctggcagtggtggctcatrcctgtaatcccagcaattttagaggctgaggcgggcagatcacgaggtcaagagatcaagaccatcctggccaacatggtgaaaccccgtctctactaaa

SEQ ID NO: 10996 - DNA, 201 bp, Homo sapiens
tctactaaaaatacaaaaattacccgggtgtggtgacacacacctgtagtcccagctactcgggaggctgaggcaggagaatcacttgaacccgggagtcrgaggttgcagtgagccgagatcacgccactgcactccagcctggtgacagagcaagaccccatctcaaaaaaaaaaagaaagaaagaaaaaaagaaaaaa

SEQ ID NO: 10997 - DNA, 201 bp, Homo sapiens
gcaaacatctgggggaagaggaaagagcaagtgcaaagatcccaaagccacagagatgtttatgtgctgggagaacagaagaaatcccagtgcttgtagtkcagtgagcaaaaggaagtatgaggccaggtaaagtaagaaaggttggcaagggtcagatcatggagggcctttggggctgttgtaaagagtttcatttca

SEQ ID NO: 10998 - DNA, 201 bp, Homo sapiens
gataacttcttcataatgaactcttgtgtgcataagcatttcttttcctgttaagaagcagtggacaatttttttgttttaaagacattctagaagatttwaaaaaattattgtggtaagaacacctaactgtgagatctatcttcttaatagatttctaagtgtacaatacagtattagtaactgtagacattatgttgt

SEQ ID NO: 10999 - DNA, 201 bp, Homo sapiens
gaaggacctgccaacatccttgaacagtgaccattcagtctctactatactagaacccatctgatgatgaaattttgactatatttttggagatttcattctgtcattggatagctctaggaagtgcttttacaccttttgagctctggtcttgagtccagtaatttttacgtatcagtccttgttctgccttccaaaacc

SEQ ID NO: 11000 - DNA, 201 bp, Homo sapiens
agtttgagaccagcctggccaacatggcgaaaatataaaagttatctctactaaaattataaaagttagctgagcatgagggcacatgcctgtaatcccasctacttgggaggctgaggcacgagaatcacttgaacttgagagacagaggttgcagtgggccgggctcacgccactgcactccagcctgggcaacagagt

SEQ ID NO: 11001 - DNA, 201 bp, Homo sapiens
taagacagagtctcgctctgtcaccaggctggagtgcagtggcgtgatctcggctcactgcaacctctgcctcccaggttcaagcgattctgttgcctcarccttccaagaagctgggactacaggtgcatgccaccaagcccagttaatttttgtatttttagtagagacggggtttcaccatgttggccacgatggtct

SEQ ID NO: 11002 - DNA, 201 bp, Homo sapiens
tttcaagatagagacagaggatgtgctgcgccgatagaataatgaaagtctcctatagtcaaaaaacaaacaaataaacttgaggcagattcttcacttcraggtgctcaccataaaatggcaatactaaactatttctagaactctatatagagtgcctgttagttattttgatcctgttacaactctttcagatgatga

SEQ ID NO: 11003 - DNA, 201 bp, Homo sapiens
ttaggttaaatctgagatgcacttatctatttatttttacaaaaacaatttgcaatgtgatttagaaatggaggagtaacataaaacaatttgactaaaawtgggtgtgattttcttatctgagactgccaaaaattcaccaaagaaaaatcattcaaatgtctttgtggttaggtttcttttataaattgaaagttgtgt

SEQ ID NO: 11004 - DNA, 201 bp, Homo sapiens
gaatttgagtgtgtccgtggaagctttatttttaggtcaattttagcgtctacagcattgcgtattctaccactaatcatctttttccttagcggaagtaycctgaaatttgatgagtaaaaatgactttcttttatatttttgtgatataacagcttctaaagtaatgtgtttctgaaaatgtcattacccctaagactt

SEQ ID NO: 11005 - DNA, 201 bp, Homo sapiens
gtatatataaggtaacacagcaatggaacatcgcaatagttggcatcagatttgcaaatggcacaattatttgtttcctcttcactggtccttgaaaaatwcataatgttcccatcaaaagttccagccaagcatatttgtaagaacagggtttgaacataacctattatatcatgaagaatggctctcttccatggtatt

SEQ ID NO: 11006 - DNA, 201 bp, Homo sapiens
gtaaaataataaatttaactctcagatttcccctgggagatgcttccaaaacttgttccattttaacatcaatagaattatttgagggaaggctattttgwtatatatatatacacacatatatgtatatatatatataaaaaaatacatgaatgagaaaaaattatattcctcattctcttaaagaaacgatagatcact

SEQ ID NO: 11007 - DNA, 201 bp, Homo sapiens
atttaactctcagatttcccctgggagatgcttccaaaacttgttccattttaacatcaatagaattatttgagggaaggctattttgatatatatatatmcacacatatatgtatatatatatataaaaaaatacatgaatgagaaaaaattatattcctcattctcttaaagaaacgatagatcactcacttaattagc

SEQ ID NO: 11008 - DNA, 201 bp, Homo sapiens
tcttaccaacatctgctttgttatgcattcattctgcctgcatctttaatttggggtgatagctgccttcagaagctttgggagccgttcctctcagtaaccaaatactgtcccatgggggacatttcctctctgcagctgttctgtgtagggtctcaacagtgtgctacagctggctgtatgcaatgtagtgccttgatg

SEQ ID NO: 11009 - DNA, 201 bp, Homo sapiens
gtgtcctagattgagtaactggggcaaatgaagaaagggtcaccaagacagttgagtgctatgagcacttttcttcttttatgtatgtattttaagttcargggtacaagtgcaggtttgtaggcttgttacataggtaaactcgtgtcatgggggtttgttgtacagattatttcatcgcccaggtattaagcttaatat

SEQ ID NO: 11010 - DNA, 201 bp, Homo sapiens
aaaaagacatcctattaatttctttctctctgtatgtaatttacagtaaatcctcttggattcattttttaattatgagcctttcaggaacagtgaaaatktatgtgttaagatatctgttttgtttgacaagaatctataaccttccccaactatttccttcctgacttaaaatgtagattgttacatacacgaggatga

SEQ ID NO: 11011 - DNA, 201 bp, Homo sapiens
aaagtgctgtgtgttgagggtactgtgaccaaccttggcttgcatagcataaacaggcttgagaggccacgacaattacaaaaacaagaaattaggttttctactcattatgaggtgatgtatatacaactcttgcacaactcctggcatatagtgagctttcaatcatggatagattttgatattattggtactcaaaga

SEQ ID NO: 11012 - DNA, 201 bp, Homo sapiens
atctggtacatagtggatgttccattaatgatagccatgttcttgtgttttcttcccaggtactttagggacatagtgtagaagatttgagttttataccratgatcgattgtttctgaaagcaaaaggaagacatttaaagatttttttagaagaagatgaaatgcccagcacttaatttttagggagattattttggct

SEQ ID NO: 11013 - DNA, 201 bp, Homo sapiens
gcaggtgttgtcagcaggttggattaaaaaggagagaactgagaaatgtctagattgggaaggttgtgatttcattaccaaaaacaaaacaggggacagayaagtaaaacagataagagtttgactttagtgatgcaaaacataaggcatccaagagccaggctattgaaatttccaattggaaatacatgatgaactcag

SEQ ID NO: 11014 - DNA, 201 bp, Homo sapiens
agtgacagtggaaggtttaaggagtgctaatgtctcaagggagatgaataggaacttgggaaatatatacatatttttatatatttaaatatatattattktatatatttatacaaatatatataatgtatattaaatatatacatatacaagataaaggaggaaaggaagagaactaaaaaggaaaggctagagggtagg

SEQ ID NO: 11015 - DNA, 201 bp, Homo sapiens
tcccttggtctgttagcttctaatgtctagcagcagagtatagtaaatacttgaaaggtagaccttcacactgaaaatcacatttattgaagtgggagcarattccatttaaattgtcccttacctgatgcctaattcctaaggttaacaggttttcatgtttgctacttatatcagcagtactggagctggtttttttgc

SEQ ID NO: 11016 - DNA, 201 bp, Homo sapiens
ttagcttctaatgtctagcagcagagtatagtaaatacttgaaaggtagaccttcacactgaaaatcacatttattgaagtgggagcagattccatttaawttgtcccttacctgatgcctaattcctaaggttaacaggttttcatgtttgctacttatatcagcagtactggagctggtttttttgcatggctaaacag

SEQ ID NO: 11017 - DNA, 201 bp, Homo sapiens
cttatatcagcagtactggagctggtttttttgcatggctaaacagcaaagcttaaattcaatactagagcgtgaaagaggaaaatgagttttggtgtgaygtgtgaatgacgtggttttcctaaataccatgaatgcacaatgaatgatccacaaagcacagccgcctcttaaaagaagacaaaaatctccctgaggttt

SEQ ID NO: 11018 - DNA, 201 bp, Homo sapiens
cactctcaggtatttctttatatcaatgccagaaaggactaatacacttactttcgtgaaaacaacttttctcttaaccacctcctactgtctgtcaagtrtagttctaagtgcttgggatccaagagtgaaaaggatagacaaactccctgtcctcatggtacttacattctagtgggggagtccttaatgggcacaagc

SEQ ID NO: 11019 - DNA, 201 bp, Homo sapiens
tctcttaaccacctcctactgtctgtcaagtatagttctaagtgcttgggatccaagagtgaaaaggatagacaaactccctgtcctcatggtacttacattctagtgggggagtccttaatgggcacaagcaatcagaacttcaatttgcagaattttgtgaaaatgtgctatcatatatattttattaattaactagtt

SEQ ID NO: 11020 - DNA, 201 bp, Homo sapiens
ccaccttcacatactcagtctatcattaaccaaaatgtcactgtgttgctcatgactgtaatcaaaaaagcacagagagctctctcgctatctggttctayttctaccaccctgacaaccactatagtttgttttcaacaccaaaagaaaataacaaaaaaatagcatcttcaccctcgattctagtttcttttttcttga

SEQ ID NO: 11021 - DNA, 201 bp, Homo sapiens
gtgaggtgtttggtataaacagtatattaacaaagaattctcctatggtataaaccctaactctagcaggaagatcaaatttctctttgaggcatgcagtytgagctccagtgactctctgcaagagaaaagctgatattgtcacattgtgagtcatagtgactcccaaggatgtatttgtgtggatgtggttggtcagaa

SEQ ID NO: 11022 - DNA, 201 bp, Homo sapiens
aggcattttcctacccgctttacaaaaacagacaccgaggcccatgtttagggccaaaatcagtgctgaatgccaggacagactcccaattcagtgtctcrtatcaaactgcatttcctttcaagatgaaaattgttactcaaaaccctatgcagctgggcgggaacacagattccatggtttcctttttcttcctgtttc

SEQ ID NO: 11023 - DNA, 201 bp, Homo sapiens
ccccaaagcaaagcatctcctctctttgcatgggggatctatccctccagaagtctacccagcctgaggataatggcagctgcagggttacaggggtaacygtccatctgtctgaattctcagttgtgtgagagcctgtgttacaaccttagtagcttctgcacctcactagcttttcccactcccttggagtgcttccat

SEQ ID NO: 11024 - DNA, 201 bp, Homo sapiens
ccttacccatcagtactttagggttataatctatatcttgcaggcatgttatgaaaattaaatatgatcacatatgcagtgtgcataacatcatgtttggyacatagtagcctgtcattattttggaaaagtgaccataatgaaagagaatgcatcaaatatataggattgttaaataacaatgtccaatttagaagctga

SEQ ID NO: 11025 - DNA, 201 bp, Homo sapiens
gcacaccttgctcctgactgagaaggaaaaaatctttgtggagtttgcacaggtataccaagtaattgagcatttgcattagtatggaaccacctactacwgacaccgggctcgtttcactcaaaggatagcctagaataagcatgaaggacctcctttcagaatcttgtttatgtaaagcccttcttggatttcctcttt

SEQ ID NO: 11026 - DNA, 201 bp, Homo sapiens
ggtacaaactcaattcaaatattctatgagaataaaaacaggcttatacccaaagataggcaataacaaatgctggtgataacatggagaaaagggaaccmctgaacactgttggttggaatgtaaattagtacaatcactatagagaacagtttggaggttcctcaaaaactaaaaaattgagctaccatatgatctatc

SEQ ID NO: 11027 - DNA, 201 bp, Homo sapiens
aaaacatccttcaaacgaagtggctattttgttgcaaaaaataactattacttctcaagcactgactgagtgccagggtgtatatgtatgtgagtatgtgygtgtgtgtgttttgttctgttttttctcttgtaaatccgtcaaagattgcaaaggtaggaactattatcctgatttttcaagtcagaatccaaaatttag

SEQ ID NO: 11028 - DNA, 201 bp, Homo sapiens
tttgcagaaaagttgtaaagattatatagtttctttaaacccttcactgagcttccactaacgttaaaatattatgtaaccgtgatacatggtttgaaacyaagaaattaacatctgtacaatacaatttgctcagataatcccagtttttccactactgtcctttgtatgtgtcagaatccaatccaggataccacattt

SEQ ID NO: 11029 - DNA, 201 bp, Homo sapiens
gtattccagagaagatttcaatatacagtagttcactgtcctgggaccaagaagaggtacaattaaccatgttgcctatgctgctggtgatgaagccagarcgtaaacagaatgatttatcctcactcctttgttcgtgaacaaaggaaccataatcccccatgaaccattctggcctctttactatcctccagacaggtt

SEQ ID NO: 11030 - DNA, 201 bp, Homo sapiens
ctttctagttttctctgacactctcactccctgccaatcttttctcctcaaagaagccagaatggtattttttaaaaaatataatcagcctttattaccarccacccccaattaaaatcctcatgtagctttatattatattaccaatccaatctaagtgcattaccaaagctttgaagaccctgtttgatcctacctctc

SEQ ID NO: 11031 - DNA, 201 bp, Homo sapiens
aaatctcctggttccaattattacattcttcctatgacaccattccctgattcctacaaccaaattagcctcctctttgagctttagttttccctctaggaaaaaaaaaaaaagcatgttagacgaggtcagggactctaaaactgagaccctaggttcagttaaaatgctgggaaggctactgtgataggggtggatgtc

SEQ ID NO: 11032 - DNA, 201 bp, Homo sapiens
atccacttactctctccagtgcctgaaacttctcaaggagcttgtgctctcctttgctcctctcttttcaaccaatctgaaaatgcttttaaaagataatktctgttttccagtgcagtcttctcacttggcatgtaatttctccatttttatttcctttgtgaatatcaaggtacaatttccatagctaccagtctaacc

SEQ ID NO: 11033 - DNA, 201 bp, Homo sapiens
ttgggacactgtaatattttagccctgattttgccctttttatagtgtccatagataatttaacttctttgtataaacttccattataaaatgaagttttwtatatatatatatgtatatatatatatatatataaaacattacacatttaggacatttcatgatgaaataaaagtgtttcaaatagaaaatgatggttta

SEQ ID NO: 11034 - DNA, 201 bp, Homo sapiens
tattttagccctgattttgccctttttatagtgtccatagataatttaacttctttgtataaacttccattataaaatgaagttttttatatatatatatrtatatatatatatatatataaaacattacacatttaggacatttcatgatgaaataaaagtgtttcaaatagaaaatgatggtttatttgggtttataaa

SEQ ID NO: 11035 - DNA, 201 bp, Homo sapiens
gatgtggggaatacctatgtacatcacagtcctcagggaactgtaaaaccagttgcattgaccaaaccaaaacacgtgccattagaaagcatataattgtaaaccaagagcttcttttccgtttacctaagataattgcagaggctttagtctaagagaatcaaagttaagtgatagcactgtcaaaaaggtttcttaagg

SEQ ID NO: 11036 - DNA, 201 bp, Homo sapiens
gaaagattaaataaggagttgagtagaaacatatatagatatgtagagatagagatataggcaatgttttctttttttttatttttatccaccaccccctccccccgctccccaccatagcatttctgctttaaacacttattctctttctctaacaattttattcattttcgttcttggggcagtagaaaaacaaagcag

SEQ ID NO: 11037 - DNA, 201 bp, Homo sapiens
gtggtatgtggaagtcaaatgactgcttctctttaaaaagtgttggaatgatgcgttttctctcaccgattctgtctagggggtaatgtgctagggtgcartaagttaagtgttagtcacatatttgcagggttaaatcttagttccacagctgactcactgcacactctaggcagaattatttaactccttcagtctttg

SEQ ID NO: 11038 - DNA, 201 bp, Homo sapiens
ccacagctgactcactgcacactctaggcagaattatttaactccttcagtctttgtttcctcattcaaaaaagaaagagagatactatctgtggcagagcctcagaggattgagggagttaaatgtaaaaatgacacactggtgcctgttacagggagggctccctgagaagcagacctgtgggctaagtttagcatgca

SEQ ID NO: 11039 - DNA, 201 bp, Homo sapiens
cttagcactaccatgttttgctttatattattcattttcataatttttaatgtattcctgtagaggacgtgaggtattgatacaaatttaatattttttttcaggtggctacccaattatttcaataactatgtttctataagtcatcatttcccatttaagcctctgttatgatattttaaattcatttctgcactttta

SEQ ID NO: 11040 - DNA, 201 bp, Homo sapiens
attcaggtgggagctgccatagttaactagtttcggagcacaactctttatcaaacactatatatgtaaaaaactgccatgttaaataccacttgttgctctttcatcttcagtcagctatatgcaaaataggtctttacaggcaaatttacattctatcacagaaacagtgactatcagataaccaactcccttctcaat

SEQ ID NO: 11041 - DNA, 201 bp, Homo sapiens
ctatatgcaaaataggtctttacaggcaaatttacattctatcacagaaacagtgactatcagataaccaactcccttctcaattcttttttttggcttgktttcttgcttacttgcttggttgctttctctctttcctagctgaatagcattacaggccacttctaaaataaactgggttgtggaatttccactgaaggc

SEQ ID NO: 11042 - DNA, 201 bp, Homo sapiens
ccttcaaaatgaagacccaaagatacaggagaaattgttcatttttatgcttaggttcaaccaagtgtggacatctgtgtagaaatatgattggacaaaawgggtatgatctaatggtaatggactgaggcagaaaacccagcgaggcctggccgtgtagactcttcttggcctctctgagcccacattcctttttttctg

SEQ ID NO: 11043 - DNA, 201 bp, Homo sapiens
ttagccgggcatggtggcagaagcctgtaatcctagctactcgggaggctgaggcaggagaatcatttgaaccggggtggcagaggttgcagtgagctgaratggagccactgcactccagcctgggcgacagagtgagactctgtctcaaaaaaaaaaaaaaaaaaaaaaagactgctttaggatttaaggaagagtagt

SEQ ID NO: 11044 - DNA, 201 bp, Homo sapiens
aaatgatattgtttttatacccattttacagatgagaaaactgagagagaccttaaggagctttctcatgatgcatggctagttaatggcagaactcatgttaaagcaagcagtccaaccctgcctgggctcttaaacagtggagtctgctgtctccttttaacaggatgaaggtgaagttctcagcttgatatttttgtt

SEQ ID NO: 11045 - DNA, 201 bp, Homo sapiens
atcaacttaatatattaaaagaggttttatatctaaagcatccaacacagtgtctggcctagaggaggcactatatctatagaacaaataaacgaatgttsgaacatagcctctctaaattctatttgaatgacttaacacaaagatcagaaatttgcatagctgtttgtgttagccctttaaaacaaaactctcctaggg

SEQ ID NO: 11046 - DNA, 201 bp, Homo sapiens
tacctgttatacattgagcacatgctatataccaggcattctatatactttatcatctttaaccctcagagcaatcatgtggtgaaaggtatccatcagtrtcacttgaggaaactgaagctcacggaggtaaaattgaacagctactaagtgatgatgccaaggatttaacacaccctaggtttgtctgactaggaactt

SEQ ID NO: 11047 - DNA, 201 bp, Homo sapiens
atctttaaccctcagagcaatcatgtggtgaaaggtatccatcagtatcacttgaggaaactgaagctcacggaggtaaaattgaacagctactaagtgaygatgccaaggatttaacacaccctaggtttgtctgactaggaacttctggtctctccaggacacaacagagccttctaaggcaggtttactgtgttgagt

SEQ ID NO: 11048 - DNA, 201 bp, Homo sapiens
tgtattcagttacgtgttggagtgctatcgagagcccagtgggattataggtggaataagataccttcaacacagccatctgctgcatatggtgacccttstgctctccaaatgagcagaagctcaaccagctttgctgaaatgtgtttgatgagaggatggtgtgttttacttttgtgacatctttccccagaggtggtt

SEQ ID NO: 11049 - DNA, 201 bp, Homo sapiens
tgacatctttccccagaggtggttgcctaaagagttgaactttagagaacaaaaagaaagaaatgtaggatccatttatggtctctcctagaatcatgccrtatgttggactctatatggaaagggaggaggaataaaatgaagaaagaggagtacacagagcatggaaaaccataagtacgtgtgatccatgattacgtc

SEQ ID NO: 11050 - DNA, 201 bp, Homo sapiens
ccgtatgttggactctatatggaaagggaggaggaataaaatgaagaaagaggagtacacagagcatggaaaaccataagtacgtgtgatccatgattacrtcattgcaccttgcaaaaacttgttgattttagctctggggaggatgagtgaaaatcatggagtcagagcagaatcatgaaaagagattggttttggagc

SEQ ID NO: 11051 - DNA, 201 bp, Homo sapiens
ctctggggaggatgagtgaaaatcatggagtcagagcagaatcatgaaaagagattggttttggagccaagggaactcagatttacatctggtcacaacattttttttttaatattccctttttttattaattattttttttttaatttaagttccaggatacatgtgcaggatgtgaaggtttatttcgtaggtaaatgc

SEQ ID NO: 11052 - DNA, 201 bp, Homo sapiens
tttttttttaatattccctttttttattaattattttttttttaatttaagttccaggatacatgtgcaggatgtgaaggtttatttcgtaggtaaatgcrttccatggtggtttgcagtacctatcaacccatcacctaagtattaagccccgcatgcattaactatttatcctgatgctctctctccttctactcccca

SEQ ID NO: 11053 - DNA, 201 bp, Homo sapiens
gtgtctttatagcaccatgatttataatcctttgggtatatacccactaatgggattgctgggtcaaatggtatttctagttcaagatccctgaggaatcrccacactgacttccacaatggttgaactagtttacagtcccaccaacagtgtcaaagtgttcctatttctccacatcctctccagcacctgttgtttcct

SEQ ID NO: 11054 - DNA, 201 bp, Homo sapiens
tttttcttgtaaatttgtttgagttcattgtagattctggatattagccctttgtcagatgagtagattacagaaattttctcccattttgtaggttgctygttcactctgatggtagtttcttttgctgtgcagaagctctttagtttaattagatcccatttgttagttttggcttttgttgccattgctttttgtgtt

SEQ ID NO: 11055 - DNA, 201 bp, Homo sapiens
tttggcgggtagtagagaaaagaagatgagtttttagaaaaagactcagagttactcagaattaagaaaatgaatccttactgtcaatatgagtctcccamctgctagcgcaagtggtggatagattttcttttccactagatttacttcctgatatacacatttatcactcaagcatggactgttcatcaagtcattttc

SEQ ID NO: 11056 - DNA, 201 bp, Homo sapiens
tctgcttgcaaagaggctgatttgggaaagttcaacagccccacttagttgctctgtgacatcctgacttcctacaggttacttctcatattgttgggtgtttgtttgtttgtttgtttgtttgtttgacagaggtctcactctgtcaccaggctggagtgcagtggcatgatctcggctcactgcaacctcctcctccca

SEQ ID NO: 11057 - DNA, 201 bp, Homo sapiens
ctgcttgcaaagaggctgatttgggaaagttcaacagccccacttagttgctctgtgacatcctgacttcctacaggttacttctcatattgttgggtgtttgtttgtttgtttgtttgtttgtttgacagaggtctcactctgtcaccaggctggagtgcagtggcatgatctcggctcactgcaacctcctcctcccag

SEQ ID NO: 11058 - DNA, 201 bp, Homo sapiens
gggcattcacagtagtccagaggtcccctgcactgtgagtgtgactaaagctcaggaaagtcagaaaggccagccaaggaaggaagatgctggcaagactyggaaagtgcaggagtgtatgagattgaatcacctggacaggggcacccaaacaaaggcgtctgctggctacgtgactttggttaagttgctgaacttctt

SEQ ID NO: 11059 - DNA, 201 bp, Homo sapiens
tggtttcctgtgacatccaggtgacacaccaggtttccactgcttttcgtcattagcccagatgttcccagttacttggacagagagccttgtagatcccygtatatggagtcttccttcccgtggttcattagaaatggcaaagccaaactggcagtattcttcaatttgttgataagagtgcttcagtgcatgtattta

SEQ ID NO: 11060 - DNA, 201 bp, Homo sapiens
tctgtccctgtattaatacattcaggctgctgtagcacaataccttagcgtgagcaaaggaagttaaagaccacctcctccccctgccccctgcaaaaacytagtagttctcagactcattggttcatagaactcattatatatgaaaacccatcaacatccatgtaattagcaaacttaacacacttgaaaatgctacct

SEQ ID NO: 11061 - DNA, 201 bp, Homo sapiens
gttcatagaactcattatatatgaaaacccatcaacatccatgtaattagcaaacttaacacacttgaaaatgctacctttcaagtcagtattcatattargcagactttggagatgttgtggattctgcttcataccaccacaataacgtgattattgccataaagtgagtcacacaaattttttcgtttcccagtgcat

SEQ ID NO: 11062 - DNA, 201 bp, Homo sapiens
gtggcagttgctggaggttggggtggctgtggaaatttcataaaataagacaataataaagtttggtgcatcaactgactcttcctttcatgaaagttttytctgtagcatgtaatgctgtttgatagcattttctaaatttatttcaaaattggagtccatcctctcaaacccagctgctcccttatcaactaagtttat

SEQ ID NO: 11063 - DNA, 201 bp, Homo sapiens
ttcttagccttcatagacttgaagagagctagggccttgttctgggttaggctttggcttaaggaaagattgaggctggttggatattctgtccagacaaytaaaactttctcatgtcagcaatcaggctgttttgctttcttatcatttgagtcttcactagagtaggactttcacttttctttaagaactttttctttg

SEQ ID NO: 11064 - DNA, 201 bp, Homo sapiens
aattcaaaatataaaaatgatttcatttaaaatgaaaaaagataatgaaaaattacagattttaagaagttggtaaatatcaccgaaatggataaattaayttactatttgcaactaactgcttgacattcttctataacacttttttctataaaattaataatgttcgctatgaatgccttttcatgtgaaaattctgta

SEQ ID NO: 11065 - DNA, 201 bp, Homo sapiens
taacggtaggattttttccgttacagtgcactgtgtcaaaatttggtctcgttaaataaattcctattctatcagggatgagcttcccacaaataatgttaaaaaaaaaaaaaaaggagaaagcatgataaaccttttttcctgtttctcttcttctaaccacagggtgcactatggcagttgcagggcttggtaattgaa

SEQ ID NO: 11066 - DNA, 201 bp, Homo sapiens
gctgaaagtgtatatttcatctcaatgacaatctcaaaaaattataatgcaagcatattctgaatgatcttgttgaccacctaataaccaggtatttttatagaattttaatgcttgtgttgagttgtgttcatggggaacaaacctgtcataccttatttggtaaggactattgagaaaagagcagagccaggttgagaa

SEQ ID NO: 11067 - DNA, 201 bp, Homo sapiens
tgtatatatacatatacacatgtgtgtgtatacatatacgcacacatgtgtatatacatatacacacacatgtgtgtgtatatatatatacatatgtgtgygtatatgtatacacacacacatatgtatatatatgtaatgctaacaaaaaataatttgaatgattgccaggggtccccaagaatgagctttttcttttaa

SEQ ID NO: 11068 - DNA, 201 bp, Homo sapiens
gtaacccattttatcagttgtgctgtcttccactgctgttctctatattccatcagaggaaacaaatggcttctattgtgcataagaatgccatttagtcmcaagcaccatttgaaatggaaatgaggagtaacagtaacagaagaacattggctaataattgtgctctgaatagccatttggccatgtgggcagggtaaa

SEQ ID NO: 11069 - DNA, 201 bp, Homo sapiens
gaatgagcaacgtgtgtgtgtgtgtgtgtgtgtgtgtgtgagagagagagagagagagacagagagacagagagaggcatgatcttggctccctgcaaccyccgtctcccgggttcaagtgattctcatgcctcagcctcctgagtagctgggattacaggtgcccgccaccacacctggctaatttttgtattttttgta

SEQ ID NO: 11070 - DNA, 201 bp, Homo sapiens
tctgcaaataatatataaattagaaatatttggaatgtttagtttatttgctaaagctcttcagaactataaattacaatattaatgaacttatttttaaktcccatcactttcatttttatagaatccagaaataatgcatgtaacttgccattcctccccattagtacacttgagtccaaaggagaggttcacagcatc

SEQ ID NO: 11071 - DNA, 201 bp, Homo sapiens
tcacaaagcaattaagtacctaattgttcatggctctgagtttgctactgaaacagaaaacttcttaggcttgctaagaaaacttcttaggcttctaagcmctcctggggcttggaatccaagaattcagtagaagacggaagcgtggtaaggagaacaagaactgaagacataaacaaatttatttgaaatatggttgca

SEQ ID NO: 11072 - DNA, 201 bp, Homo sapiens
atggttttataaatgggggttcccctgcacgagctatcttgcctgctgccatgactttgctcctcattcaccttccatcatgatagtgaggcctcccaagscttgtggaactgtgagtccattaaacctgtttttctttatcaattacccggtctcagatatgtctttattagcaccatgagaacagacaaatacactgtt

SEQ ID NO: 11073 - DNA, 201 bp, Homo sapiens
actggaacattacaaacttactccttcaacgaatgcatgtagccaatctatgtgtgatgggactgataatataaccaggagctctccaaattatcattcaygtagaatacaatggtttttaaataatcggtaatagaagttattaatttgaggcttacatatgaatctgaaatgcaacaatgtctgtagaaattgtttaga

SEQ ID NO: 11074 - DNA, 201 bp, Homo sapiens
gtgtgatgggactgataatataaccaggagctctccaaattatcattcatgtagaatacaatggtttttaaataatcggtaatagaagttattaatttgargcttacatatgaatctgaaatgcaacaatgtctgtagaaattgtttagaattttgacaagatttgtttgtggatggagtttctttttaaaagattgatat

SEQ ID NO: 11075 - DNA, 201 bp, Homo sapiens
attgatttcttttcctttggataaaaattcaatagtgggattgctggtggatggagtattttatcactgacattgtttagaattgtgaagggaaagcagarttaaattttctgtctctttaaactcagtcatcttttctctatagcacaaaagattatgttttttttttttttttcataactcagcatctttgtgagctat

SEQ ID NO: 11076 - DNA, 201 bp, Homo sapiens
gtttagaattgtgaagggaaagcagaattaaattttctgtctctttaaactcagtcatcttttctctatagcacaaaagattatgttttttttttttttttcataactcagcatctttgtgagctatgaaacttgccctgatagccttttcttgcctagggtaggatatattctgaggaagggctgggactgcccatgcat

SEQ ID NO: 11077 - DNA, 201 bp, Homo sapiens
tagagatggggtttcaccatgttggccaggatggtcttgatctcttgatctcgtgatctgcccgcctcagcctcccaaagtgctgggattacatgcatgartccccactggatttgatctttacaaattaatattagcacttgttaactaaaggaatgaagaaataagtgaaagaatgaaggaataaatacataacaacat

SEQ ID NO: 11078 - DNA, 201 bp, Homo sapiens
gtgtcttaacattgctaagaaaagaaacacacttgccccctttttgcagaagtaagctcctttagtgattttcatctcattttcttctatacttttttttkatatttgttgtgagcacgatcttctcttttttaataaattcatatttttcaattatttttattattaaggtaagaagtgtgcttttgttggtggaggaag

SEQ ID NO: 11079 - DNA, 201 bp, Homo sapiens
agaatcgcctgaacccgggaggcggaggttgcagtgagcggagattgtgccactgcactccagcctggcgacagagcgagactccatcttaaaaaaaaaamaaaaaaaaaaaaaaccaactttgataaataaaatataactctaactctagatagggaccgaatgggggtataatgtttgtttaagtttttgggagacact

SEQ ID NO: 11080 - DNA, 201 bp, Homo sapiens
gcctgtccatgaactcgtccaaagcaaatatgctttgagttttcatgtctgttttttaatttttgtggatacacagtaggtgtaaatatttgtggggtacrtgagatgttttggtataggcaagcaatgcatactaatcacatcatggaagatagatagggtatccatcccctcaagcatttattctttgtgctaacaaac

SEQ ID NO: 11081 - DNA, 201 bp, Homo sapiens
tttctaaggtctctcagaaccttagctccaacaaaacccccttctttttctctcattataacacaaatttcctgtgaatatcaatgaagcaaacagatacrgtgggagctcgtgaaagacaaaggacaccgagctagtattttcattaacaacatgggctcttgtactgtcaaccaacaagagctttgttataaatttatt

SEQ ID NO: 11082 - DNA, 201 bp, Homo sapiens
attatgattgtcactagctcactctgagccatggctctacattttatccttgtcaataagcaatccagtgttaggattttaaaaattgtttaaaatatccrtacaaagagttattttctatcttggtccacaaatttgtcaatattttccacagcatcacaattgtcagaaaacacagtgaagcttaagttaaaacaaatc

SEQ ID NO: 11083 - DNA, 201 bp, Homo sapiens
catttcatgatagacccgatttcttacactgaaattcattttaatgtttggattgagcaatggtttgctttggtcttaacttttatttattgaggtataahttacatacaatgaaaatctcaaatcttacatctactgttcaatgagttttgacaaatgcataccattgtggactccatccacatccctataacaaagcag

SEQ ID NO: 11084 - DNA, 201 bp, Homo sapiens
caatttctactgatagttaagatcaattaaccaattagttacccattttcatttttcctgtatattctttgtagatcacttactaaaatgattttctaagrccttcactttcttaagtaaagaaaaacaatttgactgagacttggccatttagctaaaatctaaaagacctatttaatttaaagtataagtcaagcagag

SEQ ID NO: 11085 - DNA, 201 bp, Homo sapiens
ttctgtccataaataataagaatgattgtttttcgctaagtggaaaaagtgagatgaggcaagaagttgaagaatgcctagccaggtagcatatgaagccyacaagtttccagctgtgggtctgatgaaaaataatgagacatctgatggaacttaggatcttatttgaaaaataagccatcaagtactttaactttctgg

SEQ ID NO: 11086 - DNA, 201 bp, Homo sapiens
gtctgatgaaaaataatgagacatctgatggaacttaggatcttatttgaaaaataagccatcaagtactttaactttctggtatttcaaaagtaaaaacrtatactaatcacttgtttttatttcacttatttgacactacacatctgtcttagtacaaactcatgtttatgcaatgagatttattagactgatagttca

SEQ ID NO: 11087 - DNA, 201 bp, Homo sapiens
aaacaatgggagtataaaggtattttagaacgtatttgtatatgttaaaacaacagcatattaaaaatttaccttgagaaggccgggtgtggtggctcacrcctgtaatcccagcactttgggaggccgaggcgtgcggatcaccaggtcaggagatcgagaccatcctggctaacacggtgaagccctgtctctactaaa

SEQ ID NO: 11088 - DNA, 201 bp, Homo sapiens
tcaggagatcgagaccatcctggctaacacggtgaagccctgtctctactaaaaatacaaaaaaattagccgggcgtggtggcgggcgcctgtagtcccasgtactcgggaggctgaggcgggagaatggcgtgaacccgggaggcagagcttgcagtgagccaagatggcgccactgcactccagcctgcactacggagc

SEQ ID NO: 11089 - DNA, 201 bp, Homo sapiens
tactaaaaatacaaaaaaattagccgggcgtggtggcgggcgcctgtagtcccaggtactcgggaggctgaggcgggagaatggcgtgaacccgggaggcrgagcttgcagtgagccaagatggcgccactgcactccagcctgcactacggagcgagactccgtctcaaaaaaaaaaaaaaaaaaaaaattaccttgaga

SEQ ID NO: 11090 - DNA, 201 bp, Homo sapiens
aattagccgggcgtggtggcgggcgcctgtagtcccaggtactcgggaggctgaggcgggagaatggcgtgaacccgggaggcagagcttgcagtgagccragatggcgccactgcactccagcctgcactacggagcgagactccgtctcaaaaaaaaaaaaaaaaaaaaaattaccttgagaaaaacaagcaaacacat

SEQ ID NO: 11091 - DNA, 201 bp, Homo sapiens
tatttcatgcatacctcagctgaaaattggcagttatgtattagtgcttgattttctagaccagtattaaaattaccttccaaaaatgtttcagttgcagmaagtattggtggccaacaggtcttccatgagtcgggacacattagccagtgtcaccctttctctagccagtcagttctatgagaatggtattggaagaac

SEQ ID NO: 11092 - DNA, 201 bp, Homo sapiens
ggatgggaagcagtgcagactctcatgtatgaatagctccaattctcaaaaaattcttttagttaactgctgtctgtcttcttctacattgcactcaagcytaactctgcacttttaaaatcaacatataaattataactttctctcctatgataacttttcaaatgttttttgacatctattcagtaccgagctcccttt

SEQ ID NO: 11093 - DNA, 201 bp, Homo sapiens
tcttaacaatcttcttcatcagggattagattcttgtttttttctttgttgccttttttttttttttttttttttgagatggagtctcactctgtcaccasgctggagtgcagtggcgcaatcttggctcactgcaacctccgactccgtggttcaagcgattctcctgcctcagcctcctgaaagctgagatcacaggta

SEQ ID NO: 11094 - DNA, 201 bp, Homo sapiens
tatatgagaaagacaaaactactctttctatcctgtactgtaatcctacctgacaaatatatccttcatgctccttgtcattttgagcaaatagcctgagyttacctcactttcatttgaacttcctccctctttattgccaaggtactacgttcctttatctctgtgcctgaacaagccccccttgctataatcttcatg

SEQ ID NO: 11095 - DNA, 201 bp, Homo sapiens
tgaactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatct

SEQ ID NO: 11096 - DNA, 201 bp, Homo sapiens
gaactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatcta

SEQ ID NO: 11097 - DNA, 201 bp, Homo sapiens
aactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctac

SEQ ID NO: 11098 - DNA, 201 bp, Homo sapiens
actgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctact

SEQ ID NO: 11099 - DNA, 201 bp, Homo sapiens
ctgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctactt

SEQ ID NO: 11100 - DNA, 201 bp, Homo sapiens
cttctgcacatgttctttatcctaggaagcaaaatatttattccttttcctgcattctttaatacctagtttatgcatgtctcattgcacttattctaatmggagcttgttcttgtcattttttttcatatttttttccttttgtgggggagtttaggacccaagtctttgtcctcttttggtttaactagtaccttgcac

SEQ ID NO: 11101 - DNA, 201 bp, Homo sapiens
cagctctgtcacccaggctggaatgcagtggcatgctgttggctcactgcaaactccacctcccaggttcaagcgattctcctgcctcagcctcccgagtrgctggaattacaggtccccaccaccacgcccagataaatttttttttgtatttttagtagagacggggtttcactgtgttggccaggctggtcttaaact

SEQ ID NO: 11102 - DNA, 201 bp, Homo sapiens
gagtggctggaattacaggtccccaccaccacgcccagataaatttttttttgtatttttagtagagacggggtttcactgtgttggccaggctggtcttraactcctgacttcatgatctgcccgcctcggcctcccaaggtgctgggattacaagtgtgagccaccgcgccctgccagaacaatcctattttctaattg

SEQ ID NO: 11103 - DNA, 201 bp, Homo sapiens
ctgggattacaagtgtgagccaccgcgccctgccagaacaatcctattttctaattggggtttttctttgttttttgtttctttgtttgtttgtttgagayggagtttcactctgtcaccgaggctggagtgcagtggtgtgatctcagctcactacaaactctgcctcctgggttcaagcaattctcatgccttagcctc

SEQ ID NO: 11104 - DNA, 201 bp, Homo sapiens
gcccggctgctcttgaactcctgacctcaggtgatctgcctacctcggcctcccaaagtgctgggattataggcatgaaccactgcgcctggccgatactrcagttttgatggccatcactggtacaacaccctgcgtatgccaagactgtcatgccttgtcagctataataaaaagcaggagacaaatggccttttgtta

SEQ ID NO: 11105 - DNA, 201 bp, Homo sapiens
tctctttgtttgaggattggaaagcctccaaaaacccactcaggagggaaattaacaaatgtctgttttgttacctccggataaatcttcatgatgaaatrtgcagccggtccacctcttcaatcttctctcttcttcttcctcagtggaagctcaattaccatgaaggccaaaataaataaataaataaacaacaaacca

SEQ ID NO: 11106 - DNA, 201 bp, Homo sapiens
ctttcatagcttgtaacttttcattgatcatcaactttactgatttttgttaatactggaaattttaataaatgggttgtgcacaggtacttattgagcayctattacgtgccatagaatattctgattattaaggatgtcaaggtatataatccagagtcacggttttcaaggaactcagtcaataattacaagctaata

SEQ ID NO: 11107 - DNA, 201 bp, Homo sapiens
gaactgaatttctcagcaaactaacacaagaacagaaaaccaaacaccatgtggtctcactcataagtgggagttgaacaatgagaaaacatggacacagrgaggggaacatcacacactggggcctgtctgggggtaggaggttgggggagggatagcattaggagaaattcctaatgtagattacgggttgatgggtgc

SEQ ID NO: 11108 - DNA, 201 bp, Homo sapiens
aaacatggacacagagaggggaacatcacacactggggcctgtctgggggtaggaggttgggggagggatagcattaggagaaattcctaatgtagattaygggttgatgggtgcagcaaaccaccatggtacttgtatacctaggtaacaaacctgcacgttctgtacatgtatcccagaacttaaagtataaaaatgag

SEQ ID NO: 11109 - DNA, 201 bp, Homo sapiens
ataaaaatgagaaaaaaagatgcacaaatagtgtcacatatagtataataatgatatggatatggcctaattcatagagtcaacattctgatactaagagraaggaaaaatcaaaacaaaataaagaaaaaacaaagcagacagtagcctttaaccgtttccttttaaagaaacattgttatctgggttcattacttgtta

SEQ ID NO: 11110 - DNA, 201 bp, Homo sapiens
caggagaatggcatgaacctgggaggcggagcttgcagtgagctgagatcatgccactgcactccagcctgggcgacagagcgagactccgtgtcaaaaawgaaagatttaatgttggtcaaattatacacaacgattcaacagtactggaagttgaggaggacgagcaagccagatagcaccaatgatcatgaataaatt

SEQ ID NO: 11111 - DNA, 201 bp, Homo sapiens
aacacagtgaggcatgcatctctacataaaaattttacaattagtctagtgtggtggcacatgcctgtagtcccagctactcaggaggctgaggtggatcrcttgagccaggagttcaaggctgcagtgaactaggatcaagccactgcactgcagcctaactgacagagcaaaatcctgtctctaaaataataataattt

SEQ ID NO: 11112 - DNA, 201 bp, Homo sapiens
ggatggatggatagatgaatatcagtatcaaaaggtccatgctttattttctaataacaattcatgtccaattatctgactgccagcacagttatctgctrtggttgttagaaactttagaaagaagtaaatcctccaaaattgtcactcttaaaatctgagagaaaacagaatgaatagataagagatgcttcaaggcag

SEQ ID NO: 11113 - DNA, 201 bp, Homo sapiens
ttccttcgaggagaagcacaaagggaatagaagacccagcatttgttactggccttagataagcttactgttcacttatttatcaatgtaaaaacgcccarttagtttttagctcaaggaagagaggacatggccaaagatggccttcatgaacttttttttttcctgtgtgaagtatggaaactcattttcagtattgga

SEQ ID NO: 11114 - DNA, 201 bp, Homo sapiens
tcattttcagtattggattttgactggattgtcttctacccagaagctggctctgcagaagttatgatcagatctttggaagtaacatttgatctaccgcygaatatagatccccttccttccctcttctactccctccttgcttttccttcttattacactgatttcatgcaaaattaattatcagtcctgtcacatctt

SEQ ID NO: 11115 - DNA, 201 bp, Homo sapiens
gctgcagctgcctagttaggtattgaaatattgtatccacttgcaggtcaaaaaggaaaaaataacaacaacagcaagtggtccatgagagtgaagtggasgtattaaaactaggctgggtcttctcttggaagatgacagactgagtcccacagtgcctcactccattcaaagcaattaggagtgtaggattgcagtgac

SEQ ID NO: 11116 - DNA, 201 bp, Homo sapiens
catccttcttcacatggcagcaggagagggaagtgcagagtgaaggggggaaaagccccgtatagaaccatcagctctcatgagaactcattcactatcamaagaactgcttggggaaccgtccccatgatccagtcacatcccactggttccctcctacaatacgtggggattatgggaactatagttcaagatgagatt

SEQ ID NO: 11117 - DNA, 201 bp, Homo sapiens
aacagaaggattgattagaaggaagccagaactggagcctggaaagttggctacatggctttcacagtaatccaggaaggggatgatggaagagaggctgsagcatgggagcaacagctggagtgaagaagagaggatatgtgtgggaaatctttaaggggtacatttggcacaactaggtgatagacagaagtgatgggt

SEQ ID NO: 11118 - DNA, 201 bp, Homo sapiens
ataatattcctgtttaccagaaatatttctgaccataagactcattatttatttattatggatggtcattttatatatttttaatgcttatttaagactcsggagtacatgtgcaggcttgttacatggatagattgtgtgccactgaaatttggtgtaagaatgatcccctcatcattcttagcatagtagtcaatagtc

SEQ ID NO: 11119 - DNA, 201 bp, Homo sapiens
tcttaaataatatttgtatatggtgagaggtgtaggggtccagtttcaatcttctgcatatggctagctagttatcccagcaatatttgttgaatagtagsgagtcctttccccattgcttgtgaccatgagattttatgtgatgttgaaacccaaaactacccaaaggaattaactactgctggttaattgtacctatat

SEQ ID NO: 11120 - DNA, 201 bp, Homo sapiens
cccaaaactacccaaaggaattaactactgctggttaattgtacctatattaaacactttctttatagtattttccttatttgggggccatctcaaagtcmtaacaatcagaatttgtgtcttctcatatgatttttactcagaattacacagaatacagtattcataaaaatgaaccaaccataaaatatttattcttct

SEQ ID NO: 11121 - DNA, 201 bp, Homo sapiens
ctcagaattacacagaatacagtattcataaaaatgaaccaaccataaaatatttattcttctactgtgtcaggtagtcttgtaggttcctaagagatacyaaatacaggttcataattcttgtcctcgaagatctcccaatctactgataaagcaagtaccatatgcatgaaaagataaatgtctttataaagtttctta

SEQ ID NO: 11122 - DNA, 201 bp, Homo sapiens
atgacgacattttaaaggaagaacctccctggcagcatggctgaatagacctgggaagaaagagaatttatgcctgaatgaatggaaaactgatgattttrtatctcaaagtggataatttatttagaggcaactggctttggaggaaagagaaaatgaggggttttctaatgtttgagatgatagagaaacaggcaagca

SEQ ID NO: 11123 - DNA, 201 bp, Homo sapiens
ccttgtctgcataacaataatagttattatgaggtatttttgtgaataaactgaaatgatgactattaagcatttagcccaaggctaggtaaaagaaaagrctagccaaaagcatctgttattataaatataataattactaatcagcacccaactatgccgggcacttttgtagttacacatttgaataagatgcaaccc

SEQ ID NO: 11124 - DNA, 201 bp, Homo sapiens
tctgttattataaatataataattactaatcagcacccaactatgccgggcacttttgtagttacacatttgaataagatgcaaccctcaatttcaaagargtaagtgtcaatacaaagataaagatgtgaagaatagatagataccattttgtggtattgtttctacaagaaagatgtaaatacaatggaaaaggtgcca

SEQ ID NO: 11125 - DNA, 201 bp, Homo sapiens
acaccacgcccggctaactttttgtatttttagtagagatggggtttcaccgtgttagccaggatggtctcgatttcctgacctcgtgatccacctgcctyggcctcccaaagtgctgggattacaggcgtgagccaccgcacccggcctattacttagtttattattatttcattattattgagtatctattatttgatc

SEQ ID NO: 11126 - DNA, 201 bp, Homo sapiens
aaaaatgtttccatttgtagtttttctacagactcatggtataggtcagcttttttattgtaaatatttaagatgtacatttaaggtgtctccatatatgtatatatatatatatgtatacatagtgaaattactagtagagtcaagaaaattaacatatccatcatctcagttacctttgttgtcataacggcacataaa

SEQ ID NO: 11127 - DNA, 201 bp, Homo sapiens
aaaatgtttccatttgtagtttttctacagactcatggtataggtcagcttttttattgtaaatatttaagatgtacatttaaggtgtctccatatatgtatatatatatatatgtatacatagtgaaattactagtagagtcaagaaaattaacatatccatcatctcagttacctttgttgtcataacggcacataaaa

SEQ ID NO: 11128 - DNA, 201 bp, Homo sapiens
cctttaacctatatctccccatctcctcttccactgcatctggtaaccaactttctactctgtgttactatgtatttgactgtttattagtgtcgacttakgagtgagatcaaactctttcactctctctttctttcccgtttttttttttgtttgtttttgtttttttttaaacaagatctcacactgttgcccaggctg

SEQ ID NO: 11129 - DNA, 201 bp, Homo sapiens
tactctgtgttactatgtatttgactgtttattagtgtcgacttaggagtgagatcaaactctttcactctctctttctttcccgtttttttttttgtttktttttgtttttttttaaacaagatctcacactgttgcccaggctggagtacagtcacatgattccagctcactgcagcctcaacttcccaggctccaggg

SEQ ID NO: 11130 - DNA, 201 bp, Homo sapiens
actctgtgttactatgtatttgactgtttattagtgtcgacttaggagtgagatcaaactctttcactctctctttctttcccgtttttttttttgtttgkttttgtttttttttaaacaagatctcacactgttgcccaggctggagtacagtcacatgattccagctcactgcagcctcaacttcccaggctccaggga

SEQ ID NO: 11131 - DNA, 201 bp, Homo sapiens
gtgttactatgtatttgactgtttattagtgtcgacttaggagtgagatcaaactctttcactctctctttctttcccgtttttttttttgtttgtttttktttttttttaaacaagatctcacactgttgcccaggctggagtacagtcacatgattccagctcactgcagcctcaacttcccaggctccagggattctg

SEQ ID NO: 11132 - DNA, 201 bp, Homo sapiens
aattttctccccatgctcaagaagagaaatggaaatatggcaaacatctccatgaacccacattttctcacatctttagatcaaaaactcttattcttcarataaacaggttgtaaaattttcagtgttgaagagaatgaaatatgacatttgattttattgattcattgcttatttttggcagaagttatcctttattca

SEQ ID NO: 11133 - DNA, 201 bp, Homo sapiens
cccaatcatgtttaaggattattattttacatagaaataaataaagaaaggggaaccaatacaaagtgttagaaagacagctacgattaatatattggacyggcccattatcagaccctctagattttacaggtagctttctgatcagaaatctcgggtgagaaatagtaagaatgatggccttagttaaatcctctatca

SEQ ID NO: 11134 - DNA, 201 bp, Homo sapiens
gttggaaaatgataaccttattcattattattgcttgatacatttccgaatttgtgttatctgtcattaaatagctaccacagccttctttcattcttctyggtatcagtttaataatttgttcaatgaatatgagaaagaacaggatcacatccagattttaccacttactggctgtgtgacactgggtatggttattaa

SEQ ID NO: 11135 - DNA, 201 bp, Homo sapiens
atatgagaaagaacaggatcacatccagattttaccacttactggctgtgtgacactgggtatggttattaaccccatggaacctcatctttaaagttcaratgatggtaactaactcatgaggttgctagggattaaatgaagtaccatgtttaaggcttctggcgtgggtgctgagatatagcagataagagatggtag

SEQ ID NO: 11136 - DNA, 201 bp, Homo sapiens
cagatattggaaaggtggaggagaattatgttctatggcactttcagaagctcgagaataccttggcagagccaagccttctgcttagggaatggctagcmgtaacaaagcatggtacctgagatcaggtacatagtcaagagttaggttgaaagtcgaatattaacctgaaaaaggaagatttggcagcacagtgtatct

SEQ ID NO: 11137 - DNA, 201 bp, Homo sapiens
agtgtatcttacagtcccaggaaaagagccagttgacatgttctgtgagacttcagaaaactgtacgacgtgaaagtagaagcatttctaatcatagttayattttgagtaatctcttcacagtagaatgagtcccccaacactggatgtactaaagccaaaggaagggccaccacttttcagagttattgaaggaattca

SEQ ID NO: 11138 - DNA, 201 bp, Homo sapiens
cccaacactggatgtactaaagccaaaggaagggccaccacttttcagagttattgaaggaattcacccatcagatatgttttgattttattcagtgattkttcaaactagatccgtttctctaccttattttcaatgggcagtggttctctagttcatcaaaaagtttttcctctggaatttttgagaagcaatagaaat

SEQ ID NO: 11139 - DNA, 201 bp, Homo sapiens
catgttacagctgagccttttcaaatgcacggtgataaagaacagatatgttttgtgtgtgtgtatgtgcgtgtgtgtgtgcgtgtgtgtgtgtgtgtgcrtgtgtgtgtgttatgcacagtggcttgaaggtagcagccctttcccctgatagaaatttgatgatggcagcaacaaaacctaaacagagaataattaaag

SEQ ID NO: 11140 - DNA, 201 bp, Homo sapiens
agcagtaagtgctagagaggaaaggaccagaataagggtaggaggtacttttgagaggtgacaacgtgctagcagccctcgctcgctcttggcgcctcctyggcctcagcgtctgctctggctgcgctggaagagcccttcagtccgccgcggcgctgtgggggcccctctctggggctggccaaggcctgccctctgctg

SEQ ID NO: 11141 - DNA, 201 bp, Homo sapiens
agggtaggaggtacttttgagaggtgacaacgtgctagcagccctcgctcgctcttggcgcctcctcggcctcagcgtctgctctggctgcgctggaagascccttcagtccgccgcggcgctgtgggggcccctctctggggctggccaaggcctgccctctgctggcggggaggtgtggagagacaggcagaggtggga

SEQ ID NO: 11142 - DNA, 201 bp, Homo sapiens
gggcgcagccggctgatgcctgctgggcttgaaaagggacgagctccctctgggctgccggagtgcccgtgctaggttccaaagtcgccagtgagtgccaytgagaggtgaagccggctgggcttttgggtggagtggggacctggacaacttttctgtctagctaaaggtttgtaaacacccaatcagcactctgtgtct

SEQ ID NO: 11143 - DNA, 201 bp, Homo sapiens
gtttgtaaacgcaccaatcagcactctgtgtctagctaaaggtttgtaaacgtaccaatcagtgctctgcatctagctaatcaggtaggggacttggagamcttttctgtctagctaaaggattgtaaatgcaccaatcagcactctgtgtctagctaaaggtttgtaaatgcaccaatcagctctctgtcaaaacggacc

SEQ ID NO: 11144 - DNA, 201 bp, Homo sapiens
gactaaacacagctagtaagttgcacgacctggatcaattctccattggcttgtttccaaagccacaggtttactttaacatatacagcttttatagcackaacattgtgttctatgtgtccgtcattaagttgggtattttacacacattatcttaatatataaaacaattatatgcagcagatgttattaccatgatac

SEQ ID NO: 11145 - DNA, 201 bp, Homo sapiens
tggatcaattctccattggcttgtttccaaagccacaggtttactttaacatatacagcttttatagcactaacattgtgttctatgtgtccgtcattaarttgggtattttacacacattatcttaatatataaaacaattatatgcagcagatgttattaccatgatactgcaaataagaaaactgagaaatagaacat

SEQ ID NO: 11146 - DNA, 201 bp, Homo sapiens
gtgttaggatttagactgatttctgtgtgatctgtagtccattctgttcaacactacatgtacctgccttcccgtggtatcattgccccagttctgaaacytaggtctaggtcgcaggagaactagcttgataaggatgggctttagagccaaaatttaagccatgctttgtcttatctgcataattttatgttcccagtc

SEQ ID NO: 11147 - DNA, 201 bp, Homo sapiens
gttgtatctccctcattgatgcatcctctgtaacatctagctgtttaatgtgtcactcagaataagtgctcaataaatatttatcaaagtagctgatgttwcaggaagtctaggaagcaaaccacctcttctgttctgctcttggattcaagaacttaagaggattttgttggaaatccacaaagaatattttaaacgaga

SEQ ID NO: 11148 - DNA, 201 bp, Homo sapiens
ttgtatctccctcattgatgcatcctctgtaacatctagctgtttaatgtgtcactcagaataagtgctcaataaatatttatcaaagtagctgatgtttsaggaagtctaggaagcaaaccacctcttctgttctgctcttggattcaagaacttaagaggattttgttggaaatccacaaagaatattttaaacgagac

SEQ ID NO: 11149 - DNA, 201 bp, Homo sapiens
tgtatctccctcattgatgcatcctctgtaacatctagctgtttaatgtgtcactcagaataagtgctcaataaatatttatcaaagtagctgatgtttcmggaagtctaggaagcaaaccacctcttctgttctgctcttggattcaagaacttaagaggattttgttggaaatccacaaagaatattttaaacgagaca

SEQ ID NO: 11150 - DNA, 201 bp, Homo sapiens
gtatctccctcattgatgcatcctctgtaacatctagctgtttaatgtgtcactcagaataagtgctcaataaatatttatcaaagtagctgatgtttcakgaagtctaggaagcaaaccacctcttctgttctgctcttggattcaagaacttaagaggattttgttggaaatccacaaagaatattttaaacgagacac

SEQ ID NO: 11151 - DNA, 201 bp, Homo sapiens
aaaaaaaaaaatcttaggctgtccctacaacttttgctatcctcacgaaagagtgttactccagtgagacaaaagtccatcacaagaaatgatttttctayggaaacagctgtgattggagcaagatacaaggtaaaacatgttgtggtcaagttcaaggagaaaacagggtggctagccctagcaatcctactggtggac

SEQ ID NO: 11152 - DNA, 201 bp, Homo sapiens
cagggtggctagccctagcaatcctactggtggacttacttctgcacacttcatgctactatctatcctgtgttgtctaaggctatataatgtcgagagaygggctagtccaggaatcatgacagcaaatgagggagagagagagagagagaggagacagagagatggctcttgcaacctttccaatagcttttgataggt

SEQ ID NO: 11153 - DNA, 201 bp, Homo sapiens
aaaactcacagaaacataaagttgacttgatcatgcccattttataaataaaggaatggagactcaaagcggttaagggacatgtctgcagtattttaccygtgagctatatgccctctgggtttctcctcatccatctgcccccaacaactatgctctttcctctttcctttactgtttctgggcatatcaaagccaaac

SEQ ID NO: 11154 - DNA, 201 bp, Homo sapiens
ttgatcatgcccattttataaataaaggaatggagactcaaagcggttaagggacatgtctgcagtattttacccgtgagctatatgccctctgggtttcycctcatccatctgcccccaacaactatgctctttcctctttcctttactgtttctgggcatatcaaagccaaacttaacagcaccaatttcacattaaac

SEQ ID NO: 11155 - DNA, 201 bp, Homo sapiens
ttactgtttctgggcatatcaaagccaaacttaacagcaccaatttcacattaaacaaaagaagaggaacctactgaccaacctttccccatcgccaccaygtctagcctcgccagactctggtaatcattacactactctgtaattctaagatcgacctttttagattccatatatgagtgagatcttgaggtatttgtc

SEQ ID NO: 11156 - DNA, 201 bp, Homo sapiens
ctgggaaggcctcaggaaactcaaaatcatggtggaaggggaagcaaacacatccttcttcacatggaagcaggagatagaagtgcagaccaaaggggggraatggcccttatggaaccatgagatctcatgagaactcactatcatgagaacagcatgggggaaactgccaccaagacccagtgactccttactgggtcc

SEQ ID NO: 11157 - DNA, 201 bp, Homo sapiens
gagaacattcagggatttaatttttctgacacacagactgtgagttcttttgttttttgtttttgtttttctttttttgttttcagcacatcacactctgrctgtcattatcagttccccataaactgtgataatttttgtgtcacatagagtgtttaggttggcctctgatgaaatgaagcccaagtacttgctcttcca

SEQ ID NO: 11158 - DNA, 201 bp, Homo sapiens
ctgggttcaagcgattctcctgcctcagcctcttgagtatctgggattacaggtgtgcgccaccatgcctggctaatatttttatttttagtagagatggrttttcaacatgttagccaggctggtcttgaactcctgacctcaagtgatccacctgcctcggcctcccaaagtgctgagattacaggcatgagccaccgt

SEQ ID NO: 11159 - DNA, 201 bp, Homo sapiens
cagatattttatcacctgtgtatgtaagccttgtacccaatagttatttttttctgctcctctccttcctcctaccctctaccctcaagtagacctcagtrtctgttgttcctttctttgtgttgatgagttctctagaaatctttgtgattagttgtagttgagtactaatgtggctttgttttttttttcatggagttg

SEQ ID NO: 11160 - DNA, 201 bp, Homo sapiens
tttcttatcatcttgatgctgttgctcattttgcttaagttttaaagatttggcctttctctttttatgttgattaccaagagtgtctttgcaaagtcctktatgcagtactcaaagtatgtccatgccatttagctcctataaagaaaacaagtttttagccttcctaggaaattaagtttcctacaaaatatatgctct

SEQ ID NO: 11161 - DNA, 201 bp, Homo sapiens
ttaagttttcttctatattatcagttgctgtttagaataaattataatctccacgtttttttttgagacagagtctcgctctgtctcccaggctggagtgyagtggtacaatctcggctcactgtaacctccgcctcctgggttcaagcgattctcctgcctcagcctcctgagtaactgggattacaggcgcacagcacc

SEQ ID NO: 11162 - DNA, 201 bp, Homo sapiens
tggtacaatctcggctcactgtaacctccgcctcctgggttcaagcgattctcctgcctcagcctcctgagtaactgggattacaggcgcacagcacctcrcctggctaattcttctgtatttttagtagagattgagtttcaccatgttggtcaggctaatctggaaatcctgacctcgtgatttgcccacctcagcctc

SEQ ID NO: 11163 - DNA, 201 bp, Homo sapiens
tccttcctcagcggtagtagtccagacagaaacagttttggtggttgcttgagttctcccagttgttctcctgtcattttgcaggtcaatctgcttcattrtaggaacattctactggagaaaaaagtctatcattattcaaaatatccctccttatgcatacttcccactgcttagatgtctatactcagaaaagttact

SEQ ID NO: 11164 - DNA, 201 bp, Homo sapiens
attcaaaatatccctccttatgcatacttcccactgcttagatgtctatactcagaaaagttactatgtggtttttctttatgggacaatactgcgtgatygtggcgttcacatttctccctccaagtccttgcttttctagtttctgtaatcattcctcaggtgacataaaagtattttccgaagttttgccattttcat

SEQ ID NO: 11165 - DNA, 201 bp, Homo sapiens
taatttcactagccatcatatgatttagcttctgaagcagcttgctgctctgttattcgtgtgaactcatatcctttctcatttggaaagtcaagaccacrtgggtacacctcttatcacaagcttcgtagagaccacaaagatgccactttagtcccaactcactaaatctcctctacaatgtctctaaaaattatccaa

SEQ ID NO: 11166 - DNA, 201 bp, Homo sapiens
ttgagtctacctaggtccttggcctcctgcccttttatcttttctgagatctcatgccatctgttacctcatctctattttatctgttataattcctctcytctgcttcttccccagctgctcagaacatactgaaatatatgtaagattttgggttttttttctggtcattttgctcaatgacttcctaataccaactga

SEQ ID NO: 11167 - DNA, 201 bp, Homo sapiens
atatatgtaagattttgggttttttttctggtcattttgctcaatgacttcctaataccaactgaagagagtttatatttcttaatacaacattgaaagcytaacatgatttggcctcaacctacctttttttatccagtaaaattcatttctctctaatgtatactatattccatccaaactaacccactgattagactt

SEQ ID NO: 11168 - DNA, 201 bp, Homo sapiens
gatttggcctcaacctacctttttttatccagtaaaattcatttctctctaatgtatactatattccatccaaactaacccactgattagacttcattttycttttaattactgctttttgctgtgctggtcccactgcttagaatgttatttcctcaaccttatttctgtttcctacatttgttgaaatcctagatgtcc

SEQ ID NO: 11169 - DNA, 201 bp, Homo sapiens
tgacggcaaagtagatctctgggcccctcagcaaggaggcagaagttcatgttgcaaagaaagttccacgggcctactgaaatattaccaatcaaaattayaatttcatttattgacaagtcatatttaacattcttctaatgttttttctcacatgccaatgtccaaaaagctaaaccatcagctgcatgatgctaaggc

SEQ ID NO: 11170 - DNA, 201 bp, Homo sapiens
tcatttattgacaagtcatatttaacattcttctaatgttttttctcacatgccaatgtccaaaaagctaaaccatcagctgcatgatgctaaggctttcrgcagtcagcagaagcagtggtagttgcgagctggttattcagaggcagctactgtgctccacataaccataaagtgaacattttgacattcccgaaaatg

SEQ ID NO: 11171 - DNA, 201 bp, Homo sapiens
cctttattgaggttcagagaggttgctacttatatggtagcaaaagtatttcccttccctacttaccctactatacaaaacaaacaaacaaacaaacaaamaaaaaaccagaaaacttgatgataaatgtcaatcaacactcagcctctgcatctgatgagcaacagaaattagcggggactgtggtgaattggaaaacct

SEQ ID NO: 11172 - DNA, 201 bp, Homo sapiens
tgagaaggagtctcgctgtgtcacccaggctggagtgcagtggtgcgatcttggttcactgcaacctccgcctcccaggttcaagcgattctcttgcctcrgcctcctgagtagctgggactacaggcgtgtgccaccatgcccggctaatttttgtatttttagtagagacggggtttcaccttattggtcaggctggtc

SEQ ID NO: 11173 - DNA, 201 bp, Homo sapiens
gtgtatgcacaaaacaccctgtcccgggccccagatgtgtgcaggtttctaattgccggtgctgcactaagatttgaagggtgagagagttgcaaaatcasgaacaccgagggcggtgttaggaaggcagcttcctgcacactgttgtaggtgttagtgagattatcaattgctccgggagagacacaggactggagggct

SEQ ID NO: 11174 - DNA, 201 bp, Homo sapiens
tatgaagcagaattcttatccatatgggaaagaagatttggggcagcatggggtattacatgaaacactgttgccatcagatctgggccctgacgttaacwtgcaggacgttaggaaagttaacattcctgggccttgtcaaatgcagtcagtggcctaagccatctccatggtttcttctgtgaataagacagtcagtag

SEQ ID NO: 11175 - DNA, 201 bp, Homo sapiens
tcctatttatatgaattataagtgagtaggtgctgcccaagtgcttaaaagccgtttgttcttttaagaatctttaccattccttctaagactttggagcrtttggtgatgtccttaacaagccattgtatatagcagaggagtaaagtggaatcacacataaatggtcacatatttcaaatatgaagatgtaaacagttt

SEQ ID NO: 11176 - DNA, 201 bp, Homo sapiens
tgccacaaatgagctacatgtctttgacaagttgcttcaactcttagtttcctcaattgtaagtttcatatgaaatttagaaagaataaagggaatgggawctagcaccaaattaaaaagtaaacgtgatgtgaacttgaggcattaaattacaaataagtggtttccaaaagagagtatgctttgtctcatcaaaggaag

SEQ ID NO: 11177 - DNA, 201 bp, Homo sapiens
ttttcatagcacttactaattatctttgtttattactttattgcttgtctccccattataacgtatgcttctgggagtcaggagctctttcttataccagygattttatcacaagacctaaaagagtgcttggcacatgaaagatgtctatatatgatgaatcagtgaatgagtgatgaatgaataaatattggtcctctt

SEQ ID NO: 11178 - DNA, 201 bp, Homo sapiens
ataatgcacagacttgaattcctatattgagagaataacttacctcttttaaataataccataatttgccttgaaggtagggaagaaagagagtgaagtgsggaaaatttcaaaattctgtcttccagggagcatattcctactcatctgtgacatctaatgtaatagattttgaagaattatttgtaagatagatacttg

SEQ ID NO: 11179 - DNA, 201 bp, Homo sapiens
gcggtacgtgacaggggctgcatgcaccggtggtcagagagaaacagaacagggcagggagtttcaaaatgttcttctatacaatgtctggaatctatgartaacatcggtttctaagttatgagttgatttttagctactgggtttaggccaggcaggcccaggcctggtttcgggcctggcgccgggctgcctgtcttt

SEQ ID NO: 11180 - DNA, 201 bp, Homo sapiens
tctaaaatggagagaatactgattagacatatcttatacgatttgggggctactaaataagataatgcatgaaaagtactatgaatcatatttacaacatrataaagatcagctgcttctattattaatattaacactattaaggagtaattttacaaatgatgctctctccctgtgagaggttatgggtaacaactgagt

SEQ ID NO: 11181 - DNA, 201 bp, Homo sapiens
aagtagtatctcattggcttatttagtaatccctttaatgttctttaaggcccccctagtgtgtccaatttcagctagtttatagaaatgatgtaaagaayaggtctggctcacaagaaatcaaaagcaaggatagaaatattcctcaaccttgtgtttatcatttattgtaatgtgattgtgttcttggaaaagcattaa

SEQ ID NO: 11182 - DNA, 201 bp, Homo sapiens
actgaaataaattaaaaataattaaaatccaaagttcaccttatgaaggtgtgtgcctttaataatgctcaaatatagatttttaacatacactctgattktctgtctgccaaaagagggaaaaatctgataatagctgagtgtcatcttcctccaagcaatcagcaatgcattatttcctaatattgctgtttgatttca

SEQ ID NO: 11183 - DNA, 201 bp, Homo sapiens
tagacctctgtgcctttatctatgtcgttccttctacctcaacaggtttctgtcctaccatggattgtctaatgccttctgcacatgttctttatcctagraagcaaaatatttattccttttcctgcattctttaatacctagtttatgcatgtctcattgcacttattctaatcggagcttgttcttgtcatttttttt

SEQ ID NO: 11184 - DNA, 201 bp, Homo sapiens
cccccttctccgcaaagcactcaggcatcggacacgctatggtaaacaaactacattgtctggtagatatcattcttattgtctctttttttgggtttgcmgtgtgttgccccccttttcctctccaacccccccttttatcctctttagactcatttcttcttttaagattttgttacattaaatgcaagcctttctttt

SEQ ID NO: 11185 - DNA, 201 bp, Homo sapiens
accaccctgccccctcctaagcagccggcttatgagacatttgcaaagatgttaaccccacataaaaagtgtgccgttcgataattatgtaaattagctgrcaattagataatgtcactcactttccctctctcgcttgattcccacacaacagagaagtgttctgagcttctgcaccagcccgggccctgcatgcaggct

SEQ ID NO: 11186 - DNA, 201 bp, Homo sapiens
ttgggcaagccatttgacctttctccaccacagtctccatttgcaaaatggtggttacaatcttccgcagccatgtgtggtggctaaatatgcaaagcacyttatgttccagaaggattatgagctcatccatggtctaggtatagacgtgctgtgacgtgcacatgatctacaggctgagctttctgtttcaaaggtgac

SEQ ID NO: 11187 - DNA, 201 bp, Homo sapiens
caggttgccattttcacttggtttttctatttgcgaatctgttgttaaacccagttggatggcatccaggctttattaaccagaaaacactatactttctraagtgcttatcaaaaagtgcttaccaaattttcttctgccacatgattgatttaatgtcttctaatgtcaatgtgaaagcgtaagaaatgataggtgtct

SEQ ID NO: 11188 - DNA, 201 bp, Homo sapiens
caccaccctgccccctcctaagcagccggcttatgagacatttgcaaagatgttaaccccacataaaaagtgtgccgttcgataattatgtaaattagctrgcaattagataatgtcactcactttccctctctcgcttgattcccacacaacagagaagtgttctgagcttctgcaccagcccgggccctgcatgcaggc

SEQ ID NO: 11189 - DNA, 201 bp, Homo sapiens
cttatcaaaaagtgcttaccaaattttcttctgccacatgattgatttaatgtcttctaatgtcaatgtgaaagcgtaagaaatgataggtgtctgcctaygttttctgtttgataaaagtgtaactccttacgaatactaaacaaatggtataggctggcacacatttgaaacacatttccacacttaggtatgtcaagg

SEQ ID NO: 11190 - DNA, 201 bp, Homo sapiens
aaaggctcacttttgtttctactaaaaacacttttctaaaatagtatcaggcacacttaagtcctttaaatggagagaggataaaccaaactgtaattcaratattgtttgtgctgttttaatcagagcagctagaggaaaactaccctggatgtttttcccgcccctgcccttcatgttctaaggcccaactctgctctg

SEQ ID NO: 11191 - DNA, 201 bp, Homo sapiens
aagcatgccttaccacttcacaaatagataaggtggcttctaagaaaatctcaaatagaggtggtcaggaagccacaggaccaaccaagaacccagaaacracagtgcttactagatgctgcttgcattctaccatgtggatacaatgagtaaaacttgggtactaaagtcaaagtgcctgccaccacacctggctaatat

SEQ ID NO: 11192 - DNA, 201 bp, Homo sapiens
tttataaagaaataaagtcttttcccattgttctgctctgtggaagtcaccttcagagtaagggtgggggtgactgtccttgccaatttttaagtaactgscttgcaagggtgattccctacagagttattttctgcatagtttccctctgggtacagaatgtgggaaagtagatgcaacgcattttagagtagtcatttg

SEQ ID NO: 11193 - DNA, 201 bp, Homo sapiens
cagaaaaccagcaactagcaaatggtttctccatgatgattttgggttcacatttcacttccatatataatacaacttatgtgcccatatttcatcctctrgaagcctgccacattatcctctgaatgaatattaacactccttgtactctgaagtagcctctggtattctggtatttattcaacaggttttgaacaagat

SEQ ID NO: 11194 - DNA, 201 bp, Homo sapiens
agttttctcctctgcaaaatggaacaatagaatccttttcattgagttattctgaggattaaatgagtgaatataggtaaagcacgtaggacatccctggyatatagcagtcaatcccttgtaaaatgttagctgcagtgggtgcaactgactgcggccagttgtcaccacctgtgacatttaccaagacaattttgggta

SEQ ID NO: 11195 - DNA, 201 bp, Homo sapiens
atcagaaccttttgagacaggggcaggacttggcatcagtatttcttaaatataaacattgtatatgtaaatattatatcaataccagtatttttaaaagyatcccaggggagtcagccttttgaattactgtccatttaatattcaaagcaaagtctatacatttgtattattcctattttatttatgaggactctgaga

SEQ ID NO: 11196 - DNA, 201 bp, Homo sapiens
aagaggcgtgtttcaactaacaggaggagagatgcaaagagctttcaccaaagcaatcagaagacctgtaaacagcctcagggaactgtaaaagtctgtgrgggtctctagtgtaccagatgaaaagcagaaactttaggtagccgtctgaatgtgtcaaatgggaatatcagaataactcactaaatttcctttttcaac

SEQ ID NO: 11197 - DNA, 201 bp, Homo sapiens
cttgttacaaacgcatattgttgattctcattccacaactattgaatcagaaattctgggactgagtcctagcaatctgtgttttaaacaagccctccaartgatttaatgcatgccaaatactaagaatcactgttatccttggaagaggggaaagctcagataacccacaattgaggtctagagatgttcatagtctct

SEQ ID NO: 11198 - DNA, 201 bp, Homo sapiens
aatgcagatgttgtttttaaaaatgaacaatgttaggctgccttcctcgaggggctgtctctcttgttctcactcttctgcctccccttccacctttaagkatcctgtgattacattgggtgcacctggatgataggcaagctccctattttaagatcaactgattagcaaatttattcccctgtgctatagaaggtacca

SEQ ID NO: 11199 - DNA, 201 bp, Homo sapiens
agggtgagcaaaggcatggaggtagagcatgttctggtgtctgggtgaagaacttacaaacagcttgctaatttcaaggcccaaattataagactgggagmtttggactggtagctgcggttaggtagggaccatttcatagaggcctttatttcatgctatacccttggactttgttctctaggtaacgggggagccatt

SEQ ID NO: 11200 - DNA, 201 bp, Homo sapiens
gtcctctgcttcctggtcctttcactactgcctctccctctgcccccatagtacttcgcctatcatggtgtcatgatgagtctttccacctctgttctctstgctttctttccatgctgcattctgccccgttttgctctttgtgccattctttggaaacatccagtgcccagcaaagcatgtcttcttcagcctcccact

SEQ ID NO: 11201 - DNA, 201 bp, Homo sapiens
agggtttcaccatgttggccaggccaatctcgaactcctgacctcagatgatcaacccatctcggcctcccaaagtgctgggattacaggagtaagccacygtgcccggcctggccagttttttgaactactgatgaatttgatcaaagcctattaaaaacttactgagtaaacaaacaattgtcccatgaaagcagtata

SEQ ID NO: 11202 - DNA, 201 bp, Homo sapiens
aacaataaaacagtctactatagtagactacctgatattttgttatcactaatgtccataggttgatccaagaagactagttttttatcctttctgttaamctctaatgtgccccaatattgataaatgccatgagacctttttccaaacacataggcttcagaagacatcagagtcttctccactgcccattttctgttt

SEQ ID NO: 11203 - DNA, 201 bp, Homo sapiens
acatggtttacaggtctccttcttcttaattctcatctatacctttgtatagatgcctaagctgaattctcacattttctttattattcaagtataacagkttacctgtttgagtctacaacacccacttgctatattctgtactaatgacagagaacatgctatttgtgctttcccccaatttcagcacagtgtctgtca

SEQ ID NO: 11204 - DNA, 201 bp, Homo sapiens
tcatctatcttccaatagaaattttagagttgaaaagtccaaaaacctaaatgaaaaattcactagacgagctcaatggtagattagagttggcagaagawaaaataattgtattagtctgttctcatactactgataaagacatacccgagactgggtgattggtatgaaaaaagaggtttaatggactcacaattccat

SEQ ID NO: 11205 - DNA, 201 bp, Homo sapiens
aaagtccaaaaacctaaatgaaaaattcactagacgagctcaatggtagattagagttggcagaagaaaaaataattgtattagtctgttctcatactacygataaagacatacccgagactgggtgattggtatgaaaaaagaggtttaatggactcacaattccatgtgactgggatgcctcacaatcatattggaagg

SEQ ID NO: 11206 - DNA, 201 bp, Homo sapiens
aaaacctaaatgaaaaattcactagacgagctcaatggtagattagagttggcagaagaaaaaataattgtattagtctgttctcatactactgataaagrcatacccgagactgggtgattggtatgaaaaaagaggtttaatggactcacaattccatgtgactgggatgcctcacaatcatattggaaggtaaaaggc

SEQ ID NO: 11207 - DNA, 201 bp, Homo sapiens
agaaagtgggtttttcttttctatcacattgtcaggctgcaacttttttggacctttgtgttctattttccttttaaaactgaatgcttttaatgacaccsaagttacctcttgaatcctttgctgcttagaaatttcttccaccagttaccctaaatcatctccctcaagttcaaagttcaacaaatctctagggcatgg

SEQ ID NO: 11208 - DNA, 201 bp, Homo sapiens
ctatattattattcagctgacttctccagtaaataatagtgttcttcaggaacagaaaaccaaacgccacatgttctcactcataaatgggagctgaacartgagaacacatggacacagggaggggaacatcacatacactggggcctgtaggtggaggggagcagggggagggagagcatcaggataaatagctaatgc

SEQ ID NO: 11209 - DNA, 201 bp, Homo sapiens
tagactgctgttcttttctgttggtcctccagactccaaataccttccagtatcagctagtcttatgcactgtgattggatagttaaatactactttgacwcaaggctgccatcttactgttggaactctccactgttcttatagtaatcatcaggctctgaacactggcttcccagccctgtataatctcccccacttta

SEQ ID NO: 11210 - DNA, 201 bp, Homo sapiens
atctgggaaataggaaaagtggcatctgcccttgctccgcacttgggatgggagagtcaaatgagaaagactgaaagcaggtgtaaaatctaaagtactakgaaaaacaaggtgttatgatgtcttgataaacatttggtaagataggagtcttgttacacataataacatttttctgagtaatctagtttggtttatttt

SEQ ID NO: 11211 - DNA, 201 bp, Homo sapiens
ttttcattgcaggcatgtctgggcaagtcacctgtttagcctttcttatctgtgtggctgtgggcatgtcctagttaggcaagtcccattttccaagttcycttatctgtgcctgcaggctgttctttcctttgagagaattcagccaaggacccaccctaactgcctgcctgaccactttcttcctttctcctctctcat

SEQ ID NO: 11212 - DNA, 201 bp, Homo sapiens
aagaaaatgataacttaggtcctggataaataaattttaagtagggaaaggtgggctggagttaggagcattctaaactcaatgaacaacatgcacatgcrcttggagacagtgcaggtcaatttaggagctcacaggccatttagagtgacagaagcagagtgtgcaggtcaggcagtaataagacatgaggctggagaa

SEQ ID NO: 11213 - DNA, 201 bp, Homo sapiens
tattcctgaacaaatttccattgccttctaaaagggttatttcttggtctgcagagctgctaatctgtaggttgcattcagtctaggctatcagaataggkcaccccatgggacttgatgatagtattgtcacttagatggcaaacaaggcatgaaataccttttcatagaactaaacaccctcaaatggggacatgaaac

SEQ ID NO: 11214 - DNA, 201 bp, Homo sapiens
gggaaaagatagtctagatagtcttagtcttcaatgagccaacaatccagagcgacatatagagttatgtaaatatatttaccaagtgttagaggagatcrgtgaaggtgtgaatagtttttataaggcaaaaggagtggtggtgtcataaaaatctttacctctaagggttattttgaactgtgtcttcaaggataggga

SEQ ID NO: 11215 - DNA, 201 bp, Homo sapiens
aaatacactacttggcacactctttccccagatcttcatctggctgtcccttttcatcttctagatctcgactcaacatctccttcttaggccatttctgwccactataactgatccctgtcacgttctatcataatgtccttttgccattttcttagcacttattagtgtataaaattatcttctgtatttagctgtgag

SEQ ID NO: 11216 - DNA, 201 bp, Homo sapiens
ccttcctgataccccacctctaatggaatatggggagaagaaattgacttatttacaatatttagcaagctgagagaaagtttagaaagcctgtttggctkgggaccccagaaggcaaagaggtccaggttcaattctgagatagtggatattattgttgcggacaactccttaaggttcttgggtagagctttaaggcca

SEQ ID NO: 11217 - DNA, 201 bp, Homo sapiens
ttctggaaatacttgaactgaggctcagagaggtttaggattgcataaagtcacacagcaggttggtatggcttggcatccagatgcgattttgcttaaayaactgtaagtttgggtaggggagcctggaaaagcatcacatgaaaggcttttaaagagtcagggcagtgttaggaaacacaggctagccagggagtctgc

SEQ ID NO: 11218 - DNA, 201 bp, Homo sapiens
ctgctatttgattggttaatgtgcactgggcctggaacctcaattggggtttgtttcctggctctatctgtgccccagtgaacaaaccagtctcccaggakgtttgatgagccctgaaggctgttgtgttggaagacacctgctgatgcgagcagctgccttggccttttctgaggtggaagcattccaacctgccgtgag

SEQ ID NO: 11219 - DNA, 201 bp, Homo sapiens
atacatgtgtgttatactcttggtcctcataactcatattaatgttaggaaaatacaggagaacctagcttctccgagatgtcccctaatcatttttagaytaagtgcatgcaatttcacatacatgtggctgtgcagtacttttgcatgcagactttgtcatgtttctgaggatgggactgagaagaaatgaatgggatg

SEQ ID NO: 11220 - DNA, 201 bp, Homo sapiens
cttctgggctggaccagctccacagatgaatgggaatactcactgaactaggaatcagagaatcatagctccagttttgtttctgtaggttcttgggtttstggattaatcgcttaatatgggcatctaaatttatctacctgtgaaatgaaattgctaaggtttactctatgaacctcagaaggattttaagcatcagtc

SEQ ID NO: 11221 - DNA, 201 bp, Homo sapiens
tgagtgaaaaaagccaattccccaaagggtacatattatatgatttcattctttattctttctttaaatgacaaaaatataaaagagtgaacaggttagtrgtttccactgtctaggcctggggagagggaagaatgtgtgcggctgtgaaaggacaacttgaagggttcttgtgatggaaatttcctgtatcttgatggt

SEQ ID NO: 11222 - DNA, 201 bp, Homo sapiens
ggttgcattcagctgtgaacttagctgggcctgggatgtacaggaaggctccttcacaagaccttcacaactcctctccttgctcaattgtctaacccagmttcttacatggtgactagatttcaagttctccaaagtggaagcatccctgctgctatggactgaatgtttgtgtccccttgaaattgctatgtcgaagcc

SEQ ID NO: 11223 - DNA, 201 bp, Homo sapiens
actgtcatcgcttgacctcaagaagcttaaatctaatgggaagggaagaagagtatcctcgaacacccgtactgtatgcaatgtgatgttccctaagggtrtggcaataggagtataggaatgagtgggattatttctagctgaggatcagggaaggttctgttgatgatttgacattttagctcagttttggaaaattga

SEQ ID NO: 11224 - DNA, 201 bp, Homo sapiens
ttatgttttaggagtagttgatggctagatcaagaaacaggagcatgcagtggagtggaatcatccccttaccatggttgatttctagctttctgcttccmcctgtgacatggtgagatgcttttatttttacttcctcatccagatatattcttgatctcatccttctttctcctccctattttcttcttctaaatatgt

SEQ ID NO: 11225 - DNA, 201 bp, Homo sapiens
catgccctaattggttcacagatggatacatcctgaggcaggtgggggtaatcctcaagttttcctacaccaaagcataccccagaacaaagaactactcrttctggaggtgaagataaggcctgtgatgggttgtcccatttgatcactgtggatttcctctctgtgatatcttctgctcccctggaatctagtattgag

SEQ ID NO: 11226 - DNA, 201 bp, Homo sapiens
ggggatgatggtatgctctctgaattgaaccttaccttttaacatgaaatttctaattgaaacaaagctgtgatgcctccagctttgttcttttggcttargattgacttggcgatgcaggctcttttttggttccatatgaactttaaagtagttttttccaattctgtgaagaaagtcattggtagcttgatggggatg

SEQ ID NO: 11227 - DNA, 201 bp, Homo sapiens
caaaagtcttcaaaatcttcattaggtatttgttatgccaacttctttctcagccctcccggtttgtaactttttaaatctttacccagtgttgcacgaaractgttgagatggttccctctgccttcctctctctaggattctccctgggaagtttaaaatatataatgttatgtaaagtaactcactggggccttcctc

SEQ ID NO: 11228 - DNA, 201 bp, Homo sapiens
tttaaaaattatatcattgattaaatcaattttaaaatgggaagtgactttgagaaacagacttactacaaacagacacataaagaaaaatctggtacatrttaaagagaaatattgctataaaatcagaatacattatatgaagtctacatttgaattatgccatgtgtcaagtttgttaagcatataggtaagatgtaa

SEQ ID NO: 11229 - DNA, 201 bp, Homo sapiens
ggtttcaccatgttagccaggatggtctcgatctcctgacctcgtgatccgcccaccttggcctcccaaaatgctgggattacaggcgtgagccaccaccrtacccggcccatacttgggaatttttactacagctgactgaaattttttatttgaatcctattttatatatgaggatactatttcttctttacagcatta

SEQ ID NO: 11230 - DNA, 201 bp, Homo sapiens
tgcctgccaccacacctggctaatatttgtatttttagcagagatggggtttcaccatattggccaggctggcctggaactcctgaccttgtgatctgccyacctcggcctcccaaagtgctgggattacagatcccaactggattgggatcttagcacttacttgctgtataacttctccaggttactgatcatctctaa

SEQ ID NO: 11231 - DNA, 201 bp, Homo sapiens
tggaacaaaatgctgccagtctgtttgctaaaacatagctagagtcatctttactccagttcccaaaaagttcttcattccatctgagaccatctcagccygaatttcattgtcagcattttggtgaaagccattcaacaggtctctaggaagttccaaactttcccatgtttttctgtcttttcctgagccctccaaact

SEQ ID NO: 11232 - DNA, 201 bp, Homo sapiens
agttcctttggcgacagcactgttggctaaatatgaaaggctgtgagatgaaatggcagcaagagaacagcagaggaaaatgtaaggcaaggatgggaaayacatgagaagtttatacctgaccatctcttttctatcattggcttcctatctcctattcttcttctttgtcaatctctgtagcctccacctttgctcaaa

SEQ ID NO: 11233 - DNA, 201 bp, Homo sapiens
gagcccatgcctttaaccactacattatcccgcctgcatgagaggggcactcatcctagcaccagtcttctactttggaccctagaggctaaccatcaccrtatcaagcccacacttggcagagtctgcttctcacatttggtccacctccttatattatttaggctcatgtctttcctttctactaacatataagtgcct

SEQ ID NO: 11234 - DNA, 201 bp, Homo sapiens
gttaaaaagaataattaacttgaccaaataggaagggagcatcatttcaggtgttttcacatgttttcttgtttagtccttttaatatttaatttttatarcattaatacgagataagtatcattatattcattttaatgtacaggaaatttagggcctgttaggttaagcagttttgcccacgatcatagagcttgtcag

SEQ ID NO: 11235 - DNA, 201 bp, Homo sapiens
ctgagtgtctgtacaaagggataaggatggagttttgataggggtctgggcatcagaaaggacataacaggttgcatcatgaagactgagtagtatttctrtggacagaggagaacattcctaggcgtgaagggatggaaatgaatgttgagaagtgagctatctgaaattgctggactagagtgtgggctaaaagatgta

SEQ ID NO: 11236 - DNA, 201 bp, Homo sapiens
gaattagcatgaaattgctgggtgccaactggggcatggggacaggagcagtcagaaggtgaattctatacacttcgaagacccaacctggatcaacaccyggtgtttgaagcacaagggcttgttagtgctaatcctgcatcaagtagagatggtgggaaatcgccctgaaaagctctatagtgtataaaatgtcatgat

SEQ ID NO: 11237 - DNA, 201 bp, Homo sapiens
atggccccattttacagaagatgtctaaagatagaccttcaagtgggcccgacttactaggccattccatccgggcccgacaagagggtcacagctcttasacccacccctcagcaactccctaggacaaggacacaatgaggcaaatctctgagcctttgccctaaggttacacaaagctcatttagagccttaacaagc

SEQ ID NO: 11238 - DNA, 201 bp, Homo sapiens
cccatcactacaaattcctttttttaaattagctggacatggtgacccatgcctgtagtcccagctacttgggtggctgagtcaggagggttgcttgagcrcaggggttctagactgcagtgagttatgatcaccactgcagtccaacctgggtgacagagtcagaccttgtctctaaaaaaataaatttaaaaataacat

SEQ ID NO: 11239 - DNA, 201 bp, Homo sapiens
tcctctctctaggattctccctgggaagtttaaaatatataatgttatgtaaagtaactcactggggccttcctcttgggcctcacctctatacactgaaracaatgctttctagcaaggaggacccatgcttccagagaggagggtttgcaactggagtaacttgagtatgtctttgggattcttgagctcaacccaaag

SEQ ID NO: 11240 - DNA, 201 bp, Homo sapiens
gcattagcaaattcccagttcccacctcaaacctgctgagtctgaaactctaggggaggaacccagcaatttgcgtttcaacaagccctcccagatgattmtgatgttatagcaattcttaacttgcttaagaatttggaaagtcttacaaataagggcaggactgggtggagaaaatggagaggtctgattatctttcat

SEQ ID NO: 11241 - DNA, 201 bp, Homo sapiens
accaaccaagaacccagaaacgacagtgcttactagatgctgcttgcattctaccatgtggatacaatgagtaaaacttgggtactaaagtcaaagtgccygccaccacacctggctaatatttgtatttttagcagagatggggtttcaccatattggccaggctggcctggaactcctgaccttgtgatctgcccacct

SEQ ID NO: 11242 - DNA, 201 bp, Homo sapiens
ttagtccattctcacactgctacaaataaatacctgagactgagtaatttataaagaaaggaggtttaattggctcatggtactgcaggctgtacaggaarcacagcagcatcttctctgcttctggggaggccttaagaaacttgtaatcatggcagaacgaaagggggaagcaggcacatcttacatggctggagcagg

SEQ ID NO: 11243 - DNA, 201 bp, Homo sapiens
tcaccatgttggccaggccaatctcgaactcctgacctcagatgatcaacccatctcggcctcccaaagtgctgggattacaggagtaagccaccgtgccmggcctggccagttttttgaactactgatgaatttgatcaaagcctattaaaaacttactgagtaaacaaacaattgtcccatgaaagcagtataatctaa

SEQ ID NO: 11244 - DNA, 201 bp, Homo sapiens
ggttttggtattcaggcttcattatttttggttccattctttgtaacacctggggtcctggttctctgctgatgggcctcttaattttgtttattttgtgwctgaacctcagattttagtttgtatttattttttgaaataataatctggttactgaattagacaccaagctcatggaaagcttggaccatgcctgctgca

SEQ ID NO: 11245 - DNA, 201 bp, Homo sapiens
caatgcaatggatatttgaaaactaaatccagaacctgaatttatcctcaataaatttgacttttcatattccattcagagttctggtattcctatattgktttcaatttaatgctagactttatattaattaagataattttatggtaacaataacattatgcatgcattgagtgtttgctacatatgaagcacttataa

SEQ ID NO: 11246 - DNA, 201 bp, Homo sapiens
tacctttaatttgattaacatgttaatactagcaggagagttactttgttgtattctagggattataacatggcatcatttgaaatgatatggttcccacygataaggggaggatgaatagaagcatacactgaatttctctccagggcattgagttcctttggcgacagcactgttggctaaatatgaaaggctgtgaga

SEQ ID NO: 11247 - DNA, 201 bp, Homo sapiens
gtctgaatggtattgtattgtggtattgtattgtgcatgagtattctcttaatgtatataaatagtatttcttttttagtttgagatggagccttgctctrtcgcctgggctggagtgcagcggtgcgatcttggctcactgcaaactccacctcctaggttcaagcgattcttctgcctcagcctcccaagtagctggga

SEQ ID NO: 11248 - DNA, 201 bp, Homo sapiens
gtttaacacatttccacaagcttggcagcttaaagcatcacacatttattatctcatagtttttaagagtcaggaatctgggcacagcttagctggatccwctggtttatggtttcttacaggttgcaatcaaggttttagccagggctgagttctcatctgaaagcttgactggagaagaacctgcctccaagttcacct

SEQ ID NO: 11249 - DNA, 201 bp, Homo sapiens
ctccatgttggtcaggctggtctcgaactcccgacctcaggtgatccgcccacctcggcctcccaaagtgctgggattacaggcgtgagccaccatgcccrgccaatcaattgttattgatttattactgagattgctttaaataaattcatccttatttctgttgtagtctttaccttgtctccagatctttggaagtct

SEQ ID NO: 11250 - DNA, 201 bp, Homo sapiens
tagaacagcaggctgtgttttcaagttcaagtccataagcagacaggaatagaatcccacaagagtttgttctgtctctgccatttactagttaatctctmtatgcctcaatttccccatttgtaaaatggatttaataatggctgtctaccttataaggttgctatgaggtgccagtgtgataataaacgtaaaagtact

SEQ ID NO: 11251 - DNA, 201 bp, Homo sapiens
cacattgttgttgacggtgataggttcagggcacaggtatcctgtatcctcagtctttgcatccaaaacttgacaaatccttttctcacccatatattctscctctcatgcaaaccttcttactttagacttatattttgtgtttaacagtcaaacatttcctctaggatgcctagtctatgtagccatttcaaagataat

SEQ ID NO: 11252 - DNA, 201 bp, Homo sapiens
gagggaaatgtatctaagacatccccattagatggaaaactgtgaccagcacccaggacttccaacatccagtctgggaatgattcctcctttatatggcygtttcctatctgagaattctcatgacattctcatgacacttcagtgtagcactgtagattcctcccatggagcaaactaaggtgctttccacccacccta

SEQ ID NO: 11253 - DNA, 201 bp, Homo sapiens
attcaagctggtgggaggtttcaggggaagaacaggggagaagacaaagcagaaacagccttaggcagtataaattctgaatacctttaatttgattaacwtgttaatactagcaggagagttactttgttgtattctagggattataacatggcatcatttgaaatgatatggttcccaccgataaggggaggatgaata

SEQ ID NO: 11254 - DNA, 201 bp, Homo sapiens
aaagaatttgaattttctgcagcactgctgcacgttaggtaaattcctctctttgggcctcacttgcaacaccaataaagagaggaagttatactagatgwtctataagccccttccagccctaacatgctattagcccatgattcttgtgtagggataccagaagaagatgaaagagagaacctaacttattttctgtca

SEQ ID NO: 11255 - DNA, 201 bp, Homo sapiens
aacagactcttttcccaaagaaatttgctaaaatgacaaatcagttatcactgtctattaggacatccactgcatccatctatcctaatatcttcctcacktatgcctcagcggcatgttttacttctatttactggtaccacagtcttagcaaaagtagcacattgattataggagttgtgaagccttgagccctgacaa

SEQ ID NO: 11256 - DNA, 201 bp, Homo sapiens
ttatccttgacacatatgggagcaggctttaccagaggcaagaattcaatcaaaagtcaggctttttgaatttaggtctttctcttttcttctgctataaratggtgagatcatagcccatgccctaattggttcacagatggatacatcctgaggcaggtgggggtaatcctcaagttttcctacaccaaagcatacccc

SEQ ID NO: 11257 - DNA, 201 bp, Homo sapiens
gacaactgcccagttcaattttatgatgaagcaagtttggaaagcatagagtcagggtgctgagcactttttgagcatctttgagcactttttgaccatgktattcctggctgtgaaagaattctttttgtatgaaatctcatctacccataacaagtcttggaagctgctcttgtcatcctcatcacagacctgcagaaa

SEQ ID NO: 11258 - DNA, 201 bp, Homo sapiens
gtgattcagaaatgagccatccattctcccagaattcctccattcaccccacagacacaaaaatcaaatctatgaaaatgtttttgtatatttcataggasaaacagatgtggaggcttaactcatgtatccaatgccaaaagtcttcaaaatcttcattaggtatttgttatgccaacttctttctcagccctcccggtt

SEQ ID NO: 11259 - DNA, 201 bp, Homo sapiens
ctcaaagtgtagtcccaggaccagcagcattagcaaattcccagttcccacctcaaacctgctgagtctgaaactctaggggaggaacccagcaatttgcrtttcaacaagccctcccagatgattctgatgttatagcaattcttaacttgcttaagaatttggaaagtcttacaaataagggcaggactgggtggagaa

SEQ ID NO: 11260 - DNA, 201 bp, Homo sapiens
gcctgccaccacacctggctaatatttgtatttttagcagagatggggtttcaccatattggccaggctggcctggaactcctgaccttgtgatctgcccrcctcggcctcccaaagtgctgggattacagatcccaactggattgggatcttagcacttacttgctgtataacttctccaggttactgatcatctctaag

SEQ ID NO: 11261 - DNA, 201 bp, Homo sapiens
ggccaccgctccaccttcacttttgggagtccggactcagattcccatcattcgccctgcgggaggggccctgggcattttaaccccgggagacacacgcscctggagagtggtcgcccaagccaccgccaggcagggaggagcgcgcgtgcggcaccaccgcgtgcagcagctccagcgctcgcgctgcctcaaggggtt

SEQ ID NO: 11262 - DNA, 201 bp, Homo sapiens
gcaactgaagttactaaggtaatagacataacatatgatctaaaaattgagagtacgttaatcaaggggagtgagcagaaattattctcgtcaatcatccrtgtgtccctctatatccttcacctttattgctgttagatttggaggaaattctgagcaatgttccgtgatcaggggtgaaaagtgtcatttctgggctga

SEQ ID NO: 11263 - DNA, 201 bp, Homo sapiens
acaaagatgcaatcaagcacagggttgtgatctcatctgaggcttgggatcttgttccaagctcacacggttagcaggatttaattccctgaagttgtaaractgaggccctcagcttgtagaagctgctcagttccctgacatgtggcctttccataggtgtttcataatatagcagcttcttcaaagttagtggtaaag

SEQ ID NO: 11264 - DNA, 201 bp, Homo sapiens
ccagtgggcctccagcattcactagcaatatcacatgaattgcatactctagtacttttgtttacttctttccttttactacctgccagtctggctttgtytttctagactctagaagatgtaaatggtatcacttccttgcaggtgtagccaagaagatcctggttatcattctcttcctacagtccattttccttatag

SEQ ID NO: 11265 - DNA, 201 bp, Homo sapiens
ttgctgcttagaaatttcttccaccagttaccctaaatcatctccctcaagttcaaagttcaacaaatctctagggcatggaacaaaatgctgccagtctrtttgctaaaacatagctagagtcatctttactccagttcccaaaaagttcttcattccatctgagaccatctcagcccgaatttcattgtcagcattttg

SEQ ID NO: 11266 - DNA, 201 bp, Homo sapiens
ccggcaagctagatgttctaccttcactagagtaattttaattcattctcttctgaagaaagaggtaaagatgaaggttgtctagggaggaggaatctcartatttttcttcattaggacagttataatgttgagaccaaaaagatgtaagtaaaggtaattaacaaagggcaatctacttcctttggagcttataaattc

SEQ ID NO: 11267 - DNA, 201 bp, Homo sapiens
attagcagatttaaactggacttggggctgccatgtttgtggattcagaagtagccttatcaatcaattagccttatcttcttgtaagtttgatgattcaytaatcaaacttagaagaactagataattctatttctaatgtttttatttgttgtattctgtagacaaatatttcagaataattttctccaaaagcctgag

SEQ ID NO: 11268 - DNA, 201 bp, Homo sapiens
tggcctgagagtcctgcctagattcattaagaatttctttctgtctctctctttcatacattatatatttttcaggtgaccattttagcaattgtacaagstatttttaatattaaattatgtagcctcagctgcttataaggagagtttaaggagaatattagacatatttataagtatcgtttgtcatgcaagggctaa

SEQ ID NO: 11269 - DNA, 201 bp, Homo sapiens
tgtattgtgcatgagtattctcttaatgtatataaatagtatttcttttttagtttgagatggagccttgctctgtcgcctgggctggagtgcagcggtgmgatcttggctcactgcaaactccacctcctaggttcaagcgattcttctgcctcagcctcccaagtagctgggattacaggcgtgtacaccatgcctggc

SEQ ID NO: 11270 - DNA, 201 bp, Homo sapiens
gagggcatgtttgatgtcagtactttcatatgttcattggccttcagtgaactggcactcgtcacgttttagttgtgcctaggtaaatggatttatgtgtyaggtgatctaattttcatgaaacaacatccacaaaacagacaggtgtcttatacaaactcccaaagaaactgtgggtggaggagaaaccagcactgtatg

SEQ ID NO: 11271 - DNA, 201 bp, Homo sapiens
ctgccagccaagaaatatcttctgtcttctccttacccttacgcaggtactttctttttccctcttagagaataatttggggggagagaaattgcactctratttacttgttgcctggtaagattctctggtgacatttactctctggaactgcacagttctaacaacaacagaaaagggagcttgatgggtttaccttcc

SEQ ID NO: 11272 - DNA, 201 bp, Homo sapiens
agtaggggttagcaggcaggcaggaagaagaagggcatggttggcagagattgccacatgcacagaatatagtggtgaacctacatggtgcatttggaatkgcaagtagtctggctttgctggaagtgggtttgcaagctgaggagtaacaagaaataaggccgaatagcataccaggaagtggtagatggcagagacccc

SEQ ID NO: 11273 - DNA, 201 bp, Homo sapiens
caccatttaaaaattatatcattgattaaatcaattttaaaatgggaagtgactttgagaaacagacttactacaaacagacacataaagaaaaatctggkacatgttaaagagaaatattgctataaaatcagaatacattatatgaagtctacatttgaattatgccatgtgtcaagtttgttaagcatataggtaaga

SEQ ID NO: 11274 - DNA, 201 bp, Homo sapiens
caccttggcctcccaaaatgctgggattacaggcgtgagccaccaccgtacccggcccatacttgggaatttttactacagctgactgaaattttttattygaatcctattttatatatgaggatactatttcttctttacagcattaaattttctagattaaaaaatactcatttccccccaagattttataaaataatt

SEQ ID NO: 11275 - DNA, 201 bp, Homo sapiens
actagatgctgcttgcattctaccatgtggatacaatgagtaaaacttgggtactaaagtcaaagtgcctgccaccacacctggctaatatttgtattttyagcagagatggggtttcaccatattggccaggctggcctggaactcctgaccttgtgatctgcccacctcggcctcccaaagtgctgggattacagatcc

SEQ ID NO: 11276 - DNA, 201 bp, Homo sapiens
caatgactccctctgtgatgtttcactcccacgcaacactcccttggatgaaatggcttgctctctgcctgaattgggctaagatatatgcctgctgaggrcttctgccctcccatctctcttctaccacccctgccttgtgaattatcttctttattcctagggaatctacagtaaatactttgtcatctatagtcattt

SEQ ID NO: 11277 - DNA, 201 bp, Homo sapiens
catgaattcagctcttcagaatcctctttcaatcctgaagtcccaactcattgatttggggcttggagagtgaatgcatctgtattaagtagactccttgmatatttaattggtgtttttgagcataaaatcaagagaagcagcaatcaacaaaatatccctacctctggcttccatcctgcacccaagctgtgacccttt

SEQ ID NO: 11278 - DNA, 201 bp, Homo sapiens
tgccaggacgcctgcttattatatgctatggtctgtccaaatcttctgtggctgccactacagcctgatttcccttggaaacttggcagcccgtgagttaygatggaattcccaggtgataatgtatctaatttccctcattgtacttcttttatcctgtaatgtgctgttgattcccacggctgagctgtgatggagaat

SEQ ID NO: 11279 - DNA, 201 bp, Homo sapiens
caacaatgttgagaatctatttatgaaaaggccaagatgataatgttagctaagtgctaaatataataaaaagtagtcatgaccaccattctagacaagcytcattgtcccgcacactttatctggacctgtggtttctggatggttaagcggcttgtactcacaaagacaaattgtgcattcttggaatacattcttgga

SEQ ID NO: 11280 - DNA, 201 bp, Homo sapiens
tctcacccatgttctacaaaatttcacttcatgattaaaacaaattatatctctgtctttgcctaagacgtgtattaaataacagcaatacaaataataamcatattaagtccattctgtgttctagtcacaatattaagtattttatatatattatttaatcttcacattactgctaagaagcagtgataaaaccaagat

SEQ ID NO: 11281 - DNA, 201 bp, Homo sapiens
aatagaaagttgagggaggcagtagttatatgcacatattttttgagccagagttccctgagtttgagttaaggtgtcctgagttttgagttaaagttccmtgagtttgctaccaattagctatgaaacctgggccgagttaaaagttagacctttacagtcttaagtctccctttttcatgtgtaagacaagggagaata

SEQ ID NO: 11282 - DNA, 201 bp, Homo sapiens
taaactacttaaggagctaacagaaaaggttgtatcagagaaacagtggagaaacacaggtttctaattatatctggcactggagagaatgtcaaaggtaytgggcctggggcaggttcacaagagtgaaagtaagagatttaaaataggttctcaactcctgataaaaacacgaatatttatttatttagtctagctttt

SEQ ID NO: 11283 - DNA, 201 bp, Homo sapiens
tcagagaggtttaggattgcataaagtcacacagcaggttggtatggcttggcatccagatgcgattttgcttaaataactgtaagtttgggtaggggagsctggaaaagcatcacatgaaaggcttttaaagagtcagggcagtgttaggaaacacaggctagccagggagtctgctggagggtaagggcctatgtctta

SEQ ID NO: 11284 - DNA, 201 bp, Homo sapiens
aggtttgtgatgtatattattttagttttataatcctaacccaatgccataggtagaattagcattttctgtattacatatgaggacacagaggggcagarccattagaacactagaataaagcaacacagctagccagcaagtagagatagacatctaggaccacagcctggtcggggctaccatccccctctacttctc

SEQ ID NO: 11285 - DNA, 201 bp, Homo sapiens
gaacctgaggtaaaggagagggcagccaggggtggaggattgcggagcagggctgaaggagaacacagaggctggacaggtctgctctcagggccggtgcrattacctcgtccatcttcctatctgctcatgtgctatattagtctgttctcacactgctataaagacatgtctgagaacaggtaatttataaagaaaaga

SEQ ID NO: 11286 - DNA, 201 bp, Homo sapiens
ccttgtagtcaaggctggacttgtcttattcatagctttatacccagtgctagcagcacactcagaacataataggtgctcaataaatacatttgagtggrtgagtaaatgcatgatgaaaaatttacaagttagtatatccatctccacataaaagaattcaaaacttatttttggtaatgtcactcaacaaatatttag

SEQ ID NO: 11287 - DNA, 201 bp, Homo sapiens
tggccttcagtgaactggcactcgtcacgttttagttgtgcctaggtaaatggatttatgtgtcaggtgatctaattttcatgaaacaacatccacaaaayagacaggtgtcttatacaaactcccaaagaaactgtgggtggaggagaaaccagcactgtatgagagcaacaatgaagtggccgagctgtcacttctcct

SEQ ID NO: 11288 - DNA, 201 bp, Homo sapiens
aaacctctaatcatgccttagtttttctggcccccatctaggagctatggtggagtccccagccactagtcatttcattggcatataaaagacactatggmgattccaaggattttaggagctgtatgccagaaatggcattttgggagggggtataggaaaatgttggggtggagagtgaggagttggcaaagaccaaca

SEQ ID NO: 11289 - DNA, 201 bp, Homo sapiens
ggtctgtaatttttctcagaaggctaacttatagtccaggtatgtgtgcactctgcccattcagtctttgcctttggtttttctttgatctggaggatcayaggaggcaagtgtggaaatacttcttcctggagacaatggcagaggagagtccgtgtatagaaattgatttgttaacccttgcgatggcctccctctccc

SEQ ID NO: 11290 - DNA, 201 bp, Homo sapiens
atatctagattcagtaggaaattgggggtgatgagagaattttaagaaaaacgcttgctttatcaccagctgtgtcattttgttcaaagggacaggaaacwtaatactctctctgaagcttaatagaactgcagacctattgccacagttttctcttttgcataatcttgtttagtcacttaagagctagtgagtgacaga

SEQ ID NO: 11291 - DNA, 201 bp, Homo sapiens
tgcctaggttcaagtcctgctctgccacttatcagctgtgtgcctgtgggccggttccctaactgctctctgtgtctgtttctgcatctgtaaaataaggsaatgattacaggtatctcaaatgggtgttgtctgtatctaatgggatggagaggtgttaaatccttaccatggtgcctggtggtaggtgcttaataagtg

SEQ ID NO: 11292 - DNA, 201 bp, Homo sapiens
atggccacttctatatggaaggagtgatggcccagagaaggggatccaagctttcttggattttagatttcctatttctaactttaggcatccactctagrcacttctgaagaagaatgaagaaaatgtattgggtattctctctatacaggaatggaatacttttcggattaaggagccctgccccattcaccataacaa

SEQ ID NO: 11293 - DNA, 201 bp, Homo sapiens
atccctcgtaggtttccagatcctttatttaaatgtctgacctggagatggatcctctgacctttcttttctgcaagaataaaatgaggcagttgggtttyacgctctctcaggcccttttcaactctaaaactctgattctcaaatgtcatcagcttggcaatgctttctcttatcccaaggagagagagaaaggtgaat

SEQ ID NO: 11294 - DNA, 201 bp, Homo sapiens
ctggcagatggcaagtaccaggctgatatcctgcaggttttttgtttgtttgtttgaaatggaggagtctcactctgccacctaggctggagtgcagtgaygcgatctcagttcactgcagcctccgcctcccgggttcaaggaattctcctgcctgtctcctgagtagctgggattacagcatacctggctattttttgt

SEQ ID NO: 11295 - DNA, 201 bp, Homo sapiens
gcaggttttttgtttgtttgtttgaaatggaggagtctcactctgccacctaggctggagtgcagtgacgcgatctcagttcactgcagcctccgcctccygggttcaaggaattctcctgcctgtctcctgagtagctgggattacagcatacctggctattttttgtgtttctagtagaggcggggtttcgccatgttg

SEQ ID NO: 11296 - DNA, 201 bp, Homo sapiens
acagttttgtgtgtttgccttggagaaaaagagaatttcagttgcccatgattcatacatttttatgtggcagcttccttgaaagggaacaaacgttgaarggattcatttggcaacattattcccattttatagatgtgggtttttaggcttgaggaggttgtgacttttctaaagtcatgtaattaattagtggcgaag

SEQ ID NO: 11297 - DNA, 201 bp, Homo sapiens
agaatatgatattgcattcaagcttcatcatacttttggtagcgcctttgcttgctacatgataactgtcattttagctgcaatttttcaaaaatctcctraaacactcttctcacacaatcggcctctcttaactaacttgtagacaattttgcccttctgctcaagatcttttctgcctcctttagatttcctccctat

SEQ ID NO: 11298 - DNA, 201 bp, Homo sapiens
tatgctcatttcaccttcagtgcccttgatccaaggtctcagatttatcctagtttcattttcagtgaagtattgatttgataaaagaaacgagtcctgckgctgattgcttagacacttgttagtttcacctgcatatgtaaggtggagttggctgtagttcaagcaatagaaagaagaggtactattttaacaacagtt

SEQ ID NO: 11299 - DNA, 201 bp, Homo sapiens
taatggcacagaaattctgcccagggatagatgcagagtgtcacaataagagtttccactctgcctggagtcactgactatctggaacagaagttagagawgttcatggctaagggttttcttaaacaatggagatcttgatggcaagcagcttatagggagcaggcagctctatgataccagcagcaatgagcaaactgg

SEQ ID NO: 11300 - DNA, 201 bp, Homo sapiens
ctttgggatggagaggttagggaagattctgtggaagatgtgagatctgagctgtgttctatggggtagctaggtcgaggtaaaaaatgccatagccaagmgatcagaggcataaatatgcaaggagtcttgggtggaatcacaaagtttagcagatgagtacatgaaggtagaccctttgtgccaggaagtaattttgac

SEQ ID NO: 11301 - DNA, 201 bp, Homo sapiens
aaagcgttaaggtttggcttatttgttttgggcagatcacagagatccaggactcagagctagggaatagacagctgaccccaagctggaaaaactttccyagatactccctcctgcctaggaagtggcctatgaaaaagcagtttaaataatggcagcctaaaatatagttctatatgcaacatttttttttctatgaaa

SEQ ID NO: 11302 - DNA, 201 bp, Homo sapiens
taatttggttgaaagagtcatttttattcaagataggagagtagactcattgatttctgttagtcttttctatgaatctgttatcggaaatagttgactayaattaaaataattcctggcactataacactactagacatcttcatgtcatgtagccaacatctttttttcctttgcaccatataatctgttttctctatg

SEQ ID NO: 11303 - DNA, 201 bp, Homo sapiens
cttttaagcctatgatgatattttatatcaaaactgagataaataaaaaatgttcactgacaataatgactatagataaatgctgtcagttgtaaggaagygtcaatcacagacagacgtcagtggatctgtgagggccacactgaatttttgcatgtgtaaactgtataaaataagattttaaagaatgtcataatcata

SEQ ID NO: 11304 - DNA, 201 bp, Homo sapiens
ttttcatttatttttttttgagacggagtctctctctgtcgcccagcctggatgcagtggcgagatctcagctcactgcaagctccccgtcctgggttcaygccattctcctgcctcagcctcccaagcagctgggattacaggcgcccgctaccacattttttttgtatttttagtagagatgggtttttaccattttag

SEQ ID NO: 11305 - DNA, 201 bp, Homo sapiens
ggttctgaatcaaaagatcagtgtagaggcttggagtggcatttgtgtggggtgtgccagaatatatttattttaattcaagaagatttggatttcagtcmtaagtctgtcacttgctaatggaaccatcttggctgtgtgctattaaaacttccagagcctcagtaacatttgtaagaatgtggaaaataatatcttcct

SEQ ID NO: 11306 - DNA, 201 bp, Homo sapiens
tacccactgtaggcttccctctttggaggcattgattagtagatacgaaatccttatcttctctctagagtttgaaatgtataattaacaatggagtctgycagatcaacaattctcatcacagaatgtcctgtgttttagtctttgtggaccatatggttgatctaccttatcattgttattagtgtggacccttttttg

SEQ ID NO: 11307 - DNA, 201 bp, Homo sapiens
atggctcaggaatgatactcaatttatcagttaacactgttctcttggcccaacccatcacaacgagacccaaaagtcctctcttactacaaccctataakggaggagaactaggaaagtgtggtaaacagtgccgctcattattttctttactaggaaccagactttgaaatgggtatggaagaccttgctgtgcctggc

SEQ ID NO: 11308 - DNA, 201 bp, Homo sapiens
tagcagttaagacactgagacctgcttccattgcccatatccctggcatacatttgaaaatcccagttctgtttctctcagctgcaattttctaaaatagyggatgatgcattccgtcttccccaggggcagtctggaatgaacgaagagatagccttcagtgacatctttattcctgagaattcttcttgcccctgagca

SEQ ID NO: 11309 - DNA, 201 bp, Homo sapiens
ggcatacatttgaaaatcccagttctgtttctctcagctgcaattttctaaaatagcggatgatgcattccgtcttccccaggggcagtctggaatgaacraagagatagccttcagtgacatctttattcctgagaattcttcttgcccctgagcatttctgctcctggagtctgaccctggtgtcggtagcatctctta

SEQ ID NO: 11310 - DNA, 201 bp, Homo sapiens
attttcttttgcctctgactttaatacatagcatttattctttgactgttcattagacccacagtctgattttttagtgtcaacaaagcaataaagaaaawttgttcctcctttatttcagggctcaagacaaaattcaaaaatgcctttggcattcattttgcacagacgaatgttgttaggatattcctattagcatgt

SEQ ID NO: 11311 - DNA, 201 bp, Homo sapiens
cctgcaagaaagtgctttctgccagcctggtgcaaattggcagaacctttaagccactctttctcagcttagcagcagtatatcatcattacctgtggctrgaccaagaaatcacatttgtcaatgcctgaattgctcttttactttcagtggttttagaaatccactttgttttggaaatgggcttagctgagtatgtta

SEQ ID NO: 11312 - DNA, 201 bp, Homo sapiens
tttcttagatgaggaggattcataaagttctgatctctgggagatacttcagaagtgagtggggaaaaaaaggtagggaagactggatttcatattcaccrggcctattattcacttttttatctatatgtgaaatcatacatagaacattttccaaatgataccactgttctgtcctcttttgctaaatttaataacatt

SEQ ID NO: 11313 - DNA, 201 bp, Homo sapiens
actggcagtgtcacttgtacaatatgctattagtctaaacagtcacagagctttcccagtttcagaggaggagacataaatatcacttctcaataggaggmggagtagcaataatttgcaaccaacctaagtctaccacattactaaggctaccatattataaagtagggagggtggtgtacttctagtggctatgttata

SEQ ID NO: 11314 - DNA, 201 bp, Homo sapiens
gtatagaatttagacagggaatttatctgagggattgactgaaaatgccttacttatgaaaaaagagttcttggttggtgtttattattcatgtaggtccrtttaccttgaagccataatgctaatatagcctgtcatttggaagttagataaatagtaaagcactttaaagaatcactaaaagtttcctcacaaccacag

SEQ ID NO: 11315 - DNA, 201 bp, Homo sapiens
tgtgatacttcacatgtactctttaaaaaacttactaagcctgctcagcttttacacagggtacgccggcacacaagtgtgacctggtccttactccatcmtcaaagataagttgtccccacagtctgccaaaaagatgtccctgatgcaatgagaatgagctggagtcctgactgtgctacatttttagtggtatcctaa

SEQ ID NO: 11316 - DNA, 201 bp, Homo sapiens
tgagaatgagctggagtcctgactgtgctacatttttagtggtatcctaactctctattccacagacatcagaaaatgtcacaacatactctttgtaactrgtccctttattatgtccatgaatgtaatatatacaatgattttcaaagagggtgatttttcacccctcttctctccctgccccacatacaaaggagactt

SEQ ID NO: 11317 - DNA, 201 bp, Homo sapiens
tgtttcaggtacagctccatgtatgctgcagatgatttgggttaaaaaaaaaaattggccagcctaaactttgaggcaaagaaattgcatttcccaatgtytcatttctctttccttttactttacttcatctactgtgaatgacccttatttttttgttgttgctttatggcaataaataaacgaacccccattgtgcaa

SEQ ID NO: 11318 - DNA, 201 bp, Homo sapiens
tcagtttgaacccatatactcttaaacactatttatacagtattaatgtgatttgacaaaagtggcataaagagcaatgactctttaagactcaaaagaaratgttcagatttatattttgatattaatattaatatcagcaagataagctgttaaataagcattacatgtaagaatcctgaccttggataaaattaaatc

SEQ ID NO: 11319 - DNA, 201 bp, Homo sapiens
tcttccggcaacagcagcagcaaaaactggaggtgggggtgaagggaagatggaagtgacagactccatattcataaaagctctgatgataaatttttttwaaaaaatgtgtttgttttaaataccagtcttccatgaatcctaagaattgcacagtaaaaaataaaatctgcctaccatttaacagcccgcaatacaaaa

SEQ ID NO: 11320 - DNA, 201 bp, Homo sapiens
accaacaataacttggaatgtgtctaataagtgcagcctaatcttaattttattgggagttatctcagctaaataatggaaaatttgacaaacctaattawtgaattatccactgttaaatcttctgtgccactgagtcctctttttagtaaaatgattaaaaacattaactatagtggtatataattactattaacaact

SEQ ID NO: 11321 - DNA, 201 bp, Homo sapiens
tcttactcctttactttgtggtcatttgttttgcagctatttagacagttacttcttaaagaacccctaaaactatttagacagttacttcttaaagaacycctaaaactatttagacagttacttcttaaagaactcctaaaactaccatttgttcctctagaaaggattaaagatttgctgaagcaaagttctcctgac

SEQ ID NO: 11322 - DNA, 201 bp, Homo sapiens
tgtccaagagcattcttacacaactttcttttgtaaatttttctttcatgccaaaaaacatgcgggcaatttgttgatgtaagttgactataaattaatayggtatgcttttttagtttaaattattttgcctatatggaaatgatttctttttttcccagaacagcttctatttttaatttgcttttactttttctttcc

SEQ ID NO: 11323 - DNA, 201 bp, Homo sapiens
cagtaaaatactggcaaaccgactccagcagcacatcaaaaagcttatccaccatgatcaagtgggcttcatccctgggatgcaaggctggttcaatataygcaaatcaatcaatgtaatccagcatataaacagaaccaaagacaaaaaccacatgattatctcaatagatgcagaaaaggcctttgacaaaattcaaca

SEQ ID NO: 11324 - DNA, 201 bp, Homo sapiens
tgtctttgtcacaactaagagtctgaccttggatgagtcatggtaagactctgtgtcatatataaagagtattctgagagtaaaacacgcatacaaatgamaagtatggttattatggtctcttgaatattcttagatcaatttcacccattggatggggctagtatatggttgatggatggtatttgtttcatttatctg

SEQ ID NO: 11325 - DNA, 201 bp, Homo sapiens
aaccaggtgagcttggtccccacaaagccctactggtacttaagcttcccatttcaagaggacatttgggttcactacacctctccaagccgtctgattarttgcagctgtgtgcaaattagttttcttcaggggctctctcctgctctcagattagcaacaacgtattcagatggaaagcaaataaagatagttgtaaaa

SEQ ID NO: 11326 - DNA, 201 bp, Homo sapiens
tgggtgtataaataaaccgtgttttagacctctaagcctttgcaaatactatttcacctgaaatgcccttctccttctccagcccacccgtcctcacttcyttcccctgtctcaccactgcctgtccctgagggctcatttcccacatgctctctgccttcttgctatttccttccttcacacattaatgcttcctcttgt

SEQ ID NO: 11327 - DNA, 201 bp, Homo sapiens
caatcactgtgaggggaaaaaatgtgaagatgacattgaacgcaacttgataaacattcccaacgtaactatgaatagaagagtttcctaaagcaacactrtttcctggaggagcgtggatggtggacagttaaaaataacaattcactacaagtgtttatacccttggttacagtgaatactaaattaatgtgaattaac

SEQ ID NO: 11328 - DNA, 201 bp, Homo sapiens
gatgcaacatgtttgctcttgatgggtgcattgatgtcagaacaactagggggaaataagaccaccttggtactgttatcatcgtcctgatgatggtcccktcttgcagaaaagcccaaacagaagcagggcgttgtctaatcactgatgggtttcctgatattattgagaagaccaagcaaaattaatggtgatattata

SEQ ID NO: 11329 - DNA, 201 bp, Homo sapiens
catttaacttctacaggttatttcctgattaatttacatccatttgaagctctcacttttcataaatttgggtagtttagtgtgtgctataattcaatttktattttcatatgagcatcaaattttaaatgaaataatttattttttcttcaaatcacattggatttttaaactgctggttttgagttagttataagcaat

SEQ ID NO: 11330 - DNA, 201 bp, Homo sapiens
ttaagcaacctagagtactggttcccaagctcgaatttaaaactagtaccagtctatgccaaagctttcagtgacccatagtgaaatgagaaaagcaaggwcaatatggtgagtctgcacaaagtcaaacttacagaactgccctatatttggatactgtatcatgtttttttggatggctaaaatcaatgtcttttacaa

SEQ ID NO: 11331 - DNA, 201 bp, Homo sapiens
ctatagttccagctacttgggatgctgaggtgggaggattgcttgagcctgggaggtcaagggtgcagtgagccatgatcacaccactgcactccagcctkggcaacagagcaagaccctgtctcaaaaaatgaaacagaacaacaacaaaaatcgatgcagagcatgtattacatttgtaatcagagagaagggatatct

SEQ ID NO: 11332 - DNA, 201 bp, Homo sapiens
agattatattaatgaattaaaacatttgattacctttaatccaagagaatgcagcagtctctttagtcatttagtttatcagggttttttgatggttcttyttttttccacgtgcatcttacgactatagtccacccctgaagctgtgagatctttcagcagatgttgttttccatatctttaccctttccgttgtggaag

SEQ ID NO: 11333 - DNA, 201 bp, Homo sapiens
agacacaggcaaagtaatctctccatttggtcacaatggactaaactaccttgttctattgtctaccttctctctcactgactccatcaaggcagacttgytcggtaaactattcaggtgactttgtgaacttttatttggtgcaaggctctgttaatagctgtaagtcagctgtttttggtcctccctctcattctcttc

SEQ ID NO: 11334 - DNA, 201 bp, Homo sapiens
atgttaatgcagaactaggtcagattatggcatttcacacatgcaagatgggaacacgcttcctctggttagacaaaggcttgacgattgcccatgcatcyggtcctgctttaaaggaagctcatgtaatcatgagaactcacaatgtatccatagatttcttagatatcaagtttctatgagcctaggcattgtgtatgg

SEQ ID NO: 11335 - DNA, 201 bp, Homo sapiens
attgcccatgcatccggtcctgctttaaaggaagctcatgtaatcatgagaactcacaatgtatccatagatttcttagatatcaagtttctatgagcctwggcattgtgtatggttttattgttattttgccaaacgagggttttctagcttcacttagtatgcctggagaaagctattttggttcggcccagctccatc

SEQ ID NO: 11336 - DNA, 201 bp, Homo sapiens
tgcctggagaaagctattttggttcggcccagctccatcactctaagaaatgatgaggatgagcgctctcagtttgtaccgactactcatgagagactaaraactgatcatctggctgctggcaacattccactgcaacagctaatacagtgttttggaaagatgccgacaacaaccagattgcattaagcactttaccgt

SEQ ID NO: 11337 - DNA, 201 bp, Homo sapiens
taactagagatagtaaaagaatgaattaaaattccagtgagccaaactacaacattgataatagtaatgagaattaattctgtgttgattttatggtgccyttgcctcgtaagtatatataactctggagtttatgaggcatgtttatagatcttaacttcttaattttgtaatgctgtcctcttaaaatttttgcttgag

SEQ ID NO: 11338 - DNA, 201 bp, Homo sapiens
agtaaaagaatgaattaaaattccagtgagccaaactacaacattgataatagtaatgagaattaattctgtgttgattttatggtgcccttgcctcgtargtatatataactctggagtttatgaggcatgtttatagatcttaacttcttaattttgtaatgctgtcctcttaaaatttttgcttgagacggacaaaac

SEQ ID NO: 11339 - DNA, 201 bp, Homo sapiens
gatcttaacttcttaattttgtaatgctgtcctcttaaaatttttgcttgagacggacaaaacctcctgaatttcttcaatttacatgggcatttttactrggaaagagcatgcagccttcatcagattctcaatagggtttattaacaaaaaatgttgagaaatcacccttaaaaggcaggcagctcttaaatgcttgtt

SEQ ID NO: 11340 - DNA, 201 bp, Homo sapiens
aaagttcttaattgacatactcaggttttttaaaatttaaagatccagattggtagctcagccatatagctaaattgaataattatgcaaatgctgcacartatttaattggaccttttggaatgaaaataacccaggtgtgcacaattctttgcaatctggagcaaccattctaatatatatctgcaagtgacaacatct

SEQ ID NO: 11341 - DNA, 201 bp, Homo sapiens
tagagagaagagcagaacaaatgcagttattcctctcaaagttcagctgaatgctactaatagttcaagaatgtggattgtaatggttctgtgcattgaargaacacaatggcaaatgacaaagatgacactaagtgtgagccacagctattgttttgatagcccactctgcttttctagttaactttcttagaaccgtca

SEQ ID NO: 11342 - DNA, 201 bp, Homo sapiens
gcattgaaggaacacaatggcaaatgacaaagatgacactaagtgtgagccacagctattgttttgatagcccactctgcttttctagttaactttcttasaaccgtcagttccatatttaagactagaggatcagttctgatggtgctcattcaaactcttgccaactgacatttaatgcactttaaagttgttaaaacc

SEQ ID NO: 11343 - DNA, 201 bp, Homo sapiens
gaaggaacacaatggcaaatgacaaagatgacactaagtgtgagccacagctattgttttgatagcccactctgcttttctagttaactttcttagaaccrtcagttccatatttaagactagaggatcagttctgatggtgctcattcaaactcttgccaactgacatttaatgcactttaaagttgttaaaaccaagag

SEQ ID NO: 11344 - DNA, 201 bp, Homo sapiens
gaacgccactgctttacaaagttattcttttcaccactaatagttctttgatgtcattttttgtacaagtgtcaaagtttttctctagaggcttccacacmgttaagttcttgcttttggattctttctaaaccaaataaataaatcttcgagactgcaggttaatcaaatgccttcaaacatgaaggctgtttaggagct

SEQ ID NO: 11345 - DNA, 201 bp, Homo sapiens
tttaatgtaaaacatgcaggactagatacagtcacggccattcaattttttaagttgtatatctttgggtgagttacttagcttatttcagcccagatttrctgctatgtaaggtgtaattataattattgagtaaaataaactaaagcatttaacacgatgtctggcagagactaagtttttaatactcttaaaaacatc

SEQ ID NO: 11346 - DNA, 201 bp, Homo sapiens
ataaaaatcaccatgagatatcacctcatacatggtagggtaggtattatcaaaaagacaagggacaacatgtgtcgatgagagtgtggagaaaagggaascgttgtacactgtgggtgggaatttggattggtccagccattacagaaaacagtatggaagttcctaaattaaaaatggaattgccatataacccagcaa

SEQ ID NO: 11347 - DNA, 201 bp, Homo sapiens
aacccagcaatgccttttctgagtatatacccaagggaaaggaaattaccatcttgtagaggtatctgcactccatgttcattgcagcattactgtaccgyattatgaaatgggttccttcaccccttttctgagcaccctccatgtctacagaagaagttatgaggaacaaaggtatatgcagggctcgttttgtaatgc

SEQ ID NO: 11348 - DNA, 201 bp, Homo sapiens
aatcctcacatccagacttccatgtccatgtacagggttctctactttcgttctaagtcaaactgtgattcagaaatgagccatccattctcccagaattyctccattcaccccacagacacaaaaatcaaatctatgaaaatgtttttgtatatttcataggagaaacagatgtggaggcttaactcatgtatccaatgc

SEQ ID NO: 11349 - DNA, 201 bp, Homo sapiens
cttcatcgttcaagggcttctgcatcgcctttcaagttaaaatggtcccgctggttatgatgggcaagtttacctaagggctactgggtatgtggcggaargatggaggggagtgagaggaggcaaggctggtatttattttttaatcttcgggcttaatctgcctaagtcatatggggcaaacgatatttcagacgggtg

SEQ ID NO: 11350 - DNA, 201 bp, Homo sapiens
gctgagctcggggcagggactatggatggggcccactcccagccctttcctgcaggttgttcctcaaattatactcctcagagagacctttcctgaccagytttctaaaatagtccccttacctcaacctcctggctgctttccagcccatgacactgtctttaattttaattggtgaatcattatttaatattatattat

SEQ ID NO: 11351 - DNA, 201 bp, Homo sapiens
cagaagctttacacatggtagttaactcattgccttctcatggtgatcttgtgaggtggacttcatgggttgcattttacagacagagcatggtggctgaragaggttttatggcttccctcggtatacccctttacaagtgtgatttgaacctagactgactccagagcctgtatttgtgactgtgatgaaacatgcttc

SEQ ID NO: 11352 - DNA, 201 bp, Homo sapiens
aaagtttatgccatattaccatcccacctgcagagtataagaattaacattttccagcccctttataatgtatttttgctaagcctggcctattagatagscctaaaaaagtgacatttttttttttgttttaaccttggccagttctaagaaagagcacgagcatgtatgaatgggttcttcagtggtgtgaggaaaaaa

SEQ ID NO: 11353 - DNA, 201 bp, Homo sapiens
cacttgcccatgcaagcatctttatttttctttcccaacccagagtaccactggcatggtgcaatgtgtcatgtgttgggtcttttcagattggctgagaygatgcacggcacacttggatgttgttgaagtacttacactttgcttgggtagagtttgcatgaaagagcattatttaactctttgagtagtaggattggg

SEQ ID NO: 11354 - DNA, 201 bp, Homo sapiens
atatcttcaaggcgagggaagagggaagagtcccgttttcttttaaggtaactggcatgctgctgggggcagggggtgagtggggagcctatagaggttcragaaagtgttgatagaacagggtcccagggaggtggcagggcttggagaaagagcactggggataagtcagttttaaagggaccgtttttcattgagaag

SEQ ID NO: 11355 - DNA, 201 bp, Homo sapiens
agcctatagaggttcaagaaagtgttgatagaacagggtcccagggaggtggcagggcttggagaaagagcactggggataagtcagttttaaagggaccrtttttcattgagaagggaagtagggaaggtaggtaggagagaaagtgagtagccagaggggagagaagcacaggccttcatgactaaaaacctcaatttt

SEQ ID NO: 11356 - DNA, 201 bp, Homo sapiens
aagaaaggtggatgaggtggggcacatcagacctacactttttctctttgcagagcctctcactactttttgaagttcttgatcttcactttcccactagkctctaagctccttgtagtcaaggctggacttgtcttattcatagctttatacccagtgctagcagcacactcagaacataataggtgctcaataaataca

SEQ ID NO: 11357 - DNA, 201 bp, Homo sapiens
ttgcacacccactagcctagggctctcaccagagcacctcccacctctttggttctctgcggtgacgtccttcagcataggcagttaacaccgaagcagaygaggctgaagtacatcgtggtgcttataggcttggaagttccattctacttaacttactatgttaagtgctcgtagtaaatttggagctaagacttggac

SEQ ID NO: 11358 - DNA, 201 bp, Homo sapiens
cagtcagcaagcacatgtctatgatcgactctgtgccaggcactaaacctaccatcgttctaagctctgcaggtcctaatacttgccctggcctgggaggktctgaagtgtgccctcttgctgtgtcttttctttgccactatcttccttctttatgcctcacatgtttatgtcttcctacaggacacagtgtgagggttg

SEQ ID NO: 11359 - DNA, 201 bp, Homo sapiens
gctaccttggggatggagtataggtagtaggtggaaaagagactgttgccatgagttgcttttggtatgaaccttagaagattgtcaaggcatggtaagarggcatgattatttctgtcctttgtgtagtctttgatgtgcacatcctggaaggtgtattcattgttcttcccaatttataggagaagaataaaaaattga

SEQ ID NO: 11360 - DNA, 201 bp, Homo sapiens
taccttggggatggagtataggtagtaggtggaaaagagactgttgccatgagttgcttttggtatgaaccttagaagattgtcaaggcatggtaagaggrcatgattatttctgtcctttgtgtagtctttgatgtgcacatcctggaaggtgtattcattgttcttcccaatttataggagaagaataaaaaattgaat

SEQ ID NO: 11361 - DNA, 201 bp, Homo sapiens
gccctacttgtccttcaagtttccttgcaggttcctctcctctgagaaacctctgaccgcaccagccctgagtcatcttgttcctctggattgtattgtaytccatgtatagacctacttagtactggacatagaacccctaaagatgtccagtctcttctgggtcatccccagtaacagggagcccgcttcatttggagg

SEQ ID NO: 11362 - DNA, 201 bp, Homo sapiens
atgagatatgatggttttataaagaggagttcccctgcacaaggtttctcttgcctgccccaatgtaagatgtccctttgctcttctttcatcttctgccrtgattgtgaggcttctccagccatgagtccattaaacttctttcctttataaattacccagtctcaggtatgtctctattagcagcttgagaatggacta

SEQ ID NO: 11363 - DNA, 201 bp, Homo sapiens
aatccacaggaacattcttccacttctgcttttactgttcattctatctacaagtgcttcccaaactccagctccatgacgaggccctgtggcagacaccrtgttgaagcagtcattgcctccagggagccccccatcagcaatctggttccagagcctgggctcttaattgccgtgctttactgtctctgaagtaaactt

SEQ ID NO: 11364 - DNA, 201 bp, Homo sapiens
attgcaaagaggcacagagattgactgcagtgttgttcagccaagcctccaagggagctgagagtatacagcatagcctggagaacctcccaggttcaacygtgacttcccagggagaagcagggaggcacagaggcttaggttgccctcccttgctcaccaaatctgactgtttgggattagatctaagagaggtggctc

SEQ ID NO: 11365 - DNA, 201 bp, Homo sapiens
cctactggtctcttcgtggaggtggtgtaaggtatagggcagaacagtggttctcaatttagctgcatgttaagattgtcttgggggaatttaaactccasaccacaccccaggctaattaaatcagaatctcttggcatgggatccaagcatttgtatgtttttaaagctctccacataattcctgtgcacaatcaaggt

SEQ ID NO: 11366 - DNA, 201 bp, Homo sapiens
ttatgtctataaatagaatgctttggtggtcaactagacttgttcatgttgacatttagtcttgccttttcggtggtgatttaaaaattatgtatatcttrtttggaatatagtggagctatggtgtggcattttcatctggctttttgtttagctcagcccgtcctgttatgggcagccttgaagctcagtagctaatga

SEQ ID NO: 11367 - DNA, 201 bp, Homo sapiens
agctccattttacggatgaggaaaccgaggaaccgagaaattgggaacttgaaccccccgtttggcatagtggataagagtatggctgctggagggaaaaygatccggacttaaatttgggcttgtctacttacatgttgtatggctctggagaaggtttttgaagcttcagtatcttctttagtaacaatgatagctaat

SEQ ID NO: 11368 - DNA, 201 bp, Homo sapiens
gtatggctctggagaaggtttttgaagcttcagtatcttctttagtaacaatgatagctaataatcacagagcactggctccaggctcacactgtcttagktgcttttcatgcactagctcttgaaaccctcgcaaccactcttgacatgcgattatgattctcatttttttggataaggaagctcggggcaagaggttaa

SEQ ID NO: 11369 - DNA, 201 bp, Homo sapiens
ttctaagtctccacacctaattttgtatttgcaatttctttttcttaaggactcccaaatatcataagcaacaggtcccacctctgtggatccgcctctgytaacacaacttgttgctgtccgtgacagcaatgttgctctgggtgtatgtgtgatttcatttttttcttctaaccagtgaccattcatcacagacacatt

SEQ ID NO: 11370 - DNA, 201 bp, Homo sapiens
ccacatcatggggaaagggctggacaggctgggagtttaccacacactcagtttcttccttcctcctcattctctcaggcttcttttctttccagacgggrccctgtatcttgcatggttagccttgagagttaagagaatgggaaagagtgggcttgaagggcactgagctctgacctgtggaatccttgaaagacaaat

SEQ ID NO: 11371 - DNA, 201 bp, Homo sapiens
taggaatgtagaacaggaaagccattgtgaggagcaggtttggggtgaagatgagagaggagtaaaaatagattttgatttggccgttatcctgccttccktgcagatcctataggacccttgtcgggagatgtacaggggcaggtgggggcaatggttggcattggcggggggaggatgggggctgccacaagtttcagg

SEQ ID NO: 11372 - DNA, 201 bp, Homo sapiens
ggggcaacgccttcatttttctaagcagaagagactgaggtgttaggggcccagctggtatgcgatgggaaccaagaaatggagcctatgtggacatgcaygctttacacaaattctctcgctgaaactcgggaatgttatcagaaagctatctctttccacctcatccaacaacaatgcacactatttgaggttcactgt

SEQ ID NO: 11373 - DNA, 201 bp, Homo sapiens
tagcttcaaactctttcttaacacagtattccaggttgtcaacaatcaaagaacagggaattagtatgtgctgagcatggtgtcaggcaggtcattaagcwttttatatacaattgattcttttgataagcttgacaactctggaattgatacaatgactcccaatttatagatgaagtttaagggacttatctaaggtca

SEQ ID NO: 11374 - DNA, 201 bp, Homo sapiens
gggcagatcctctgtctcaaggaaatcactggggtcaagtaatgcaataattgtgattgccagcctcaatgactacttcttttgtgccagacaccttgctragtgcttttgcgtatgttagttctttataatgcttacatcagtcctaccaggcaagtagactgtccccattttacagatggggaggttagggctcgaaga

SEQ ID NO: 11375 - DNA, 201 bp, Homo sapiens
gcaataactacatgcttttgagcccttcctgtgtgctaggaactgtgctaagtgtattccatgtgtggttacatgtgactgtcacagtgattctgaaaggmtattttgcagatgagaggcaggaaattttacaggtatttttcagatgagaggcagaaggaagtgcaaagttaacttgctcagaagtcccaccattagtga

SEQ ID NO: 11376 - DNA, 201 bp, Homo sapiens
tttcttttaaccaagtctagggccttttctcctctcttcttactatacccttcccccacaaaagacccaaaatgaattttttgaacaaaacaaatcatgaraatgacttgttttatcttgatttcattcttccgtgagtatttatcctggtcctagagcaacaaatactaaaactatctatttaaaatattatagtttaat

SEQ ID NO: 11377 - DNA, 201 bp, Homo sapiens
ttccagttagcacttactcaattattgccctctcctaattggtctttctgcctctgttctcttctagtctatccagtggttgagaattgcttaaactctgyggcccacaaatggagtgcaggattagctatctccctttcaaagccttcccttatatggtcgtgtttacctttatcttgctcctctgttaagcttaactac

SEQ ID NO: 11378 - DNA, 201 bp, Homo sapiens
ccattgttccttgttgctggtaagaattgctaaatggcaaatatgcattgaacaacacactcttctattattagtgatatctctgaacctgaacttgatamtgtgagttttgtggtccagtattttacctataatggcttgtgtgctatgaagttgatgaaaggactgtgaaactcaaatcaaatagaggctaatgcctct

SEQ ID NO: 11379 - DNA, 201 bp, Homo sapiens
gccagattgtcatcttccaaaaaaattttgagaaacgctaataatgtttttttttttaactttttctttaggtttgggatatatgtgcagatttgttatayaggtaaattgtgtgccataggggtttggtataaattattttgtcacccaggtaataagcattgtacccgataggtagtttttccatcctctttctcctcc

SEQ ID NO: 11380 - DNA, 201 bp, Homo sapiens
agaaacgctaataatgtttttttttttaactttttctttaggtttgggatatatgtgcagatttgttatacaggtaaattgtgtgccataggggtttggtrtaaattattttgtcacccaggtaataagcattgtacccgataggtagtttttccatcctctttctcctcccaccctccatcctccaccctcaagtagtcc

SEQ ID NO: 11381 - DNA, 201 bp, Homo sapiens
aacgctaataatgtttttttttttaactttttctttaggtttgggatatatgtgcagatttgttatacaggtaaattgtgtgccataggggtttggtatarattattttgtcacccaggtaataagcattgtacccgataggtagtttttccatcctctttctcctcccaccctccatcctccaccctcaagtagtccctg

SEQ ID NO: 11382 - DNA, 201 bp, Homo sapiens
gcctgtaacattgcctgccccatcatagaaacaacttagtaaatacttgttgatgagttaagtaacttcttagcagagttctgcaacagggccagccccargtcttcctgtgatcccattatgctttcaatagagagggtctttgggtacctccattgcaagagggaatcattagtctcttcctttagaacaagttcatcc

SEQ ID NO: 11383 - DNA, 201 bp, Homo sapiens
ttagaattcctttagtcgattccactgtgattttgtggatgacagaacatgctgagagggcatgagtgatgtgtttgtcactgcacagaaaatttgtagcrcaatcgggacttagaacagactttctgacttcagatgttgttttctttctcctcccaccaagttgcctctaagtcctggtcatcttcactgttgatggta

SEQ ID NO: 11384 - DNA, 201 bp, Homo sapiens
tagtgcccgtccgtgaggcagccttgggggatgttgatgggtgcaggaaatcggttcttaaattgttgcaaaattgccttccttcagactgttttgatcaygagggctctcaagtgtcaaagtcatttgtagaactagatagataaaatgcatgagcactaagctttttttccaggatagaataaataagtgtgttttcta

SEQ ID NO: 11385 - DNA, 201 bp, Homo sapiens
agcactacttctttcttagaaatggtttatcttgtctgaaataatcctccagtttccctacttttacctctgcctttctttaaataaaggttttttttttwaacaaaactttctcgtatcagtttaaatacatttctgaatgattacatggcattatccccattttcacaggcaagaaaacagaggcccaaggttacaaag

SEQ ID NO: 11386 - DNA, 201 bp, Homo sapiens
gtaacactcttccttgactgtattagtcagggttctccagggaaacaaaaccaagaggagatatatatgaacatgatgattgttatgaggaactggctcamgtgattagggaagctgagaagtcttatgatctgccgtctgcaaactggagaggaagccagtggtatagtttcagtgtgagccctaaagcctgagaaccga

SEQ ID NO: 11387 - DNA, 201 bp, Homo sapiens
cttcacaagtccaccccttttcaactcgacactcatctatatctccttaaatgatacttaatctataaataaagataaaaagatcataatttcacctaacrtgatacacctatcctgagtataattgaaaatgcactaaagagttggttttcctcctacagtatattggatttagggggaggctggatatttgactccaaa

SEQ ID NO: 11388 - DNA, 201 bp, Homo sapiens
tgaaaggggaaggccattggtatcctagcatctgtggaatcagggactcagcatcttaggatcttagttcattgacatgaaaagaggcagggaaatgtctrtgggaatggagtgaatgccaggcccaactttcttaagtggaaactgctctgatggcatcctttccttctgccttgatctcaggcctccacttaggtcacc

SEQ ID NO: 11389 - DNA, 201 bp, Homo sapiens
gttcttattacctgccttagccgtcagtataacaaggggcagccagtgtggcaggtagaacagaatgagttccctagggtgcaacaactggaaggatgtgkttatcaggttcttcaaaccaaataccatgagagcaaaggcccttcttgaaagggctgctgcctcttagcaccaaggttgcatttgaccttctcaaactgc

SEQ ID NO: 11390 - DNA, 201 bp, Homo sapiens
ttctaggccagtgtgtctcacaatctaatgtgcacccgaatcatctggacatcttgttatacgcaggttctgcgtggggagggttgaggtggagcctaagwttctgcatttttaacaaactcccaagggatgtccatgatgttgctggtatgtggaccattctttggagggacaagtctttgaggccatcactttgaatga

SEQ ID NO: 11391 - DNA, 201 bp, Homo sapiens
tgggtataatctcacttaactttactctgcaaatgcaatgttggtcttgccatccctgtgttgtgttcagtcttatttgatctcactctccctgttacccrtctgtataatcccctgggaagaatgagatctaaacaaaaacaaaggagaaaatgcttaagaaatataatctgactgtctaacaaagcagatagttaagtc

SEQ ID NO: 11392 - DNA, 201 bp, Homo sapiens
aacaaagcagatagttaagtctctggtggactcctttgttttatttggactagagggaggaagaaaaaagcttgggactgctgctggaggaacagaagtgmattaggaggctcatatttcacaactggttgccagtgtctatattggctgatggctctggtttccagctggcggtggccttggttgaaacatttacctggt

SEQ ID NO: 11393 - DNA, 201 bp, Homo sapiens
ttgcccttttaccctctcctgtcctatttctgtttttttctggattcataaatatttgtatgtgaatactcttgtatgtgtataccctctctttcctttcrtcttctctgctctttagagggcacaatgagtagttgtcattgttttttaaaggttcctgcaaggctctctgttggatttagtttattcttgctaaaacat

SEQ ID NO: 11394 - DNA, 201 bp, Homo sapiens
tagggatggagatgctacaagaggaagtgtgtaagtctctctgggcaaagaaggaaaggctttgagataatttcttacctgcatataagatgatatccccrctttcaaagaacttaaaatctagttgaggattgacatgtatacatggcaaggtactatcttacaactgcaaacctaggctgctgaggaagtgcagcaggc

SEQ ID NO: 11395 - DNA, 201 bp, Homo sapiens
agggacactgagcttacctattgtagaaaagctgcctttttaatgattctgtaaacacttattgaaacacctactagggctggacggagcagtggaaattkttgccaacattatatcctcagagcaaccccaggagtttggaccagagaatcgctctccatgaaggaaacaggaatggggaggtggattgaaggtgggtac

SEQ ID NO: 11396 - DNA, 201 bp, Homo sapiens
ccccaagttagactgaaaaagaaatgagagcagaatccaggaccacaaaaattaggctttggtacttttaggtgaaaattttggacttaacactttaacasttgaaagggcctcttcattgtggtttcattcaccttatttagaaatgaggaaatccagtttctgagaggttgtgtgacttgcccaaggtggtggaggtgg

SEQ ID NO: 11397 - DNA, 201 bp, Homo sapiens
aatctcgggccagcaccctagacctgttgaattagaaactctgggggcggaatccacctctctgtgttttcatgagctctgtgggtgactgtagcaccacractttaggggtttggaggtcagacacctgagaagtagctggtgagggtaggatatttgcaggtgctggactccagaggctgtcctttgtggcagacccca

SEQ ID NO: 11398 - DNA, 201 bp, Homo sapiens
tggtcagcacacaagtctcagggagtgacaccgaacaaggtgaggcagagaaaccaggagaccctaccttgaaccaggtaagaagaaagaggctgcagccmctacgtatgtgtgaaccctccccaccttttgaaaattatccattaagccaacattatctctttgcctggatcatgaccatagactcctaattggtttcct

SEQ ID NO: 11399 - DNA, 201 bp, Homo sapiens
tcttaaaaagacatggaggtcatggtcccttttctttttaggctttgtttccctactggtgaatttctggttgtgggactataggtttctgaagttggackttttttctaaaatcacgtctttgccctgtcccttgcccatgacagcttggaagcatgtcttctcttattttaagcatagccaatacagaaggcctcaata

SEQ ID NO: 11400 - DNA, 201 bp, Homo sapiens
atgtactaagtgtggttgtaagtaccatgtgtggattatctcatttaatcatcacagtaattccatggtactttattagctcaattttcctgataggaaastgaggcacagagtggttacacagcaacaaagttgtggaaccaggattctaacccatgagatttacctacaaagcattccatgtctctctgttgctgattg

SEQ ID NO: 11401 - DNA, 201 bp, Homo sapiens
gatattacagagagcctggtagtgttgggttaattttaacatggccaataagaaagcattcaaagctggagaatgaataactgtaactgaatcttagcccyttctgaactaaccactttaggatcactgggctgttacaaaaaataccagtagcatccaggtcccaccccagatcaatgaaataaaaatctctgggcatgg

SEQ ID NO: 11402 - DNA, 201 bp, Homo sapiens
ggaacaagccctgtatctgttgaccagtacaacttgcttagataaagtggcccaaatatattgaaagagaatagtctgcaaggggccaagagggagatgcrgatgaaatggatgatttaatgggtcatctctcctgtagttaatttctctagatctcttgtgctatattgattttgtaaatagctattgtcacatctgccc

SEQ ID NO: 11403 - DNA, 201 bp, Homo sapiens
catggtgagaaagatatatcaataattattaacttatcctatctcttttggtgctcttataaaaaattgcataaatctataagaatttggttttgttttarggatatggttcatggctatcagctagatccaagctcactgttttccctaggaacagtacacatgactttggacttggtaagcagcttttaagaccctcta

SEQ ID NO: 11404 - DNA, 201 bp, Homo sapiens
ttgagaacctcccttctcaaattcttgtgaagatttcctctatggagccctcatgtggcccactcaagccagggctctcaggagcctcttctcccacaacrctttattctttctgaaatacaaggactatgttgacttcaccaaagggatagtcaggtcgcacctggatatcataacttgtagccctggggccttgtcacc

SEQ ID NO: 11405 - DNA, 201 bp, Homo sapiens
caggtcgcacctggatatcataacttgtagccctggggccttgtcaccagtcatactgcctgccagtcaccatctttagcatgtgtatgtacttgagtggrtaagataggcttttatttcttttatgatttgcctcaggacaaatcaaagagagcttcactaataacttgtaatgttactcggaaaagagaccagggcttc

SEQ ID NO: 11406 - DNA, 201 bp, Homo sapiens
tctggccttgggataggtaaggtaggaggctacagtgggagagagtttaagcagagtgacatcagccattttactgtatgcatagctgggaggcagatcawggacttcaaacttcaagagtaatggaacttgctgtccaaagcacctgctgaacaacagtttcaaaaacaaggcgtgcctattgcagggttcctaggtgct

SEQ ID NO: 11407 - DNA, 201 bp, Homo sapiens
catcttttgaggaatgaagcagcccaatacttaacagtggtctgatagtgaccttattctcatcctccagtaatactgattatatgcttacaattcacaascaaccagcatttatttgcatgtcacctactctgctgaccctgtgtgtgaggtctttctcatgtatgtgccattatctcctaagacaaacagagaccacag

SEQ ID NO: 11408 - DNA, 201 bp, Homo sapiens
ctcatgtatgtgccattatctcctaagacaaacagagaccacaggatagaggattttgttcccttggaatcaaacctgcctttgggaaggactttttgggrgagagattttaagaaaagttttggagaaagaaagaaaagaataagctggcaactgtgccttgggagctccttggcatttttctgaatctgattctgattt

SEQ ID NO: 11409 - DNA, 201 bp, Homo sapiens
agctgtgggagaaagatgggtacttattgtaatactttaaagacaaatatttccttcatttctatcactaactaggttttcaacaaaagtctgggggatgmctttaaaaggcctggtaattgcttattgcttacaaacaattcatatgctaattgaaagctgctcctatctattcattgaagcccttacttcaaaaatttt

SEQ ID NO: 11410 - DNA, 201 bp, Homo sapiens
gcaaagatccatctcaaagaacaacaacaacaaaaactggagatgtaaaaattccatgggtgtggccacatgctatggatttagacaatattaaactgttrtgaattcttaagtctgtaagaatggatttatgaggttttaaggggtcctaagaaagacttacaatatggtcatgagaggtcacatcctgaccactagaac

SEQ ID NO: 11411 - DNA, 201 bp, Homo sapiens
atgaacttattctgtgtgttccttcagtatgtatgctcctggcctcctctttgtttttctgacacttgtttaaatggaatagtgtattaaccaccctaggygatgtgttttaacagttacttattggaaagactgctttgatccaaggtctaagacagagctgtttctgtttgggaagtcaaggttacattgagtatagtc

SEQ ID NO: 11412 - DNA, 201 bp, Homo sapiens
aaaattaagtaaaataagtatgctataaaaaataaaaggcaatgtatcataacacggtagacattagaagaagacagttgtcactagtagggcaagaaacstaggtagaataatgaagctgaggtagaataatgaagttctgggttaaagtaccaaaggctgtcaaatattcatggcatcaccatggctctgggcttactg

SEQ ID NO: 11413 - DNA, 201 bp, Homo sapiens
aagacagttgtcactagtagggcaagaaacctaggtagaataatgaagctgaggtagaataatgaagttctgggttaaagtaccaaaggctgtcaaatatycatggcatcaccatggctctgggcttactgaaaaggaagtatctaaaattggtatgcaggctcaaggctcagataaccttgtcctgttcaaacctttaac

SEQ ID NO: 11414 - DNA, 201 bp, Homo sapiens
tgaggtagaataatgaagttctgggttaaagtaccaaaggctgtcaaatattcatggcatcaccatggctctgggcttactgaaaaggaagtatctaaaaytggtatgcaggctcaaggctcagataaccttgtcctgttcaaacctttaacagttgaagtatctcaaatatattaaacattggaggtcgagaatgccaag

SEQ ID NO: 11415 - DNA, 201 bp, Homo sapiens
tttgccatattctttttaaaaaatattggtttttattttgtgctttaattcagtgttaagtgagttgttgacttttttggtttgtttaaaaaagaagttaracagttggaatcccatgtaggcataaaagtggggttctaaaaactaggtccgtcctgggtcctaacacttcccacatatagatacgtgtttagtgacagt

SEQ ID NO: 11416 - DNA, 201 bp, Homo sapiens
aagacattcaggaaagacttttacaagacagtgcatgctaagggctaggaagtttggtgagagatggctcccatggagaagtagaaattaagatgggcttygaagcatgagcagatgacaaaaaagcccaatccaaactggcttaaacagcaagggggtggttattggctcatgtgattgagaagatcaatgtgaccaagg

SEQ ID NO: 11417 - DNA, 201 bp, Homo sapiens
gagtaagggagatacatgtacagaccactgatgtggactcatcatctccataactgcccctttgcccttcctttgcattcaaaattattatctctctctcrttcaatttagctatttctatgaaggggtgaaaatccctaacctcttgatatgaatttagcattcaaaggcacctgagatgaggaaggcagaaagtgttca

SEQ ID NO: 11418 - DNA, 201 bp, Homo sapiens
ttggccaatagccaaccatttggtcaacattagtttcagttattttctccctgtctgtaaactctagagtttacaaactcaacaatttggaggtttttctycccacgcagcacatgacttcacaacactaagcatgtcgatagtgaattaacttgtcattaatgtatgggttttattattatgtttgcttttgaattagta

SEQ ID NO: 11419 - DNA, 201 bp, Homo sapiens
ctctagagtttacaaactcaacaatttggaggtttttctccccacgcagcacatgacttcacaacactaagcatgtcgatagtgaattaacttgtcattawtgtatgggttttattattatgtttgcttttgaattagtattttgagcagttgcatcaaatcacagaacagtggaggggttctgattaagctgagcctttc

SEQ ID NO: 11420 - DNA, 201 bp, Homo sapiens
gagcacttatgatgaaattaatgcttatgaaacgaggaagagatgagatctctgcatgcatgcaccaaggaaggccatgggaggacaaatccagaaacacrgctctcaccaagaacccaactatgccggcacactgatctcagacttccaacctgtagaaacatgagatataaatgttcatggtctaatctccatctgctg

SEQ ID NO: 11421 - DNA, 201 bp, Homo sapiens
ctgggttcaagcgattctcctctcttagcctcctgagtagctggaattacaggtgcatgccaccacgcccagctaatttttgtatttttagtagagacagkgttttgccacattggccaggctggtctcaaactcctgacctcagatgatccacccatctcagcctcccaaagtgctgggattacaggcatgagcccccaa

SEQ ID NO: 11422 - DNA, 201 bp, Homo sapiens
cagggggataaggcagatgaatatgtgaacaatgttttggtagattagcttggttagaggattttcaaactttttgaaattataaaacctacaaatatatrttttttaaatcacaaaacaaaaccttaatgaatcagtaaaattctcataatctttatacaggaaaggtagtagagaaaagtttatatcagtttgcaacta

SEQ ID NO: 11423 - DNA, 201 bp, Homo sapiens
ttaagtgtttcagaaatgtttctagattttagctgaggtcctgtggcatcttagagtattgtccaggaatcttggtggcagtatttcccaaattttagcaygtacaggaatgatctgtgggggaagtgtcaaatctgcatattcccaagccccacccaagtgattcagattggaccaggtggtgctacagtggatgcagcc

SEQ ID NO: 11424 - DNA, 201 bp, Homo sapiens
catccagatggcaccactgagaaagctggctcacaggccagcaggggcccctcccaccccttgactaaaccctctgcattccttcagactcttcttacccygaatggagagtgctagaaacgttcttagtagctttctaaaggctttataaggccaacgagtaataatttggtgatttcagaagcagccctcagaataata

SEQ ID NO: 11425 - DNA, 201 bp, Homo sapiens
acttgcagggacaaagccagcacctaaggttttataaatactagtccagtgctcttgttcagacaccacattccttctcatcttgtttcctcagatttatrgccaaaaacaatgggaccatcagggacccaccttaggaccctcatagcgagtggtcctccagctcagcccatgtgcatccagctgaaaggctttcatacc

SEQ ID NO: 11426 - DNA, 201 bp, Homo sapiens
cgtgcatgctctcttctatcttccactatgggatgatgcagcaagaaggccctcccaagatgtgggctccttgaccttggacttcttagcttccagaaackgtaagaaataaatctctgctctttataaattacccagtctccagtattctattatagcagtacaaaatggactaaaacagtggctcggacaacaaaattt

SEQ ID NO: 11427 - DNA, 201 bp, Homo sapiens
ttttttcttaaaactttatccctattttacaggtgtggaaaccaaggcagaatttttacaggtgtggaaaccaaggcgaaatttgctcaactcatcacgcrtcttggtagggtcagagctaggactggagctggggtctcttactttctagtcctgttctgcttcccaggaagcgaacacccacaagtagctcctgagtaa

SEQ ID NO: 11428 - DNA, 201 bp, Homo sapiens
gttgtctaggcagctgggtgaaaggccacatttgttttgcttttattgttaaacaacataaggacagggccttgtcatgtgagaacatcaatactgaatamataatatatttataataccaataagagcaattgacatttgtatagcctttacaacttacagattactctgacttacctcattgcgttttgtatttatggt

SEQ ID NO: 11429 - DNA, 201 bp, Homo sapiens
atgatgccctttttgcaaaggggaagccaagggcttgaagagaggaactgaaatattaagatttcacatcaaatcagagttagggcttaaatagaagtaarggcactcattttcccactttagtgggaagggaaataaaccaacatttattgacctcctaatataagccatgtccttccctcaaatattttattctcacaa

SEQ ID NO: 11430 - DNA, 201 bp, Homo sapiens
agatacacatgcaagatgggggcgtgcttatgaaactgtccactggacacccactatgtgcttaacattatgctctaggcttttttttttttccattatarcatcatcatttcccggatgctttcctcatggcctctctatgtaaggtatacttcatacttgctattatagttaaagttgatgacataacatttaagtgtc

SEQ ID NO: 11431 - DNA, 201 bp, Homo sapiens
gttaggaggtctagtacagtttcaatcacttgctgtgttgcctcaggcaaaccacctaacctgtctgttgcagtgttcccattggtaaaatcgagttgctrcattctgtcattcatatttcagagtgctgctgatttctgtgtgagtaaatgagataacagatgctaaagtgggatatgaatgcatagtatgattatgctg

SEQ ID NO: 11432 - DNA, 201 bp, Homo sapiens
cgcggagagagtgagcactcggtgcctttttggataaaccaggtaaagaagaaaacaaattactttttagtacactcctttattcctcattccctccgcarcctcctatgacttctgatttcttgtctgaacttcaggaacagcacctctctctgtgtcttcctcatctcactcctatatggtgtttcattctctttatgg

SEQ ID NO: 11433 - DNA, 201 bp, Homo sapiens
tctttgtatcccactaaggaatccttctccattctctaacagaccattggctatctgtctacccaactcatttcctatgtcttcaaactcttaagcacacrtcaatcagcatttgacagagggtcccaaaggtgaatgcctgaggcatatggaaagctcatcaggaattattattttaaatttaaaatggataaaacaagc

SEQ ID NO: 11434 - DNA, 201 bp, Homo sapiens
gctatctgtctacccaactcatttcctatgtcttcaaactcttaagcacacgtcaatcagcatttgacagagggtcccaaaggtgaatgcctgaggcatayggaaagctcatcaggaattattattttaaatttaaaatggataaaacaagcactggcaagaaatccatcaatctgctagcaatgactgtgcaaatgactg

SEQ ID NO: 11435 - DNA, 201 bp, Homo sapiens
acgctttacttaataacttcctccctacctggagcccggtggaatccacaaagccataagcacacaccagcctggtaggttggggcaggtgggaaggagcyctgggaggctggggcatcagaacttcaccctctctggtcagagctgtgggctcctgagcttctccctctgcctgctgtggacttatgtaacacattcaca

SEQ ID NO: 11436 - DNA, 201 bp, Homo sapiens
ttgggtctttgtagatgatcgagttaacgtgaggtcattagggtgggccctaatccaatgagtatgttctcataaaaaggggacatttggacacagaaacrgacacatatacacagggagaatgccatgtgaacatgaaggcagagatccaagtgatacatctacaagccaaagattgccagcaaatgaccagaaactaaa

SEQ ID NO: 11437 - DNA, 201 bp, Homo sapiens
gactctcccttagagtcctcggaaataaccagctctgaaaacacttgatcacagtcttttagtctccagaactgcgagacaatgaatttctgttgtttatrtcacctgctttgtcgtactttgttgccctaaaaaactaatacaccactgaaccaagataattaagagcttatgtcctctcctttccttctttcagtaaat

SEQ ID NO: 11438 - DNA, 201 bp, Homo sapiens
atcagggatacggataagtaagcaggccattactggctgtatgataggtatttcatgtcttttttcccctctagaccactagctctcaaccttcaccataytctagcttctcctgataacttaaaaaaaaaaacctatgtccaagccccattcccaggcattttgatttaggtaccctgtggtgggaacaaggctttggta

SEQ ID NO: 11439 - DNA, 201 bp, Homo sapiens
ttttttcccctctagaccactagctctcaaccttcaccatactctagcttctcctgataacttaaaaaaaaaaacctatgtccaagccccattcccaggcrttttgatttaggtaccctgtggtgggaacaaggctttggtattttatgaatcttcctaagaaatcccaaaaggctgttattgatgaaaaccactgttttc

SEQ ID NO: 11440 - DNA, 201 bp, Homo sapiens
cagagagagaagaccttaactttactctagaatatgagcaaatcttcagagaaaggagggagacctaactatcctggaatgtctctggggaaggagacagkctctatctttgttatactggtcagaaaacaaatctgccttctgacctagagagagacactctatttcatttccaagaatttttactatgcaaccaaccca

SEQ ID NO: 11441 - DNA, 201 bp, Homo sapiens
acctagagagagacactctatttcatttccaagaatttttactatgcaaccaacccagaaaaaattgtcagtagagccctttgctcagaggactcaaaccrtgcagaaatgtgagatattcacagagaattgtcttccaaaagggactcttaggtgtgaagtgaggggcttagacaacattagagacttgaaaaatgtgga

SEQ ID NO: 11442 - DNA, 201 bp, Homo sapiens
agttggggaaaaggagaacatctcttctgaggcaattttgtggtttaagattttcgtacaaagcaagttcttaatcctaccaaataacattctcaatttartctttaatccatgagaactgtagctattaacttagagaggcttcccttgcaaacagggattaatagaagaataggtgcctgttgttatatctccttctca

SEQ ID NO: 11443 - DNA, 201 bp, Homo sapiens
ggtaagaaataatacctggtgatgaaataatctgtacaacaatcccccatgacacaagtttacctgtgtaacaaacctgcacatgtacccctgcacttaaragttaaaaaaaagaaaatatttggatccacctatgacctataagctctctctttgagttgttctgcctttccagactgaagtaatgtatgtctcacatgt

SEQ ID NO: 11444 - DNA, 201 bp, Homo sapiens
accttctccacctagttacacaataaaatcgcctaaagagcttttaaaattgataattgagtctcatccaaggccaattaagcttaaatttctgggtagarggcctggtattttttttaatattcacaggaaatctaatgtatggcaaaataggaatcattatctaaatcagtgttcttcttgtgcccatacgttagaatc

SEQ ID NO: 11445 - DNA, 201 bp, Homo sapiens
tggaggcctgcttggagcctggctactgtatgaagacatattaaacgtatgtccatctgtaatattagtggtcctctgaaaaaccagcttagaggactaawtatcattcatctgataagaagagagagtaagagatagggaatggtgtaattaactttctggttatttgtagttttagaaaaaagagccaccattcttcat

SEQ ID NO: 11446 - DNA, 201 bp, Homo sapiens
aggggtacagggagactggacaggtgtgaaaaagcattttattagcattatctttgtggatattccccttcctttcagatgataagctcttagaggtaggwcctatatgctatttaattttgcaactcccgcagaggttagcatggtaagctgcttgcatcaggcttacaatagatgtgttaacacataggggcaagttca

SEQ ID NO: 11447 - DNA, 201 bp, Homo sapiens
taggataattgtaaatattttttatagcaaaccaatgtgctacaatatgtaagttagggtgtgactatccctgtgcttcataagtgagaaaattattattkctctaagtcagttttccatcttggctacacattagaatcacctggcgaactttaaaaattacgaatgcccaggaccttcccccacctgctctcccaagag

SEQ ID NO: 11448 - DNA, 201 bp, Homo sapiens
actatccctgtgcttcataagtgagaaaattattattgctctaagtcagttttccatcttggctacacattagaatcacctggcgaactttaaaaattacsaatgcccaggaccttcccccacctgctctcccaagaggcatagtgagtctgagaagtggcctgggcattggggtttctaaagctccccaggttattctaa

SEQ ID NO: 11449 - DNA, 201 bp, Homo sapiens
agagtttgttaaaccacagactgttgaattccatcggcagagtttctgattcattagatctgggatgggaaccaagaatttgtatttctaacacatccttrggtgatgctgatactgctggttctggggaccacagtttaagaaacgttgatttaaactattgaggtcaagacaattcaggttgtacaaagtcagcatttc

SEQ ID NO: 11450 - DNA, 201 bp, Homo sapiens
aatgcagctgcggaataatacactagtgccacagagtttaataatagataatgacaaataatacagttggggaattgtgtaattcaataacagagtaaatracaaggaaacacacacaccaatgaatggttctagtggggacgcttaggtgttttcaatttaacttacctctccagccctttggcctactacccttttgag

SEQ ID NO: 11451 - DNA, 201 bp, Homo sapiens
agatgggaagagactgggagttggggtttgggtttagggtcataatgggaggtaaaaggtttagccacagctatggtttagtaagcataccagtgatctgktgtgtacttccctgtcctcagctgcattagagaaaggcagccgctgatcactgttagacctgtattctttctctaagagaatgggatatttccctctcat

SEQ ID NO: 11452 - DNA, 201 bp, Homo sapiens
taaatgataaaaacaaaacacttgatccctatgatctaaagccctgctctgcaattctagagattgctttagaagtttgcatttaggtatagtcgtaacawcctagaaattaatttagaaagctgcttttacattaaaaatcaaaaaggtgagcaaaaagaatcatggctctgtaaattttcttttattttgatatttcag

SEQ ID NO: 11453 - DNA, 201 bp, Homo sapiens
acttagaaacccatatttggcgtgttttgttgcttgggtaaagggagtaagacctcatggcttgaaagaatcctaccagaggtgttttgtttttttttttrtctgatttcctttttcaaacttgataagggagtaggcaaaaaatgtctgagtcaccagaactggggtttcacaaatgaatggtctcgctgtaacctaaag

SEQ ID NO: 11454 - DNA, 201 bp, Homo sapiens
atcattactaagaattacggagtgttaggcttagaaaaggtctaggaattgactcattttcctacttccaggagatctggttctagaacccaggacttccrgctcccaggcaaattgaagcgcttcttcttccacatgggacccacttctatgagagcatcagtctgttagggttaagtccaagctctaccacttaagagc

SEQ ID NO: 11455 - DNA, 201 bp, Homo sapiens
tcagaaagtggaatgagtgtgcatctgaatggctgcccaatctataacgaatattctatctacagggcaataagcagaaaaggtgatgcagagcagccagscagatactatcatcctcatttctttaacatgtatttctagatccttttttgctcagaacattgttatggcattcctcagaacgcttttagtctctctctt

SEQ ID NO: 11456 - DNA, 201 bp, Homo sapiens
agtgtgcatctgaatggctgcccaatctataacgaatattctatctacagggcaataagcagaaaaggtgatgcagagcagccagccagatactatcatcytcatttctttaacatgtatttctagatccttttttgctcagaacattgttatggcattcctcagaacgcttttagtctctctctttctcttttatactta

SEQ ID NO: 11457 - DNA, 201 bp, Homo sapiens
ccttggtagtactgatgaactggttgttctcttgtaaattttagaaggaaggtggacagtctgggagaaccagaactgacaggagcaatagggtgcattgytaactggcaccctgtgctctgaggtcaaaaggaaacataggaaggtggtttctgagggcaagacctaggctcctctctcaattctcttttgatttcaaat

SEQ ID NO: 11458 - DNA, 201 bp, Homo sapiens
gagaaatttattaggaggatgactgaggtgagcaagctgcttacaaagagagaagggagagaatacattgaacctattcagcttggcggtcacgaccaagygaggtgccattggatatgtggttacttgtgggtgagctcaagtagaagcctcgggctgggctcctctcctggggtggaacccttctgctgggctcctttc

SEQ ID NO: 11459 - DNA, 201 bp, Homo sapiens
ttatgtgagagtagacctccctggagcttcttaaactagccaatgttaatcttggtgctgagacatattgatggtatgtcatatgtaataggttaccaaakaataatgcatatactaaaattatgctaaagatttactaaaaatttaaattaaggcagatcaggcttatggctaaaataacatcatttccatgcacctgca

SEQ ID NO: 11460 - DNA, 201 bp, Homo sapiens
aaaacgtggttaatctgaattgcagtaggtctgatggttggttggcaagttgtccttattctggtgtatgggtgaagggaataagcagtgagttagctctyacctagatccatcccctagaaagtaactgtgtccagttatcaatgggcagggcttgctgggcgttaagcacaggtaacctctagtcttttactatgtttc

SEQ ID NO: 11461 - DNA, 201 bp, Homo sapiens
tggaatcaagtccttggcctggtaatgaaggtccttcgatctggtctgcattttccagctccatctcctactaatctttatatccttatctactgtttccytaggctgttgtcttcacggccgccatggtaggttttgcctatcatcccaaaccttgtgcaggcctaccacagtacttgacatatggtgggggtctcagtc

SEQ ID NO: 11462 - DNA, 201 bp, Homo sapiens
tagaaaaattatgatgtcagccctgactaccccttctcattttaatcttgccaacgtggaggtctttggcctctaagtgcacaggaatatggtgagtgacmctgggacttataactggagaagatggcagaattcatcttcgttgcctgcagctttccaatcctgagcccttttccactttcatcgtgtttccatctccat

SEQ ID NO: 11463 - DNA, 201 bp, Homo sapiens
accactctctggagcatggattggaggatgagtgactcaaggtggggtgactagtgaggaggtgatgaaggagatgagaggaaagaggaagaaacactcayagagtaaacctggccatatctaatgactggaagcctgagtttctcttcaaactcagaagagaaaaatgaatttatggttttgggcgcagctttagttttg

SEQ ID NO: 11464 - DNA, 201 bp, Homo sapiens
ccctagcctattctcatgtcattggcagaggcacgggcaagcttattctcacacctgctttttaagtctctatttgtgtcacattcactaacatcacaaarcaaatcatgtgattaagcccagtgtcaaggggcggaacattctgtcctacccatagttggaaggtactgcagggttatgtggcaaagggaagggtgaaaa

SEQ ID NO: 11465 - DNA, 201 bp, Homo sapiens
ttcacaaacaacccttattatggctgtggaagacacaatagtatgtgtaatgtggtgtttgggctgtatttgctgcttgggaatctggtgcattctgagayggagggaatgccaagtgtttagacaacatgctgcttggcgcctgcaggttcctggaaaggactggggtctccagatctaggctgccagccaggagtctca

SEQ ID NO: 11466 - DNA, 201 bp, Homo sapiens
tccatattgcggggctgtggaccacattttgagtagcgtggtgtagtggacactggaggaagaagtgtagacctgagctctagccccagctcagccctgtrtgtggccctgggcaagtcactgacactctaagactcacaattatgtcaatcatagtgataaagggaaatgaactagaaagactctccctggttctatgat

SEQ ID NO: 11467 - DNA, 201 bp, Homo sapiens
tgtgcaacgggcccattgttctactctactttaactggttttctgatggatgtgtttatgatacctcctgctgggtattgtgcgtgacaactggggactcrataactaaacaatatctgaacgcagaatccctctgtccagggaggggctgaggaagtcacaacagttaatctgtagtaggacccatgtcctcccatctgc

SEQ ID NO: 11468 - DNA, 201 bp, Homo sapiens
cctccttctacttcctcttccaagagtttaactcatggaaaggaaatgaggggaaatagcacatttcatggcatcgaagagggcatctttgaaacctagcrgctttccacctacagacatttagaatgcaacttatgctggcaaagctattgagggtttaaatgatatgctttatagcgtgttgcatttcttcctttgaaa

SEQ ID NO: 11469 - DNA, 201 bp, Homo sapiens
ggagacatggcagcaagttggcaagctggggtcttcttattccaaattcaaccatttcttggcactttttttgtttctttttctgagaggtagtagacagyggagctaaataaaattttctcccaagaaaaaatggttagaagcagcgtgtcccctgcccaggcctgaaatctcttcattccctttccctttccccagggt

SEQ ID NO: 11470 - DNA, 201 bp, Homo sapiens
tgtctctttaggcaaacccaggctttgatccgcttccctgacacagtgatctcacctcctttggctcagtcctctccttcgtcattggcccagctatgagyctggaagtccccacagtgccttctttgggtcaatactattatcgtgcacctgctatttgcctggtgctgtgctagagactcaggatacagatgtgtagag

SEQ ID NO: 11471 - DNA, 201 bp, Homo sapiens
tgccagtttctccctcctcctggtttctctcccattcctcccttctatagcttctcttttttgtacttcctttccctcctcttttttttttttccttctckctgaatcacttatggatataccagaaagcatacatatataatgcaattatttgcatgatgacttacaagttccaaagcacattcaaatacattgcttttt

SEQ ID NO: 11472 - DNA, 201 bp, Homo sapiens
tgtgataaataaaaaatgagggaatgataggcccaagagggcacagatgggcaagggtgatgtgagataatgcactctgcttctgaaataattcctaattmcctttggttttgttcttaaaacacaactggagttcttagaagaaatatgcaatctggcatatagtaagggctcaataaatgtttgaatacatgaattaat

SEQ ID NO: 11473 - DNA, 201 bp, Homo sapiens
atcactgcagagtagctagcaaatgaatgcctttttatcagaggtacatgcccagttggtggctacgaccacatagaacagcagatatggccaaagggggwatcactgacaaaacaggcagaccctcacccagagtggatggtgtttcttggcatctgagaatcagaatatagaggaagatgaaagcactgtcgtgtttac

SEQ ID NO: 11474 - DNA, 201 bp, Homo sapiens
gggcagtagtaaagagtgagtaaaggatttggggtcagcaaaacctggttttgatcctcgatgctacctctttcaatggacaggttaccaagcctcaactsccatgtctgtagaagagactgtcacaacacttgtctctgagttgtgacggctccacacaatagtccaggcaaggaggtaagcctggtgctcagcattgac

SEQ ID NO: 11475 - DNA, 201 bp, Homo sapiens
aagaccaagtttccgggcctgtaaatcagagaatcaggttcatttaacatcctcttagatctcaacttctatcagtagcaagatacatctttgcagatacytacatggagatttcactacatctggcagggatgagccaccggtcctcattttcttaattcctggacaaggtttttgtgtattctaaccaagtattcttgc

SEQ ID NO: 11476 - DNA, 201 bp, Homo sapiens
aacatcctcttagatctcaacttctatcagtagcaagatacatctttgcagatacctacatggagatttcactacatctggcagggatgagccaccggtcytcattttcttaattcctggacaaggtttttgtgtattctaaccaagtattcttgcttttctttgttctgattcattcatctacaaagtgtggtcagaaac

SEQ ID NO: 11477 - DNA, 201 bp, Homo sapiens
acaaggtttttgtgtattctaaccaagtattcttgcttttctttgttctgattcattcatctacaaagtgtggtcagaaaccttgaccaactgctgatatrtacaaatatcacaacttctctaagtctgggatctcctaccacagttgagatatccaaatcattcacagttttgtcataactcgtggattaaaaaaatcat

SEQ ID NO: 11478 - DNA, 201 bp, Homo sapiens
gatttagtcccttctgagccttagttttatcatttgaaaaatgggctagtaaaactttatttcacagggcttttgtgagggataaataagaaatatacaargtatcctaataaaaagttctcatttcagatgaaatatgagcatgtagatatgctatctctattaataattcatttgttctgtgttgttttgaactcttgt

SEQ ID NO: 11479 - DNA, 201 bp, Homo sapiens
attatacaaaaatatacagtgttactagggacacagacctctcctctccagctctgtgtccctcctaacatttttgtccttatgaagtccacagaatgtastgtgacagcatggcatttgctattccagtataatcgccttagttattgagtacttttgatgattctttttggtcttggccaagggtgaaaggatatgtaa

SEQ ID NO: 11480 - DNA, 201 bp, Homo sapiens
ataccttctcaacaacaatgatagctaacacttctatggctgggaactgggccaagaactttattgtattcctgcctcacagcaactctatgaaatatgtrctatggttattcccattttgtagattagggaaagaagggttagagaagttaagtaataagctagagttccatagatttagataagtttcagagctggctg

SEQ ID NO: 11481 - DNA, 201 bp, Homo sapiens
tcaatgtctgacatgttttcattttcagtcctttcttgactaattctttgtctttttctgccaaattttgcctttggtctttggctttccaatgattgcayttggatcttaagtatccacactttggtttcctcctgtgttctctggcttgctgtgcctctgcctctcttaggttgttctgctaggaacttctgcttacat

SEQ ID NO: 11482 - DNA, 201 bp, Homo sapiens
tccccacacttcttagattgcatagtaataaaatataacactgagtattttaatctgctttggaatttctcagagaaatagagtgattattatataaattrtaagttgggtgtcttttagggggaaagaagtgaagaacagaattaagtaaatgcttattaatactaagtatatatcagtattgaattaatcagccatttg

SEQ ID NO: 11483 - DNA, 201 bp, Homo sapiens
ttatttatttatggtgatattctcttctctacactgatgccattttttcccctgtggcctcccacataaaagaagtgtttttgctttaaatacagatctargggctgaaagggaaacatttcttttggtgaatgagtgattcatgtaaggtgagaggaattggtttctggctcaatttattcaaagtttgggatggtttgt

SEQ ID NO: 11484 - DNA, 201 bp, Homo sapiens
cttctctacactgatgccattttttcccctgtggcctcccacataaaagaagtgtttttgctttaaatacagatctaagggctgaaagggaaacatttctkttggtgaatgagtgattcatgtaaggtgagaggaattggtttctggctcaatttattcaaagtttgggatggtttgtcagtcaatgcacagttccatgga

SEQ ID NO: 11485 - DNA, 201 bp, Homo sapiens
aagccaggtcaggaccaaggccaggtattttattgtggcttacaattaaaggaaggaatgtggactacctgtatctattgcaaactataactgggattagrgaccaaggtagtgaggaatttgtgtgtttgtatgtggtagtggggtggtaattggtccttgacattgcctgagtccaaggtcatggccataactttcatt

SEQ ID NO: 11486 - DNA, 201 bp, Homo sapiens
ctgccttaaaaaaatcttctcttgccatttgtggctttaagttgtcctaaatgaaacaaggtgattttatgtgtaattttcttcaaattagggacatggcraagggcctatgcaatttctgctccagatcatcaatatttctttgtgtgtggcacaaaataggttttgtctttgggactgtagttacttcacacctaaaag

SEQ ID NO: 11487 - DNA, 201 bp, Homo sapiens
acattattgctttgggtagcaaggtaaacatcttgctgtacatctttattccattaaggaagatgtacggaaaagcactctgtgggtttggagataagagygtcttgacagaatgggagaaccaacacaaaaggtgaccagaagaaataagagttgagcaaggtggaaagaagtgaagatgcaaatcagaggaaatggagg

SEQ ID NO: 11488 - DNA, 201 bp, Homo sapiens
actttcagtaagagctgtccaaaactgccttcaaagtaatgagttctccaacactcaaggcatccaagtagagactgggcaaccattttgctgaggttatygaggggattctggaatcatatgagtggttttgattttatagatagatctatagatagattgattttatatgatagatctatagttctacgatgaatgacc

SEQ ID NO: 11489 - DNA, 201 bp, Homo sapiens
ggagaagtgccaagcaaaggagggaaaaagccccttataaaaccatcagatcttgtgagaacttacttagtatcatgagaacagcataagggtaaccaccstcatgattcaattacctcccaccgggttcctctcatgacacgtggggattatgggaactacaattcaaggtgagacttgggtggggacacagccaaactg

SEQ ID NO: 11490 - DNA, 201 bp, Homo sapiens
gcacctgcatatcttccctgcaccaaacatctgatactttttttttttgaggaaataaaagccccaaggaaccaagtacgacactttgacagtcattgggytttttgagcctgggccttgttaaggcagctgcctgtaccgttgtggaatcacttcagctactgtctagtcctcagtgctacagcctcagggcattgattt

SEQ ID NO: 11491 - DNA, 201 bp, Homo sapiens
atagaaccagtgtcagaaggaatagggtggagaaaatgaatataaaaaagattggatatggaattaaatggacttagtaaaatattaattctgggacaatkaagagagaaggttcagatatatctacacaaatttgagcttaggtgaccattaacagaaataaggaagttgggaggaggaaccgatgagtttgcttttagg

SEQ ID NO: 11492 - DNA, 201 bp, Homo sapiens
ctttgccttcatcttataaggattcaagtgcttgcatttagggtccacctggagaatacaggatagtctcacctcaagatccctaacttaatcacatctgyaaagactcctttccaaataaaataatatttacagtttccatggattaggatatatctttggggaacattattcagcctactacagagatacctttctctt

SEQ ID NO: 11493 - DNA, 201 bp, Homo sapiens
cgtatggagaatctgaatttagtctgagcttgtggttttatatgaaaacttatttgattcctagaagtgataatgaatttgggacctctttagacatcctrtgtcccttttctccaatatttctttctacctatttctctattatttctacctcttcttttatataaatataaaagaaatttaattcatcagtttcctatt

SEQ ID NO: 11494 - DNA, 201 bp, Homo sapiens
aaaacagaaggaaatgtaggcattctctgggtaggtttgtttagtgcctaagaaaatgcaggaaatgagagtgtgtatttattgagcttctactatgtgcyacacactttgctaaatacagggaatgcattggttatcacatcagaaacacacaacccatgtgtttatgacgcttagtttagaggatcgaaacagtgccat

SEQ ID NO: 11495 - DNA, 201 bp, Homo sapiens
tctattgaaaagacaagacttgtgctgtacaaagataacaaagttgagagagttttaagtgatgagtgagtggagtggacagtttagcggagggagaaatyacagcaggcccaagtcatcagctgcctgagggagagaagggaagtggggcagagacagtgggatgtgtgattccgtggagaccccagaagcaagattctt

SEQ ID NO: 11496 - DNA, 201 bp, Homo sapiens
ccttgtcaggagaaatagtgccaagaagccatctgggcactccagggcacatgcccacatcccctcattctttctagttcccttgctggagtgcatagggrtggggcatttacaacagaacacgtggaaacacattctcagaaagttgagaacagagtggcctgggataagatggcagagggagagaagaaaatacttctc

SEQ ID NO: 11497 - DNA, 201 bp, Homo sapiens
gtggggactgtctctaattcttagtttattctcatgcacctgccttctaactcaaataccttggaagaatttgaagtaataagtgcatcatgtagggttakaatactctctctttttccaatcaagtgggttgggcaagagggcagacagcttcctcattggtaggtaataaaaggattctgatttatcagattgtgggat

SEQ ID NO: 11498 - DNA, 201 bp, Homo sapiens
gcttgtcactgtttgtgactctgcttctgtacctcccagtctgtgtgacatcttcccccatggggagccgtttctactttgtctttaattgctcctcaccraggcgacttgtcagccaaggctgctttctgtcacttgatgccacatctcttcctatttcagccagccatttggggacattcatttagttgacagtctgat

SEQ ID NO: 11499 - DNA, 201 bp, Homo sapiens
cccagtctgtgtgacatcttcccccatggggagccgtttctactttgtctttaattgctcctcaccgaggcgacttgtcagccaaggctgctttctgtcayttgatgccacatctcttcctatttcagccagccatttggggacattcatttagttgacagtctgattttacagagaacattgtaccagacaataatttgc

SEQ ID NO: 11500 - DNA, 201 bp, Homo sapiens
gtcagccaaggctgctttctgtcacttgatgccacatctcttcctatttcagccagccatttggggacattcatttagttgacagtctgattttacagagwacattgtaccagacaataatttgccttgtaagggggtccagcagggtttcctgcctccatgctgacccagggtgccagtacacttctgcgtggctgtggc

SEQ ID NO: 11501 - DNA, 201 bp, Homo sapiens
acaataatttgccttgtaagggggtccagcagggtttcctgcctccatgctgacccagggtgccagtacacttctgcgtggctgtggctgtggttctgcayagagcaggtggggaaggtgaagatattaacaatggagagtcccagttgagcatcactgggctacaagtcccttgccctcctgtccttttcctcttggtag

SEQ ID NO: 11502 - DNA, 201 bp, Homo sapiens
atacctggtttagaaagtcataacagatttttttcccataggttattggggttcaggtggtgtttggttacatgaataagttcttaagtggttatttgtgmgattttggtgcactcatcacccaagcagtatacactgcaccctatttgtagtcttttattcctcaccctcatcacacccttcccctcaagtccccaaagt

SEQ ID NO: 11503 - DNA, 201 bp, Homo sapiens
gcaagtatctttttcttataatgacttcttttcctctgggtagatacccagtagtgggattgctggatcaaatggtagttctacttttagttctttaaggratctccacactgttttccatagtggctgttagacagtcataacagatttttttaactgccatcctcacgttctccacctacctacccactctgcaggaca

SEQ ID NO: 11504 - DNA, 201 bp, Homo sapiens
aatttcttgagagctagtctcactctgccacccagcttggagtgcagtggcacgatctcagctctctgcaatccccacctcccgggtccaaggaattctcytgcctcaacctctcgagtagctgggattacaggtgcctgccaccacacctggctaatttttgtatttttagtaaagatggggtttcaccatgttggccag

SEQ ID NO: 11505 - DNA, 201 bp, Homo sapiens
ccacctcccgggtccaaggaattctcctgcctcaacctctcgagtagctgggattacaggtgcctgccaccacacctggctaatttttgtatttttagtaragatggggtttcaccatgttggccaggttggtcttgaactcctgacctcaagtgatctgcccgcctcagcctcccaaagtgctgggattacaggcgtgag

SEQ ID NO: 11506 - DNA, 201 bp, Homo sapiens
agaataataaatacctattttaaaatttctgacaggaagtttagatatcacctagtccatttccttaattttccagttcgggaaattgagccataaagtgkttcagggattggcctagggtcataaagacatttaggactagaatccctgctctcaaggtcccaggttagcttgtggggtttcatcttctacaatctcatt

SEQ ID NO: 11507 - DNA, 201 bp, Homo sapiens
tgccttctctattctagccacacatctgcctacctcagggcctttgtaggtgccatcccctctgcctggcatgctctctctcctggactttgcatggctgratccttctcaacattctggtttcagcttcacttttacctgcctagagagaccttcagtgactctacattttaaagtagaatgcatgagtaactagcacac

SEQ ID NO: 11508 - DNA, 201 bp, Homo sapiens
agcttggtctatttttttatatgccaagcacacagaatcaagctgaatatccgcaggctgtcaacttctatattcaatgaaaggataatttgcatcaggaycaagtttttgctaagggtatagctctagggctttgagaatgctgtacctgtatagttcttgccctcaagaagtttatcatttatttagctgaggagttga

SEQ ID NO: 11509 - DNA, 201 bp, Homo sapiens
tcaatgaaaggataatttgcatcaggaccaagtttttgctaagggtatagctctagggctttgagaatgctgtacctgtatagttcttgccctcaagaagwttatcatttatttagctgaggagttgagacatctatataataagctgtaataagatgatgtaagacagtagcatgttagtggacagaaaagaaggacatg

SEQ ID NO: 11510 - DNA, 201 bp, Homo sapiens
aggacaaaggaagaaaagagagctttcttggagcatatggaattaaaattaaaattcactgaattttcaagtcagcaaccaccagaacaggagctatgatraggaaatactcatctgggacaggaataggccacaaggggctggtcagtctgtcaggtgcctgggctctttccaagtatgtttgtagggtaacctaccctg

SEQ ID NO: 11511 - DNA, 201 bp, Homo sapiens
gcctccctttttaggcaacctcctatgtgatcctgggtagcagcagcagcagcagcaaaagcaaatgattctgcctggaaagggtgagataccaatcttcratgaggctggattgtgtcattgaaatgctacatatatgccacatggaaatcatgtcataagaaaatagtagggttggcagaggccaggcgtggtggctca

SEQ ID NO: 11512 - DNA, 201 bp, Homo sapiens
taccaatcttcgatgaggctggattgtgtcattgaaatgctacatatatgccacatggaaatcatgtcataagaaaatagtagggttggcagaggccaggmgtggtggctcatgcctgtaatcccagcactttgggaggctgaggtgggtgggtcacctgaggtcaggagttcaagaccagcctgtccaacatggcaaaac

SEQ ID NO: 11513 - DNA, 201 bp, Homo sapiens
gcatgtagtatatgattatgaaaaatccaaattcattttgtgtcttctttagaatattaaagttaaattattaaaatttctatattctcaacacagtctaycttaaatagctttagtttcagtggcttttggtccagaaaactgtaggaaatgaagctatgatgcttctttggaattaacttcagcattaacatagagatt

SEQ ID NO: 11514 - DNA, 201 bp, Homo sapiens
gcagtttagtggaaaagactaaatgggcatctgatgaactcaaacctggtccccaaagatgtcagctcacccgttcgaggaatgagtctcagccttggtcygtcacttccagcctaggtgggggaatgtcagctgatatgaaagctttaccctcccctcccatttacctctcagaccccaccctcaggacagtggtatctg

SEQ ID NO: 11515 - DNA, 201 bp, Homo sapiens
aagaatgtctgaaagcacaacatttttggacaggccaagatgccatgggagaaaacacacacacaagcctacgtgctttctccaaaacttggctctgaagwcagtcatatggcagtcacaccacaatccaatgaattgttttacctcaggttttggaagtttcactgctcccaatagcttgcattaagccctaaataataa

SEQ ID NO: 11516 - DNA, 201 bp, Homo sapiens
ttattccattatgtaggtaatgaaagtttgtatgtaaataaaagtttaagcttctctttataataatttatcacaggaactgcctgcaaatagattctaaygataagaatgttcttcttttagctataaatccttagttttctacttcttgcaaataaacagcttagttaaataaactcaagacaccatcattaaacaatt

SEQ ID NO: 11517 - DNA, 201 bp, Homo sapiens
atgtcagtttactaatgtagaataagaaataaaatctcagaagacctgagctctcctgtcagcatgacttgcacttgtacttttcctttttgtagagaagytaaattataatcagaaagttgttttggtgagcttggaatcagaaaataggagtttaagtcatctgttcaacatgcagctttcctcagctgtgatagcttt

SEQ ID NO: 11518 - DNA, 201 bp, Homo sapiens
gtggaggagagatagtaagagctgttaggctctctgaagcctcttagataaaagaagtccttagctttgactataataccagctatgctcaagcctttttycccccactatattctttacaatttcacagttaatctctgcattatggttctctgtagccagaagacattgcagacagggaattgagaggatgcttgagtt

SEQ ID NO: 11519 - DNA, 201 bp, Homo sapiens
gccacaggcagaattcatctcagcagaaaccgaagtcaccaatggcaagtgttcgtgtatttgtgacattccttgggaattgtgtttgtccttgcacttgygattttgccttttaaaagagcattttggggccaggcgcggtggctcatgcctgtaatcccagcactttgggaggccccgaggcaggcagatggcttgagg

SEQ ID NO: 11520 - DNA, 201 bp, Homo sapiens
tatttttgcaaatgaggacactggggcttgatgaagttaaataacttacccagatataaccattgtaagcagaggagtaaatattttgattacataaatayatcgctgagttctgtcattcagtcttttctcatgacttttcctcatttgtgtcacacatcactcatcagtcttggcatatcatttttcctctggagattc

SEQ ID NO: 11521 - DNA, 201 bp, Homo sapiens
tggattcatttactcaccttgggtcctgcagaggaaaagtgaaagcaagtgtttaaacgttgacactcagatctcttactccaaagaccattctctttatyattaaactattgattagcagtgattcacaaaggtctgttttgtctcctacaaatgtgtcattgtgtatgcatgactgaacctgtcttcttaggaaatcac

SEQ ID NO: 11522 - DNA, 201 bp, Homo sapiens
taataagcgttgtaactttctctttcattgttggaggtaacacgtatgaaaggaaagcagcaatcagaacaatgcagtttcccagagggctctttagcagmagtctcctgtggttccatgctgttgttaatgctccccttattttagtctcctggactccctaaatgctttggaccacttgagcaaggccacgttgctaat

SEQ ID NO: 11523 - DNA, 201 bp, Homo sapiens
aggcaagtgacactggtttcaatgaaaatgtatgtaaatgaaaagaagtgaagcaatttaaggaaaaagacgaaataataattcaggtagtatatagatgrggcaaaaatatgtgatattgacgcaccattgaccaaagtttgggaaaaagaggagtcatagtaaaatgttgatccttgtgttgaagtttctgatcctcct

SEQ ID NO: 11524 - DNA, 201 bp, Homo sapiens
ccacacaggttcatataatacaaaccaaaacaaaacaaccttctcacacgaagagaaaagaatactttgcaaaatggctgctgcatcttcccaaatacatmtttcacctccccaaacagattttccatccttgaccttctcgttggaaacctctccttaagcagttacacacagctctgcaaatgttagagtgacatttgg

SEQ ID NO: 11525 - DNA, 201 bp, Homo sapiens
tcatctagtgttttgcaatataattagttgttgactcaaggactgctgaacagtgtcactgagtcataaagacggctccaagaggaaaactttgggcacarattaatgctatgtaccctctactttctatcttctgctgcagcgctattcttggcccactcatttctaagttttagcaatatttctcaggctggtgtgcct

SEQ ID NO: 11526 - DNA, 201 bp, Homo sapiens
gatacattatatagcatccaacagtcattccaataacatgctaagatctgcaaaactgtaactgcatatttgaattcaaatccagggacagttttttaacstaggtaactctagattctactgtacacaaagttagagttgtgagatttctctttattaattctcttttttctcttagccacatccactaaaaaaggtact

SEQ ID NO: 11527 - DNA, 201 bp, Homo sapiens
aaggtacttttatttcatgtcctgtatgagttgtatgtaacgtctggctctgtcaccattcctttgtgttctcattccatagctaactttccttaagaagygttgtaatagcatatatttcagtgttcacaaaaaaacacaaaagcaatgttctgactaggtgactcaatagattttatgtgttttatatatacttatgta

SEQ ID NO: 11528 - DNA, 201 bp, Homo sapiens
tttaatcatctgtttcacaacattgttgattttgtttttcctgattttggaagcaggattccaaataaggacagtaaaaagcaaactttttcatatctctrtaagaagggaaatcaaggctttaaaatattacctcagtttcctcaggtatgaaataaaaggtatgaatgcaggtaaatttcaactttctttctaactcta

SEQ ID NO: 11529 - DNA, 201 bp, Homo sapiens
atagaattgaggtttgttgaactggcacattgtgaaacaactgccaggaagaaagtatattttcttctgccaccctaaaggatttatctctctgatctggyctcagataatatggaagcacccacattctagtgagtacaactgtgtgtggagcagttcagttatctagcccttcaacatagtcatttggaaatcaaaagc

SEQ ID NO: 11530 - DNA, 201 bp, Homo sapiens
actggaccatgatatcaggctcaatcactaaacatagcctgcccatgactgttatgagccattcttaccctcaaagaaatataaaagatttaactttggakttttgaatgcaatctctaccatgattgtgaaagtagatccattgtgtagggagtttgagaacagaagaaagcagaacgtcgcccttatttctctatttaa

SEQ ID NO: 11531 - DNA, 201 bp, Homo sapiens
aggaaattcaaacacatatgtacatgcatatatatacaacatgtactgagcatgggttattatcaggcatggcttggatattttcacattcatacttcagkgttttcctttgtgctggatacattttccttgcaactctggatccatttccaatctttctccacccttcttcattcagttttgcaccttggaatgtgattc

SEQ ID NO: 11532 - DNA, 201 bp, Homo sapiens
tgagtggttgggacacagggcaccaagtccctaggctgcacacagcgaggggtttgggggtgtggctcagccacaaacaaaaccattgtttcctcctagcytctggggcgcctgcagttggagaggctgccataaaggtctctgacataccctggaaatatttgcctcattgtcttggccattaacatttggccccttatt

SEQ ID NO: 11533 - DNA, 201 bp, Homo sapiens
aatagtaaatgctcaattttaggtatcattattgatcttctttagattctgcccttccaggagataaaagatttgttttgttttgcttcacatctggatcrtgtgttaaatttagattgtttccaatctaagaagagatcttcataatatgtcttattgtaacggtgtttgcaactgtcacacttttatctgtaatcgctt

SEQ ID NO: 11534 - DNA, 201 bp, Homo sapiens
tcaaacacttacaaaaccatcagatagtgtgagaactcatgagaacagcatgggggaaaccacccccatgatccaattatctcccactaggcccctccttygacacatagggattatgaaaattacaatttgagatgagatttgggtggggacacagagccaaaccacatcagatgtttctgttaaattgaatagtttgtt

SEQ ID NO: 11535 - DNA, 201 bp, Homo sapiens
cagcttccctcctctgaatgttacttgctttgtatttatttcctgtgtcatttaaccacttgtatgttccagtacagttacttgtgcattctgtgtctccytttagaacagggaccttgtctgtttcacctttgtattctccatagtgcatgtaggtagcaaatatttgacaacagccaatatttaataaagacctactca

SEQ ID NO: 11536 - DNA, 201 bp, Homo sapiens
gctctttttcttgtccaacttcatttgatttctgttgtcagtgtgtctcttggtttttcttttgtttgtgtattgtgtgtttggtcattttaggttatatktttttcttttgctggatctttttgtgtgcgtgtgttcctgagtttccaatcctccccgccatcaaccatggtaaatcaaaagatggtattcaacccttca

SEQ ID NO: 11537 - DNA, 201 bp, Homo sapiens
aatgcagctcttcatatccacgccttgtttaaaggttttccttccgttccctccccaaaatatacccctttgcaaatattttctttctctttgccgtgaayttgtgtttcatttttctcaattacagaagaaaatgtatccaagtagaatttgtcttcacatgcattccaccaaaattaatttcaaatgatcactttgctc

SEQ ID NO: 11538 - DNA, 201 bp, Homo sapiens
tgcagtcagtagctgaagccatcacctcttcctccctccctgccctccctccttccagtcctcaccaggggcatggcctcctctgtctggtaatcataccrgttgctccagggctgtttgctcccacttttctgttgcggttgacgacacatgacaaacctaaccgcacgaaaccaaacccagatttttctcaagagatgt

SEQ ID NO: 11539 - DNA, 201 bp, Homo sapiens
tgggtgtttgtgcggttagctgtttgcaagtggccattttatgacaggaaatgaccaggtggtgttaaccctttccttaccactaaggaagatggcaagtstgcctatgcaaatttctatagcatttggggcccaacctaaggagagggtggagggagtttgattttagaaaaagagaaagggttaagtacttcactgagc

SEQ ID NO: 11540 - DNA, 201 bp, Homo sapiens
agctttttactactaaaaatgtaagaagtatatacttttgttcattagttaatgcatacatgtataagaagatctattggataaattcctaaaagtagaaytgctgagtcaaaagataagtgcattataaatattgatatatattaccaaattgcactccaaagaggttttacaaagttatatttctaccagcaatatatg

SEQ ID NO: 11541 - DNA, 201 bp, Homo sapiens
tttcaaaatgttgctgtcacatatttatttcccatagatcttttcctcccatcctttaacatcttcaaatatacatagggatcattgtcattcatgacttyggtgacaacttatatcagaaatcttttaatagcaatctgctgtagcaacatttcatatgttaatcttgttttgataaacagggatattgtagaaaagtag

SEQ ID NO: 11542 - DNA, 201 bp, Homo sapiens
catttagtgcaattacaaagagcaaggaggacactggagccaaatagcctgggttcaacacttgtctatgccacaaatgagctacatgtctttgacaagtwgcttcaactcttagtttcctcaattgtaagtttcatatgaaatttagaaagaataaagggaatgggatctagcaccaaattaaaaagtaaacgtgatgtg

SEQ ID NO: 11543 - DNA, 201 bp, Homo sapiens
gcaggcagcaactgtttattgatgaggattttaccatagttttatgtgattacatgttagtttagctttcccttctaaatcaccacttagtttatagttcratattatcgatccaagtgctaccagagagcaattctattgatggcatgttacgtgtttggaaggcagtctaactttcaacccacactctcttttggagag

SEQ ID NO: 11544 - DNA, 201 bp, Homo sapiens
tttatacctgatcaggtctgccagttgcaaagctatacaatgtagtggagaactgcatacggttaattatgacaattacaatcagttctttacaatctctsctgctgttatgggatttaaataccataatgtatgtcaaaaggacaaaataatgttcctatgttttctgcttacagctgcttttatgattgggttttgctc

SEQ ID NO: 11545 - DNA, 201 bp, Homo sapiens
ggagttgctggaagtgatgaatttaccccaagccatgaaggatgggtaagattagaacagataaaggaaatgaaagtgaacgtttgaaatataggggccaygggagcaggagtgggtttgtttttgaagtcagtagcaagcaagagttgagagtcagtggtaagtaattatgcacagagaaaacttggcaaatagataaga

SEQ ID NO: 11546 - DNA, 201 bp, Homo sapiens
tttttgaagtcagtagcaagcaagagttgagagtcagtggtaagtaattatgcacagagaaaacttggcaaatagataagaaaaaatcacattaatatttraagtggtttaatatcaattgaatcacaaggacatcttaggtattcattatgaagctagagacagtatagcctctggacttaaggagtgggtctgtattca

SEQ ID NO: 11547 - DNA, 201 bp, Homo sapiens
gtattcaaatcgtagttctgacacttctgagagtcctcaggcaagttagttagcttctctttgaccatttttcccaatctgttcacttgggatgagaagakaatgtatctttagactcagatacacaaacattatctaaatccaggatgtagaagttgagtgcaaggaaagtctcagttgtccccaggctgcatatcattc

SEQ ID NO: 11548 - DNA, 201 bp, Homo sapiens
ttattactctcacttttatcctctcccctccatcagtgaagactcctacttgccatctttcctctaaagatccttagtccctgagaagcaagagctactgwagattatatcctaataagtttctaaaactcaaaagttttggtaggaaagaacatgtaggcttaattcctttctctttgacagtttggcccaattggatgc

SEQ ID NO: 11549 - DNA, 201 bp, Homo sapiens
agtccctgagaagcaagagctactgaagattatatcctaataagtttctaaaactcaaaagttttggtaggaaagaacatgtaggcttaattcctttctcwttgacagtttggcccaattggatgctcaggtgtaatatgctattattagccctgagatgaaaatttcagggccaaaattattagtaaaacacttaacatt

SEQ ID NO: 11550 - DNA, 201 bp, Homo sapiens
tgccttgactctcaattttgtttcttgaagcaatgagatcattgatttgatctctaattataaagtaattaaaaacaattttatttcagtccacaaatacrtaaatattctaaaaaggagcctttaattcatttaataatccataaaaataaactgaaaaatcaagcgtggacttctttgtcactttcctctttttcattg

SEQ ID NO: 11551 - DNA, 201 bp, Homo sapiens
agagagtttcatgttgtataaggggagtgttgatttaaaagccttagattaaaatctgcaaatgaaactaaattaaaggtgttttgaagtgattttaaccdccaaacaaattgcatttaatacataataattactttattctcccattaaaataattatttttaagtgaataacagcttctttgaccaccctacctgtagt

SEQ ID NO: 11552 - DNA, 201 bp, Homo sapiens
aacacttctgcccagaggtgatgccagtcaccttgatcgaagcaagtcaatggctacatcaaatatcaaaaaagtgggaagtgaaatcttaaaacacccckgaaaatactggaaatttttattttagttttacttgaaaaaagtataaattttgattttctgtattaaatcacttattcaaacaatgatttattcaacaga

SEQ ID NO: 11553 - DNA, 201 bp, Homo sapiens
tgaagtagttacaagaaccagagttgagattaagaaagggatacaacagctgggaaacactggtcctgttacaccattgccctcctggggagacacaaggrcaagtatatctggccatagctatcacttgccaattagcctggtgactagatatatgttttatctctatgtatcaaccagagcaaatgtggggccagaatg

SEQ ID NO: 11554 - DNA, 201 bp, Homo sapiens
atagcttctctctttccctgtgttccttaggtataatgcaaagaactcatagtagtattaaagcacttaaaacattgtattacatttttatatcactctcyactccattagactgtaagtaactttgatccagggatcaaaatatatttctccttttatctccagccactagtcaatgtccagtgtgttataaataagcag

SEQ ID NO: 11555 - DNA, 201 bp, Homo sapiens
tatcactctctactccattagactgtaagtaactttgatccagggatcaaaatatatttctccttttatctccagccactagtcaatgtccagtgtgttayaaataagcagtaaatatttgatgagttgttgagttaatgagtaataacaaataaatgttattgtacaacaagttggcagatatttgttccttgaatagaa

SEQ ID NO: 11556 - DNA, 201 bp, Homo sapiens
acagttgatgacttccagatggcctgagtgcccaccagcagggtatctagtggacacctctgtacctgttcttccacatgattggtgtttatttgttcaaytcccccagcagactctaagctcctttagaacagtgagtgtatctttttcatcttcgcaccccagaaactttcacaacacctgtctagtaggtcatcaact

SEQ ID NO: 11557 - DNA, 201 bp, Homo sapiens
gcactatttttttcattactgtaccattatcctttatgtttgaattgagacttttgcatttggggactcctacagagaatccactggatcagtaaaattcraatggactttgggtggaatataattccttgaatgctgctgggtcatgtgcaccagtgtggttttgacaaccctgatgcatgagcactactttcagaattg

SEQ ID NO: 11558 - DNA, 201 bp, Homo sapiens
gtgattatgcagtatttagcacagtgcttgccttatatggaattttcagtagtcttggttttggcttgttatctttctccccagttacttctctttccccygaagtttgaaagaagcggctgtgaggtatgaatatatttgccccttaagtagaaaggaggttcagtttgcagacagcattcagaggagatgagtgaaagg

SEQ ID NO: 11559 - DNA, 201 bp, Homo sapiens
ggacactgaggtttagagtttaatatcaccagcccaaggtcacattactagtaagtgattaaactggattttaaagcccatgacctttcgcctattatgcygtatggtgtgagtctgggtttgcttatttccaaagcagaaagagtacatagatgaccagagagtatctgagagtgtcctccatgctgactttatggtaga

SEQ ID NO: 11560 - DNA, 201 bp, Homo sapiens
tcttattcagtctttccagacacatttctgttgtcttgtcactttctgtagtatacaaagaaagtcaccatcttttctcaaagggatatgtgactattttmgtgagagttattcacatatcaagagcaaaaataacttataccattcctatacaggaacttcctaaggcctttggatgttttaagatattaataattaata

SEQ ID NO: 11561 - DNA, 201 bp, Homo sapiens
tgttttatgaaaaattatgattattaagtccccagaattgtctgtcatgcttataaacgtaacatttgatacagatttctgttcataaaattggacaaaaygagatcttcctgtttaactgaattgaaatggtatttgaaagttttccttgtaaaaaacaaaaacaaatccttacatcaagacgtcatcttttcccagttg

SEQ ID NO: 11562 - DNA, 201 bp, Homo sapiens
tggcctttgccccttaatgcaagtgaagcaaattcagtggaattgataaataacctataatccccgccctgtatttggtccctgatgaacttctgacaaayggaaaagattgcatactttgcagagtgcagacatgctcctacactcaggttttggaagcatgatatagcaaatcaagggtggttacaattcagatcaccc

SEQ ID NO: 11563 - DNA, 201 bp, Homo sapiens
tgttctacctagaaaaagcagtctcactatatcatagaccattattttctatagcagccttgacccttagagttataattggctatttcatctcacaaacwtcttcaaaatgaagttacctgcatgatattctatatgcttacctttgttgataaatttttggtggcgtagcctgtatcaggactcaagtgttaaccttca

SEQ ID NO: 11564 - DNA, 201 bp, Homo sapiens
tcgttgatgggcatgtgggttgattccctgtatttgctaatgtgaatagtgctgcaatgaacatacgcatgcatgtatctttgtaatagaatgacttataktcctttgggtatatacccagtagtgggattgctgggtcaaacggtatttctggttctagatctttgaggaattgccacaccgtcttccacaatggttaca

SEQ ID NO: 11565 - DNA, 201 bp, Homo sapiens
ttggagtttctagtctagaatacaaatggtattcccactaatacgcaggagctcttgcctcatgacttgatacactatccaaattccaaagacattccctygctcggtttcttggcccctgccttacagctagaaaaagtcatgtacttggcaattacttcctgtaaatccatatcctcttaccttagcaatgccctcagt

SEQ ID NO: 11566 - DNA, 201 bp, Homo sapiens
tcattttctacgttggtagttagtacttactcagtagaagttatctgatgagagtctttcttcatatttctttgtgtcaaaatgcatttttatgtttaaayatctcaaacctccctggcaattaagacattttgggacttttctccaaacataacattccatttaagtctgggactcactttcataaacccatgcacctgt

SEQ ID NO: 11567 - DNA, 201 bp, Homo sapiens
ctgacataagcagctttgtgcagtgggaaggaaatgtttatgttattatacacctgggacctctaagtccacaaggttcactttttattgtacacctgggmcatccttatctacacttctggctcaatttgtttttggtttggtttagaaggttttcttctccctaaaatctcccttaagtcttaggccctttttatgcag

SEQ ID NO: 11568 - DNA, 201 bp, Homo sapiens
aaaaataatgttttcttctgagaagaggaaagaggaagggagtgctctagcttcttcatccagaaacagactcttatgtaaaacccccaggagattctatragatatcagggaagattcacctaaagattaggaccctttgagcctgacaaatctcctgttgaatgccttgctttcaaccaaagctgagataaaaagtgcg

SEQ ID NO: 11569 - DNA, 201 bp, Homo sapiens
gaactcttcattcttaggagaggccccagaataatcacaaaacttggaactgtatctatggaatatagaggtttccttgtcttggagtggattcttagagyaaaacatgcctatatccttctgttcttttatcaacttcaactgactgtgaatgatgtactcactgagaaaaatccatttgctcaggtctaattttaggta

SEQ ID NO: 11570 - DNA, 201 bp, Homo sapiens
tgcctgcctgaccactttcttcctttctcctctctcataatgatgtaacagtaaaaatacctgagttcaaatcctgatttttccttttaatagctgttgaytttgggctatgtgcttaaaaaacattttttgcagagctttctcaatacttggcacattattgtcactgtttctccctggatcttagttttttgggttgct

SEQ ID NO: 11571 - DNA, 201 bp, Homo sapiens
gcagagctttctcaatacttggcacattattgtcactgtttctccctggatcttagttttttgggttgctaagtgagcataataatccatagttcagaaayttttgtgaaataatgtatgtcaaagagcatggtttttagcaggtactttcattcatagagatagtagctgagtttaggtgacccgttaaatttgggaaag

SEQ ID NO: 11572 - DNA, 201 bp, Homo sapiens
atttaaagtcaaggagcagatccattatgacaccataattagaatggataaccacatccgcagaaagtgcgctgcactatgagtaaatgtaattttgttcrtaaagtgctgggcctagggttaggggagataagttcttaatatgtcttaatatagccttgggttctgggatatgctaaaaaattattcaactcattagtg

SEQ ID NO: 11573 - DNA, 201 bp, Homo sapiens
gtaataaaatggcatttgttcagtccagttttaattgatgagatactaaacagagtcggcactaaagaaaatttccttggagaaacatttatgcttagctmtttcagagctggaaagtccctttggtttgatataaacggccttcatttttatggagctggcatcaaactgattttagaaagaactggcctttctccaagt

SEQ ID NO: 11574 - DNA, 201 bp, Homo sapiens
aacaccgcatgttctcactcataggtaggaattgaacaatgaaaacacatggacacaggaaggggaacatcacacaccggggcctgttgtggggtgggggraggggggagggatagcattaggagatatatctaatgttaaatgatgagttaatgggtgcagcacaccaacatgccacatgtatacatatgtaacaaacct

SEQ ID NO: 11575 - DNA, 201 bp, Homo sapiens
aaagaagccgaattatatgatttcttttgacttcaaaatggaaaatacatgtcgatactgggggagaaattaggaggttcttgccataatacaggtggcawatgatggtagtcttcaggtaatggcagtaggaatgcatagaagaacacagatatgaaagattcttagtctggcagacacctggaagcaagggtgcatagg

SEQ ID NO: 11576 - DNA, 201 bp, Homo sapiens
caggtagtctgaaatcttgccaggactttagtgcctcttgggatacttctgaggtagggcaaagtcccattcaatgttctgttggaggagagaatctttaktgaaatctcaagaatgaaagccaagaagccttaagataagagcgagagattcaacagcaagtactatctgtaagaactttgatttcattgcatttaagct

SEQ ID NO: 11577 - DNA, 201 bp, Homo sapiens
cagcttagcacagttcctgccctatggtacatgttccttatatgtacatggaaattagccaaatgtcaggatgccactttttcatctccatctctattccwatgatggatgactagtaaatacttctctgactatgtatgtgtagttcaaatactctagtttttttttagcataaagtgctgtgaaatcccaccatcaaaa

SEQ ID NO: 11578 - DNA, 201 bp, Homo sapiens
tcctgccctatggtacatgttccttatatgtacatggaaattagccaaatgtcaggatgccactttttcatctccatctctattccaatgatggatgactrgtaaatacttctctgactatgtatgtgtagttcaaatactctagtttttttttagcataaagtgctgtgaaatcccaccatcaaaagagccaaagtaata

SEQ ID NO: 11579 - DNA, 201 bp, Homo sapiens
ctggggagacaacagtgcataaagagatcccatctttgttcatatgaaactatattctagaggaagagacacacactaattgaatactctcacaagcaaamgtacttttgtaatggtaattcatgctacaaagctgtagaccttggtgctatctgatacagagatctgatggaatcagaaagttcaggaagagatcgtctg

SEQ ID NO: 11580 - DNA, 201 bp, Homo sapiens
atcaagaaaacattttctcaagccagactgcctgtgctcaaattgcagctctgctacttactggctgagtgaccttggacacgttatttaacctctctgtrcctagtaaccactacataggagggtattttataaggattaaatctctgtaacacacgtagaaaagtacctgccatatggtaggcacaatatacatttttg

SEQ ID NO: 11581 - DNA, 201 bp, Homo sapiens
tctgtaacacacgtagaaaagtacctgccatatggtaggcacaatatacatttttgttaaataaaatgaagcttagtagtttacctgcattgttcacattwtctaacacattaccttccacatcgtaggtacacaatgaatattattagtcatgacttatacatgactaaatgtattcttaaattggagtggtacaaaaaa

SEQ ID NO: 11582 - DNA, 201 bp, Homo sapiens
tttttatttctcaaattactaaatcagttctaggggaaatatgctagtaaaatagttaaggcttgacagatataactggtccagaggtcggtagtcatcaygagtactaagacctagatactaggggtctgtgtttgttcttgagaatacagcaaagtgtttcaaggaaggaggcttctcctttacttaccaggcctgttc

SEQ ID NO: 11583 - DNA, 201 bp, Homo sapiens
tatactagatgatctataagccccttccagccctaacatgctattagcccatgattcttgtgtagggataccagaagaagatgaaagagagaacctaactyattttctgtcaccagtccttataattcatggcattgtgtatttctccttgagtcaacattgcttcttttagtgacacaagcaagcctgctttctccagct

SEQ ID NO: 11584 - DNA, 201 bp, Homo sapiens
ttgtgaaactgcagactgattagaaaactgtcatagtaaaatactttaagcatgtccttttctcattttaaaataacaactggaaggaaaatataaatatrtcactgaaataatggtttctccatgaagaaaaagacatttagacaaaccaaaagtgtatattctatggtgtagtaaatcattaccttactatattaggtt

SEQ ID NO: 11585 - DNA, 201 bp, Homo sapiens
tattccaaaaaagaataatagattggtattaatgtttctgcctcttttactctttggaagacgtgccaataggcaggtaaagagatcaaaaagaaaaagtygggcagggtgcagtttctcacacttgtaatcccagcattttgggaggccgaggcgggtggatcacaaggtcaggagttcgagaccagtctgactaacatg

SEQ ID NO: 11586 - DNA, 201 bp, Homo sapiens
ggcccctgggttctactgaggttaagcgtctaaagtgtccttgactcactcaatttcaaagcaaattcaatttgatctcttgcctaataataaacactggkcagaagcagacatggaaggatttggaaaatggtgttaaaagatcaaagagatctaaataaactattttgtttgaactagagttaccaagtagaatagatt

SEQ ID NO: 11587 - DNA, 201 bp, Homo sapiens
caccttatcatgcacgttacatcaggcatgaatactggaaatctttctaatgtagggacatccaagcaaaacaagttgcatacatgtcataaaaaactttwaaaaattcagatttacttctggcaaattcattcaggaattcaaactcagataattaaattaatttcttaatattcaaataaagaccagatacacattggt

SEQ ID NO: 11588 - DNA, 201 bp, Homo sapiens
attttttctgcctccttcatttttaaatggatggtgacatgcttcacagcagcatctccaaacaaaagatgacaaattcccatttattttccatcagtggyactgtgtgagatgttgtactaagtctaagcttgttgttcctgaggcacagaagtctttttcctgcagcatatagcattactgtaaaaataaccattccat

SEQ ID NO: 11589 - DNA, 201 bp, Homo sapiens
agtattggcagagtgaagaagacttatttgatttcactaaagctattagtttgaaattctgatctgtaaatctggatgggaaccacacgagggaaaggatscctgccagaagcaatgggtcttgtacattctcaaaaacaaaggtcagatgaaaacactggattgaaaatagagccctagaaatgaagcaagaaggaagga

SEQ ID NO: 11590 - DNA, 201 bp, Homo sapiens
atgggtcttgtacattctcaaaaacaaaggtcagatgaaaacactggattgaaaatagagccctagaaatgaagcaagaaggaaggaaacttatattgagygtttgtaatgttccaagcattctgttaggctgtttacattatgtacttgaaaccgtcaactggattcatcttttccttcctttttccaccattgctggca

SEQ ID NO: 11591 - DNA, 201 bp, Homo sapiens
cttttccttaactttcaaggacctgtggggatagtttctactcaatgcttctttttattcgctttcctaataaaactaatatttaattataaaattaaaakgaaacaagtttggacttccgtatgaaaagtcttatacttgatctgtaactacaagatgttagatgttcttcatgcagatgacaggcaaaggttactttta

SEQ ID NO: 11592 - DNA, 201 bp, Homo sapiens
agctaaggaacccagaagtggccaacctgaagatcaattccttgtctacgaggaacatctgatcccctggcctgtcccttggaacatgggccatacaaggrgttgaggccctttgttttggattaaatgaaggtttccaagcggacgtggttaggaggagggtactaagtgaaaatgtgatgtaaactgcctgccttttgc

SEQ ID NO: 11593 - DNA, 201 bp, Homo sapiens
aaaaaatcttttatgtttgagaacttacctggaagagtcctctggagagagaataagaagatgctttcagttgcacttggagagaatgtgagaattaatcrcctgcttgtttgggaaataacaactagttgtttctggttaaagcaacaccagtatttggatgagttggagcaacgtcagaatgattggaaattgctcaaa

SEQ ID NO: 11594 - DNA, 201 bp, Homo sapiens
agcctgaagttgagaacagaagaaacaggaggagaaaaagcaccagaagcaaatttattctcatatcccagttttgagaaaagctagcctactgtaaccckaggagtttggcggctgctaatatctaaaaatgcgctggctctgtagcttggaagaaaaagaggaacagccattctctttctgctttccaagggtaagcat

SEQ ID NO: 11595 - DNA, 201 bp, Homo sapiens
agaatttctgacaatgtaagctgaattgacaagaacaaagttctgaaggaagaggccaaaccattactgaatgggtgatttgtggctgaactggatgaacmgatagcattccatggctagaatttgtgtcactggttcattctgtgtttcctcttattttccaaattgcattcaatcgatatggcagaaatgaatacccct

SEQ ID NO: 11596 - DNA, 201 bp, Homo sapiens
agctagccacgacagaaaaacgtcgggatgaggatggttcttcagtcatggtggagacatattttctgtgggtcttttggctgtagtgctttgggccatgycctgtgttgtctgtttgaagtactcccactccaggtgtgttcagtgatgtgtggtcagcaacgctccctctgaccacgagacagcttctgcaaacatctt

SEQ ID NO: 11597 - DNA, 201 bp, Homo sapiens
gtcctaatcccttgttcctgtgagtgtgaccttatttggaaggaggttctttgcagatgtgattaaaatggaagctaagatggggccattcataagatggrgagtattgtgggtcctcaatccaatatgactggtgttctcaaaagaaaagaaggtaaacacagagacaggcacagagaagagagtgccatgagaagatat

SEQ ID NO: 11598 - DNA, 201 bp, Homo sapiens
gaccgacctttctcagcctcagctctgttgacattttcaaataacaacttgctgttagggactgttctgcacattgtaggatgtttagcaccattcctatsttatgcctgctagataccagcagcactccccttccaattgtgcaaataaaaaatgtctccagacattgccaaatgtcctctggaagtcaaaaaagcattc

SEQ ID NO: 11599 - DNA, 201 bp, Homo sapiens
cttgcatacacagcatattaataaaatctcaaaaattgcttactctttacaagtaggagatattttgctttttgtgtccatactttccctttagaatgagraggattctaagtaatcttattgtatcacatttctacttcattgcattgctctctaggggggaaattaacagcagaagacttgtcacttgagttctattca

SEQ ID NO: 11600 - DNA, 201 bp, Homo sapiens
tatgttgccctgctaagagcaggtcatggtccttaatgtaagccatgtcatttgcttacagtctttattatttaatctctgacagatggaaattggttgasaacaggtaatggtacagagtcttctgtgtgtgcttgcatgccagtgagatctactgggagaattaacttctactctcccagcacaatcggtggtcatttt

SEQ ID NO: 11601 - DNA, 201 bp, Homo sapiens
gctttttagagtttccagtttttctgctctgttttttccccatctttgtggttttatctacttttggtctttgatgatggtgatgtacagatgggtttttsgtgtggatgtcctttctgtttgttagttttccttctaacagacaggaccctcagctgcaggtctgttggagtacccagccgtgtgaggtgtcagtctgcc

SEQ ID NO: 11602 - DNA, 201 bp, Homo sapiens
ctgcgatgcaggcccaacaatgggctcagctaaccccacgaggagctctgacactaacatgacctttcagtttgtcctgagttgggccaagatggcaaagyctttctaccccatcatcaacaggtcattgaatgcgggtcactctgggaagagcatgatcttaggcaagatggtgctctgtgtctgaggccaaccctgaag

SEQ ID NO: 11603 - DNA, 201 bp, Homo sapiens
cttgcctgaaacatcaggctaaaaatagttcttgatatatgaagatgatctgaaaaatgagccaaaatttgtgttgcaaaacagcaattcaagaattcaakcttaaaacattgcctatttttttcttcagaaaacaggatacaaaagtcagtgtgaatgagcaaagccattgagttgctcccaaagcagaagaaattagac

SEQ ID NO: 11604 - DNA, 201 bp, Homo sapiens
aattgtgcctttgaatgagtaatgacagatttgaaataagaacattggagcattttaagtgtccagtaatatttgctcctggatctactttgaatggtggrtgtgtgatgactggtctccatgaatgggatcatctaatgccttttaaaaattaaagacatagtgtcatttggactttttatgatgcagtactatcttgtc

SEQ ID NO: 11605 - DNA, 201 bp, Homo sapiens
ttatgatgcagtactatcttgtcacagaagacttcaggatttctcttggttagcaagtcaacagagacctgtgcatctaggcctgcatatatgcatgcatrttgttacttgatgtattcggttataagaaaaggaagtcagtcctagttaataacaccatccatatgagatttatgggtttcacttataaatattaaatta

SEQ ID NO: 11606 - DNA, 201 bp, Homo sapiens
ctatcttgtcacagaagacttcaggatttctcttggttagcaagtcaacagagacctgtgcatctaggcctgcatatatgcatgcatattgttacttgatrtattcggttataagaaaaggaagtcagtcctagttaataacaccatccatatgagatttatgggtttcacttataaatattaaattaataaataaaatat

SEQ ID NO: 11607 - DNA, 201 bp, Homo sapiens
gttagcaagtcaacagagacctgtgcatctaggcctgcatatatgcatgcatattgttacttgatgtattcggttataagaaaaggaagtcagtcctagtwaataacaccatccatatgagatttatgggtttcacttataaatattaaattaataaataaaatattatcctatcatacttagtaacaaaggtataaggct

SEQ ID NO: 11608 - DNA, 201 bp, Homo sapiens
ataaaatgatgaatagagatttgtccattgaaaagggcagacaggccaggcacggtggctcacgcttgtaattccaacactttaggaagccgaggtggacrggtcacaaagtcgggatacaagaccagcctggccaacatggtgaaacctcatctctactaaaaatacaaaaagtagccaggtgtggtggcgggcacctgt

SEQ ID NO: 11609 - DNA, 201 bp, Homo sapiens
ttcctgagtattatgtgcacgcttagtacagtcattgagatacataaggcaaccatgtgccttaatctgtatgaagtctcagttcatatgtgattatttargtaaagtatataactgaaattttacatcttttgatctctttgcaaaatttccctgagccacttaaaaataacctttctttactcctttttgtcttgaaac

SEQ ID NO: 11610 - DNA, 201 bp, Homo sapiens
aaatttccctgagccacttaaaaataacctttctttactcctttttgtcttgaaacatttttattggaagacttcagacctaactttagtaccagagaccraaagtcatatctcacttagttctacaatctctagtccacttttgatactcagaatagatagtaaaggtgctatttttttaccccagagtgacagactgtt

SEQ ID NO: 11611 - DNA, 201 bp, Homo sapiens
gagttgtcaggagtggacttgaaaaaaagagtgacaaccatgaggtctgataggctttagaacgcaggtcttaaagagcctggagaaaagagcgtgcatcwcaaatcctacatagacagcaaaaccactgcccaggtaaaccaaggccgcagtctaatcttggaaggagagagtaatttaggacagcaaagcagaatccat

SEQ ID NO: 11612 - DNA, 201 bp, Homo sapiens
tctccagcagtgaccttctcctcatttattcatgacagaatcatacgtataaaaattcatgtattctggtcaccgttctaaattctggatggtgaaaaaaratatgcagggcccctccttttatggaactttcattttaggaaggaggaaacagtaagcaagtgaacagataagttagtggtataaaattgtttaagagtg

SEQ ID NO: 11613 - DNA, 201 bp, Homo sapiens
tataaaattgtttaagagtgactggatgggaggagggtttactggaagctcagagggttcatggtagcccactctgcagagatgagagttaaacagtgttstgaatgattgaaaagagccaaccattcacagatctagggaggcatgctcccagaagctgagacagctagagcaaaggcctgaggtgggaaagaacttagc

SEQ ID NO: 11614 - DNA, 201 bp, Homo sapiens
gattatttcagactcgggagtagggatgtgtttgcacttctagctctataggccctcatgagcctgttggacacattgttaaattgatgccaagtagctcraagcagaacccagtcccttgtccatcatcttctttctgctgacttcataggaacatggttcactttcactgccttcctttgtggacatactcagcctgcg

SEQ ID NO: 11615 - DNA, 201 bp, Homo sapiens
gatgtgtttgcacttctagctctataggccctcatgagcctgttggacacattgttaaattgatgccaagtagctcaaagcagaacccagtcccttgtccmtcatcttctttctgctgacttcataggaacatggttcactttcactgccttcctttgtggacatactcagcctgcgaattaaaaacagaactgattttct

SEQ ID NO: 11616 - DNA, 201 bp, Homo sapiens
ggccctcatgagcctgttggacacattgttaaattgatgccaagtagctcaaagcagaacccagtcccttgtccatcatcttctttctgctgacttcatargaacatggttcactttcactgccttcctttgtggacatactcagcctgcgaattaaaaacagaactgattttctcatctcccttggatcctggggaaatt

SEQ ID NO: 11617 - DNA, 201 bp, Homo sapiens
cttccctcctttactgaatggatggctgggtggatagctgttctttgcacatgttcgtgttgagtaggtgctgtataaaatcacttgttctttttttaacrtgactcacgaaaaaattatcccagctttcagtaatctcaaggaaaaaaaaacacttgccatctgcaatttactgcttttaacctgaaaaataggatctaa

SEQ ID NO: 11618 - DNA, 201 bp, Homo sapiens
ctgactcttcacccatcagaaagatggagttctctctttgtacaccttgcacctatcactggcttcatcacaggatccctatcacagtctttttgatgaakcattgttggatggatagatggatgcatggactaggtgataaatgaatgatgaaccattaagtgaaataaggagtgtggtatagacttggaaaagaaaagt

SEQ ID NO: 11619 - DNA, 201 bp, Homo sapiens
gctgctacctgcaacctgctttatagtgataaacgtgctgcttatttcattttaattgaaatttgaaatcatagtctctagcaagaaataaatggactcaytccccatttttcccccttggccacacaaaaacaagtattagtaggaaatatctgagcatttttaaaaagtaaatatcaaatttttgacagtatgttttcc

SEQ ID NO: 11620 - DNA, 201 bp, Homo sapiens
tggattaactctagtctataatcacaactcttctgtttccttgtctgcactgtgctcacataatggctatgtctcttaccgccaaagcccggctcactgcytacaacggcatcctgtttcttcacctgtttttcttttgcttacctgacaagctcttgcattcataaaagtcgaaaggattccagcttaacgtttcaatcc

SEQ ID NO: 11621 - DNA, 201 bp, Homo sapiens
cacaaatactttgcttggtcctataggctctcaggtttttttgatatcatgtggcatttgtgtcaaattgagttgtgctgtaattttattaacaagcttcmcatctcagaatattttacagagatgcacctaacacagttgacatgttgtctattaaaagttacatcatcttaagaagttattagtccttttaaacatcat

SEQ ID NO: 11622 - DNA, 201 bp, Homo sapiens
acttggagtcaaactgtctgggttgaatcaaggctgtccccaccagttactgtctgtctgaccttgagaagttatttaacctctcagtgtggagatgttcrtggtacatatctcatagggtttctgagtggataaaatgttctgatacatgcaaaatagttagaatagtatttgcctggcataccttaagcactcagtaaa

SEQ ID NO: 11623 - DNA, 201 bp, Homo sapiens
tgatagtggagagtctctttccaaatataagacctagcattaagaagtatttccaagtctcctattttaggaatctcaaatctctaaattcgagatatgtkgaaaaaataggcaattttcaagaaaatttgtgttgctgctagccctttggcttgtacaatacatatttttttttttagaatatactggaaagatgaaatc

SEQ ID NO: 11624 - DNA, 201 bp, Homo sapiens
tccaagtctcctattttaggaatctcaaatctctaaattcgagatatgtggaaaaaataggcaattttcaagaaaatttgtgttgctgctagccctttggyttgtacaatacatatttttttttttagaatatactggaaagatgaaatctctaataggtatctttctggagaacagtctttatagcaaggttttctttac

SEQ ID NO: 11625 - DNA, 201 bp, Homo sapiens
attttcagattaagttgaaaaggtccataatccttacggaaattttttttttaatcatcatcaggctattcttgacagtcagtaaaatatcaggtctttcycatttaactgacagatttcttctttttgctttctttcttccctctctgtatctatatctactctctttccagggctcacggcatatagtaagtattgaaa

SEQ ID NO: 11626 - DNA, 201 bp, Homo sapiens
tctctcgatattccgaggttatatatcaaaagaagccgtgtgtatggcttccagttacccatccagagaattcctgaaaaaagcaaattattcttaagatyccctggaattatgaatctcttggtggagatgcatggtagggaaaagggaaacttgatctggtttattctgaaccctttcttctcatcttatccttctact

SEQ ID NO: 11627 - DNA, 201 bp, Homo sapiens
ccaaaacaattcagtatgaatcagacgtacacatacataattgtctcattgagtttcccatctccactaagtcatggtcactgttttgccttggttatggyaactaaaagccaatggagattaatggaaagccccccaggagaaaatactcttttgcggtctttggatgaaggcctgagtatcagcaggactggagttcta

SEQ ID NO: 11628 - DNA, 201 bp, Homo sapiens
ttgccaggcatgtgacatacgactctgaaatcttgcaacaacccagttagaacgacttactaagacttgaagttaagtttgcctaaatgtatacagcaggygattaaaatatggatttaactgctgatttgttcatatttaagatccttgacctttccactgttataatagtacatattgatattccactggcgatgagta

SEQ ID NO: 11629 - DNA, 201 bp, Homo sapiens
tctgcttctggaaatttctagcacataagaagatagctggagggtatgtttgtctgtatagtttagaggctggctggtgctataaaggaaagtaagaaaarggcaaagatatccttcagaggattcccccagaagaaagtagcagttatgaagttttattcctgaggtaggacaggcagtcagacccaagaggtctcagtg

SEQ ID NO: 11630 - DNA, 201 bp, Homo sapiens
aggacaggcagtcagacccaagaggtctcagtgtctctccctgtgttggatgtaattgcttttcattgtcaatactgaaagaaggcacacaagagacaaaygaaatgtgtgtgtataaacctggctttggttttcagagacagtcttcttacaccttcagatctcctagatgagctgggccttacagaaaatacaagtctt

SEQ ID NO: 11631 - DNA, 201 bp, Homo sapiens
taactgatttttctaatttaagggagttattttctgtggaggaagaggctataaagtcacatttttatcttattttcttttttttttctctgatatttctkctctgttttccacattccttgtcactgtcaaaactggtaattaatcaagagttagtcatggatggctccttttccctccccttcttatccttcattttcc

SEQ ID NO: 11632 - DNA, 201 bp, Homo sapiens
ttcttatccttcattttcctgcctgagtgataacgaatgatgtctcttgtcctgtacccctggcttcctctcctcagagcattcaagccagaccccatgayaagatgctcccagtgaagggagaaaactgggaatgacaaatgtgagtctgggaacccaggcatcaaggggtggacttcctgatctctaccacttgccatc

SEQ ID NO: 11633 - DNA, 201 bp, Homo sapiens
ggccttgaaggccagctgcgtcatctggagatgaagatggaaggaaatggggatcactgaggatgaagaagaaaaggagccctaaaggtctcttacagtcrtcattttgtccgtagaaacacatctctgggaaggaatgagttaggtttttcttattctttcttcattaataaaaatagaaaaacaggtggtgaaacaaat

SEQ ID NO: 11634 - DNA, 201 bp, Homo sapiens
ttcatttctttggacaagtatgttaatttcttcatatgcagttgtcaatggtccaggtttcggaaccaaatagcctaaatttgtgtctggaccccactacytgctattattgactttgggcaaactagttaacctttctgtgcctcagttttctcatctttaaaatggggctattaagagtacttctctgtattgtcattg

SEQ ID NO: 11635 - DNA, 201 bp, Homo sapiens
gctagaagtgactggcatggctgagacctagaattacctggaggcttctttattcacgtgtctgtgtctgagcctggaatgggatgatttgaaggctgaasttagctgagatggtgtggcttttccatgtggctcaggcttttcatgcatggtggctgcgcttctgagagagaagtcctgagaggaagtatctggaaaggg

SEQ ID NO: 11636 - DNA, 201 bp, Homo sapiens
tgagcctggaatgggatgatttgaaggctgaagttagctgagatggtgtggcttttccatgtggctcaggcttttcatgcatggtggctgcgcttctgagwgagaagtcctgagaggaagtatctggaaagggagccttccaagagaaccaggtggaagctgcattgccttttctgacctatcctctggaggcacacagtt

SEQ ID NO: 11637 - DNA, 201 bp, Homo sapiens
cagttacatttccaccacatttcattggttacatgtgaatcagaccaaacagattcaaggggagaaagaatgagcctcacttctttgcgcaggagagtcarggtcacattgcaaaagagcgtgttggatggaagatgttacatctgattttgaaaaatatacttctctacaatattgtttggtcatcttataaaagtaaaa

SEQ ID NO: 11638 - DNA, 201 bp, Homo sapiens
aggaattaaaagcatccattcttttattcaggaaacctttgagcacatgagtattccaagattgtattctgtacttggagtatataggaatgaacaagacrgccacacttagcagaatgggagagggaggcaataagaaagttaaagaagagatgacaatgtcggtttctgatagaagctgggataaaaaaaggaggtagc

SEQ ID NO: 11639 - DNA, 201 bp, Homo sapiens
ctcgttgttttaatttgcatttccccagtgacaaatgatacagagaatcttcatatataattattgccatctgtattactttttgggtgaggtgtgtgttyagatctttggccatttttcatctgctgttttcttattgttgaatttcaagagtttttaacatattttggataacagtcctttatcattatgtctttttca

SEQ ID NO: 11640 - DNA, 201 bp, Homo sapiens
tttcatctgctgttttcttattgttgaatttcaagagtttttaacatattttggataacagtcctttatcattatgtctttttcaaatatttttcccattmtggcttatcttttcattctcttgacagttacatcatgcttttaattgtagaattagacaacaatgaaataaccaaagccttagtaatcttaattagagat

SEQ ID NO: 11641 - DNA, 201 bp, Homo sapiens
gagtttttaacatattttggataacagtcctttatcattatgtctttttcaaatatttttcccattatggcttatcttttcattctcttgacagttacatyatgcttttaattgtagaattagacaacaatgaaataaccaaagccttagtaatcttaattagagattatcttctattattttctatttttcttgtttcac

SEQ ID NO: 11642 - DNA, 201 bp, Homo sapiens
gcttttaattgtagaattagacaacaatgaaataaccaaagccttagtaatcttaattagagattatcttctattattttctatttttcttgtttcacctsagttagaaaactgacctgcactgacttcctctttcacaataattccagtgaaatgaaagtgattagaaagtcttagcaaattcaccaaaagttagagcca

SEQ ID NO: 11643 - DNA, 201 bp, Homo sapiens
aaagccttagtaatcttaattagagattatcttctattattttctatttttcttgtttcacctgagttagaaaactgacctgcactgacttcctctttcayaataattccagtgaaatgaaagtgattagaaagtcttagcaaattcaccaaaagttagagccagaagactcacatttcaattctctacctaaagagaagg

SEQ ID NO: 11644 - DNA, 201 bp, Homo sapiens
aattcaccaaaagttagagccagaagactcacatttcaattctctacctaaagagaaggacaggcagaagccaaatatgtaaagagtttgtcagaagtatrccttggagccatgggcattgttcattactctgctgaatttatcttatggattttcccctccacattaatgtttcaatgatcttggttagattgttgaagt

SEQ ID NO: 11645 - DNA, 201 bp, Homo sapiens
ttatccctatgagcaattaaatacttttaatgggaatgtcatgtttttaaatcacatttcttataagaaaaaaatggtgtttactcaaatgaatgtggtcygatggtgatcctgatctatgagcagtaattgagatcatggaaataaatacaggaaagctggctccctgctcccttcaataaccaaatctatggtttagac

SEQ ID NO: 11646 - DNA, 201 bp, Homo sapiens
aacctaattcccttttaccatgtagcctaacatattcacagctctagggattaggatgtggacgtctttcaggagccatgatccttccttccacacattawctgcagctaagcaacatgactccccatcacgacagagtagaaggagaaactgaactgtgagaggggaaacagctttatcaaaacatagcaaatgtcaatt

SEQ ID NO: 11647 - DNA, 201 bp, Homo sapiens
attcttttataaacttgctgatatggaaattaaaaattaaatctacttaatggaaaatatttgatataagaacatcagacatatctttgataggcaataarttactttatagaatcgtttagcatcttatcttcagggctattttttggccctaactttgagcacattaattttgagttcctcttgtttctcttctatttg

SEQ ID NO: 11648 - DNA, 201 bp, Homo sapiens
atcaacttatgtctcaacattttgttgcagtagaggaatttggaagaagggaaaagagaatagcaatgaattgattggataagaggcagacacatgttttwaaaaaaggatcagagcttgcccagtttctatttaaagtattgtaaggacctaatagctagctatagtgatacatttaagattaaaatgagcagatttggc

SEQ ID NO: 11649 - DNA, 201 bp, Homo sapiens
taaagagtcaacctaagtgttcatcagaggataaatggatgaagagaatgtagtaatgtggtatatacacaatcgaatattattcagccttaaacaagaargaatttctgccatttgcagcagcatggataaacatggaggacattgtgctaagttcagaaataagccagacacagaaagactaaaacagcatagtttcac

SEQ ID NO: 11650 - DNA, 201 bp, Homo sapiens
agcgaggcaggagctgccaaacacttttaaagccatcagctcttgtgatgaactcactcactatcatgagaacagcatgggggaaaccacccccacaatcyaatcacctcccaccagatccctccaacatgtggaaattacaatttgagatgagatttgggtgggaacacagagccaaacgatatcatcaagcaagtgggt

SEQ ID NO: 11651 - DNA, 201 bp, Homo sapiens
cacctactaacccagaatattcccaatgtcctagtcaagagatactatagtcaagtacctggccacataggaaatgctttctaaaagggtatgtatttggrattttaggttaggataccaatgacatatttttcaccattacagatttgataacaagatctgggctacccaaacacctacttgctgtctgcaaagatccta

SEQ ID NO: 11652 - DNA, 201 bp, Homo sapiens
ttttgtctggcaataatatttccgtatctgttttcttttggttaacatgtttcaagcatattagttagaatatttgtttgacagtatggtagttctgcttstctaggtcacctccagatccaggttgcctttttcttgttgctcagccacagcacattgggcaacctatcagttcagcaaatgttaaccagaagaaaacat

SEQ ID NO: 11653 - DNA, 201 bp, Homo sapiens
gtagataggtggtttgggttcaaatactggctctggcacctcctggctgtgtgagtatagacaagttacaatctatgcctcattttctccaattgtaaaayagagatacttataataatatatatcttatacacattaatcaagtattggttattattattacctttatttttcttctgcagtttctagaatgcctttgtt

SEQ ID NO: 11654 - DNA, 201 bp, Homo sapiens
agtgccctaagaggtaatgttgtgtttacagatatggggaaaaaaacagctattggttcagtgaagacttgtgttttctttcttctcagtttatcttctgkgactgagtccagatctttatttgcacatagactaattctgtctgactgcagacacatgctctaatgtccacacattaaagctttctttacctagacctgc

SEQ ID NO: 11655 - DNA, 201 bp, Homo sapiens
ctcaatactcagtaggccctttaaaaacatcagttttagtttgtacttttcccttgattgagaatctctcctatttggtagactgctactaatttttcacrttgcagctgactccataatatctggtctgcaaagttttccctatctcccactgcacagtgagtttcccagccttctgtgtttacttttttcgctatagaa

SEQ ID NO: 11656 - DNA, 201 bp, Homo sapiens
cgtttagcctcatcactcaaaggtccttctgccttcttgattccagcgccctggccttctcccaaccattcatattcaccactacagacttgcctttgctyatcctatttaagcagaatcctcacttcttcctttgatggtcacctactcagaactaagaactcttctttagtgtagcacctcctcaaggaaatccccctg

SEQ ID NO: 11657 - DNA, 201 bp, Homo sapiens
taaaaccagtaacggagagaaaaataaatataatgcctctcatttatatagtgcttcacaacttttaaagtgctgttttatgttccccattatgccccttkgtaggagagtattgtttctaaaaagacagccatttaattatcacttttctttataaattcaattacatttcccagtccatgtagttcatcagttcagaga

SEQ ID NO: 11658 - DNA, 201 bp, Homo sapiens
ataatgcctctcatttatatagtgcttcacaacttttaaagtgctgttttatgttccccattatgccccttggtaggagagtattgtttctaaaaagacarccatttaattatcacttttctttataaattcaattacatttcccagtccatgtagttcatcagttcagagatgtttgtcttcatttctgtctatttttta

SEQ ID NO: 11659 - DNA, 201 bp, Homo sapiens
gaccagccagaggctaatttctgtggtatttcttcctgatgccagaataggtagacaagtcagaagcacccacttcagataataaagatataattccagtyattcaaatttgtgttgaaagcaaatcctttcactgcttatttttcaattagtgccaagtgtggctccatggcttctagctacagaaggccaggtgatcga

SEQ ID NO: 11660 - DNA, 201 bp, Homo sapiens
tataacaggagcagcaactcttgagagcttggaaatcatacaagaacactttcgctgtattctgttggtcaaagcaagtctcagaatcaggctagattcartgggcagggaaataggtgacgtgtcttagtgggaggaacagcaacatcatactacaaaagggtgagcgtgcaaggatgggagggtttcttgctgtgtttg

SEQ ID NO: 11661 - DNA, 201 bp, Homo sapiens
gcgtgcaaggatgggagggtttcttgctgtgtttgccaacaatttaccataaagtgataactgagttggaccttcacagaaaataaagatttgggaaatamagactttgccagagcagggattataaagaagagcattacttcagattagctgagaatgaggccacacgcctatattgcattattgaggaaatttcctctt

SEQ ID NO: 11662 - DNA, 201 bp, Homo sapiens
ctgtgataggcctttgggaataattcttttcaaggcctgaagcatttaaagtgcactgtatattgttctaaatgcaagaccaatgccccattctatcagakaaaagaaaaagggtatctgtgggaaactatttaaaagattaaaggagctttgactgaaatgtggtttggtggcaaagaaagggaaaccaccatcccttgg

SEQ ID NO: 11663 - DNA, 201 bp, Homo sapiens
gagttctgatgggaaagataatgagaagtgtttacttagcatctaggccagcaagctaagaaaaacattgtgccatgctagtattgacaaggtgacagagwgcccacacttgcctcacatgttggccactcccgatgctacatcccactttactcttgctggaggactgacattaatgcttactgttttgaggtctggaca

SEQ ID NO: 11664 - DNA, 201 bp, Homo sapiens
atgattctttcacattaaatgcaactccttttcaacatatgtgtatacttggccctttattgaacctttttataagctgccaattggaaatacacagtcayggtagatatgacaatgagcaagtcacttaataactatcagcctcagtttcctaatctacaaaaggaggctattaagagcacctacctcacagtgttaata

SEQ ID NO: 11665 - DNA, 201 bp, Homo sapiens
ctcataaaatattagctgaatagttattatataaaaaggaaatgatcagaatatcacatttcgggtggtggtgtttagtttgtgggttccttcatgtgacrggttgaactgggtggtagagaattctgagttctgtacaacagagtgattgatttctcggtttgcatttcttggcatctggcagtgacaccactgcagacc

SEQ ID NO: 11666 - DNA, 201 bp, Homo sapiens
aatgttataaagaacttggccaagtccataaaatgtccatggtgtataacaaatcttttatggtgagtgatccatggaattaggtacttagaaaagtcgaytgaaacatattcacagaaaggcaaaggtttgatgacctggtgcatggaatgagacagagacactgagaaattttgattgtacaagtttttcctaatatcc

SEQ ID NO: 11667 - DNA, 201 bp, Homo sapiens
ccagactggtcctactaacattcttgattaccacttatttaagtgaccatcaaaccagttttatatctgatatgtttaatccaaataaatgtctttttttwaaaaactgtttaaaaaatggtatttaaatccttcccagattttagctgtgtatagtctggaaggaaacccattcacatggttttatcaggtttgatattt

SEQ ID NO: 11668 - DNA, 201 bp, Homo sapiens
accaaaatggcagaacatttaaaatcagtctgccaaatatcttttctcactttacttcatttgttgaacaatttatatgctgatatagatggccattttarcagtgtatacaaagcatttatatccacacatgtacatttaatcaaacctacatgtctacatacacatacttaagacacacatagagagagagtgtgtgag

SEQ ID NO: 11669 - DNA, 201 bp, Homo sapiens
gttgtcaccacctgtgacatttaccaagacaattttgggtaaaaaaggcagatttattggagaaagtacaaagataccttgcaagaaagcaatgcgcaggrcaatgggctgtctaccaagaggcaggagctagagggaagttttatagggtcatactggaggggctatgtccagataagttgtgcagataaggtcctgctg

SEQ ID NO: 11670 - DNA, 201 bp, Homo sapiens
cctgacactcttggacttaaatgttcacctacactcaatctgatcatggacaaactacttaatctcactgagcccatgtcctcatccataaaatgagggtrataatagttccacgttttagtattgttaggatgattaaataaaataatgcatgtaagtaaaataacccagctattggaacaatcgctgctgtataataaa

SEQ ID NO: 11671 - DNA, 201 bp, Homo sapiens
ggaaactaccctgaaaactgtagaacattctacaaatattatctaacaaaatatatgaatgcataattagtgtcttcaagggatgtcataaatatcgtaawactaaagggtgagctgtatcaaaacttggaagggattgggatgaaaatcaaactgtctaaaatagaatggccaaatacattgggacttggctccagaaag

SEQ ID NO: 11672 - DNA, 201 bp, Homo sapiens
cttggggtttcataatttctgcctgaaatcctttggtttcctctcaggaggcatggagtgaatttatagggagattcttcaatccagacacaaaaaaaggytttaaaattttttgtgtgtctccatatttgactttctgtctcccattctcatttcctttactttcatgtgtgtgttttcttcttactgtgccaaacacat

SEQ ID NO: 11673 - DNA, 201 bp, Homo sapiens
gcaggtgacagtaaattggagcacttggccaggcaagccctgcatctgccacagtgagatcagttactggagagtcatcccaggcctatttcacactgccrtctgggaatgtgggactctaggttcttaagtgttaactatgggcaaaaaagaaacaagaagtataaagtcattgagaagattgtctgcagtagggcaggc

SEQ ID NO: 11674 - DNA, 201 bp, Homo sapiens
ggactctaggttcttaagtgttaactatgggcaaaaaagaaacaagaagtataaagtcattgagaagattgtctgcagtagggcaggcatggatgaaaatygaactctactttgtctgtgggtgaattatttaccttctatctgtcctgggtctgtaaaacagttataagaatagacagggttaatttgtgaaacttagat

SEQ ID NO: 11675 - DNA, 201 bp, Homo sapiens
attaaaacaaatattaattcctcaaagtttaattcttaacaaatattaattctacaaagagctaaaaggctctatgtaggtagataacggcattcagattyacctcctaatctttacagtaattggttttaagggttggagaaagaagtaaaggaggtaaaagaatgtacatagacaataataattatgaataacatttac

SEQ ID NO: 11676 - DNA, 201 bp, Homo sapiens
gccatagcttaggggttaaactcacagacatttaagtcacatgttcttgagttcaagtccaagttgctggccctttgggacttttaactcccctatgatcrattgctataaattaaaactcagttaatagaatataatgtaagtagttatatatcggaaccaatgatagtacctacttcttagggttgtcaagagcatcca

SEQ ID NO: 11677 - DNA, 201 bp, Homo sapiens
atgtttatgttgataatttctccccttttatttttctatcagtcagatttataataagaatcagctgttctttctaaaagactattgtgcctttatattaytttctttaattttcaataatcctatgaattagcaattattatcctcatttttacaaatgaggaaactagagatccgaaaagtaaacagcctcccagctaa

SEQ ID NO: 11678 - DNA, 201 bp, Homo sapiens
ctgagagaaatgggaagtcccctgagctgaaagttgggagcactacatcctcatcaacctaaatctgccacatacaatctctgtgatcctggggaagtcaytggacctctttgagtcatgctgtcctcaaatgtaaaatgagttttacatttaaatgttctaaataagttcctttagaatgtttcaattaaaaatttatcc

SEQ ID NO: 11679 - DNA, 201 bp, Homo sapiens
agaggtaaaccaataggctcactttccaaaagaaaatctgaagcatttaagattatttaataaggaagaatttcctctggtgtcctgaatgaggaatcttyggggcaagaagggtcctgtcctatttattatccttaagaaattccttgctatttttagttctcaacatcagctacttctcattactaagtaaaagccaga

SEQ ID NO: 11680 - DNA, 201 bp, Homo sapiens
acttacttacaaagggtcatgatgtgtttgtcaaaactcatcagtgtgtccagaaactatgtgcgtgtgtattttagtcaaactttctgggagttaaagtrtatataaggtaacacagcaatggaacatcgcaatagttggcatcagatttgcaaatggcacaattatttgtttcctcttcactggtccttgaaaaataca

SEQ ID NO: 11681 - DNA, 201 bp, Homo sapiens
tgcctagaagagaaacctcctgggaaaaagaaaaagtgatagaagacacaagggggagatgaaggcaggtggttttctcagtttttttactgctataacaraatatttgagatttggtaatttataaggaacataaattaatttctcacagttctggaggctgggaagtctaagatcaaggtactggcaggtctggtgtct

SEQ ID NO: 11682 - DNA, 201 bp, Homo sapiens
tgtaacctggactagaggcagctctctgcaggggagctggtgtgtgttttctcagatctctattattcccatgatatttctatctaaatctgtttactttkattccacacatggttttgagaggcagcaagccatagtagaaagatgtgcttaatttgaaaccaaaaaaaagttggatttgagttccatttttcaatccat

SEQ ID NO: 11683 - DNA, 201 bp, Homo sapiens
gctcacaggacttaatggcaagcctcccttaacaccatcagttggatgaattatctcattgacccaccgcttacactgctccttgtcattactcctggggyattgttcagtgcaacagggcaagaaataactcattgactccctgaagctatagatgatggattttagatccctagctgtattcagaaggcataggagctc

SEQ ID NO: 11684 - DNA, 201 bp, Homo sapiens
attcattagccacccactccacagaatcagtttcttagatcctggtgctgtcactgctgctgttgcaacttgttagtgtttcagggacagacgtcagaggraactgtataactacattagcctcacagatagtaccgacagccagacctgtcatttcctggcctgcgatgacacctctggagcctagaatcacttaaagat

SEQ ID NO: 11685 - DNA, 201 bp, Homo sapiens
ggaatctgaagaaagagcatacctgatgaagataccagcatgagtgtcatatcaaaggaaatacaggatgtgttctcaaattcatgaattcaattggaccrtaatgaatggcataagaaaagaggcaggtaatatggattagcacaaagaacatatgatttaggggcaattggtctctgattcaaggtctagttctgcctc

SEQ ID NO: 11686 - DNA, 201 bp, Homo sapiens
acttaatttttagggagattattttggctctgttaaaagaatgttgttcagtgggttcaaggaaaacagcagggtcttgagtaagtgtttctagagaaacrtctttaaagacttattctatgatgatgcatataggaaggtaatgaggataaaaccaaagaacagttcagagattgaatcggcaggtgttgtcagcaggtt

SEQ ID NO: 11687 - DNA, 201 bp, Homo sapiens
ttttgtcaatatagtaaattgagtaacagcctctgagggccctgcaaagagccaaggcccaatttaactccctagtgccagggtctccaaatgtttttggytgtctatacatactagaaaaaaattaactctgcaccaattaaaaatatgtatatatgtatgtagaatacacacattgcttatattatcacacatacagaa

SEQ ID NO: 11688 - DNA, 201 bp, Homo sapiens
tatgtagaatacacacattgcttatattatcacacatacagaaacatcaggcattttaaaagataagattagatacatatatatcccagtattattccctkaagttcccatgaaccaaccttggcacccctgtggatgcccaccccaacttggagaccactgctgtggtgggaaaaccatggtgacaaacggagccaccac

SEQ ID NO: 11689 - DNA, 201 bp, Homo sapiens
ctaagaaagtgctggggctttagggaaattgagagagatttcttttcttccccctccacaaaaggtaattaatgagtacaacagacaattcaaagcaagaraatagaatctgaaagcttgaaagccatacattcagaatccatttagagatttacagaagggctttagcccagaacagtgcctacaggagctacagtggtg

SEQ ID NO: 11690 - DNA, 201 bp, Homo sapiens
tagctttatattatattaccaatccaatctaagtgcattaccaaagctttgaagaccctgtttgatcctacctctcaataccctccagaacatcctcctcrtctaccactttcctccacatctaccacaccctgggctgtttgtcaaacatgcctggtttgttctagctttgagcttttctctgtctgggagacttcttcc

SEQ ID NO: 11691 - DNA, 201 bp, Homo sapiens
ttcttccttcagcaccagagctgacttttccttgttttatacatagtgagatgtcagctcagatgttacctcctcaaaatgatctttttgatcatcataayttagtaagctctctccctccaccagtcacactgtcccacatctcttcattctgtccagtattagtctgtaattaccatgtgcttacatgtttaatatctg

SEQ ID NO: 11692 - DNA, 201 bp, Homo sapiens
ggtctctttctttaattaagctttgattaagatgctcccagcaaatcccacactgaacatttccattgccccctccctcccccgcttctactatgagagaycgagatccatgtgaggtattctgtgatgaagatcttgttctgtttttattattaagcgtacatcttccccttttctgatattaccactatgcatcatcag

SEQ ID NO: 11693 - DNA, 201 bp, Homo sapiens
cctcaatcaaagcccaaaccataccccaagggcactctgcatcgttgaatttatagatgagatctttcttttgggataaagagctattctcaacttgactrttataccttggccttcattccctaaagaaaatgggcagggaggcttgcagacagaagtatatagtgtggaaaatgaaccacctcttttgactctttgcaa

SEQ ID NO: 11694 - DNA, 201 bp, Homo sapiens
gtttacctaagataattgcagaggctttagtctaagagaatcaaagttaagtgatagcactgtcaaaaaggtttcttaaggaagaagatctaggggttctygggattcgttgaatttgatgccatggctgaaaaattaagtggagatacactgtatgccattggagtcaggcactcatgtgaaagatcagcactcacattt

SEQ ID NO: 11695 - DNA, 201 bp, Homo sapiens
tatacttttccaaaaagaggtggagagaatatttattgacttaggtatgtctgtgatgatctaatgaaatgtcatggaacaacttaaagtcatagccaaakgaagaggaatgttaatatgtaagaatttgcagatagattattaacatggaatgatgccaaaatagcacagtagaaaaactaaaataaattaaataggcct

SEQ ID NO: 11696 - DNA, 201 bp, Homo sapiens
ttttcttgcttacttgcttggttgctttctctctttcctagctgaatagcattacaggccacttctaaaataaactgggttgtggaatttccactgaaggytggagatgaaaaacatactcatttacactgtgtgcgaacttggtggactaacattggttaaactttgaaattaagagatttttttttcctgatttttggc

SEQ ID NO: 11697 - DNA, 201 bp, Homo sapiens
tgaaggctggagatgaaaaacatactcatttacactgtgtgcgaacttggtggactaacattggttaaactttgaaattaagagatttttttttcctgatwtttggccatctctttaatgcaatttcaggtagccacatggttcttaaaaccccaaatgcagctatcttcagtaagtacaaaatgaaaatatgttgcatcc

SEQ ID NO: 11698 - DNA, 201 bp, Homo sapiens
ctgagcccacattcctttttttctgggtagggggcaaaactttttctgaaatgggggtcttatgacctataatcaaacaaggtagtcaggcagtttctgcrtggtcagtttttacacagaaaggcagagggaaattggagtaatatttttaggtcttatgactagctttgaggaagagggatcctagtttctatggctagc

SEQ ID NO: 11699 - DNA, 201 bp, Homo sapiens
gacatgtatgttaagtgactagcacagcgcttaccagaggaccattctcccgctgtagcaggacgagccgcagacgaaacctctcagacaccaaattgtaraaggaagggctttattcagctgggagtatgggccagctactctctcaaaatccgagctctctgagtgcacaatttctgtcccttttaatggctcacaaca

SEQ ID NO: 11700 - DNA, 201 bp, Homo sapiens
aacatcggtttctaagttatgagttgatttttagctactgggtttaggccaggcaggcccaggcctggtttcgggcctggcgccgggctgcctgtctttgrttttacttccttgttgttttttcttaaaacaggtactgagtataaaacaatataaaacaatatgagagggtctctctcttccctcaccacatatgtgaga

SEQ ID NO: 11701 - DNA, 201 bp, Homo sapiens
ctgtctttgattttacttccttgttgttttttcttaaaacaggtactgagtataaaacaatataaaacaatatgagagggtctctctcttccctcaccacrtatgtgagaaaagagaaaatatggctaagtcatgtacttaactgagtattaaaacacatgtcttaccagaaatagcaatttttcaagtgtgtgaaacaca

SEQ ID NO: 11702 - DNA, 201 bp, Homo sapiens
accaccacacctggctaattttttttttgtatttttagcagagactgggtttcaccacgttggccaggttggtcttgaactcctgacctcaaatcatccayccacctgggcctcccaaagtgctgggactacaggtgccccgctcaagacagattttaaacctagcattcttgctccagaattcatgctgttaatcactgc

SEQ ID NO: 11703 - DNA, 201 bp, Homo sapiens
gagtacctattatgttttagtcattatggtagaaacatggcaaatggatataaacaaaaaacatataattccatgcctctgttcagattgttgtctgcccytgagattcctctttttcccactccccttgactaactcaactagccctgctttttgtttgcctgtttgttctatttattttttggaggacagggtctcact

SEQ ID NO: 11704 - DNA, 201 bp, Homo sapiens
gaattcacctctctaagattatggactacatattccaaatgtgtagattttgacctaaattttacccattctacagaaaaccaacaaactccacctcagaragatgttctcactatatctacccaccagggtaccagtctaaaaggccccaatattttctcctgtgttttctgaataattgtgtttgagctagagccggga

SEQ ID NO: 11705 - DNA, 201 bp, Homo sapiens
catttttatagaatccagaaataatgcatgtaacttgccattcctccccattagtacacttgagtccaaaggagaggttcacagcatcgtgctcttttgtsatgtggtttagaagaaaaccagctcaggacaagtggactctgaaaatagcagactttcctttactcatcttttgagttttcagagaagagtagagattca

SEQ ID NO: 11706 - DNA, 201 bp, Homo sapiens
ccaagaattcagtagaagacggaagcgtggtaaggagaacaagaactgaagacataaacaaatttatttgaaatatggttgcagtggagcagggagagtgrattcaggggaaagaaaaataaaatgaaataagatgctgaggttcaagaaaggataaaaggtaaagtggctgaatttaaatgacctgggtttcagttttta

SEQ ID NO: 11707 - DNA, 201 bp, Homo sapiens
gaaaagaaacacacttgccccctttttgcagaagtaagctcctttagtgattttcatctcattttcttctatactttttttttatatttgttgtgagcacsatcttctcttttttaataaattcatatttttcaattatttttattattaaggtaagaagtgtgcttttgttggtggaggaagaaggaagcccctacatgc

SEQ ID NO: 11708 - DNA, 201 bp, Homo sapiens
gttcaatacaatttatatattgaatacaaaagagattttcacttattgatatggctttctaggtgtttaaattctaactcaatattttaaggattcagtartagtagggtttccatttctacatggtaggcattctctagtttacttttcctcttctttctgtagaaattaactatttttgcttcacagtcatttcatgat

SEQ ID NO: 11709 - DNA, 201 bp, Homo sapiens
acaactactaagttacacattcaataaaaagactttttctttgtaatgttatatgttaatggtcagcctcctagatactgatgaagcccatcaatttctastgatagttaagatcaattaaccaattagttacccattttcatttttcctgtatattctttgtagatcacttactaaaatgattttctaagaccttcactt

SEQ ID NO: 11710 - DNA, 201 bp, Homo sapiens
gaaaaataatgagacatctgatggaacttaggatcttatttgaaaaataagccatcaagtactttaactttctggtatttcaaaagtaaaaacatatactmatcacttgtttttatttcacttatttgacactacacatctgtcttagtacaaactcatgtttatgcaatgagatttattagactgatagttcatatctta

SEQ ID NO: 11711 - DNA, 201 bp, Homo sapiens
atttcacttatttgacactacacatctgtcttagtacaaactcatgtttatgcaatgagatttattagactgatagttcatatcttagccccttttcatasagaatcattgaaaaaaaaactgttcactgtgagaaaactctctcccctcactactgatcgcttatagtaccaattcagtatatgagaagacactattttt

SEQ ID NO: 11712 - DNA, 201 bp, Homo sapiens
tctacactctaaaccagaagggacttattccaccaaaagaggttaagggctccttaccacagtcacaaaaccagaatatatattctttcagagaaaacccrgatacagggcatgagattagaaccctagaatggcatatcaaaaacttctggagtctgttgagtagaagtttggagaataaacaaattgatagattgatat

SEQ ID NO: 11713 - DNA, 201 bp, Homo sapiens
actgaccagtagcagaaacagagatccacattctaatctcacgtctttctactttggttaaaggcaataattcctatttcactcactgatgagtctttccstaacgagaatgtgactaaaaccagttgagtttgcgaaagggatgtagaaagagacaattaggtaaaggtgaaaaatgagactgacgaagtgacgttggtc

SEQ ID NO: 11714 - DNA, 201 bp, Homo sapiens
gttggctccagaagtctttacaaagttagcttggcattggctgggtttcaaagaataaatagaaggggataaaccaagaagaaatgtggatatatatgggkcacgattgaataatttccagaaagaaatcagatagtacaaggagtgtccagagaatgatgtatatggctgaaatggaagtgttatagaatggtagttagt

SEQ ID NO: 11715 - DNA, 201 bp, Homo sapiens
ctcccttcatgactactgttaaagataaagactgcctttggttgacaccataacccacaagaaatgattgcattcctcctggatggggagcaggtgacatygcagatgttacacttcccacatggctaagccactgatcgagattaaaaattcaaaagacaccaaagagccacgttattgtcccctcacagggagctctag

SEQ ID NO: 11716 - DNA, 201 bp, Homo sapiens
caccacttttcagagttattgaaggaattcacccatcagatatgttttgattttattcagtgattgttcaaactagatccgtttctctaccttattttcartgggcagtggttctctagttcatcaaaaagtttttcctctggaatttttgagaagcaatagaaatccagagcatttaaaggtgatgattaattagtatat

SEQ ID NO: 11717 - DNA, 201 bp, Homo sapiens
tacttttgagaggtgacaacgtgctagcagccctcgctcgctcttggcgcctcctcggcctcagcgtctgctctggctgcgctggaagagcccttcagtcygccgcggcgctgtgggggcccctctctggggctggccaaggcctgccctctgctggcggggaggtgtggagagacaggcagaggtgggagtcggggctgc

SEQ ID NO: 11718 - DNA, 201 bp, Homo sapiens
cttggcgcctcctcggcctcagcgtctgctctggctgcgctggaagagcccttcagtccgccgcggcgctgtgggggcccctctctggggctggccaaggsctgccctctgctggcggggaggtgtggagagacaggcagaggtgggagtcggggctgcactgggcgctcgctggcaggcaagggttcgggctccgtggcc

SEQ ID NO: 11719 - DNA, 201 bp, Homo sapiens
agctaaaggtttgtaaacacccaatcagcactctgtgtctagctaaaggtttgtaaacgcaccaatcagcactctgtgtctagctaaaggtttgtaaacgyaccaatcagtgctctgcatctagctaatcaggtaggggacttggagaccttttctgtctagctaaaggattgtaaatgcaccaatcagcactctgtgtct

SEQ ID NO: 11720 - DNA, 201 bp, Homo sapiens
tgtaaacacccaatcagcactctgtgtctagctaaaggtttgtaaacgcaccaatcagcactctgtgtctagctaaaggtttgtaaacgtaccaatcagtrctctgcatctagctaatcaggtaggggacttggagaccttttctgtctagctaaaggattgtaaatgcaccaatcagcactctgtgtctagctaaaggtt

SEQ ID NO: 11721 - DNA, 201 bp, Homo sapiens
cacccaatcagcactctgtgtctagctaaaggtttgtaaacgcaccaatcagcactctgtgtctagctaaaggtttgtaaacgtaccaatcagtgctctgyatctagctaatcaggtaggggacttggagaccttttctgtctagctaaaggattgtaaatgcaccaatcagcactctgtgtctagctaaaggtttgtaaa

SEQ ID NO: 11722 - DNA, 201 bp, Homo sapiens
acccaatcagcactctgtgtctagctaaaggtttgtaaacgcaccaatcagcactctgtgtctagctaaaggtttgtaaacgtaccaatcagtgctctgcrtctagctaatcaggtaggggacttggagaccttttctgtctagctaaaggattgtaaatgcaccaatcagcactctgtgtctagctaaaggtttgtaaat

SEQ ID NO: 11723 - DNA, 201 bp, Homo sapiens
ataaggatgggctttagagccaaaatttaagccatgctttgtcttatctgcataattttatgttcccagtcaggtaaaaccttacccatttatctttattkcctatcaaatgcagacttccctatgagctgttgcttggtaagttccaacccaatatgatgtcaccactgggtggacctctatggcacctgtctcactctg

SEQ ID NO: 11724 - DNA, 201 bp, Homo sapiens
atttttacaggtggctaaggaaagagcatttgcagccatggaatcaggtgttgttattttgggtgtgaccttgaatagaggctgctaacttttggcttctstttccgataataaatctccctcctccccacccccaccatcagccccaaggaaagatgaatgactcaggtgcttcagagacttcccaagaagtggtttcag

SEQ ID NO: 11725 - DNA, 201 bp, Homo sapiens
gagcatttgcagccatggaatcaggtgttgttattttgggtgtgaccttgaatagaggctgctaacttttggcttctgtttccgataataaatctccctcytccccacccccaccatcagccccaaggaaagatgaatgactcaggtgcttcagagacttcccaagaagtggtttcagtatatgcagcaagtggacattta

SEQ ID NO: 11726 - DNA, 201 bp, Homo sapiens
attagtggcagaaatgagaccagattccagtctcttgctttcccgaataccttattctggaattcaattataagtacaaggcatcccactcttggcttcckttctgaataaatgcttgcaccaaatccccagtggcttcttgagaaagctggctacaaatcttcaaagcctcagttgaagaattcttattaagcctactag

SEQ ID NO: 11727 - DNA, 201 bp, Homo sapiens
gaaacaacaagtacactgtggaaactttagctggtattgaaaggagaaaaaacaaaccgaaaaaacaaaaaggcaaatttaagactccggttgggtgtcasagatggtacactaaaattgcaaatgaatgccactctgtaatcatgaagatggtgatcttaatcccacttaaagggacactagcctcttacccaacagttt

SEQ ID NO: 11728 - DNA, 201 bp, Homo sapiens
agatagcatcagaacataagaaaattgattggatgtgacagtgtgagagagaggagatgaagagcgtgggataatgcccaggttgctagctgggcctgctragtggatgagaatactaaggaaggtaaattcagaaggaacagttaagagaggaagtggaggaggaaaacaatgagtttggttgtagtcagagtatgtctg

SEQ ID NO: 11729 - DNA, 201 bp, Homo sapiens
ctctctctccctccagccttttttttttttttttttgagatggagtcttgctctgtcgcccagggtggagtgcagtggtgcgatcttggctcactgcaacytctgcctccaggtgattctcctgcctcagcctcccaagtagctgggactacagccaccacgcccggctaatttttgtatttttagtagagacagggtttc

SEQ ID NO: 11730 - DNA, 201 bp, Homo sapiens
ttagcattgcacttgatttgtgaagtagtgttgactgctagattcccatcattaacattaagttttattgccttaaatctctgtcttatgttcactataartgttttaagtcaacataatgctagcaagaggtgctgggttaacagactacagttggcatatgattctcatttggggcagggaattgtgcagggttattag

SEQ ID NO: 11731 - DNA, 201 bp, Homo sapiens
aaattccatgtgacccaaatactaccaaatcctaaaagatttaactaactggctcactaaccaatgcacacacatacttacttatttcacccagtatgtgytgactaccttttgcccaccaggagctaggcaggttcacagtgcctagctcccaggcacaaagataaatcagaaaccattctgtctaagtcaacctttcat

SEQ ID NO: 11732 - DNA, 201 bp, Homo sapiens
ttagtggtagtatgatacgggaaaagagtaatgtcaaaatgcatggtaatttatgtgatatgccgaggactgcaagaagtcaagaaagaaacataacaagytaacagctgtcaccaacaaatagcaattaatttcagcattcattcccttgctcatgcttcatgaaagtatataggtaaacaggattcgtatcatgttcta

SEQ ID NO: 11733 - DNA, 201 bp, Homo sapiens
tgccgggtccaactctcagcacatggtaagctcacagcaagtactgtattgttatgatttccactaatacagccattatgtgctatttaatttgtagttcrcgtatgtgtccccatgacggttggggccctgttttactaagctttataatcccagtatctcctgtagtagatgatcactaatattgacagttaactgaac

SEQ ID NO: 11734 - DNA, 201 bp, Homo sapiens
gtggagtgcagtggtgcgatcttggctcactgcaacttctgcctccaggtgattctcctgcctcagcctcccaagtagctgggactacagccaccacgccyggctaatttttgtatttttagtagagacagggtttcgccacattggtcaggctggtctcaaactcctgacctcaggtgatccgcccgcctcagcctccca

SEQ ID NO: 11735 - DNA, 201 bp, Homo sapiens
tcttttgtcccctaaatcaagctgtctcttaatgatgacacaggactttgtttttaaaggattaatggggaaaaaagagggggatcactgcaaaggtaacraattagaatatttttacctaaaccgatgaataggagtggaatgaaatttatttctgaaatccaggagatgacagagaaatgaaattggtgttatccacaa

SEQ ID NO: 11736 - DNA, 201 bp, Homo sapiens
ttacgctaaaaatgttgtttaaatttagttcaaaatgttctgttctatgtgaaaaaaatactatcattttatttaatgcaacctatcactgaaatgactayctcaagctgtttctctctatctcgtggagggaaggagtggaattgggggtagggtgcagggtggaaagaaaggagaggtaatactgttacccagagccaa

SEQ ID NO: 11737 - DNA, 201 bp, Homo sapiens
aagcaaagaaattgtgtaaacaaattaattaattgtctgaaagtgaaagcatgtttgtaattttgcccttgtcaaagaaaaattggagttcattatgctcrctgactgatttaaaagcttcttcccgcgtagcatcaccgggagaatgagtgtgttgtgagtgcaaagcatggatcggttgcagcatcaattaaaatagaa

SEQ ID NO: 11738 - DNA, 201 bp, Homo sapiens
accttgtgaacatcctccaatattgctacccgtttcctatcctatacccccaccctcacaacacagaaggtaggtaccagtttattcccaggtggaatctyctcagccaataatgactcctatatggagatggccctgcaattgaaatgctttagcatgcccctattcatttggtctgatgctatatgcaattctaatatt

SEQ ID NO: 11739 - DNA, 201 bp, Homo sapiens
gttaattttatgctgcttcagcacaaagaaaatttacctaaactgccattgctatagattaggtgtatgacacaccgcccccctttcaccgtttcaccccygaacatctgcttcttagagctaagtgattgtactcaacaaatagtgtggagaccagagcttggcgcctttgcagcctccattttacacttggccccctgg

SEQ ID NO: 11740 - DNA, 201 bp, Homo sapiens
agctgtgggccaggctgtgtcctatttgtgtctgcattcccagctctttgcacagcacatggcacagagcttaacctcaaaaatctctattgaacaagaastatggccacaagcacatggggagttttgagtttgtagggttccaagacatggtggagcttaaagggtatcctgtccaaggagtgcaaactgaggcccaag

SEQ ID NO: 11741 - DNA, 201 bp, Homo sapiens
tttaaaaaacaataaaaaaccaatataacaatagaaaataatacaaataaaaatacatataacagctatttgcatagcatgtacattgtgttaaatattayaagtaatttagagattagagtataggaggatgtacatagtttatatgcacataatataagacaccattttatataaggaacttaagcatctacaaatttt

SEQ ID NO: 11742 - DNA, 201 bp, Homo sapiens
taaagtggggcagttcttactaaactgacttagcacacttcttgctaaaaccagattttacaaggaagtgcacagatgagcctaggagaaggtagaggggyctgactaaagttttgatcaagtaaaaaagtctttatcaatcttggtatttcccgttaagcacaatgcttggaacataatagttgctcaacaaatgttggc

SEQ ID NO: 11743 - DNA, 201 bp, Homo sapiens
gaaagaagacacccattttcctcatagtaaaccaaaaatgatctaaaatattccatgtttgttaaaaagcaagatctttatggttactgttaggcactgcrgtatgcctccctggattgtcaataccaatgccatatagatagaacaaatagtttgaaaagacatgaggacaaaacagtctccctgtctcccaaataatag

SEQ ID NO: 11744 - DNA, 201 bp, Homo sapiens
ttaagttaatgaatgaaagatgtgaatgctcatgctaggagaaggggaaaagcattggtatttcccttaaagagaccataccagggtattttatttcctgyaagtggtttaattttgtacattgcttctctgctcacagaatgttctctgtctgtcataataaaggagagccttttcattgaaatagacctctgaatctgt

SEQ ID NO: 11745 - DNA, 201 bp, Homo sapiens
tgttccatgtgttctcattgttcaactcccacttatgagaacatgcagtgtttagtttctgttcctgtgttagtttgctgagaatgatggtttccagcttyatccatgtccctgcaaaggacatgaactcatccttttttatgcctgcatagtattccatgttgtatatgtgccacattttctttatcactggtcattaga

SEQ ID NO: 11746 - DNA, 201 bp, Homo sapiens
ggaatggctggtcctgtagttctttttaaggccaaattttcactgaccttgagatgatttaatgttacacggggattcgggaaccaagctgtagtaattaytggttttttggctttccctcctgtagcacatacataaatgggaataaactgggtgagttcctgaactctttccgcaaattaagaaagtcagaactttgga

SEQ ID NO: 11747 - DNA, 201 bp, Homo sapiens
caaccactttataaaaaatgtaaacaacaggtaatttcacattttaatttatttttatctaaacaatatattcacatagtttatttttagtgtatatatgyatatatatttatttcttatttatttcttatttatatatttatttatagagatgaggtcttactttatttcccaggttggtctcaaactcctgggctcaag

SEQ ID NO: 11748 - DNA, 201 bp, Homo sapiens
tacaagtgtgatttgaacctagactgactccagagcctgtatttgtgactgtgatgaaacatgcttcagagcagtcagaacggagggacagacgggccaamatggaagtgcatttgatgaggctgtgggaggaggctgagaccttcccagggaggacccctgcaggcattggcctccgctgcaatagtccctttcccatag

SEQ ID NO: 11749 - DNA, 201 bp, Homo sapiens
agttttgataatccttcatttccagtcactgctatggtctggctgaccttctgaatgtacccagtattggctggctttagatctatgatatgagctatttytttactcattaaagtgtttaaatttctgtgcttagtttctcagatgacttttttttctgtgtggaatctggttgatatttttggagaataatttaaatca

SEQ ID NO: 11750 - DNA, 201 bp, Homo sapiens
gagtagctaggattataggtatgcaccactacacccggctaatgttctatttttagtagacatggggtttctccatgttggtcaggctggtctcgaactcytgagctcaggtgatccgcctgcctcggcctcccaaagtgctgggattacaggcatgagccaccgagcccagctgcctggtgtacttttaattattcttga

SEQ ID NO: 11751 - DNA, 201 bp, Homo sapiens
catcaatatctggaacaacaccattcttcatgatattggttttgagagccacgtgggcagagaaataaattctagaaaaaaagaaatggtaatctgacatscagacttggattataaatatggtcaaaggtgtacttaaaaacaagatattttgcttcttggttagctttactgagaatccagggatcaagtaaaatcatt

SEQ ID NO: 11752 - DNA, 201 bp, Homo sapiens
cacaaatgtacagcccccccccccctcaacgaatgggagcgcttccccacacctcaccaatagagactgtggtcacacttttagaaatttgtccatctggkatgtgaaaatggaatttcagtgtagttttattttctttttcttatgatgagtgagattgtacatctgtttatatgtttaggaactttttagaaatcattt

SEQ ID NO: 11753 - DNA, 201 bp, Homo sapiens
agattgcgccattgcactccagcctgggcaacaagagcgaaactcatctcaaaaaaaaagatacttgccattggattcagagcccacctagataatccagratgatctcatctagacagcctttactaattccatcttgcaaagactcttttttcaaataatgacacattcatacattccatatcttttggggagacacta

SEQ ID NO: 11754 - DNA, 201 bp, Homo sapiens
catgtaaaagctgtgattgtcgaaaatgcatggattttagagtcagacctggattctatttttccataagtctcttattgtgtgaattctcttgtaattarttgtaagaatttgaatatacttctattataaaaatatttactgagcacctattctgtccatttaggtagcctggtttatgttgcagtgacaaaagcctca

SEQ ID NO: 11755 - DNA, 201 bp, Homo sapiens
attagctggatgtggtggcgcacacctgtaactccagctactcaggaggctgaggcatgataattgcttgaacctggaaggtggaagttgtagtgagccgrgattgtgccactgcactccagcctgggtgacagaatgaaactctgtctcaaaaaaaaaaaaaaaaaaaagttatgtctgaactgaccagaagacagagtt

SEQ ID NO: 11756 - DNA, 201 bp, Homo sapiens
ggacatcgaaatcatcctggccaacatggtgaaaccccatctctactaaaaatacaaaaattagctgagtgtggtggcaggcacctgtaatcccagctacytgggaggctgaggcaggagaatcatttgaacccagaggtggaggttgcagtgagccgagatcacgccactgcactccagcctgggtgacagagtgagact

SEQ ID NO: 11757 - DNA, 201 bp, Homo sapiens
ggaatacacagtaaaaataaagtaaatataattcccaatgacattgctatatataataatttgacaaatccattaaactaatacttactgagtgcttactrtgtgtcacacagtattgggcaatggagatacagtgataagagaagttttgtaatttcacagtgcctaatttttttaggccaggaaaaagactataaacaa

SEQ ID NO: 11758 - DNA, 201 bp, Homo sapiens
agatggtatatataaaatgaatgacacataataaatattggtttcctttttttgcagggtagaaactcaggtgcttatctcatttatgctgtccccccccyccccccagctatcttattccttatctgatgaattatctcaagtgtatcaaactagttgacatggtcaccacatcctttactcattctcttttgctaatta

SEQ ID NO: 11759 - DNA, 201 bp, Homo sapiens
tacagaatataataaattactatccttgttaattcttttatcaaagatatgtactaggcttctgcttccacatgggccatttgaaaaacagtgcttcataygatccctgaactttttggcaattataaagagagatcacaaatgagtaaggttgaaaattaaactataactggaatgaaatgtcctataggactaaaccta

SEQ ID NO: 11760 - DNA, 201 bp, Homo sapiens
ctcctgtctcagcctcttgagtagttgggactacaggcacacaccattatgcccagttaacttttttctttctatagaaatggaggtctcactatgttgcycagggtggtcttgaattcctctttctagttttctctgacactctcactccctgccaatcttttctcctcaaagaagccagaatggtattttttaaaaaat

SEQ ID NO: 11761 - DNA, 201 bp, Homo sapiens
tgcataaaatattttaggggaaaaatattaattaataacaggtaagactgggatacactatttgtttttgaatcatcatagcatcctggaaaggggtcctrttattattattaccattttagagatgaggaaacgaagtctgagtggttaagtaacacactccagtgttgcacagctagtaggtggcagaaccaacatttg

SEQ ID NO: 11762 - DNA, 201 bp, Homo sapiens
aaagtctagaagtctcaaaacaaggtgtcagcagagccatgctcccccctgcaatctgcaggggaataatttcctcttcctagtgtctggtggtttgcccmgcaatctttggccttttttggcttgtagttgcttaactccaacctctttcttcctcatcacatggtgttctccctgtgtgcccctttcttcatatggcta

SEQ ID NO: 11763 - DNA, 201 bp, Homo sapiens
atttgttgaataaatgcacagtgcataaatttagcttttactacaaatgtactacactcttcttatttttctttctttctttcttttttttttttttttgktgtttttgagacggagtctcattctgtcacccaggctggagtgcagtggcgcgatcttggctcacggcaagctccgcctcctgggttcacgccattctcc

SEQ ID NO: 11764 - DNA, 201 bp, Homo sapiens
tctggatatccttgtcttgatctgtaaaatgaggatagtaatccctgctaatccaaatgcacactactgtagagaccttcttgtaaatgtagcatagaacrcacattattgctttgggtagcaaggtaaacatcttgctgtacatctttattccattaaggaagatgtacggaaaagcactctgtgggtttggagataaga

SEQ ID NO: 11765 - DNA, 201 bp, Homo sapiens
attcaacagcaagtactatctgtaagaactttgatttcattgcatttaagcttcttttcctagtggactgtttttagttgaatacttcttgaggataagtkttgtgtcttctatacttatatctgcagcttagcacagttcctgccctatggtacatgttccttatatgtacatggaaattagccaaatgtcaggatgcca

SEQ ID NO: 11766 - DNA, 201 bp, Homo sapiens
gttctggtttaaaccccttgtggcattttctactgcatggatagtggtaaatggggttgatagtgacatagaaatgaacttagaagtaagtttatagactrttggggaccatctgttaatgtaaatgtttaaggtaaaatgcattaaggcttaagagctgacgagacgttttatttgcctcctgcttttgggattatgcct

SEQ ID NO: 11767 - DNA, 201 bp, Homo sapiens
aggaaagtgactgggatcccctgcctgcactgactttaacaataaagatactggaataatgagatcccatggaatttagcaaaatacgagtagaaacaagyggtaaagacagcccagactgtagttcaaagtctaagaacatctaagctgcgggttcaggtataaaattagggccctgtggcttatctcaagacagtaact

SEQ ID NO: 11768 - DNA, 201 bp, Homo sapiens
ctagtaacaagtttcctgggcaatactgctttgttatcagacttcaccatgtagatctcacatccttctcttttctgatcttgctcttatcatttcaaagytacatgtagagtgaggatgcaggtttcatagggtttttgtttttatctgagacagagtcttgctttgtcacccaggctggaatgcagtagtgtgagcatg

SEQ ID NO: 11769 - DNA, 201 bp, Homo sapiens
aagcatggcttttcctgtttcccatagattatagaatatgagtgcttttacatttttattgttctaggaaacctgcaaaatggcctgtattacattcgacmcaagaattaagagagagttttaaaatttctgattggaatgggattctgtttccgatcttgttgttaacatctagttattacactgtgatcagaaaatgtg

SEQ ID NO: 11770 - DNA, 201 bp, Homo sapiens
ctctgtggctgtgcatggacacagactcttctgcccttctcttgcctgttccttgattcctcatgtttctgtctggtgcctacctgagatccaggtattcytctttacctcgtcgtcttgctattttttctagggacttttcttctcccaaagttatgttgaaacaggcaaaacacctagaaatgggtcatgtgggtgagt

SEQ ID NO: 11771 - DNA, 201 bp, Homo sapiens
ataggaatttatctctcatgattttgttaaccagaaaatagaatattatgcccaatgaagatttataggaaatgatacgtttggtgactagaaatgatacrtttggtgactagtagttcatttttacaagtatgcaatgaatccaagtctcttaactgaaatttaatttcagctaatttaattatcagacctggtttttaa

SEQ ID NO: 11772 - DNA, 201 bp, Homo sapiens
caatgtaaatgctatgtaaatgcctgttatactatgttttaaaatttgtatattttgttgtattatttatatttttgttttttgaatctacggtttatatraatatcattctctctccctctgcatctatctgtatctacatatgtatatttgtttttttcttagaacataacctagattcctctacagtgtaaatccctt

SEQ ID NO: 11773 - DNA, 201 bp, Homo sapiens
attcttttacatgaatgaattttaaaatatataattttgaaataggcaattcattattaactctagtcaccatgctgtgtaatagatcagaatctacttcycctgtctgaaactttgtagtcttcaaccaacatctcctcattccccattgacctttcctttctcagcctctgataaccaccactctactctctatttctg

SEQ ID NO: 11774 - DNA, 201 bp, Homo sapiens
tgcctgaatgtctagatctgctggaggaattgcaacatgctcaacttcagtagtttagtagaaagggcttctctatccctggctcagatgactctgcctcmtttgagatccctctaatattagtaatcaccattctcatcatcatcatagtagtggtagtaatagtcgtgatatagctatcatttctgcagtagttactat

SEQ ID NO: 11775 - DNA, 201 bp, Homo sapiens
actgcaacttctgcctcccgggttcaagcaattctcctgcctcagcctcctgagcacctgcgattacaggtgtgcaccaccatgcctggctaatttttgtrtttttagtagagaaggggtttcaccatgttggccaggctggtctggaactcctgacctcaagtgatcagcccatcttggcctcccaaagtgctgggatta

SEQ ID NO: 11776 - DNA, 201 bp, Homo sapiens
ctgaaaggtgtttgtttgtttgtttttttcctttggtctgacaatttatttttggaggagaagggagctgggagggcctaatatatatgcccaggccaagrgaattttggtgagacattccctttcttcccagcagagaatgatttatttatttgatatgtcagttaggatgctttcagctgcaaagaacagaactttcaa

SEQ ID NO: 11777 - DNA, 201 bp, Homo sapiens
ttatctgataccactcaggctggcaagttgagaccccattatagcctaacaagtgtgagggtctaggttcctcagttgttcttcactggactgggtagatrtgggaccacactctttctgtgatgtttggctggagtatggaaattgctttgtgaaagttttttgtcttcctggttctttgactagagatagcaggccttc

SEQ ID NO: 11778 - DNA, 201 bp, Homo sapiens
gtccaactggtgcccctcatgatgggaagagacagaacactgcgaattagcacagtgaaagttaggagctgtgaagaccctagggggcagaggaggtacargcattaatattatggtgctgagaagttaatatctttctttttaaaaaatagctcggcatagaagctgtcagtagggctttctccccggtcagatttatga

SEQ ID NO: 11779 - DNA, 201 bp, Homo sapiens
gtactcttactcaggtgctattcctaggaaaacaaacttaaaaacaaaatcgttcattcttggtggtctggaagactgtatttattctgaaggctgaaacwtctcaagggtgacaggaggataatttctaagctaacagtcctttgctgaacatgaggcaagatcataaacttcctcaaagcagtctccaagtcacacata

SEQ ID NO: 11780 - DNA, 201 bp, Homo sapiens
tctgtttttattctcgggcccacagatattccatggagccaaagggaagtcagaagataacaatgaaacccagggtcttctaagagcagaatgaagctagyggtactcttaggaacagttctatagatgtgggttgtagcttgttgcccatgggaatcacacttgcttttaagttccatcaatattaagaagggatgattt

SEQ ID NO: 11781 - DNA, 201 bp, Homo sapiens
ttaaaaattcagatttacttctggcaaattcattcaggaattcaaactcagataattaaattaatttcttaatattcaaataaagaccagatacacattgrtatcatctctcttgtatattcagagtaccagataaatgggatttttcactagggggacaggattgctacactacaccattgccatttgcattcacaacac

SEQ ID NO: 11782 - DNA, 201 bp, Homo sapiens
ggtgagccaccatggttgctaggcaatagagcgggttgatagagcacggtattaaactgaacccacattggtgttttacttaacatctatttgcttagcayctttgtcatctgtggtgtcatagaagggaaaggaggaggagacaggcagagtctggttatctgcagagactcaaacaagtaggagaaataatcatcccaa

SEQ ID NO: 11783 - DNA, 201 bp, Homo sapiens
gaaaattataagatagtgtatgtctaggtcatgatctttagtatcatcaataaaaccactaaggatgcctcactatagctgtgagatgggttcggaccatkatatccagtttaatactatttgggagcagaagtaactagatatatttatcctatgatattttacacttattggacacctgttgaatctctgttggcttga

SEQ ID NO: 11784 - DNA, 201 bp, Homo sapiens
gttgtgttttaaagttcagctggaagatacccttattcctaagaaatccactaaagaaaactgttcttccaggagttccatttcattctctgggaagggtycatcccttgttcctgttccctttcctctgaattctataggacatatcacagcaccttcttgctgcctccttgtttgtgtctttcattaaactgtaagctc

SEQ ID NO: 11785 - DNA, 201 bp, Homo sapiens
catttcctctgcctgcaacagcccttccctgctattcacagtactcactccctcacttcacccaggtttccgcttatattgcaccttccagaaaggacctycttgaccgtctgtaaaatacaacactctatcgccttttcctgttttgttacctctcatagcacttatcactgcctgacattatagctcacatttatttgt

SEQ ID NO: 11786 - DNA, 201 bp, Homo sapiens
cttttccaaagttatgcaccacgtttgatgcagagacaaaactagaatcaaggtttcctggctgccagggtagggctctttctactccatcatgctgcctsgtgggctgtgggcccttttccaagggtattgcagctgctgctgtgggggctgcctggggtgccttcttagttctctttcttcagaggggagtgaggtctt

SEQ ID NO: 11787 - DNA, 201 bp, Homo sapiens
aaaaaaattagccaggcaaagtggtgcatgcctgtggtgccagctacttgggaagctgaggtgggaggatcgcttgaacccaggagataaaggctgcagtragctgaaatcacaccactgtactctagcctgggcaacagagtgagacccatctcagaaaaaaaaagaaaaaaaccaatcatgggataataagtttaaagg

SEQ ID NO: 11788 - DNA, 201 bp, Homo sapiens
aatgccttcttcagttcagtatctcatgaaagaaatgcaaggtgaagagaaagcttaaatgaaaaaaataaagtgaaatctgtaagcctggttctcatttytaagggtttattatactggagatttcatgaaaatagtattgagaatgactactctgtgatttttgctagcttttagtccctataggcagaaaagcatttc

SEQ ID NO: 11789 - DNA, 201 bp, Homo sapiens
ttcattcattcatattaactgttacttcatgctccatactttttttttttttttgtagagacagggtttcactgtgttgcccaggctagtcttgaactccygggctcaagcaattgactcagcttccctaagtgattggagctaaaattatctcccaccacacccagctactccagtatattttcatccacagttgtgcca

SEQ ID NO: 11790 - DNA, 201 bp, Homo sapiens
ttatgcttttcatctgtccaagctcttcagctgagctttcctcactgatgacagcactatctggagtgaaggaggtgcagatcctgagatggactgcacamcccttggggctggatggacagactactcttcgagtgagataagggatgcaagtgtaaagggcgagtatgttgcctcactcaatcacatgttcaccaccct

SEQ ID NO: 11791 - DNA, 201 bp, Homo sapiens
gctttcctattcaagtgagtttttcttatgtccagctagaatcccctttgggttaatataagtctttagtgtacgaatttgaatctttgcctgaggtgctrcactgttggttctcttaaaaatttgtggcattatttaattcagtaaaatttgtgtggattgatttgtatcctttgaatagttagtattatataaatatct

SEQ ID NO: 11792 - DNA, 201 bp, Homo sapiens
ttttctgctgacaaaagaaagggaaaggaaaaaaatcagataataattccctttacaggcctaatttgaacttaattctctctctctctctctctctctcwcacacacacacacacagacacacacacacacacacacgacaactgtgagctgtaaatccatggtcatctagttactagcgcagtaagagcagttgtctga

SEQ ID NO: 11793 - DNA, 201 bp, Homo sapiens
acacatggacgggctttagggctcagttgctaaagagatagaagtaaaatattatagaaaatgcttatagtacatgttaagtgagaaaggtaaggtaaaartggtttatgacctataactgtgtgaaaactaaccaaagagacacgtatcatttaaaaagatttaatgttgtgcctgtaatcccagcactttgggaggcca

SEQ ID NO: 11794 - DNA, 201 bp, Homo sapiens
gcagaggaggtacaggcattaatattatggtgctgagaagttaatatctttctttttaaaaaatagctcggcatagaagctgtcagtagggctttctcccyggtcagatttatgacttctgaatgacattgttttactttgccatttggaggataaacaaagctggagagaacaaaagttttattttcctatcagtgacaa

SEQ ID NO: 11795 - DNA, 201 bp, Homo sapiens
agagcatatatgatgatgtcatctcaaggggagcccaggatttcaggtcacctatgtataaagtgagaaataaaggctggctaggagtcagccatgggaargggatagaataagttgaacattcatggtaaagagaatactatattcaagatcctaaagcataatatgtttggaaaacagaaaatacagtatggccagaag

SEQ ID NO: 11796 - DNA, 201 bp, Homo sapiens
agagccttggttttgtgagcccataaatgccaggaagcctccaagatttctagctttgtgaagtttacagaccattcatttccgcagtctcctgttgtcayctctaggggaattgcagtgtgtccatccacccttgaggcatggcaaggtgaacatcccttggactgaagactgaatgcttggttttgttcccatacttaa

SEQ ID NO: 11797 - DNA, 201 bp, Homo sapiens
tagattcaacttaatgaaaacaaaaattcagctcatcaaaatatatacctaagaaaattaaagggtaaattttaaaatttttgttccccagacatagactsggagaaaatattttcaggatatatatctaaaaaaggacctgtattcacaacatatgaggatctcctgcaaatcaaaaataaacacaaacaataaaaatag

SEQ ID NO: 11798 - DNA, 201 bp, Homo sapiens
tcagttgttttatagacaagtttctagtttgagggagctatttagaaatgtatgtagccttatgtagaaattccaataaagctttcaaaaaataaagctgrtatttatattggttgaaatggcaagataatgagtctaaaagattttcccttctgatgttattttttttgttgttcagaatgacacttgaaagatgcctaa

SEQ ID NO: 11799 - DNA, 201 bp, Homo sapiens
atatcttgtatcttcatataaaagcagttacggcagccctctgcactgtattttcatagggttctgtttttatcttacttaactgtaaggtccttgagggyaaaaacagtcaagtctttctcattcatcctttgcaaacccagcaccctgattcccaacagagtagaactcagcacatatttgatgaattagattgaattt

SEQ ID NO: 11800 - DNA, 201 bp, Homo sapiens
aaagctgggattgctttttggctagtataatatttccagaatccctgaggcttgcttttaaatcagcataagctggttttgtgtctcacttttgtgttgtrcaattacagaaagcagcaaatacttatcttggcatgtcctgtcatgacatgagccaaaagctgtcatcctcatagattccctgtctaagggaatagttgc

SEQ ID NO: 11801 - DNA, 201 bp, Homo sapiens
gagccaccatgcctggcctcaatgttgtgttttaaagttcagctggaagatacccttattcctaagaaatccactaaagaaaactgttcttccaggagttscatttcattctctgggaagggtccatcccttgttcctgttccctttcctctgaattctataggacatatcacagcaccttcttgctgcctccttgtttgt

SEQ ID NO: 11802 - DNA, 201 bp, Homo sapiens
cgctctactgcttccagcctgtcatgtcaagcagcattgcctttattattgaaatgaagacgatacttagatcattgatctcaatggcatttggcaccatragaactaccagtctgttgtatcatataaaatgatactgcctggtatgcaaatcagccagtgtgtcaacaaaaatgctggcatcagatagaatgtccaaat

SEQ ID NO: 11803 - DNA, 201 bp, Homo sapiens
aactagcaaatgaggcatggggcaaataactcattctcatgcacatgtttctaaaacagttcttactaatgtttgagataaattaaaataaacaccaacargaacatgaaaagagactaagaacaatgttaatgcggcaacttaaacaaatttggttttccaaatgaccttccatctttcacaacttttaacagcatgcaa

SEQ ID NO: 11804 - DNA, 201 bp, Homo sapiens
aaggtggtggcagggaatggaaaagggaagattatttagtcgataaacacttaatggccactgcctgctgtgtggacagatctggatagagttaaaaagayaataaagcaagtgtaggatgcctgtcttcatggtacttatatcatgggaagaaggcatgaacaaaccaattttacacataattattcaatcacaatcatg

SEQ ID NO: 11805 - DNA, 201 bp, Homo sapiens
ctctcaggatgagaagagaaaatcctgaactgacttgatattatgtaattattatataattaaaagtgtgcttaatacatcctttatggattaaatcagaktaatcacaatggttctccaatatctcaggcaaaattcctgggtctagctactcccctcatccttgtcatgcaaagaaccttccccagacttcagtgggag

SEQ ID NO: 11806 - DNA, 201 bp, Homo sapiens
tcgaactcctgacctcaagtgatctgcctgctttggcctcccaaagtgctgggtttacaggcgtgagcaactgtgcccggctagatctctaaaatcatagygtgagtaaggtgaacagaaaaatagtaatgatgataatggtcatggctaacatttactgaatgcttgttatctaccagtctgtgctgggagcctattgca

SEQ ID NO: 11807 - DNA, 201 bp, Homo sapiens
agcttaatggggatggcattgaatctataaattactttgggcagtatggccattttcacgatattgattcttcctatccatgagcatggaatgtacttccrtttgtttgtatcctcttttatttcattgagcagtggtttgtagttctccttgaagaggtacttcacatcccttgtaagttggattcctaggtactttatt

SEQ ID NO: 11808 - DNA, 201 bp, Homo sapiens
aactctttgggaggccgaggcgggcagatcatgaggtcaggagaccgagaccatcctgaccaacatggagaaaccgtatctctactaaaatacaaaaaagyagccaggtgtggtggcatgcacttgtagtatcagctactcaggaggctgaggcagaggaatcacttaaaccctgcccagaggcagaggttgcagtgagcc

SEQ ID NO: 11809 - DNA, 201 bp, Homo sapiens
tccattttctcaggaggtctaactcattacagttccatttaacccaatcaaaaccaatgctcccctttccctcacatctttaccgcattcttttaaagaarcatacgcacaactctttgagcaagaaatatcaggcaaccgctgccatcttagctaaaaaatcttttatgtttgagaacttacctggaagagtcctctgga

SEQ ID NO: 11810 - DNA, 201 bp, Homo sapiens
attgtaactggtgtgagatggtatctcattgtggttttgatttgcatttctctgttggccagtgatggtgagcattttttcatgtgttttttggctgcatmaatgtcttcttttgagaagtgtctgttcatgtcctttgcccactttttgatgggattgtttgtttttttcttgtaaatttgtttgagttcattgtagatt

SEQ ID NO: 11811 - DNA, 201 bp, Homo sapiens
gctaaattatttttcttaggtaaacataggaggcaagagattaaaagggtgggagaaacattaattaggctatgctcttatcaagtagtgtgaccttagcraatttacctaatctttttgaacctcagtgtcctcatttataaaatggaggcataactttttatgaagattaagataatgtgtgaacaatctgtgcagtag

SEQ ID NO: 11812 - DNA, 201 bp, Homo sapiens
accctgtcaaaactctcaggagttcgagaccagcctggcaaacatggtgaaaccccgtctctactaaaaatacaaaaattagccgggcatggtggcagaascctgtaatcctagctactcgggaggctgaggcaggagaatcatttgaaccggggtggcagaggttgcagtgagctgagatggagccactgcactccagcc

SEQ ID NO: 11813 - DNA, 201 bp, Homo sapiens
tccaggatacatgtgcaggatgtgaaggtttatttcgtaggtaaatgcgttccatggtggtttgcagtacctatcaacccatcacctaagtattaagcccygcatgcattaactatttatcctgatgctctctctccttctactccccagcaggccccagtgagttttgttcccctctctgtgtccatgtgttctcattgt

SEQ ID NO: 11814 - DNA, 201 bp, Homo sapiens
agtactaccgtgtagggtgacatagacctactggtgaggttaattcaggataaagaaataaagagatacaatatgtaagaaggacaggcactccatttacstatagttaaaaatgacaaacaacaaaatagctaaataccatttttttaattcaacaccaaagacagacacagattccattctagagcaagatttgaagat

SEQ ID NO: 11815 - DNA, 201 bp, Homo sapiens
ctagaatcaaggatcagagaagcatcaacacatgcatcaacctttctccaattttccttccctttcccaactccctcagccttaccctctcctctcaggamctgcattattgcatctcttcttttggatttggtaattctttccttagaaagaggaacagggctaaggataggcaacaggggcccagctgtccatgtctcc

SEQ ID NO: 11816 - DNA, 201 bp, Homo sapiens
ccaaaatagggataataatagttcctacatcatagaggttttgtaaggattaaatgacttcacgtgtaccatacttggcatagcgcgttgcccagagcaastgtattatgagtgtttgctgttgctgctgtgttgtaaggtgtgtgtgctggaagaactgtgtagcagcctttccactggctttccaaaatcacaaaagga

SEQ ID NO: 11817 - DNA, 201 bp, Homo sapiens
cctactattcattttttcattcatttgtttatttcattcaacccacactgagagactattttgtgccaggtatgagcctatgtgcaaagtatgtgcaagtrttcacagaattgtgtgtaagacaattgaatgagttttgggcaggagaagatactagatgcatatctcaattctatttctaaagatgtattaaaagaaaat

SEQ ID NO: 11818 - DNA, 201 bp, Homo sapiens
gtatctagggttatgtagagtcacaaagtaaatataatacatttttttctgaagctaattttaattgttaatatggagtaaaagtttaaattgaaaccaarttgatatattatgcagaagaatgcaaataagcataaatctttaagaaaaaaacataagaattcaaagacatttcatttttattgtgaatcttctctattt

SEQ ID NO: 11819 - DNA, 201 bp, Homo sapiens
gtatacatgtgccgtgctggtgcgctgcacccactaactcgtcatctagcattaggtatatctcccaatgctatccctcccccccgccccaccccacgacmgtccccagagtgtgatgttccccttcctgtgtccatgtgttctcattgttcaattcccacctatgagtgagaatatgcggtgtttggttttttgttcttg

SEQ ID NO: 11820 - DNA, 201 bp, Homo sapiens
tcctaagatagaactccaactctttgccctctagcacatagccatctgctcggccacatccacacagttctctcactctttcaaaatgtcagcaccagttycagaaggagggactggcccttgtgatggccataatgtaaagtgttcacacgaccaggtagcatttccattcttagaaagctacgcttcttagaaagctac

SEQ ID NO: 11821 - DNA, 201 bp, Homo sapiens
taccaggttggaaatcattctgttatcagctacctgccaacctgacatattcttcctatcactttccccacctcttttgctgattgcagaggggctctttrgagcactttgaaaagccacctgattaaagccttcattaggctagaagcagaagtgcttcacaggccaggcaagaaatactttgtaattgcttctgacggg

SEQ ID NO: 11822 - DNA, 201 bp, Homo sapiens
taatttgttgtactttatattttcagctatccttgagaatggtttctgcttcttacattctcaatgatagacaagtctgacacatggagtttactttaaasggttaggcaatcccatgggttgtggcccatagggtgataacaatagaatttccttttgtctgaccttaaaaaaggatatcagataaatactgcttccttg

SEQ ID NO: 11823 - DNA, 201 bp, Homo sapiens
aataagtcatcaatagttaatgataaggaatcagtctgctgtgccatattggtagatgaaatgctgctactcctcctattcctgggcttttctgccccccmcccccttccttccctccttcctctgtccctccaactcttcttcacatctcccaactcccccaattcacttcttttccactgcatgccatgttaccctatg

SEQ ID NO: 11824 - DNA, 201 bp, Homo sapiens
aggcactcatgtgaaagatcagcactcacatttaggaattggatacagctaacagcaggggaattgataggctcatgaaaagagcatgggtagaggatgayatagaaaattaagcacagttagggaagacttaccagccaggttacaagaagcaaacacctatcccaccgattcagaataccttgcctcactcctgcatga

SEQ ID NO: 11825 - DNA, 201 bp, Homo sapiens
tgattttttaaaaattaaatgcccattaagaaaattatccacattcatgttcccttggatgctttcaaatattttattttcctttgcttttggcagttacratctatcagtgttatttgtaaaatgtcttatatttgtatagggtatgttctccctttcctcttttcttcttttctttttaaactaagatagatgtgttat

SEQ ID NO: 11826 - DNA, 201 bp, Homo sapiens
taggttcagtcaactcatttaagttcgcttttccaggagtcactggggaccaggaatgagtcctggtgcatggtaatcccatgcagagttcccagccatcyctctgtcagcccagcacctgtgtcttcccacatccactgtcaatgccttccctctgagatttgctcagagtgcgcctgtcttcgcaatgtccccatctct

SEQ ID NO: 11827 - DNA, 201 bp, Homo sapiens
gtatattaaaatcacagtgatgtatcattttataccaactaaaatagttaaaatttaaaagacggacaacaccaaatattggtgagcattagaactactgraattgtcatactttgcacatgggaatgtaagatgataaaaccactttggaaaaattgcagtttttaatatagttaaacataaatctaaactaagacttcg

SEQ ID NO: 11828 - DNA, 201 bp, Homo sapiens
tcagagtcagtctctctctctctctctctctcataaaggggttgagccttgcacaggttaaacatgaccctttatttagtttatttcttcaacgattggtwgctcagtctcctttaaatctttttgactggtccccagtctagtttctcattaacctacatctgataaggttcagtgtgatggaaaataagaagaaagtaa

SEQ ID NO: 11829 - DNA, 201 bp, Homo sapiens
gttggctctatgctgacccaaaatgaagtcttttaagagattagagtactacactgtctacatttaaccaggtgtcatataacaattaatgaaaattcaaygttttatacttagaatttttaagtaataacagatgatggatcaagattaaaactgtattgacagcctaagcaaagaaataaaatctaacaaaagaagctt

SEQ ID NO: 11830 - DNA, 201 bp, Homo sapiens
aaaaaaaaaattatgatagtgctagtcaatactgagttgactgtcaaaaataagcacactttacattagccagttacttctgggacactgttgaagagtaygtcacatgtacccacaaattagtcaaacatctttaggcatcacatgatatctaaattagtctttttctccttctccatcccctggttgtccatgaaatat

SEQ ID NO: 11831 - DNA, 201 bp, Homo sapiens
caattatttctctatggcttcataaagaaaatgtcaatccaaggctgaggatttatttatgaaaatctaaagacagccggttttcctgatggttcatgccrtgggggaacgggtctctttcccaatatataagaggacaaatcttgggatgggttttttttttttttggtcttttatgacattctttaatgatttctcctg

SEQ ID NO: 11832 - DNA, 201 bp, Homo sapiens
aggcatgagggtcgtgggcagtgacacacacacacccttagaaatgaataccagttctttaagagaaagcagaaaagtcatattaccatttctgaattccytgagaaataagaagaataaaatggacaataatattagctatgggcatgaaaagtacaaaaagaacccataatcaggttcatttatatatgcatgcatatt

SEQ ID NO: 11833 - DNA, 201 bp, Homo sapiens
gggcagcggttataactgatgttagaattttcctgtatagcttctagctgttagaaaataaaccattgtttttcaatgaaaaacagtctctaagaagataygtattctttgttgttgttgttgttgagccagtgtaagctactcttgtctcaacacctaaagggagctcttaacatttgtagagatttcattgagttatat

SEQ ID NO: 11834 - DNA, 201 bp, Homo sapiens
aggtgtctgctggtctagtacagtaagtgtgaatctttggcaaatctgcacagatcattttgctcaatagtttcaaactctgagcaccagaatagaggctyaggtttagagcacatactacaagatcatcttgagaatctcaaaaaggtatttttttaaatttcatagtaaaattatcacataggccagagatgacactgc

SEQ ID NO: 11835 - DNA, 201 bp, Homo sapiens
tatgtattctccaatttaatgaacaacgttagctttgtctttcacacatctgcttatcttctctagcttcatgtggttgaaagcagaagatatgacatacrtagcatggaaaatgtgatgtgggtgaaaggaggtttctttctttttattctcagaaatgtctttttcacaatgaaaccagcaatatttattgtttttcct

SEQ ID NO: 11836 - DNA, 201 bp, Homo sapiens
tttaatcttgccaacgtggaggtctttggcctctaagtgcacaggaatatggtgagtgacactgggacttataactggagaagatggcagaattcatcttygttgcctgcagctttccaatcctgagcccttttccactttcatcgtgtttccatctccatcattcctttcattcagggttttcatgatcttattctatca

SEQ ID NO: 11837 - DNA, 201 bp, Homo sapiens
gtgctggtctctcatgccaggtccccttctcttatttgcaaactgtctctgtttgatattaaaatttgtaatggggaaacactcactggtttctaaaaccstatgtagatttaagtagttgatgattctgtgaaaaaaccaaataccttctagagaaaacatacaggttgggcagagcccaggtattgatgtccttgatga

SEQ ID NO: 11838 - DNA, 201 bp, Homo sapiens
tgcgggctttgggataatgtgtttgttgttgctttttttcttctttaaaaaaaatactcattttattttaccctgtcttgcttgctgtctcttgttgctawctctcatgctatcacttaatttcttctctggattttcttttgggttgtcctctttcttccttactcattttcctccctcttccccatctccgttccgttt

SEQ ID NO: 11839 - DNA, 201 bp, Homo sapiens
taaataatatataacttataaataaatatataaagttatgattttatagtttattaaatccagagtttttcttttgttgtagccctgcctcttaggcttgrcaattggcttagaagttatcctcaagagagaatctttctttttcttttcttttctttttttttttttttttttgagatggagtctcactctgtcacccag

SEQ ID NO: 11840 - DNA, 201 bp, Homo sapiens
tggaatgggtaaattatttctacttgatagactaggaaagtgagtcacaaaaaggctcgcccagagctactggttattagttgtgtgtttttctctcctaytccacactcgagaaaaccccgaagaatagggggtggttaatggtaaaaagaaatctagaagaagagttctggaaatgaaagacagctaggttttgagttt

SEQ ID NO: 11841 - DNA, 201 bp, Homo sapiens
gaatctataaccttccccaactatttccttcctgacttaaaatgtagattgttacatacacgaggatgaggggcagacaaagaactgctgtccagactgayccccatttcacggtggcaaagtgttctccttccaaaaactggaactttgaaaacagattgataatattctatcagtgtcatatttggggaaactggatat

SEQ ID NO: 11842 - DNA, 201 bp, Homo sapiens
gctgggattacaggtgcccgccaccacacctggctaatttttgtattttttgtagagaccgggttttgccatgttggccaggatggtcttgaactcttgasctcaagtgatccgcccacctcagcatcccaaagtgttgggcttacaggcgtgagccactgtgcctggccaacagaacatattttaatgtctgaaaaaaaa

SEQ ID NO: 11843 - DNA, 201 bp, Homo sapiens
ggtttgttcagcttttagagtagccctgtataagaatacttatatttagaaggttgtttgcgcttcagtcaaactagcaaatgaggcatggggcaaataaytcattctcatgcacatgtttctaaaacagttcttactaatgtttgagataaattaaaataaacaccaacaagaacatgaaaagagactaagaacaatgtt

SEQ ID NO: 11844 - DNA, 201 bp, Homo sapiens
ctttgtaggattttgcagattaagccttagcactcattttgtgaggacagtgaatcctaattcctcttcttcattctttctgtgacctttttgattttgcytctttagtaatctcctcactgcccttgtaatgcaaaaaataagaataaaaatggtctgtttgggtgctgtgagtcttggcaattaaaacttcacatgaaa

SEQ ID NO: 11845 - DNA, 201 bp, Homo sapiens
ttctcctgtccttctgattcctaaaactcaaaaccagaatgaagtaaggctacaaaatgtcatttatggggatgggtgaggcttaagtctcctggaaccaycttgggtcactcagctctacggaagacccccccaagacggtctagacccagagtcattctcagtcacacagtagttaagaattcttcatcctacggtatg

SEQ ID NO: 11846 - DNA, 201 bp, Homo sapiens
acatattagaaactgatagaaaacttctgatgtatcagtaagatgataattacccttgtaacatttctggaagcatgtatgtatgtatgtatgtatgtatstatttaaacgaatgcttgtatatctagcatctctttcaattgactcaatacccaaggaattttatctccattttacaaataagagagattatgacttatt

SEQ ID NO: 11847 - DNA, 201 bp, Homo sapiens
ccttcacccaccagcgcagtactgccatttcttctttcccctggaattctctatgtttagtgagcgagtttaagaatggaggatgctcagggatcttcttytcttatatagagactgggataatttgagtgttccatgttctgacacaggtggcatggatgaaggggtgtcactgaagaagctttggcaaaagctgattta

SEQ ID NO: 11848 - DNA, 201 bp, Homo sapiens
gtagtaccagctacttgggaggctgaggcaggagaattgcttgaacccaggatgcagaggttgcagtgagccgagatcatgccactgcactccagcctggygacagagcaagattccatttaaaaaaaaaaaaaaaaaagaaaaaaaaagaaaaaaaggctggaaattctcttatttgcaacaacatggatgaacccggag

SEQ ID NO: 11849 - DNA, 201 bp, Homo sapiens
tagacatggtcccagctctagtagagcctgtgatctggtggagaaacaggcactaaatcaatagctacaagagtgatgaatgttacaaaagaagagattcmagatgctacaggtacatagagcaggaggatttaacctaatctaggggatttggggagttttcatttaactctgctgttgtctaactgaatgaccctgagc

SEQ ID NO: 11850 - DNA, 201 bp, Homo sapiens
caaggcagcttttggacccaattatgcatgcctctgaaacacatgttctgcaccacaccattttttctgttatgtttgagagataaaaagttgtccgtctrtctacctctccaggctaatgtctcaccacattcaatcaaacttctccttccccaggccaggattcatgcagtccctacctgtaatgtgctttttcatatt

SEQ ID NO: 11851 - DNA, 201 bp, Homo sapiens
caggatcttgctaggttgcccaggctggtctcaaactactgacctcaaatgatcttcctgcctcagcctcccaaagtgctatgattataggcctgagccaycttttcattatctttcttcagatctcaaattatttgtcactcactggaagtgtacagctaatctgaagtggccttccacagttcccatctcgctcattac

SEQ ID NO: 11852 - DNA, 201 bp, Homo sapiens
agaaaattaaagggtaaattttaaaatttttgttccccagacatagactgggagaaaatattttcaggatatatatctaaaaaaggacctgtattcacaayatatgaggatctcctgcaaatcaaaaataaacacaaacaataaaaataggcactttataaaaaagatatgtgaatggtcaatagtcccatgcaaagatat

SEQ ID NO: 11853 - DNA, 201 bp, Homo sapiens
caaggaaccttaccaagtagatgacatttctcacttgttcctctcacttgttcctctcacttcctgttgtagtatcatcttctatttattctccttatcaycagcagatcaaaacaatgagggcattgatctatcataagaaggctgccttcaggccctattcttttttttttttttttttgagatggagtctcactctgt

SEQ ID NO: 11854 - DNA, 201 bp, Homo sapiens
cctgactagaacttccaatactatgttgaataagagtggtgaggaaaggcatcgttgtcttgtgccagttttcagggggaatgtttccagcttttgccctkcagtatgatattgactgtgggtttgtcatatatgactcttactattttgagatatgtttcttcaatagctagtttattgagaattttaaacatgaaggga

SEQ ID NO: 11855 - DNA, 201 bp, Homo sapiens
taaaaattcagatttacttctggcaaattcattcaggaattcaaactcagataattaaattaatttcttaatattcaaataaagaccagatacacattggyatcatctctcttgtatattcagagtaccagataaatgggatttttcactagggggacaggattgctacactacaccattgccatttgcattcacaacacg

SEQ ID NO: 11856 - DNA, 201 bp, Homo sapiens
aagatgtatttattcaaattcccactatgtgttttactagctgtatgtctttcagcagctcacttaacctaactgcaattctaattagtcatgtaatagtyatccctgtcccaaaagacggttgtgagaatcacgtctaattaataactgtaactaaaaagtgtgtgtgtatatatatatatgtatatatatatatgtgtg

SEQ ID NO: 11857 - DNA, 201 bp, Homo sapiens
gtgcatataaaagtatgtttataccatactgtgctttgttatatgtgaaatagcactatatcttttaaaaaaatactttgataaaaaatactttactgctmacaaaaatgctagtgatcaacagtattcagcgaatgtttttgctggtagagggtcccgtcttgatgttgatggctgctgacagatcaggatgtgggtgct

SEQ ID NO: 11858 - DNA, 201 bp, Homo sapiens
aggagataagtgaggagtctaggtcaacaattcaggtaagagatggtgatggagttaagtggcagtgaggatagaaaggggtaggcaggcagaagggaagrgtttgtattgagcaattgggaggttgtgggtgccatttgatgaggccaagaaaccagatcacaaagcaaatgtggaggctgctgggaggttgatgaatcc

SEQ ID NO: 11859 - DNA, 201 bp, Homo sapiens
ggaaattgcacagccaccccaacattcagtaaccactagcctgatcagtggttatcaaaactgaggcagaccctacaccagcaaaaagattacatctcacwgaaggctgtcaacttagatgactgttagcattttttttaacaataaagtgattttaattaaggtttgtacattgtgtttttagacataatgctattacac

SEQ ID NO: 11860 - DNA, 201 bp, Homo sapiens
ggtagtgtgatgcctccagctttgttcttttggcttaggattgacttggcgatgcaggctcttttttggttccatatgaactttaaagtagttttttccarttctgtgaagaaagtcattggtagctttatggggatggtattgaatctgtaaattaccttgggcagtatggccattttcacgatattgattcttcctacc

SEQ ID NO: 11861 - DNA, 201 bp, Homo sapiens
cttgtgaaatggtcgcctctcatgccaatcttggaagcgtaacattttcttgaccactttagttctaatgacttcacgtttatcctgaactagaaatatgstatcttcttggttgtttattctctttcttcttccctctttatatctctccatccttctttcttccttcttttttcttccctctatttcttccttctttcc

SEQ ID NO: 11862 - DNA, 201 bp, Homo sapiens
gttagcatatgtatatataaattagataatgttaatttacaaattaaggagagctataacttctatgacctatatgtgtctttctatttagtgacatgatmtgtctctccttttgcttaaattttattttatataatttcatatgtctcatattttgttaggtttatctctaaaagttttttcttctctgtacctaattat

SEQ ID NO: 11863 - DNA, 201 bp, Homo sapiens
gaccaaagatttcctctaagcatggcttttcctgtttcccatagattatagaatatgagtgcttttacatttttattgttctaggaaacctgcaaaatggsctgtattacattcgacccaagaattaagagagagttttaaaatttctgattggaatgggattctgtttccgatcttgttgttaacatctagttattacac

SEQ ID NO: 11864 - DNA, 201 bp, Homo sapiens
aaaggctttcatacctctgccctgcataggtcttgttcagagaagtgggtgcactgtggcagaaacaattctctactaacccatttggaacaataaagaartaaatcctaatccaccaaccttgaccagacagctgaaggttgtgctcacttggtactgaccttgtaaagatggattgcaattttggggagtcgattttat

SEQ ID NO: 11865 - DNA, 201 bp, Homo sapiens
gtacaagggccaaccatacagcctcatagtttcaagggtgctttgggagtcagatggacttgagtttaaatcttgcctctgccacataaaagctttgtgarcttggacaagtcatttacttctctcagcctcagttttctcatctgtaaaatgagataattatggcatcttatagaattgttgcgataatttcagatagtc

SEQ ID NO: 11866 - DNA, 201 bp, Homo sapiens
ttttttcagcaggtttctgtttttccacttaaaattgcttccaaatttctgagtttacttctaataatgggtatgctctccttgctatttttatctctagrtaattgttgactgcttgtagttttttcttgttgggcatgaatgactggcttcatcttccaaaagtgttacaaaacaccagttatttctttgagctttaga

SEQ ID NO: 11867 - DNA, 201 bp, Homo sapiens
ttaatggaacccataactgttttgcctactggtttccaactgaggattaatataacagtttccactcaacaattgtattgcttttttatcccccttatttycttttctttcttcatatgagaatattgagaataagagagattaggaaatttacactgcttctgagggacaaggcagcttttggacccaattatgcatgcc

SEQ ID NO: 11868 - DNA, 201 bp, Homo sapiens
atatattttgtgtgtgtactttttgtagagacaggatcttgctaggttgcccaggctggtctcaaactactgacctcaaatgatcttcctgcctcagcctyccaaagtgctatgattataggcctgagccatcttttcattatctttcttcagatctcaaattatttgtcactcactggaagtgtacagctaatctgaagt

SEQ ID NO: 11869 - DNA, 201 bp, Homo sapiens
taattgatgaagcaaggtacggaatgaggcataaaatggagagatcagagttagagcaattgataattatttttctttcagacaggttaaaaatatgaatstttggatgtaaccgagaggaaaattgagggagcttatgcctgatgcctctacattttctctaaagtaggagatgcgggaaggggtcagtagagagttgtg

SEQ ID NO: 11870 - DNA, 201 bp, Homo sapiens
ttctctaaaaatattgaaaagttaaagtttccttatccactttctcctcaaccagagctgcttctcccaaaatcccaagggaatcattattttgagtttgmtgtagatacttcaaacgtttaaaatatgtatttacatgcatatatatatatacatctagaaaaatactagcatatgttattttatgtagtttattcagtt

SEQ ID NO: 11871 - DNA, 201 bp, Homo sapiens
gataagattttgccaggtcaagaaaggaaccggtcaggtagaacattagtttacgtattagcacttacttcataaaggcatggaatagactgcggaaaatsaaggttgctggactttagggtggaactggtgagagaagagacaggagactgagtaaatgcagaaagggtggccatgtagcctatggcagatattttgaat

SEQ ID NO: 11872 - DNA, 201 bp, Homo sapiens
atttaaaaaaaataaaggagattggcagattttaaaaaggcttttaaagatatataagtgcttattttctctctgaggaaataaagagcaaaagaaaactwaaaagttaataattttgcataagtataatttggaatgattcagtgtattttttcattatgacttcaaatcatttaatgtatcaaaaacatagtcataaac

SEQ ID NO: 11873 - DNA, 201 bp, Homo sapiens
tgaaggcaaagtattggggggcactgagaattagagagacctaatttagaatgatggggccgggggggacaatgatagctaaaattcgttgagcactcacygtctgcaggccctgctgcaagggcttcacaagtatcacctcatttaattttcacaatgggtcttggagaagagctaatgttattattgttgccttgttac

SEQ ID NO: 11874 - DNA, 201 bp, Homo sapiens
tcctcaagagagaatctttctttttcttttcttttctttttttttttttttttttgagatggagtctcactctgtcacccaggctggagtgcagtggtgcratatcagctcactgcaacctccatctccggagttcaagtgattctcccactgcaggatcccgagtagctgggattacaggcataccgcaccatacctgct

SEQ ID NO: 11875 - DNA, 201 bp, Homo sapiens
aggtctagaacaagggctgaatgaccagttttcaaggcctgtttttttgtaaggccaactgtggggccaactgtgttactagctaaggtatatttcaagakaactacaaaccctttttacagtcagatcagaaatagaatacaggacatgaggacaaaggaagaaaagagagctttcttggagcatatggaattaaaatta

SEQ ID NO: 11876 - DNA, 201 bp, Homo sapiens
aactgataaattttatttgaaatgttggcaactgatttagagggaggaaatgtggagggaagagatgtatatatttctcttctctttctgtttcatcactyatcccatcttaccccaacaaataacccagcccaacagagaggatactggggtgacaagtacatctggaacttgaggctggacccttcaatatgagtggct

SEQ ID NO: 11877 - DNA, 201 bp, Homo sapiens
aaaaaaccaatataacaatagaaaataatacaaataaaaatacatataacagctatttgcatagcatgtacattgtgttaaatattataagtaatttagarattagagtataggaggatgtacatagtttatatgcacataatataagacaccattttatataaggaacttaagcatctacaaattttggtattcacaagg

SEQ ID NO: 11878 - DNA, 201 bp, Homo sapiens
gaaaactaaaaatagaattaccatatgattcagcaatcctgcttctgggtttcagtccaaaataattgaaggcagtacgccaaagagatatctgcattccsatgttcattgcagcattaatcacaatagctaaaaattagaagaaacctgggtgttcatcctcagatgaatggataaagaaaatgtggtatatgtacacga

SEQ ID NO: 11879 - DNA, 201 bp, Homo sapiens
aggtggaaagcgacaagtatcaaaggaatgagtgacccctacgtgccaagcactatgttgaagtgcttacatgtgttgtctcatatgatcccccagcaggkggatttttagcatttcatcctcaatgacattcaaatgttaagtaatctgctctaggtcaaaagttactaagtgatagaacaaagatttaaactcgtttct

SEQ ID NO: 11880 - DNA, 201 bp, Homo sapiens
gtttccagtttttctgttctgttttttccccatctttgccaagatggccgaataggaacagctccggtctacagctcccagcgtgagcgacgcagaagacbggtgatttctgcatttccatctgaggtaccgggttcatctcactagggagtgccagacagtgggcgcaggccagtgtgtgcgcgcaccgtgcgcgagccg

SEQ ID NO: 11881 - DNA, 201 bp, Homo sapiens
ttactgcaattgtatttaaataccagcttaattagctgtactcatcctccttcccaatcctctttgaagtaggaaagtcccattgcttccgtttagctaaygctatgctcataccctagtttttaagctttgtagaaagtacagatatgactgccccatgtgatctctaagaagtctagatatttgatccacagaagcatt

SEQ ID NO: 11882 - DNA, 201 bp, Homo sapiens
ggcagaagttatcctttattcagtttcatctctttatgtcttaccacctctttgtgaactagccacttgccttgagggtttacaaattcaagatttctcarcacgattagccctaatagtatgctttccttccaaggtttccagattatccaatacagtattatttctatcccaatcatgtttaaggattattattttaca

SEQ ID NO: 11883 - DNA, 201 bp, Homo sapiens
aagtgcatgacaccatcttgtgtttcatccaagtgacacatctaggctaacccagcaagtccagtgtatgagttgtgggaattacattcttttgtagttayaatttcatgggtccttgtttttattattatttccattggatcatgacagccctaagagctgctctcgcagcatctctgtatggttttgttcttgtgtttt

SEQ ID NO: 11884 - DNA, 201 bp, Homo sapiens
aaaccccatttctactaaaaatacaaaaattagccgggtgtggtggtgtgcacctgtagtcccagctactcgggaggctgaggcaggagaatcgcttgaayccaggaggcggaggttgcagtgtgctgagattgtgccactgcactccagcctggcgactgagcgagactccatctcaaaaacaaaaacaaaaacaaaagc

SEQ ID NO: 11885 - DNA, 201 bp, Homo sapiens
gtggaagtcagtgtggcgattcttcagggatctagaactagaaataccatttgacccagccatcccattactgggtatatacccaaaggactataaatcaygctgctataaagacacacgcacacatatgtttattgcggcactattcacaatagcaaagacttggaaccaacccaaatgtccaacaatgatagactggat

SEQ ID NO: 11886 - DNA, 201 bp, Homo sapiens
attatgaataagtcatcaatagttaatgataaggaatcagtctgctgtgccatattggtagatgaaatgctgctactcctcctattcctgggcttttctgycccccacccccttccttccctccttcctctgtccctccaactcttcttcacatctcccaactcccccaattcacttcttttccactgcatgccatgttac

SEQ ID NO: 11887 - DNA, 201 bp, Homo sapiens
attttaattcttatttcagtataatttccatttaaatttaaaaactcaagcagtgtaaaatagttttcatcaaacacaatttttgttctaataaaactatmtttcacctaaagcactgaaaatttagcattgagtttcagtgtgctgttaagtataaaaatatactagattgtaaaaacttcatatcacgatataaattat

SEQ ID NO: 11888 - DNA, 201 bp, Homo sapiens
accccactgttaacattagacagatcaatgagacagaaagtcaacaaggatacccaggaattgaactcagctctgcaccaagcggacctaatagacatctmcagaactctccaccccaaatcaacagactatacatttttttcagcaccacaccacacctattccaaaattgaccacatacttggaagtaaagctctcctc

SEQ ID NO: 11889 - DNA, 201 bp, Homo sapiens
attcctgatcactagccaaactatatactacagtttggttcatccaatttaaatagctggcctgtaactaagaaaagaaaaatatattttgtgaagaatakgtatgaggtagagaaattagtggtagtatgatacgggaaaagagtaatgtcaaaatgcatggtaatttatgtgatatgccgaggactgcaagaagtcaag

SEQ ID NO: 11890 - DNA, 201 bp, Homo sapiens
ttacaggtgtgaaccaccgcgcccggcctccccacattggactttctaaggaatattacctagccacagatctacagggtgtgtttgtttcttaaagcctrtgaaaacccaccccttctttttggtttgtttcttttatacgacccttaaatgtctttctccagagccctgccacccaccttcttcctgcgcactctacct

SEQ ID NO: 11891 - DNA, 201 bp, Homo sapiens
ctgtgaagggtctgagactgcagcctacttgcaagctaacaagttaatctgccacaggtagatattatatatatgtatatggtgtatacagatatatatgkgtgtatagatatatctgtatatgtgcatacacacgtacccacactgctgtcagggtacataatgagagaagatacaaactctagatcaaacacaaagatc

SEQ ID NO: 11892 - DNA, 201 bp, Homo sapiens
atacatatatgaagttcataaataaataatatataacttataaataaatatataaagttatgattttatagtttattaaatccagagtttttcttttgttrtagccctgcctcttaggcttggcaattggcttagaagttatcctcaagagagaatctttctttttcttttcttttctttttttttttttttttttgagat

SEQ ID NO: 11893 - DNA, 201 bp, Homo sapiens
tggggggaggggggagggatagcattaggagatatatctaatgttaaatgatgagttaatgggtgcagcacaccaacatgccacatgtatacatatgtaasaaacctgcacgttatgcacatgtaccctaaaacttaaagtatataaaagaaaaaaagaattagtggctcttgcagttgttcaggcaagagatgaaggagg

SEQ ID NO: 11894 - DNA, 201 bp, Homo sapiens
ctcccatttgcattggctgcagactctctaagtattactttcccttccttgtggttcataccctaatcattgaatattgatgttctatttatttctatgcrctcactttgtttttgaccaagttatatagttatttggttttcaggtaatgctttcttacagttactcaagaatgtatgctagaaaatgttgcccataact

SEQ ID NO: 11895 - DNA, 201 bp, Homo sapiens
aagtgagctatctgaaattgctggactagagtgtgggctaaaagatgtagaaaagaaagtggtttaatggcttgtggagaaccttggatgctttgctgaakaattagaatttaattgaaaggccatagggagctatggagaaatttttaaagagaggggtggacttgacctgtattttcagatgcaaagtaaagagagcaa

SEQ ID NO: 11896 - DNA, 201 bp, Homo sapiens
ttctgctatccatctgtgccaatctgaactgaatcagagtatcatttccttttttttgcatgtgctggtgtctcctgtgttggccttttagagtctgacayggtatttgggaccctccatgagattggaaggagttccattaagtgatagataaagatgtagccagtagaggccaaaggtactcaaatactttttatttaa

SEQ ID NO: 11897 - DNA, 201 bp, Homo sapiens
aagaatagtagtttaggcaaataaagatactttcttcctacatatcaagaagttccaagcgaggcagcccagagctggtaacagcccaacaatgccgctakggaatatagtccatattttgctccaccacacatagcatgttggctgcgatcctcaggtttgttaccttatggttacaatatggttcccacacatccaggc

SEQ ID NO: 11898 - DNA, 201 bp, Homo sapiens
agaattgcttgaacctgggaggcggagattgcagtgagcagagatcacgccactgcattccagccagggcggcaatgcaagactctgtggccaaaaaaaawaaaataaaaaaaaaaaaaatgggtgggagggagggtgtttactccctgccctggagatttgtataaacaggaaaagaagactgttttcttgtttagtctt

SEQ ID NO: 11899 - DNA, 201 bp, Homo sapiens
ttataatgttgaagttatcagacttttcttttatggcatccttatttcgacacttaattagaagggaggacttcatattctagagtggtaaagtaattctycatggttttctcttagcactaccatgttttgctttatattattcattttcataatttttaatgtattcctgtagaggacgtgaggtattgatacaaattt

SEQ ID NO: 11900 - DNA, 201 bp, Homo sapiens
ctatttgagtttcacttaaaagcattctgacatagctcacctcccctctttctcttatattgctacccataaggactagagaaaagatggataacataatsctgagtctatgagttgctagaaattcctcattataattgtgtgtcttctggcaaaaataaataaataactttctcttttaaagccacttataggagacaa

SEQ ID NO: 11901 - DNA, 201 bp, Homo sapiens
ggctgatttgggaaagttcaacagccccacttagttgctctgtgacatcctgacttcctacaggttacttctcatattgttgggtgtttgtttgtttgttwgtttgtttgtttgacagaggtctcactctgtcaccaggctggagtgcagtggcatgatctcggctcactgcaacctcctcctcccaggttcaagggattc

SEQ ID NO: 11902 - DNA, 201 bp, Homo sapiens
taagtttcatggttgtttcttctgatgtaaaagtaactgtagttatagatcctccagcacatgtcacactgaaaacctaatcacaaagtcaaaatatgtgyataaatattagcttgattatgtgtcacatgtaccccaaattacacatatatataccttcctcaaagatttttttttttgtggggggacagtctcactctg

SEQ ID NO: 11903 - DNA, 201 bp, Homo sapiens
cacatttccacacttaggtatgtcaaggaagccatcctgttgggagattacatttatctcaggtaaaaatgccaaatgacacaagacttagagtccccaakcatcttgacattcatgaatctgatatttttgaatcattgttctatgtttttcctccaaggccaaagaaccctattgctaatatcttctttcgtcattcct

SEQ ID NO: 11904 - DNA, 201 bp, Homo sapiens
aggttgcccaggctggtctcaaactactgacctcaaatgatcttcctgcctcagcctcccaaagtgctatgattataggcctgagccatcttttcattatytttcttcagatctcaaattatttgtcactcactggaagtgtacagctaatctgaagtggccttccacagttcccatctcgctcattacctggataatttc

SEQ ID NO: 11905 - DNA, 201 bp, Homo sapiens
ctttcaaggatgctacattagaaaactctctttatatttgagtttgtcaaattccacagaaacttgtctttataggggttggaagagaaaacattgctatrgtacttataaaacattgctatagtacttattgatgaccaaaataccttcatatcggttattacatttgagcctcactccatcctgtgaaggacagggttt

SEQ ID NO: 11906 - DNA, 201 bp, Homo sapiens
tcaagatgtggagggaaaagcatgagctttggggtcactcatgcagacttgggtaggtaactccctgctttttgtttactagttgagtgattacctcctgmgtctacatgccattcagaggtaataccatcatctttgtagttggggatggcttagaatcaagtgacatgtgcaaggtcatctaatctagtagttggtgca

SEQ ID NO: 11907 - DNA, 201 bp, Homo sapiens
cctcctgagcacctgcgattacaggtgtgcaccaccatgcctggctaatttttgtatttttagtagagaaggggtttcaccatgttggccaggctggtctsgaactcctgacctcaagtgatcagcccatcttggcctcccaaagtgctgggattacaggtgtgaaccaccgcgcccggcctccccacattggactttcta

SEQ ID NO: 11908 - DNA, 201 bp, Homo sapiens
gggcgtggtggcgggcacctgtagtcccagctacttgagaggctgaggcaggagaacggtgtgaacccgggaggggcagcttgcagtgagccgagatcgcrccactgcactccagcctgggcgacagagtgagactccgtctcaaaaaaaaaaaaaaaaaaaaaaaaaaaaagaaaaggtggtcccctgagcttcggcatt

SEQ ID NO: 11909 - DNA, 201 bp, Homo sapiens
ctggacttcaataccattttggttcaacatgtgttttcttacactgataacaagaatgggggctcctaaaagcatagatgttctttatgacatcaacctcraaaatgtaaaggatatattcaaaatataactcctctaaagtaagtaaccatttatccaaaaatttagagggtatattcaaaatataactccccaaaaata

SEQ ID NO: 11910 - DNA, 201 bp, Homo sapiens
cattgcttttgtcttctaaggttttatatctaaatagaaaggctggggaaatggtccactgacaggtcaaaagcaagatttctagtgtcatattattgggracacacacgaagccagaaaatccatcatttcataacttttgtagcacttcacactattctaccaccacatagatgtttgcttccatatttgtctgaacat

SEQ ID NO: 11911 - DNA, 201 bp, Homo sapiens
tagccagttttcccagcaccatttattaaacagggaatcctttccccattgcttgtttttctcaggtttgtcaaaaatcagatagttgtagatatgcggcrttatttctgagggctctgttctgttccattgatctataactctgttttggtaccagtaccatgctgttttggttaccttaggcttgtagtatagtttgaa

SEQ ID NO: 11912 - DNA, 201 bp, Homo sapiens
tagtctattgtattttttaactgaaccttttttgtttttcacacacatgcatgcacacacacatagacaaatatatatatgcttatgtatatgtatatgtrcatacacaatgaatgtatatgtatatgtacatacacatatgtatgtatatgtatatgtacatacacatatgtatgtatatattatttgtatatctaaagt

SEQ ID NO: 11913 - DNA, 201 bp, Homo sapiens
tactccttccctgagcttgttccttcctttcaccaaaacacacatattccatctttcaactctcctgctctacacgtgtatgcttgagtttagggccctgraataagcaatcctgggtcaacatctgctctgcaaacatcaaaaagtgtgagcaggggcagcctagccttggtattgatgtgtttcccatccacagccaca

SEQ ID NO: 11914 - DNA, 201 bp, Homo sapiens
aattgatttggttgttcatctgattcaacccatgtcagagtttgaaagtaattatgatagtggggctgataggcaggcaattacatttttgttctcttgcyttctggctccttctccctctctttcccttcccacacctccacctgcaaggttgttcttgtcaggaaggcaatgtaagcaggagacgagagagtaatcttt

SEQ ID NO: 11915 - DNA, 201 bp, Homo sapiens
aggattgaaactctctcaaagccacaatgtatgtctgtgttgctttgcactcttacattgcccatcctttacaacagcccttctcctgtccttctgattcytaaaactcaaaaccagaatgaagtaaggctacaaaatgtcatttatggggatgggtgaggcttaagtctcctggaaccatcttgggtcactcagctctac

SEQ ID NO: 11916 - DNA, 201 bp, Homo sapiens
actggtatatcaatctctaattggggaaatgatttggctgcagcacaaaggagcccctctctgtctaacattaggtttgccccttgagctttctgcaggcrgagattgatggtggtggcgtgatggtcaaggaatgtgtcctcagatgaggctgagcagaattatttctttgtaaattttctttttcccctttcttcctcc

SEQ ID NO: 11917 - DNA, 201 bp, Homo sapiens
cagtacccagtatatcctgaatttttaaggcagcctctccaagaacattctgaggtgttctggtgtctttagtaatcttatctcctaattttggttcttgsctggaatgaagaaaattactggtctgtgaatctttggctcttgtcattgtaagacttagggaacaatgctgcaatttttgcagcctctgtaatgaccaga

SEQ ID NO: 11918 - DNA, 201 bp, Homo sapiens
cacatggacacaggaaggggaacatcacacaccggggcctgttgtggggtggggggaggggggagggatagcattaggagatatatctaatgttaaatgaygagttaatgggtgcagcacaccaacatgccacatgtatacatatgtaacaaacctgcacgttatgcacatgtaccctaaaacttaaagtatataaaagaa

SEQ ID NO: 11919 - DNA, 201 bp, Homo sapiens
tgcattagtttgctgaggataatggcttccagctccctccatgtccctgaaaaggacatgatcttattgcttttaatggctgcatagtattccatggtatmtatataccacattgtctttgtccagtctatcattgatgggcatttaggttgattctgtgtctttgctgttgtgaatagtgctccaatgaacatatgtgtg

SEQ ID NO: 11920 - DNA, 201 bp, Homo sapiens
tcctagcagaaaaattatttttcagccttctcagaagtactaaaagtcctttgccaacatcagcccagtgcaagttaacctgttatgagatttgttttgtrctttggaaatgcttgtcagacaagctttcaacattgagatgtgtgatttaaattagtttgcataagaaaatgtaatgccagggacaaatttctctcttta

SEQ ID NO: 11921 - DNA, 201 bp, Homo sapiens
ttctgccatcctttcaaaggggtagaagtctgaggaatacccttcctcagataacagcaactatgaccagcctggcccacaccatttcaatttcatggctsttgtctcattttgttctgttatccctctgaggtgtgtagcccgagtgtcatttcagtgttgaggaagttggggcccagggaagttaaatgatgtgtgacg

SEQ ID NO: 11922 - DNA, 201 bp, Homo sapiens
aaggtcaggagatcaagaccatcctgcccaacatggtgaaaccccgtctctactaaaaatgcaaaaattacctgggtgaggtggcgcatgcctgtaatccyagctactcaggaggctgaggcacgagaatcacttgaacccagcaggtggaggttgcagtgagccgagatcgcaccactgcactccagtctggtgactgag

SEQ ID NO: 11923 - DNA, 201 bp, Homo sapiens
gcacctgtagtcccagctactcgggaggctgaggcaggagaatggtgtgaactcaggaggtggagcttgcagtgagctgagatcttgccactgcactccakcctgcgtgacagagcgagactctgtctcaaaaagaaaaaaaaaaaaaaaggttaggtgattgtggtggtgcatgactgtagtcccaactttgggaggctg

SEQ ID NO: 11924 - DNA, 201 bp, Homo sapiens
tacccaccacctacataataaaaaaagccacaagccccagccttgggggaattgtattgatttataaagagagaggctatcacttgctgttctcattaacytggaaatagacaccacattttatctgctgctctgtttcctgctgtagatctgtgtagtaaatccattaatctgtctgtccattcatccatccatccatcc

SEQ ID NO: 11925 - DNA, 201 bp, Homo sapiens
tggggtgccatcacccatgcccatgtagaatgttcatagataaatgttgcatgggttctgactgttccaccaaccagctgttcctccagccttctccctcycttcaggtttccctattctctttgatacaataatattgacattaggccaattaatagccctactgtggcctccaagtgctcaagtagaaagaaagagttg

SEQ ID NO: 11926 - DNA, 201 bp, Homo sapiens
gctgagcagtgacttcttcctggctctactgtgggcctcctgatggatggacatgggccctgtggtaaagagatggttctagaaatgcacagaaactatcrattccaagttgacaaatgagaaacaaatccaatctcaccagccaatcgggactcatcattttgccaaaacaatgcccatagattgcctaccactattatt

SEQ ID NO: 11927 - DNA, 201 bp, Homo sapiens
tttccccagcacttaagagagcagggctgtgtactgttcaaaaagcactttgtcatttctcgaagtactcttagctttgtgtggctgtctggacacaagcrtcagcatctccaggagaaggaggaaatcgagtgaagtgagagcatggaggggccagtatgccacttcctagggaaaggcaaaggcatttcttctcaggaa

SEQ ID NO: 11928 - DNA, 201 bp, Homo sapiens
cgatccttctgcctcagcctcccaagtagcttgaactacaggaacccatcacagtacccagtatatcctgaatttttaaggcagcctctccaagaacattytgaggtgttctggtgtctttagtaatcttatctcctaattttggttcttgcctggaatgaagaaaattactggtctgtgaatctttggctcttgtcattg

SEQ ID NO: 11929 - DNA, 201 bp, Homo sapiens
tcatgatattggttttgagagccacgtgggcagagaaataaattctagaaaaaaagaaatggtaatctgacatgcagacttggattataaatatggtcaarggtgtacttaaaaacaagatattttgcttcttggttagctttactgagaatccagggatcaagtaaaatcattgccattggtactgacggttgagagtca

SEQ ID NO: 11930 - DNA, 201 bp, Homo sapiens
agctgcatgctgggagaaccactgctctcttccaagctgtcagacagggtcatttaagtctgcagaggttactgctgtctttttgtttgtctgtgccctgyccccagaggtggagcctacagaggcaggcaggcctccttgagctgtggttggctccacccagttggagcttcctggctgctttgtttacctaagcaagcc

SEQ ID NO: 11931 - DNA, 201 bp, Homo sapiens
tggggctaataatacctcatgcatatggctgccaacgggagttagtgaaataatgtacatgaaatatttaacactaaacttggtgcctaatgtatcttcartaaatgataactattgtcatagtcatcattgcttttatacttttcggcttccagtgatttccagtgactacagccctaaggccattgggggatatctttt

SEQ ID NO: 11932 - DNA, 201 bp, Homo sapiens
tcaagacctccaagtgccctttacctccaggtcacctgtgttcctgcagcaagacacacctctgtccccaccatgaggcagaatgaggcttgggacagatragacttccagaacccagctccagcactgtggccactgtctgattaatcagttcttcttctgcactgataattaaatactcactgttaaattttatattac

SEQ ID NO: 11933 - DNA, 201 bp, Homo sapiens
gtttatgggtacatgtgaaggtttgttacctatgtaaacatatcatgcggttttgttgtacatatcatttgatcatctaggtattaagcccagtatcaaawaattatcttttctgctccctccatcctctcaccctccctgctcaagtagactccttgtgttcctaagtcatcatttagctccaacttgttgagaacatgc

SEQ ID NO: 11934 - DNA, 201 bp, Homo sapiens
atgttatagctctgttagatggcgtggtccctccagggctaacagcatctataatacgtatgtttccttattctcctccttacctatcagtatgtctgctstatgctcaggagtattccacagtggctcagtggcatgaataataggaaataatgtctaaatggactataagacataagctggctttttcaatggccctta

SEQ ID NO: 11935 - DNA, 201 bp, Homo sapiens
tgagttattttaaaaaataagaatccttcagtctctgttgcccattttctcctctatgaataatttctgcagacaggtgaccagttcaaccatctctctcrgttacaaatgcctgtggttggtccacttccttcagccttggagtaaaataaaggcttcttttgcaagatcacgaaataattcagcaaatactgtgggact

SEQ ID NO: 11936 - DNA, 201 bp, Homo sapiens
tcttaaattgctaaatggtaacgaaaatgagagaaaatagtacagttagctgtttgctttcgagtttgtggaaagtgattttctaatcaatgttactcttsatttcttaagcataacaagattaaaatgagtgtgaatataaaagatcatgataaaagataaaggatgatgacctgagatcttctttattttttattacta

SEQ ID NO: 11937 - DNA, 201 bp, Homo sapiens
tgaaataatattttgattatattgggctacacaaaatacattattacaattaatttaacatttctttgtacagtttttaaatgtgaatccttggaaattcrtaattgcatatgtggttcacattatgtttctcttggacagtgctgagctagtacattctgaaatatgtagcaattatttctctatggcttcataaagaaa

SEQ ID NO: 11938 - DNA, 201 bp, Homo sapiens
tgaggcagagggggcatttcccccgccacacacacacacacacacacacacacacacacacacacacagaggagaaggtgatggaggcagatactggagtraagcagccacaagccaaggaatgctgacagctgccagaacagtcaagaaacagattctcttttagggtcttcagagagaatgtggccctgctgatgtctt

SEQ ID NO: 11939 - DNA, 201 bp, Homo sapiens
agacatgatgggtctgctgcagtgtggtactaaatttggggttacaagaaatttttggcttattagtttcctagggcttctgtaattaagtaccacacackgagtgccttaaaacaactgaaatgtattatctcatagttacaaagtctagaagtctcaaaacaaggtgtcagcagagccatgctcccccctgcaatctgc

SEQ ID NO: 11940 - DNA, 201 bp, Homo sapiens
atgtcatagcccatatatgcatgtgtcttttgttcttattggaagagtggaaatgccatccaaaagtaacttactgctttttgtttcacttcttgatgcaygcacattctaccaacgctttttaacttcagcctaccgatgcatcaggtagaaccaaaaacaagaggtctcttgccctgtgcaagccaagcctttctgatt

SEQ ID NO: 11941 - DNA, 201 bp, Homo sapiens
ccctggtcattctttgaacacttcagatttccacagattctatccctttaacatttctgaacgttatgattttgcttcctccccacactggcagctctgcytcaatgaaaccgtgttgcttttttggttgatcaattgtgcccaacttcctgatcatacttgtcctgagagcctgtgttaagctcatgccggctctcccac

SEQ ID NO: 11942 - DNA, 201 bp, Homo sapiens
ctgggcgtggtggcgggcacctgtagtcccagctacttgagaggctgaggcaggagaacggtgtgaacccgggaggggcagcttgcagtgagccgagatcscaccactgcactccagcctgggcgacagagtgagactccgtctcaaaaaaaaaaaaaaaaaaaaaaaaaaaaagaaaaggtggtcccctgagcttcggca

SEQ ID NO: 11943 - DNA, 201 bp, Homo sapiens
cagtggtgtatatttcagatatttaattaagtcttcctttctgtccaactctctgccaaaacatatttttcatttttatacctgcaatgctcaaacataarttgatgccaaatgcatgctgtttgattacattccatccagatttacttccaagcaggacgaggcctgtagcatttatttcaagtagctttacaaagagcc

SEQ ID NO: 11944 - DNA, 201 bp, Homo sapiens
gaatttgatcctgtcattatgatgttagctcgttattttgttcattagttgatgcagtttcttcctagtctcgatggtctttacattttggcatgattttrcagcggctggtatcagttgttcctttccatgtttagcacttccttcaggagctcttttagggcaggcctggtggtgacaaaatctctcagcatttgcttg

SEQ ID NO: 11945 - DNA, 201 bp, Homo sapiens
acgattgactttcctaattcaattggctatttgacttccctaatagttaagttagatttgagccagggatttgaactacaaaaaccgtgttttttctagtytaccaccttatatagagagatatgacagaggggagagatgagaggtgtgtgggtgggtgggtgagggtggaggaggtggtactggatattactgaaaaac

SEQ ID NO: 11946 - DNA, 201 bp, Homo sapiens
aaaccaataggctcactttccaaaagaaaatctgaagcatttaagattatttaataaggaagaatttcctctggtgtcctgaatgaggaatctttggggcragaagggtcctgtcctatttattatccttaagaaattccttgctatttttagttctcaacatcagctacttctcattactaagtaaaagccagattactt

SEQ ID NO: 11947 - DNA, 201 bp, Homo sapiens
tgctttcatttggtaaactttgcaaagcagaagctttatcttaaaagttgttgtggttttgtattaagctcttttgaagtaactgatatgacttattttgmtttaagacttaaagtgcaatttttaataagctggtaccatttattaattacttactaatgatcccagcacagtgctttctgtatattatgtctcttcgtc

SEQ ID NO: 11948 - DNA, 201 bp, Homo sapiens
gttttaaattagcataggtaacatagagattattactcagttgaccactttgcacttgatctgagggacattgcagagtcatcacagattcttgagttatraggtcagtatttaatgaaaggatacgtcgaaggcttttccttaactttcaaggacctgtggggatagtttctactcaatgcttctttttattcgctttcc

SEQ ID NO: 11949 - DNA, 201 bp, Homo sapiens
ctggccactgtggtgaaaccctgtctctactaaaaatacaaaaattagccgggtgtggtggcgcatgcctgtaatcccaacgattcaggaggccatggcaraagaatcgcttgaaacccaggaggcggaggttgcagtgagccaagattgcgccattgcactccagcctgggcaacaagagcgaaactcatctcaaaaaaa

SEQ ID NO: 11950 - DNA, 201 bp, Homo sapiens
aagatctggaagtcacctctctgtaaatctgagaagttattttcattgttgttggatgataatgcttaagccagtgttggaggctgcacaagtaaattacrtggttttagaagcacctcctccttccatctgtgctgtttggttgtattctttattggatctgggatgatatgacttctttgcctggggctgttgctgcca

SEQ ID NO: 11951 - DNA, 201 bp, Homo sapiens
ttaaagccctaattttaaaaaatgctattctggccatcacatttacaatgtgaataatatttgagtcatgacgtaactataagttacttctaatgattgaytgtcacttgagttgtaaatcacagcatttagcagtgctagttgtccttacttttggtaaccccttagtccctggatcttgatcattttggggtctttact

SEQ ID NO: 11952 - DNA, 201 bp, Homo sapiens
tgttcattgcagcattactgtaccgcattatgaaatgggttccttcaccccttttctgagcaccctccatgtctacagaagaagttatgaggaacaaaggyatatgcagggctcgttttgtaatgctgacaacagcaatcctcacatccagacttccatgtccatgtacagggttctctactttcgttctaagtcaaactg

SEQ ID NO: 11953 - DNA, 201 bp, Homo sapiens
tatcttctctttttgctgagagcagtggttctcaaccaggacagttttgggggtgctactgtcatctagtgggtagaggccagggatgttgccaatcatcyagcaatgcaaggagagcctgcaacaaggaattatctagtcctaaatgttaatagcactcaggttgagaaactctattttaaagagaagaataatcatgat

SEQ ID NO: 11954 - DNA, 201 bp, Homo sapiens
ttcagcgaaagcaagtcacatgtctgagcttagtgtccagggctgggctcagtgatgttaaattgccaagggtatggagatggggagagtgaagaatttgrgacattaatacaatcaaacccaatcaaaccactacacaacattatgggagaaatcgctgaattttctttcttttttttttttttttttgagacagagtct

SEQ ID NO: 11955 - DNA, 201 bp, Homo sapiens
attatctttgtgtgatttatctttttctatcatcttattttcatcctgtctgtatcactctattagaattgaattctttgtagatagcatatagttgggtsatgtttttaatctattttgctattttctgtcttttacatatttagactctttatatttaatatcatcatttatatgtaagggtgtaagtctactatttca

SEQ ID NO: 11956 - DNA, 201 bp, Homo sapiens
ttctgtttccaataattggtattcaagttatctggaagaccttctgttttggaactagcagcaaagccagtttgttctacctagaaaaagcagtctcactrtatcatagaccattattttctatagcagccttgacccttagagttataattggctatttcatctcacaaacatcttcaaaatgaagttacctgcatgata

SEQ ID NO: 11957 - DNA, 201 bp, Homo sapiens
cactcctcagtgatggggtagctgctctttgaaagacaagcaactgtgatggggacctgtcagtcttccttacatgcagctggttctctaaatattccaaygattcctatcattttctgtaggagtacctgcaaaactggaaggctaggctgatggctttttctccattaagcagtaaacacgttaagcaagcttgagcca

SEQ ID NO: 11958 - DNA, 201 bp, Homo sapiens
agcactatcaatgtcagtcaagataacagttcatttatttcatagattactttgattaaaatcactattaaagctatttgaattatattataattttctgrtgatgtcataataaagaagtttttgaacgtgcccattttatttttaacgcttcaatgtgtattactggagaagaaattgaagtaacatatttttactgtt

SEQ ID NO: 11959 - DNA, 201 bp, Homo sapiens
tgaaaagtcttatacttgatctgtaactacaagatgttagatgttcttcatgcagatgacaggcaaaggttacttttacagttctatgaaagtaaaaagcytttaaaacatttgaatgggaattggtaaaagaagcagttcttaattatgtcaattgtctgtaagagctcaggtgattatggtaaacacacctgataacaa

SEQ ID NO: 11960 - DNA, 201 bp, Homo sapiens
agaagacaacatcacacctgaaataagagagattagaaggagccagtgataacagacctggaagaagggaattcaggacagagggagcagaaggctctaaygtggaaacaagaaggccagagtacccagagcagaatgagaaggggattcctaatcaggaaggaatcatatgtggttgttcactgagagcaatcattgaca

SEQ ID NO: 11961 - DNA, 201 bp, Homo sapiens
gagccgctgacttagagaaagtttccaacatattttgtttaaatgttcatcatgtttttgtaatttagacagtatacatcggtataagaaagatttttttyttgtccacatctcttcctcaattattgagactttaaaggattaaaaacaagtctatgtacttgacatgatgctgaaatttctcaggccttgggttttcat

SEQ ID NO: 11962 - DNA, 201 bp, Homo sapiens
ggaatgtagagaaggatgaggaaaccttctctgaaaaaaatgatatttgagcagaagagtgtgaaataagtgacagctaagaggaagaaaaaatgcattasagcttgcaaaaaattctgaacattagaaaaagtcagccatttctgggagagagttatctgggagcagcaactgtctcacaggattttgtccaaagtataa

SEQ ID NO: 11963 - DNA, 201 bp, Homo sapiens
tgcagtgagccacgatccacgattgtgccactgcactctagcctgggcaacagagtgagaccttgtctcaaaaaaaaagggggacttaggtagaaggtttyttctaacccttcccctttcctgtaaacattcttctcaatcccacgctgtctcctgtgccctgcctcctgcccatggtggcagacttcttcagtctgcatg

SEQ ID NO: 11964 - DNA, 201 bp, Homo sapiens
tttttacttttcttcaagtgggcttatcaaagtattttttttaaataaaataaaggcaagtctttctgtaagaaaaaaagtcagaaaaacattttcttctyattataggaccaaaagtgcccttagagatcaagtagcccagtgatccccagactttgcttgttggtcgcgataccctgggcagcatttgaaagccaggcc

SEQ ID NO: 11965 - DNA, 201 bp, Homo sapiens
tttttcttttgttgtagccctgcctcttaggcttggcaattggcttagaagttatcctcaagagagaatctttctttttcttttcttttcttttttttttwttttttttgagatggagtctcactctgtcacccaggctggagtgcagtggtgcgatatcagctcactgcaacctccatctccggagttcaagtgattctc

SEQ ID NO: 11966 - DNA, 201 bp, Homo sapiens
gcaggagtgaagtgatgtaatctcagcttcctgcaacctccaccccttgggttaaactgattctcctgcctcagcctcccgagtagctgggattataggcrcccaccaccacacctggctaatttttgtatttttagtagagatggggtttcaccatcttggccaggctggtcttgaactcctgacctcatgatccacccg

SEQ ID NO: 11967 - DNA, 201 bp, Homo sapiens
ttgctgtcccttggatggatttttgttgctttcatcttctttgatgcccttgggggcttgattgtggtataaggtaggttcagtcaactcatttaagttcscttttccaggagtcactggggaccaggaatgagtcctggtgcatggtaatcccatgcagagttcccagccatccctctgtcagcccagcacctgtgtctt

SEQ ID NO: 11968 - DNA, 201 bp, Homo sapiens
gtatctggatgatgctggcctcatagaatgagttagggaggagtccctcctcttcaattttttgaatagtttcagtagaaatgtgtactagctcttctttstacctctggtagaattcagctgtgaatctatctggtcctgggcttttttagttggtaggctattctctactgcctcaatttcagaacgtggtctattcag

SEQ ID NO: 11969 - DNA, 201 bp, Homo sapiens
atgtatcagtaagtcaaggaaaaaattaaatttgtcaataggtccctattctccagtgctgtcttttcaaagttactttgcaaggtattcagttttagtgmtaacgtatcaatcttttttttttggtgggcgggggatgggggcagggtctcactctgttgcccaggctggagtgcagtggcgccatctcgccttaccaca

SEQ ID NO: 11970 - DNA, 201 bp, Homo sapiens
attacctctcgcattttacaaatgagaacactgaggttcagggagattaggtaattgtcagaggttacaaagctcctcagtggtagagctctggaataagratccagttttatctgactctagtctagctcttaactgaatcccagaataccagaaccttggggcagggacaccccttgaaatgtactacaggggaatcta

SEQ ID NO: 11971 - DNA, 201 bp, Homo sapiens
aggaaaacccaacccaaactgccttaagccaaaggaaattttagagggtcccataaggagaaagtctaggggttgctctgggtctaggaataccttgatasaagatctcatgtaatattgccgggttttctgttctcttctttgaacttagttctcctcctcttgcctcatgatcacaaaattgatgcagcagctccaacc

SEQ ID NO: 11972 - DNA, 201 bp, Homo sapiens
ctctctgtctcttatttccttccattgtactctagtcctctagtcttagccaacaggttgtggctgctgcaatccccgaggctcttctacgctacctctgkgtccatgctttgctgtgtgccctatagactgttcctctgtatctgcctttgcaacagctgtctgctcatccttcataacagctcaaggggttaccaccta

SEQ ID NO: 11973 - DNA, 201 bp, Homo sapiens
atgtccttatctctgaaaacatagggacactgaaaagaatctgaacaagtaggccttgccgtgttacccccagtttattaacattagattgtactcttttrtcctccaattatacttccatgcacgactgtccactctttatcaaacctaagcataaaaatacccagatttccctgtgtcttcgggccttcatttctgaag

SEQ ID NO: 11974 - DNA, 201 bp, Homo sapiens
gctgatagatactgttgtctgtttcataggtgactttataggtcttgcatatgttctttcatttaatcttcacaccatatgatgcagtagaaatacatatstcccttatacagatggggacactgaggtttagagtttaatatcaccagcccaaggtcacattactagtaagtgattaaactggattttaaagcccatgac

SEQ ID NO: 11975 - DNA, 201 bp, Homo sapiens
atctttttggtcttggccgtgatggaagtctgaaaaacagcatttggcaagggaatgacccaaacagaataattttctatagacaaaatgtgtttaagttratgaatgaaagatgtgaatgctcatgctaggagaaggggaaaagcattggtatttcccttaaagagaccataccagggtattttatttcctgtaagtggt

SEQ ID NO: 11976 - DNA, 201 bp, Homo sapiens
tgagcggcagaggaaaaccatagaacaaactaagtaaaagaaattgagaaaatgtattctttggaaaatcagatattacgagatccttcagttaaatttaygtctctatttgctagaagagatatttatcagttccaaagcaacaagcctttcccttttggttttattagctacatggtaattgatatgaatttaaaagat

SEQ ID NO: 11977 - DNA, 201 bp, Homo sapiens
gacacttccatctttgaaatacccagaagtctgtttctccaatgccttgactctgcctaaagcagtctaccattaatctctgaggaatctcttcaaacagstttctgccaatgtatcactgaagccttttgagaaataagtgctgttccagcttagtcatatctcaaggcagcgtggcatgggaggtggagactacgagta

SEQ ID NO: 11978 - DNA, 201 bp, Homo sapiens
gggattggaatgggggtagataacattaataattttttttgaccaaataagcacccagtgataatgatccaatttaaccatccatgaaatatatgtttgcsgtacattggaggaaggttatgtgggggaggcagagtctgacggggttacctccggggagatttgatgcctggacagtagagccacagccccctcccccat

SEQ ID NO: 11979 - DNA, 201 bp, Homo sapiens
aatgatttcttctcctttgggtagatacccagtagtgggactgttgaatcgaatggtaattctatctttagttctttgagaaatctccatactattttccrtagaggttgtattaatttacattcctacagtgtataagcattccctttcctccataccttgttgttttttttgactttttaataataaaatatgtttttc

SEQ ID NO: 11980 - DNA, 201 bp, Homo sapiens
cacaaacctaaataggaagcagcatgatctaatggaaagcatatagtctttggaggttaacattggcttgtattttggatctgctttcaactggaaatatyagaaggatttagtcccttctgagccttagttttatcatttgaaaaatgggctagtaaaactttatttcacagggcttttgtgagggataaataagaaata

SEQ ID NO: 11981 - DNA, 201 bp, Homo sapiens
atgtgctaggcagagcccagtgttaggaaaggctaggcctcaggaaaggcatagtgtctgtcttcaaggtatggagtctgtctatgctagtcctcaggaarggcatggtgtatctgtcttcaaaacactgaaactctgcatttcccaaaggaggatggctaaaggatgagattcacataatgacattgtgaatgcagtgtg

SEQ ID NO: 11982 - DNA, 201 bp, Homo sapiens
tcatctttgtattgctactctctagtagagtgagtttactggttaaagcattttcattaaatgtttgttaagtgaataaatgttgatatatatatatatayacacacacacacatacatatatacatatatatctttatatattctcaccttcccccatccattatttctttggctaaggccacctggattttctctgttt

SEQ ID NO: 11983 - DNA, 201 bp, Homo sapiens
ctctgtgttttggtgttgtcattaatgctaagttacatttccttagggtatctgcattaagcaaatgtaagatgtttgagtttcaaagatgaacaagtgayttgtaagtgtaaagtggtatggctgtttttaataaataggtaataccacccttttggcgggtagtagagaaaagaagatgagtttttagaaaaagactca

SEQ ID NO: 11984 - DNA, 201 bp, Homo sapiens
agtggatctcagtctagaggtgagaagagggctaatcataataattgggactgagtgtgttagaattacacatctttcccctgctctgataaaaaatatcstgccatagagagtcactgatactaatcagagcatgtcatatctttcagatatttggggacagagaaaaaaaggtgatgaattacagtactagagatacta

SEQ ID NO: 11985 - DNA, 201 bp, Homo sapiens
aagagtggaaatgccatccaaaagtaacttactgctttttgtttcacttcttgatgcacgcacattctaccaacgctttttaacttcagcctaccgatgcrtcaggtagaaccaaaaacaagaggtctcttgccctgtgcaagccaagcctttctgattagcaatcctagagaggacaggtggctcacgcctgtaatccca

SEQ ID NO: 11986 - DNA, 201 bp, Homo sapiens
tttggtttttggtctttgtaagtgagagagagtaacactcttccttgactgtattagtcagggttctccagggaaacaaaaccaagaggagatatatatgmacatgatgattgttatgaggaactggctcacgtgattagggaagctgagaagtcttatgatctgccgtctgcaaactggagaggaagccagtggtatagt

SEQ ID NO: 11987 - DNA, 201 bp, Homo sapiens
aggctacctcattggaagttgagaggattaaatgagatgatatatttaaagtgcttaaattcttggctcataataagcattcagtaaatgtgagctattayttctctttctcctcctcatttttaattttttaaatactacctctattactattgtgaataatgtcattataaaggtgcaactagatcatgtttatgaagg

SEQ ID NO: 11988 - DNA, 201 bp, Homo sapiens
agggagagaatacattgaacctattcagcttggcggtcacgaccaagtgaggtgccattggatatgtggttacttgtgggtgagctcaagtagaagcctcrggctgggctcctctcctggggtggaacccttctgctgggctcctttcctcctggctccctgtactcactgctgctctctggtttaccagcatagaggcac

SEQ ID NO: 11989 - DNA, 201 bp, Homo sapiens
atggtggtccaaaagactgtggtgaggggatggcctcccaagaggcagggattgagccctacactgaccagaaatcactgcattacagaataatggagaargcaagacaatgaaactgagtttctctgaaagcttggcatcttggatatttcaaagattaaagttgtatttaatgggaatcacgtggttcaattaactggt

SEQ ID NO: 11990 - DNA, 201 bp, Homo sapiens
ctccccgccagagataaccaatgggagaattttgatatctatcattccagcttaatttctaagcatctgcaatccagggtgtgttattttgtttttaaagragttcattcactcatttaacaagtactaattgagcgcccgctcgatgccaggcactggaatcacattttggaagctgtcacactagcctgatttttcaca

SEQ ID NO: 11991 - DNA, 201 bp, Homo sapiens
tgtaggtgaaggaattgctttctggtaggaattacttgtttagaagtcattggctcagctaaggattttgtgggttgtcgcagtgcacagctgaggacttygtcctatttatgtgctgtctgttcagtatgaagtggcagccattgatccatctgtagtacaccatttgcctggggctatttatctggttgtggagatgta

SEQ ID NO: 11992 - DNA, 201 bp, Homo sapiens
gctaacctcagctcccatcccacttgctgaaaccttggctagaaccccaccctgctaatccatgatgcttcactatcccaggtgccgtcttatctctgctygtgcttgcccatttatcagggacatttctcccatttgtagccatatcttgaagtttaatttgagcctcacacactctgtgacactttgcctggccacctc

SEQ ID NO: 11993 - DNA, 201 bp, Homo sapiens
ggtcagcctttgtgttctattctgctcttcacccaattgcatgaagcctatgcacagtcaatctgttttattcaacctacaaatttaactgttaatctcayccaaaaaaacgccctcacagaaacaactagaataatgtttgttcaagtatctgggtacctgatagcccaatcaactttgcacctaaaattaatcatttta

SEQ ID NO: 11994 - DNA, 201 bp, Homo sapiens
attgaacaccctcttggtgcaatgtgccatgcttagttgttggggattacaaaggtagaatattctacctcaaagggcatagaagtgaatttttttttttwaaaaaaaactacaatacaaggaatagagtggtcatttgcaaaataaaatttttattgaattgctgaagcagtaaactctcagctgggagggtcagggaag

SEQ ID NO: 11995 - DNA, 201 bp, Homo sapiens
atggtctagttgggaagcttgtcaggcaaagaagtatatagcacatatcagagttgctctaatagcaggtagaatgtttgtaaagcagcttaaaagggagyatgttaccatacctgggtgtgggcgcgtgcctgtgcacttgaagtgagagttagggattggaggaaactttgcagagcaaattcttgggcaggacatgga

SEQ ID NO: 11996 - DNA, 201 bp, Homo sapiens
gtttacgctggagaatggtagtgacatcttcaaaggaagcttcttgagtgacctatgttatagctctgttagatggcgtggtccctccagggctaacagcrtctataatacgtatgtttccttattctcctccttacctatcagtatgtctgctctatgctcaggagtattccacagtggctcagtggcatgaataatagg

SEQ ID NO: 11997 - DNA, 201 bp, Homo sapiens
gaagctgggtaaagtcatttagtttattttgaagcctcagtatccttatttgtaaaatgtagacaggttattccctgtatactcacaaacttgtgctaagrctcaaatattctcatgtttgtgaaattagtttgaaagtgatgcagttgggaacgattactggataggttggaaggttgtccaactggtgcccctcatgat

SEQ ID NO: 11998 - DNA, 201 bp, Homo sapiens
ctgattaaataccttctttgtgtagatccttatataacatagagacagatataatccttctaaatggtctcgtaattttgtataaacccgagcagataatwgtattgggggatataggatttagagaaatttattctgataactatgagaagaaatttataggtcagtgtggcattatattaatcctttttcatcttatca

SEQ ID NO: 11999 - DNA, 201 bp, Homo sapiens
ccaaaagcttcctggtatcaaaatccaattgttgaaagcagagagaacatgaataagttcatatggaaggattttatggactaagactaaaagtagtccayattaattcagttcacattccactaaccacatggacacccctaacttcattggtgactaagaaatgtagtctagactattcccaggaataagaggaaatgg

SEQ ID NO: 12000 - DNA, 201 bp, Homo sapiens
tggccaacatggcgaaaccctgtctctaccaaaaatacaaaaattagccgggtgtggtggtacacgcctgtaatcccagctgtccagaaggctgaggcagsggaatctcttgaacccaggaggcggaggttgcagtgagctgagattgcatcactgcactccagcctaggcaacagagtgagaatctgtctcaaaaaatta

SEQ ID NO: 12001 - DNA, 201 bp, Homo sapiens
acaaagtagacattttcctctcccctgcttttcctgccacagccacacttcagcttctcaaggggaggggactgggtcattgtcatgaggtgatcatggastttgaaagatcttcaagctctacagccgtggtcttgtcagtttgggtgatttctgaaaggcatcttctctgatttagatttttcaacggagagacctggt

SEQ ID NO: 12002 - DNA, 201 bp, Homo sapiens
actccaaatcccatttgtaaaaactagcaaaagtgtgtaaattatgcattaaataagttgtaaggcatatgaattatatatgttcacaatgtaaaaaaaaraaaaaaaaaaaacaggtgtctgctggtctagtacagtaagtgtgaatctttggcaaatctgcacagatcattttgctcaatagtttcaaactctgagcac

SEQ ID NO: 12003 - DNA, 201 bp, Homo sapiens
acaaccagaaaggacagtgcaaatggccctcaaagcttgagcttagcaactgctcccctgttcttagtcttgccactgtgtggaatttaggacttatataygcagatagtttgttacttgcaaaccattagaccaagcttgtcctacccacagcacacagggcgcatgcagcccaggacagctttgagtgtggcccaacac

SEQ ID NO: 12004 - DNA, 201 bp, Homo sapiens
cgccactgcactccagcctgggtgacagagtgagactccatctccaaaaaaaaaaaaaaaagattggaagttctggaatacattggagaagatgaaaaggrgattggattagacttgcctaacaagcccatcatggtagccagagtcagacacaccaacagaaataaagatttcgctaaaaggcctagtagtatttttttt

SEQ ID NO: 12005 - DNA, 201 bp, Homo sapiens
ctgatgctccatcttgcaatctggagttattagcatcaaagaacaaaagcaaacagcaccagggctctggggctcagtcctctatgaaggtagatgaatgracccttatgtcggggataaagctaacaccacccggccttttatggagacaactcttcctgtgtttgaagagctcagacactgagagccagaaagagccct

SEQ ID NO: 12006 - DNA, 201 bp, Homo sapiens
gtatgtactaaagagggtatttttgaaaattacatgagataaaacagcctagaatgctatctgatgcaatagtcatccagtaaattttaatatcattctaytttgaaccaggttgtttatattaaatttaacagaattaagcaacatacagtagcgatttattctgtgggctctggagtctgcctgtaagggtttgagctc

SEQ ID NO: 12007 - DNA, 201 bp, Homo sapiens
gcatgttctcactcataggtaggaattgaacaatgaaaacacatggacacaggaaggggaacatcacacaccggggcctgttgtggggtggggggaggggrgagggatagcattaggagatatatctaatgttaaatgatgagttaatgggtgcagcacaccaacatgccacatgtatacatatgtaacaaacctgcacgt

SEQ ID NO: 12008 - DNA, 201 bp, Homo sapiens
tggctggatatgaaattctgggttgaaaattcttttctttaagaatgttgaatattggcccccactctcttctggcttgtagagtttctgccgagagatcwgctgttagtctgatgggcttccctttgtgggtaacccgacctttctctctggctgcccttaacattttttccatcatttcaactttggtgaatctgacaa

SEQ ID NO: 12009 - DNA, 201 bp, Homo sapiens
tcccattaacttcctgcatcaaaatgaacatttttcccctttgccctagttgatgaaattaacaacataattttttctcttttaagtcacatctttaaggrtatgaggataaggcagagggtcaggagagttagtagtggtcttgaactcctgacctcaggtggtccgcctaccttggcctcccaaagtgctaggattaca

SEQ ID NO: 12010 - DNA, 201 bp, Homo sapiens
ccaaacagtaccaaagagtttgtgaaagaaataattgtcccaaaggaaaaacaatgagcttatgaaaattcctttaagcaagagggaatttgagtgtgtcygtggaagctttatttttaggtcaattttagcgtctacagcattgcgtattctaccactaatcatctttttccttagcggaagtatcctgaaatttgatga

SEQ ID NO: 12011 - DNA, 201 bp, Homo sapiens
actgttggaacaaagcaaaatatttaagttcctgtcatcgtcccactgtggcttttgatcatttctttcagtagccagtttagtttaattatttatagaargacattcatagtgctagaggaaatgtcctataaagcatttatcaaagaatgagtctttgtaatctgagacatccccagagcaaaagcaaagtatctgggc

SEQ ID NO: 12012 - DNA, 201 bp, Homo sapiens
ggcagatcacttgagatcaggagttcaagaccatcctggccaacatggcaaaaccttctctctactaaaaaatacaaaaattagctgggtgtggtggcacrtggctgtaattccagctactcgggaagctgaggcacaagaagcagaggttgcagtaagccaagagcaggccactgcactccagccagggagacagaagga

SEQ ID NO: 12013 - DNA, 201 bp, Homo sapiens
aggaaaaaaaaaaaccctggaaggagagcttaggatatgactaaattgatgcaatctcatgataaaacttgtatggatgaggagttgcttcttatggattygcaataaaagagcagtttcttgagatggaatccactcttggtaaagatgctgtggacaatgttgaaacgacaacaaaggacttagaatattacataactt

SEQ ID NO: 12014 - DNA, 201 bp, Homo sapiens
ctcttaggcttggcaattggcttagaagttatcctcaagagagaatctttctttttcttttcttttctttttttttttttttttttgagatggagtctcastctgtcacccaggctggagtgcagtggtgcgatatcagctcactgcaacctccatctccggagttcaagtgattctcccactgcaggatcccgagtagct

SEQ ID NO: 12015 - DNA, 201 bp, Homo sapiens
acagggtcctgaggcgacatacatcctcctcagcttatgaagatgatgggaataagagattaaagtaaagacaagcataggaaatcacaagggtattgatkggggaagtgataagcgtccatgaaatcttcacaatttatgttcagagattgcagtaaagacaagtgtaagaaattataaaagtattaatttggggaacta

SEQ ID NO: 12016 - DNA, 201 bp, Homo sapiens
cttatttacatccaaatgaattcccaggagagttttccactgatgccgactggttaacagaagtacaggcgagcaggaatccctcgctacctggcctttcrttccctggttccatctggatctctgggaaaattttccatctttatttgccataaagtatgatttatttatttcaacgagtggctaagagccctggaatgc

SEQ ID NO: 12017 - DNA, 201 bp, Homo sapiens
actttaagttttagggtacatgtgcacaatgtgcaggttagttacctatgtatacatgtgccgtgctggtgcgctgcacccactaactcgtcatctagcaktaggtatatctcccaatgctatccctcccccccgccccaccccacgacagtccccagagtgtgatgttccccttcctgtgtccatgtgttctcattgttc

SEQ ID NO: 12018 - DNA, 201 bp, Homo sapiens
agtgcctagcacatagacagccctcagtcaatgtcagctggtgattttattaccttcatatatgagaggataagagtattataaaaatcaaccccaaaccyttcctcttgtcacacagaaggaaggcagacagacacagaagggacgcagctgcaggtgtttctgactccttgccttgctgcctccccatttctgagggtc

SEQ ID NO: 12019 - DNA, 201 bp, Homo sapiens
acgcaagtgcctgctgaaactcaagccttctcatcccccttggataatagaagtggggcgtcagtctgcctctgtctccgtgtctgtatgggaaacatggrggtcatggcatatatgacaagtgcacatgtgctgttccattcccacaaggagagaaacatggggagtagcctataattctgtgtctaccagactcctctt

SEQ ID NO: 12020 - DNA, 201 bp, Homo sapiens
ttttttcccttcaaaatacatataaagaatttaaaaatacatataatttttgacttcaggaatgtatgtttgtttacaagtaattttattgcaaaatatcragaatgttctgacctctatgtgaatggatgtacatatatctccccaaagtggtctatgtcaatgtcagataaaaagtcattcatgtatttcagatgagat

SEQ ID NO: 12021 - DNA, 201 bp, Homo sapiens
gtgtgtgtgtgtgtgtgtgtgtgtagacacagcaccatttttggtgaggatggcacaggggctctcaaaagaaggagttctcagaatcatagcaccaaaamgttgtgagtttgcaataatcagagtcatggtgagcatcatggaaatttagaactaaaagagatgttacagattatctccagtctgagtccctgccacaca

SEQ ID NO: 12022 - DNA, 201 bp, Homo sapiens
cctacattatgacacactaataagtggtctaccttgacccagagatacgaattttggcctcatttgtagaatagcacctggattcaggaataactccttgmagtgtcccccttaaatctctatgtggcattcaatgttcacttactcatagaccaaggagataaggacatttatcttctcaggtaaggtccctctgttgaa

SEQ ID NO: 12023 - DNA, 201 bp, Homo sapiens
cagcctccccagtagctgggattacaggctcatgccaccacacccaggctaatttttctatttttagtagagacgaggtttcaccatgttggacaggctgstctcaaactcctgacctcaagtgatttgcccgccttggtcaattaaagtgttgggattacaggcgtgagccacagcacctggccgccacaaacttttata

SEQ ID NO: 12024 - DNA, 201 bp, Homo sapiens
gtctgtaatgctttgttctcattcctgcatactgaaactcttcctgcaggtttttctctctggcagccatccccagttttagctgtggaaactcaagtagrcctctaacaaaatgttctgtggtggtgagaaagctaaggaaaaccagctgctaaaattacagcaagtctctggttgctgttgcttggtttctttccctgt

SEQ ID NO: 12025 - DNA, 201 bp, Homo sapiens
ataaaatctgatgctccaaaaattgaaaacataacttaccattcatctctgaatgtatccatgcattttttttttcattcaagttacatttttaaatgatktgcaagttctatagactgggtaacagtgtacataacacttaacaactaactaaaatcagtgaaacacatatcaatataaacaaagagctatggaaattaa

SEQ ID NO: 12026 - DNA, 201 bp, Homo sapiens
ctcaaacaaagaaatattatttggaagatgtgatttgatgttagtatttaatcaaatgtacttatttcacctacttgctgaataagcacccttctttactrccatcactggttttcatattgaggtatgtggatttatcctttatcattgctcacctttgaagatggtggcataattaaagaattacaaggggatttcaga

SEQ ID NO: 12027 - DNA, 201 bp, Homo sapiens
ttctgttctgttttttccccatctttgccaagatggccgaataggaacagctccggtctacagctcccagcgtgagcgacgcagaagacgggtgatttctscatttccatctgaggtaccgggttcatctcactagggagtgccagacagtgggcgcaggccagtgtgtgcgcgcaccgtgcgcgagccgaagcagggcga

SEQ ID NO: 12028 - DNA, 201 bp, Homo sapiens
ctcagagcctttgctcttgttgacctgagtgtcccatcccagataccgttgtatggcccttccactcaatcctttcccacctccctccaaatgttaccttrttaatgaagacttccctagctcattctattttatctgcctttcttccttatcccacctccctgcagttccttctcccttaccctgccttactttttccca

SEQ ID NO: 12029 - DNA, 201 bp, Homo sapiens
aacatagacagaggaaatggttccaggcagaatcaatggaattgaaaaaaatcatggtacttctgtggaacaggtagttggatgactgtaatgcacagggraaaaggtagacacaagttgacactggagaagtaggaggggatagagcaagaagaacttgacagaccgaggagtctggattgcttccaggacaataatcta

SEQ ID NO: 12030 - DNA, 201 bp, Homo sapiens
ggataaattccttgaaacatacactctcccaagactaaaccaggaagaaattgagtctctgaatagacgaataagaggagctgaaattgtggcaataatcratagcttgccaaccaaaaagagtccaggaccagatggattcacagccgaattctaccagaggtacaaggaggaactggtaccattccttctgaaactatt

SEQ ID NO: 12031 - DNA, 201 bp, Homo sapiens
tcattttacactgtgatcacaatttagagatgctattgaatgggctgccagtgtttgctttgtaatgttaggggcactcttttttctagtcttaaggcatrggttacagcacataacagaaaccatgcaggaaagacaaaaagaagaaagagagggagggaaggaaggaaggaagaaaaaagaaggaaagaaggaaggaag

SEQ ID NO: 12032 - DNA, 201 bp, Homo sapiens
tgcgtgtgcctgagcatttattgtacaacagatactgtgctaaggcttttataagctttgtattgcttaatgttcatggcagccttgggaagaaggtactrttagagtaggaatgctactataatcttccaactgggttgacattaattccttaacctgctctttttgacttttcttcttcaacccattgataatctaatt

SEQ ID NO: 12033 - DNA, 201 bp, Homo sapiens
gtttatctcatcctccttgacttctccacatctctaagtaggaagttatttattgctgctgaagttgtaaccctggtgatttcgctatcaacttacaaatmacttcctttccatatgactacagcatgtaagaatgctgaggttttcttttctccaaataaggcagaatgcttcaagaatattttatcgtcctatatggat

SEQ ID NO: 12034 - DNA, 201 bp, Homo sapiens
tgtatgccgagtaggaaatgttcatctttattccgaaggcaatggagggatccttcattgaaagccttctgagcaagggtgtaacatggtcagatttaagkcttattaagattgttctaggatcatctaggggatacagtgaagagaactttactgaattcaggcaaggcaaagagaaagctattgcagtcaacctagcat

SEQ ID NO: 12035 - DNA, 201 bp, Homo sapiens
cttgagagtttcagtaaggaaagtgaggctcacttctttctggaacattaaacttaagcaggaaggtgccacatgaagtattatatcataatggaagcaaygtaaaaagaagagtgagtcacttcatcaacttcacaatgcaaaggtgctaccataagtcataattctaatacaaagatttatataaataatgattctggg

SEQ ID NO: 12036 - DNA, 201 bp, Homo sapiens
agtataagtggataatgatttttttaaatcataagagcgccatgttgcaattgttattatcaccccacctcactgtgtgtgtgtgtgtgtgtgtgtgtgtrtgtgtgtgtgaagttaaatgatctttaatagtggtttgttaccaaaaaatccatgtaagctcaagtcacctaaataaaaactactgtataagaaggaggc

SEQ ID NO: 12037 - DNA, 201 bp, Homo sapiens
gtaaaggttacagaacacaatatagactacattatcattaaactacttgatagtcttatgactatttttatggtaatgaaacgtaatccaatgcaacttcrtatatgtaagtaaaacttcttaattcttgtcttgtaaaactgaatcttcatcctttgactgatcaactgaccagcttaaaccttggagaatcttaaactt

SEQ ID NO: 12038 - DNA, 201 bp, Homo sapiens
tcctttggaggaggagaggcgctctgcgttttagagtttccagtttttctgttctgttttttccccatctttgccaagatggccgaataggaacagctccrgtctacagctcccagcgtgagcgacgcagaagacgggtgatttctgcatttccatctgaggtaccgggttcatctcactagggagtgccagacagtgggc

SEQ ID NO: 12039 - DNA, 201 bp, Homo sapiens
gggtcactcacttgagaccaggagttcgagaccagcctggccaacatggtgaaaccccatctctactaaaaatacaaaaattggtcgggagtggtggcatrtgcctgtaatcccggctactcaggaggctgaggcaggagaattgcttgaaccctggagttggaggttgaagagagctgagatcgcaccactgcactccag

SEQ ID NO: 12040 - DNA, 201 bp, Homo sapiens
tgtcttccaaaagcttcctggtatcaaaatccaattgttgaaagcagagagaacatgaataagttcatatggaaggattttatggactaagactaaaagtrgtccacattaattcagttcacattccactaaccacatggacacccctaacttcattggtgactaagaaatgtagtctagactattcccaggaataagagg

SEQ ID NO: 12041 - DNA, 201 bp, Homo sapiens
atctgaaaacaagacaggctttattacctactttagagtcatttcacaatggaaggtagcatagcttgaggaaagtgtttcctccacagtgatcagggtgytttggccaaatttgttgtatttttcagtagtaaggctatagcatagtgattcagtgcatgcacttggagctagattagctgggtttaaaactttgttcat

SEQ ID NO: 12042 - DNA, 201 bp, Homo sapiens
ggccattacataatggtaaagggatcaattcaacaagaagagctaactatcctaaatatatatgcacccaatacaggagcacccagattcataaagcaagwcctgagtgacctacaaagagacttagactcccacacattaataatgggagattttaacaccccactgttaacattagacagatcaatgagacagaaagtc

SEQ ID NO: 12043 - DNA, 201 bp, Homo sapiens
atatggttttaacattattactttattggcacgaactttcctccattcttgtaatgacttgacagtctctttgtttgtggcaggagctgctttttttttckattatttggggccgtcttactctttccctgttttataggaaaagcttttagttttttgtttcctaacattggggtgtggactattactcacaagctggct

SEQ ID NO: 12044 - DNA, 201 bp, Homo sapiens
ggagggaaagtatgtgcttgtgtgttggggagtatatctttggtcttcatatgataggtaggagggagcatctgaaaaaaaaattatgtgtagacctcacrgatgcttatgggttgaaactggctttagtgactggtctacttcctcagttttacagattataaagtaataataataatagcaatatttgaacttaactct

SEQ ID NO: 12045 - DNA, 201 bp, Homo sapiens
aattttatttacaccaacacatatattttgaagagatgaatgaccaattctgggaatagttagaagtaaagaatttgaattttctgcagcactgctgcacrttaggtaaattcctctctttgggcctcacttgcaacaccaataaagagaggaagttatactagatgatctataagccccttccagccctaacatgctatt

SEQ ID NO: 12046 - DNA, 201 bp, Homo sapiens
cctcatgcatatggctgccaacgggagttagtgaaataatgtacatgaaatatttaacactaaacttggtgcctaatgtatcttcagtaaatgataactaytgtcatagtcatcattgcttttatacttttcggcttccagtgatttccagtgactacagccctaaggccattgggggatatcttttttataactgaattt

SEQ ID NO: 12047 - DNA, 201 bp, Homo sapiens
atttactggagctcctccccaaacccctaaactatgtgacattcttgctttaaaaaaaaatggattatacagcacgtgtcaccactgcattctcttttttrtgttgttcatgtgtgtctgtgaaatgtgccttctaataaaaatttgaggatcttatacttttccagaatcattttgttgaagtcatgttttggagtacat

SEQ ID NO: 12048 - DNA, 201 bp, Homo sapiens
tcttctgaaagattcataagtaattctctcctccagaaacttgggaaataaatgactagtgctcttatgagaagagtgaagagatgtgtcttgcttaacarcactaaatattctcccacttgctcactccctgtgttttttctttagattagaatagcgactgagaaacaataaccacagcagcaaaccatttcaggcaat

SEQ ID NO: 12049 - DNA, 201 bp, Homo sapiens
atatacaatgattttcaaagagggtgatttttcacccctcttctctccctgccccacatacaaaggagactttgcctatgtctggaaacatttttggttgycacaattgaaaaggaatgtatggaggtgttgctgttatccagtgagcagaggccacagatgctgctatacattttataatgcacatgaactctggaatat

SEQ ID NO: 12050 - DNA, 201 bp, Homo sapiens
tgtgaggacagtgaatcctaattcctcttcttcattctttctgtgacctttttgattttgcctctttagtaatctcctcactgcccttgtaatgcaaaaamtaagaataaaaatggtctgtttgggtgctgtgagtcttggcaattaaaacttcacatgaaatttgtctcctgagagaaaatattattctcccttttaata

SEQ ID NO: 12051 - DNA, 201 bp, Homo sapiens
gtgctaatctagttgttgctggagagcatccaaacctaaggcagaactcttgctccttggattgttaggcattagattggcagggtcttggactctggtamattctgcaggcctaagggagactggtcatccagccaggtgtagggtaaaggaattattgggaaatatacagtaagggaggcctgtgaggtcagtaccttg

SEQ ID NO: 12052 - DNA, 201 bp, Homo sapiens
tgtactgcagcctggggacagagtgagactccatctccaaaaaaaaaaaaaaaaagccatgctgcttaaaagatgtaattttcagaaaaattgtgctacarctaggatgtgatatttaattatttgagacatgttctataatcacaatcaccactgattagtagtcaaccatgttgaagttatagtacctgtgaggaaata

SEQ ID NO: 12053 - DNA, 201 bp, Homo sapiens
aggttttttactgactgcatattgaaatgaatatctaagagctaaatattttttcctaaagttcatcatgtggcaaatgtgtcacaccctccagggaaaayataccacaacatctggagacactgctatagggtagtggttcttaaactttagtgggcatgagaaacactggcagagcttctaccagaaacactggtagat

SEQ ID NO: 12054 - DNA, 201 bp, Homo sapiens
gttctgaaaaccctaacctagatataccttcagccaaaagagagacatgctaccatggttatcatccaaagccactctgtagaatatagcccaaacatcaytgtgtattaaaacatttctctttactgttttcacataaatagattaatttatacagatttgtatttatttacatatttgtgtatatgctgcactaaatcc

SEQ ID NO: 12055 - DNA, 201 bp, Homo sapiens
tcatctttctctgcattgagcctttgcgtactaatttatagctattttctcacaggatagtctatttccattatatctatattttctagtggtcctttgcrtttgcctcttttccagactgtatagggcatggtgccaggcacagtttatttgttttattctatatgctgatagtatcatcttttccatctttagatgttt

SEQ ID NO: 12056 - DNA, 201 bp, Homo sapiens
ttgtgtctccaaagaacattttgctaagtgccagagctgtatataacactaaagtagatgctgacatatgaggattgtgagagatgaatggtgatatttgrcttttgcttcccaagtataggtcgtgtccgaggtatagataattgttgttggtttatgataattcgacttgcggagttaggtcagtcagcatagatgcat

SEQ ID NO: 12057 - DNA, 201 bp, Homo sapiens
tattaagtttaggatcccgtggagaggcctatcatccgagagaccatcctatcatcaaaaggtgaatatcaggtcaaagcaaaagaaaccacattaatttktttctgttgtcagctcacaaagctattttaagcctttggacaataagaaatatactttttttcccctccaataaatatacattatccattaaagtagagt

SEQ ID NO: 12058 - DNA, 201 bp, Homo sapiens
gaatctgaccactgtgaatatctcaaggataccataagagctgatggacctccaaacgttagcatcactggactgagagaaagctcgttttatatctctayaggtactgtcataccaatgaagcaatgttcccaaactactatgtttgtgttagtcattttccgcttatcttgtccccaatcataaaaattaagcgatgta

SEQ ID NO: 12059 - DNA, 201 bp, Homo sapiens
tatcaaactagttgacatggtcaccacatcctttactcattctcttttgctaattactttcctttccaggtgatctctatatggctggtctggcccaaggsatgtacagcaacctcccaaagctcgtggcctctcgagatggctttcagggctgtctagcatcagtggacttgaatggacgcctgccagacctcatcaatg

SEQ ID NO: 12060 - DNA, 201 bp, Homo sapiens
cccgtctctactcaaaatacaaaacattagccaggcgtggtggtgggcacctgtagtcccagctacttggaaggctgaggcaggagaatggcatgaacccrggaggcgcagcttgcagtgagccaagatcgcgccactgcactccagcctgggtgacagagtgagactccgtctcaaaataaataaatacataaaataaaa

SEQ ID NO: 12061 - DNA, 201 bp, Homo sapiens
tgtctacatacacatacttaagacacacatagagagagagtgtgtgagagagaatcaactcatcataattgtaaaggtgaagaaaattgattccttaagaytaaaacacaccatattaaacttggagtttatattttgaaaataagattcaggaagtcttctaaagcattcgaagattgattagaaagataaatttcggca

SEQ ID NO: 12062 - DNA, 201 bp, Homo sapiens
tgccatgtccgtgatgtagttgcttatctaattttgtaatcttttatcaattccctctacagcttgaaggccaggctgagggtatggtacagaatactaartggtttcaaatcaagtccaatctctgttgcaatttttattgtgataacaagatatattattaataacaataaaagacaataataatgtattattatattg

SEQ ID NO: 12063 - DNA, 201 bp, Homo sapiens
taagagctacaatatcattggatgaagaagaaaaatttctgaacagaagcatagctcccaaccatatgttttccataccagcatctatacaggcaccaaamatcatggatgttcttatagccttgtgcctcacggcgtgaattgctcattgatcatttgaactcgtaacaatggaaacatcagttttaccaggcctcctgg

SEQ ID NO: 12064 - DNA, 201 bp, Homo sapiens
atggtaaataataaaacattctataaaccacacatcccatctaggactaatcattatattttccaatttaacattcattccttccagatatgttcttactygttctttaaaactatcataaatggaaagctaccatttaagcacaaataaaactcttaagaaagctaagaaaatctgaactcattaaatatttctaactag

SEQ ID NO: 12065 - DNA, 201 bp, Homo sapiens
ccagaatgaagtaaggctacaaaatgtcatttatggggatgggtgaggcttaagtctcctggaaccatcttgggtcactcagctctacggaagaccccccyaagacggtctagacccagagtcattctcagtcacacagtagttaagaattcttcatcctacggtatgccctctctagaaaaataatcgtaatgatgggag

SEQ ID NO: 12066 - DNA, 201 bp, Homo sapiens
ccttgtggtaagagttgaggttcccagccactatcatcacctattactcacttacaagaatttatctttactcagtcctttacttgatcatctcgaaaacygttacaaccacagcaattataatcatagcagcaacaataaagactagcaattattgaacacttaatgtgaacacatgtgaaatgtgtgtctacatggtgc

SEQ ID NO: 12067 - DNA, 201 bp, Homo sapiens
ccaaacagcagtctttacaagcccatgggtgggatagtaagaccagcttgtcactgtttgtgactctgcttctgtacctcccagtctgtgtgacatcttcycccatggggagccgtttctactttgtctttaattgctcctcaccgaggcgacttgtcagccaaggctgctttctgtcacttgatgccacatctcttccta

SEQ ID NO: 12068 - DNA, 201 bp, Homo sapiens
atttttagtgctcaatatatttaaaccagagcttctcatccaatataccacactcagggcttttggatagaccctctggccatgaacaatcttgtcttctyctctcagtctcgacaaatatattatttgctttttgacctatcatttgaaaaatattgggaaatgtcactttaaggaatatgcactagctctttactatga

SEQ ID NO: 12069 - DNA, 201 bp, Homo sapiens
ctgccatttcctctgcctgcaacagcccttccctgctattcacagtactcactccctcacttcacccaggtttccgcttatattgcaccttccagaaaggwccttcttgaccgtctgtaaaatacaacactctatcgccttttcctgttttgttacctctcatagcacttatcactgcctgacattatagctcacatttat

SEQ ID NO: 12070 - DNA, 201 bp, Homo sapiens
caattaaagtgttgggattacaggcgtgagccacagcacctggccgccacaaacttttatatgaccggatctcactgtcatgaggacagcaccaagccacragagatccaccttcatgacccaaacacctcccaccaggccccacctccagctttggggattacagttcaacaagagattcaggcagagacaaatattcca

SEQ ID NO: 12071 - DNA, 201 bp, Homo sapiens
cagtgtgataataaacgtaaaagtactttgaatattgcaaaacactgtatgaatgtcaggaattaggcaggcaacaactatttcttgggggtttgttctgyatgtagccctgcactatgtgtagatagaggcctctgtacattacagaagactggcagaggcattggggattcatcatggctggaattctggttctcagat

SEQ ID NO: 12072 - DNA, 201 bp, Homo sapiens
atggtcaatacaactactcttgaggattaggatggttttctcagtaaccgatggcttccctttaatgatataaaccttctcagggtctttcctaagcacarttctagattcatatttgggccagaagtccacactcaatctccccattccagtccatttcctatgactttgtgtcattggcaatgtccgctacgaaggatg

SEQ ID NO: 12073 - DNA, 201 bp, Homo sapiens
actaaaaacacaaaaattagccgggcggatgagggttcctataatcccagctacttgggaggctgaaacacgagaatcgcttgaacccaggaggcggaggrtgcaatcagccaagatcgcgtcactgcattccagtcctgggcaacagagtgtgaccctgtctcaaaaaaaaaaaaaaaaaaaatcttatgataacatgaa

SEQ ID NO: 12074 - DNA, 201 bp, Homo sapiens
gtatacctaccactcagcacagctcttggtacctaaggagatggtgattggagacctggaaatgaagaccaaagagatgctgagatggttgtagtttccartaggaagattagcaaccaggcaagtggcagatcagagcccaaatgtgagtggctcaactgctggaccctgtaagctgttgtggttctcaaatgatgtcct

SEQ ID NO: 12075 - DNA, 201 bp, Homo sapiens
tatatcacagctgccttaccgtatcagaacaaagagaaattctttttttttacagctctgtcatatttcattgaatgaacatgccttatttacttaactgytcctttactgtttgcagttacaaataatactgcaggtaacctcaaatatgtttcattttttacgcatgtttgagagtatgtgttgaatacaatctcagaa

SEQ ID NO: 12076 - DNA, 201 bp, Homo sapiens
ttttttaattttcaatgcataagtctttaagtgtactgtttgatataccttataaattatgctatttaggtcaattatagtcttacttttgactacttcayctatcattgaataagcaagatgatttaaagtgtcttatttctgttttttggctgaatgtttcttcagataactcttaagttttctgttttttgaatgtta

SEQ ID NO: 12077 - DNA, 201 bp, Homo sapiens
actgaggactttgtaggtgatggagccttttcacgtttttgaggtttgtggagttctttggaagttttcaggaccatttcataggaggggcttctaggagrccagagtcaaagtgcggagaccaagagtagctttctatctgaccttctgccctttgtgttgatgggggcacaggtagtgcaggagaaatctatttaggtg

SEQ ID NO: 12078 - DNA, 201 bp, Homo sapiens
tgtgtatttcaactggaagatgaaattcttcctttcccaggtcatttttgggagggttatcaagccactttcctctttaaaatgcaaattgaacaacatgrctttttttcccttttctctcttttccaaattcctggtcaccctacagacacttttggcttctgcaaatttgggggcccaccctcttcccccttcagtatc

SEQ ID NO: 12079 - DNA, 201 bp, Homo sapiens
cttcctggttccatttattctcttcctcctccaaagtaaccactacctgaagttgatggggagattttctgtatacatatttcttattcttgttacatacraatagagctgtagtatcaaataattagtgatcactatatagctatgtgtatgtatgtgtatatatatataaattagtgggggtcaattttatcagcccct

SEQ ID NO: 12080 - DNA, 201 bp, Homo sapiens
ttgagtcaatataatgtttaaggacatgagattctacagccaaatagaaggatttctattgctctttggttttgacatttaacttgaaaagtaacactaakaatgactaatctataatctaagattatataagtatatgtataattacatataattacatattttatattgtgtatatatgcatatacatggatggaactg

SEQ ID NO: 12081 - DNA, 201 bp, Homo sapiens
tgtctttccggacagatgtgaagcttacctctcttgctacatgcaaagtgaaaagggagcttggcccctcggcttgcatgggtggtttttgggtgaaggtrgaactaagtgctcagaagctgagtacctctggggcttgcatgaacttgatagtcatgcaagagcacattgcattgtgtgtgtgtgtgctgctaacactct

SEQ ID NO: 12082 - DNA, 201 bp, Homo sapiens
gtatgtatccctgctgaactccatgtctgtaaaatggggctaatgctacctatttcatttgcttattgtgtatgatataaaacagtgtttgcaaagtaccyggcacatggtaggctcttttcttatattgttccggctctcagcttgctttactcctggtattgctcctgtgtgtctctgtattaaagatcatggaggaat

SEQ ID NO: 12083 - DNA, 201 bp, Homo sapiens
ggtatctttcagatatagggtagaaattctctctgactaaatttattggtatctggtttatatacacatagctattctgtatgtatgtgtgtatatatatrtgtgtgtgtgtgtatatatatgtatgtatgtattttctattttgtgagtatattttatatgtatatattatgtatttggtttttattggaagagagtctt

SEQ ID NO: 12084 - DNA, 201 bp, Homo sapiens
agcgctttccaaaggtcatacctcccaacactgtggcatcggtgatcaagtttccagcacatggaattttgggagacatattcagagcatagcagcagaayatatttgcagcagaatatattccagggataagggaagaggacagggctctgcctaccgatgtgcttcaacaagggattacatgggggcaaagcttcattc

SEQ ID NO: 12085 - DNA, 201 bp, Homo sapiens
ctgtgcaaggctgttcagacccagtcaggtcaggccctgaatccttgtgatatggaatgagatatgataaattggaaattgtctttaataaattgccattygtgataattctagtgataattaatctgctgaggctgctataaaatatcatagactgagaggcttaaccaatgtatttccacatagttttggaggctggaa

SEQ ID NO: 12086 - DNA, 201 bp, Homo sapiens
aatctccccgccagagataaccaatgggagaattttgatatctatcattccagcttaatttctaagcatctgcaatccagggtgtgttattttgtttttaragaagttcattcactcatttaacaagtactaattgagcgcccgctcgatgccaggcactggaatcacattttggaagctgtcacactagcctgatttttc

SEQ ID NO: 12087 - DNA, 201 bp, Homo sapiens
tggtggacagtgactgtcatcagagaagtaaatgctatgtctgcaaaaaagaggtgagggcacagtgatgcgtagagacccctggctttaattatcccatsccttggtgttactggtcctctggagatctacttaacaggaagtagtgagctatgtccccacaaaagcatcccagaggccatttctgagcaggatggcctg

SEQ ID NO: 12088 - DNA, 201 bp, Homo sapiens
gttattaattaaacttactgtttaggaggatgatggagaaacccaggtcctggcaaaaacggtcacactactttaaagtttgggactaagaaggaaatgartaggatatcatgaaagtaggctctgtgattttcttagtttgtagggagatggtagaacttagtggttaagcacttgagctttgagctctgaaagatgtga

SEQ ID NO: 12089 - DNA, 201 bp, Homo sapiens
ttaaatggaactagttttcgagggtctgcttgtctccatgaaaagagaatgtatccttctgaaagtccttttgtttaaaaatatgatcaggctctgaaagmattttaggtcttgatactaactaacagaagacatgcatttattaaaaattgtatcacaaaggggtgaactggggcctgattgattgatgttgaaatttga

SEQ ID NO: 12090 - DNA, 201 bp, Homo sapiens
taatctctgaggaatctcttcaaacagctttctgccaatgtatcactgaagccttttgagaaataagtgctgttccagcttagtcatatctcaaggcagcrtggcatgggaggtggagactacgagtaattaaaaataactcccagctcaagcagggagagggctgtccctgcctcatctgtattcccatcacaggctccc

SEQ ID NO: 12091 - DNA, 201 bp, Homo sapiens
aaacaaaacaaaacaaaaccttccttcatgaattattattggccttgtatgcaagactgagttgatcccagtctcaatttacctgataccatctatttcarcaataacaataataacaacaataatgaatatttatttagagctttctctgttccaagcactgttctgaccactttatgtatatttacttggttgactcta

SEQ ID NO: 12092 - DNA, 201 bp, Homo sapiens
cctcaaactataagcttgatgaattttagagttcattgtaatgcttttggtttaggtgacaaaactgatgcctacaaagataaactgatttgctgaaggtmatggacctagtctttattggagttgtaattcaatcccaggtgtcctaaatctttaatccatgccattttattgatattatatattaagattttttttatt

SEQ ID NO: 12093 - DNA, 201 bp, Homo sapiens
tgcaacacaacagtcgtgcgatggcctttcctacatgccacacggatgcagccttctgataggagggcaaagtcggcacatccacacacacactggcataygctcttgcacacacagtctctgtcacatacacaggcgccaagggcttcattttgcttggtttcattccccttaacctctttccccactctacctccacca

SEQ ID NO: 12094 - DNA, 201 bp, Homo sapiens
ctaggcctgcctctaccccacacccacaggggaagacacctgctgacccctgagctggaggggtgctggttctggcctggagagaaggaggagatgggatmatgcacagcctcactggtggaggcgggatgttcagaaggagttacctccttcccccgtggagcaggaacatgtgcactgacaacatccccctacatctgt

SEQ ID NO: 12095 - DNA, 201 bp, Homo sapiens
gtagaaggcctcagcatctatacaagttagtaggataaaagctatcccatactcagaaaaaaatttcaaattagtatcatggttaagagcaacttgtctawcctgtggcccatagggcacatgtggcccaggatggctttgaatgtggcccaacacaaattcataaactccttaaaacatcgaggtttttgtattgttttg

SEQ ID NO: 12096 - DNA, 201 bp, Homo sapiens
agcaattcagcagaagtccaaaggtccagtgcagcagtacatgtgacaggtgatgttgcctgcatacacaaaattaaatggaactagttttcgagggtctkcttgtctccatgaaaagagaatgtatccttctgaaagtccttttgtttaaaaatatgatcaggctctgaaagaattttaggtcttgatactaactaacag

SEQ ID NO: 12097 - DNA, 201 bp, Homo sapiens
ttgcctgctagatttcaaaatgacttctcagagatggtgagttctgagctgggtggtgaaggatgtgtaggagtttgtcagataaggagatgaaacaggcrttccaggaaaagggaatagcaagttcagagacttggtatagtcctaaattatgtttgtcttcatttcagctagtgctatttcattgttgctggagataac

SEQ ID NO: 12098 - DNA, 201 bp, Homo sapiens
cgggaaccaagctgtagtaattattggttttttggctttccctcctgtagcacatacataaatgggaataaactgggtgagttcctgaactctttccgcarattaagaaagtcagaactttggaagaaaagtagggtacaagatacaaaatcttgctagtgattataactctaaacgttatagaacctatggccattttag

SEQ ID NO: 12099 - DNA, 201 bp, Homo sapiens
gttctccaatatctcaggcaaaattcctgggtctagctactcccctcatccttgtcatgcaaagaaccttccccagacttcagtgggagatctattgtttkatcatggggtttggcaggcacttcgttaaggtggtgtgatataattttctggacctaggttctggccctactgtgtatcagtctcttgagctatgggggg

SEQ ID NO: 12100 - DNA, 201 bp, Homo sapiens
attgacatgtatacatggcaaggtactatcttacaactgcaaacctaggctgctgaggaagtgcagcaggcatttggggtaggggtggggacaggattctrccacatggtctccatcacagctttaaaaaaaccagatctttttgtgttcattccagaagctgcacagtttctagagacttgtcttttcacaggaaatatc

SEQ ID NO: 12101 - DNA, 201 bp, Homo sapiens
caaaggattttgaagctcttgtgatagaaaccagggacaaagaccaaatatgtatttcttattatatcacaatatcacaggctgtcgctgtatccaaattycccccttcctgtaaggaaattaaaataaggccaaccctcatccagtatgaccttgtcgtaacttgattatacctgcaaacatcctatttccaagtaaggt

SEQ ID NO: 12102 - DNA, 201 bp, Homo sapiens
catcatcactggccatcagagaaatgcaaatcaaaaccacaatgagataccatctcacaccagttagaatggcgatcattaaaaagttaggaaacaacagrtgctagagaggatgtggagaaataggaacacttttacactgttggtgggactgtaaactagttcaaccattgtagaagtcagtgtggcgattcctcaggg

SEQ ID NO: 12103 - DNA, 201 bp, Homo sapiens
tagtgatggaaaaaaaatctgttccaattactgtataagtaaaatgcttcccttccacctccactaaagaaaaaaatggcactcactgctcaggatctgaratcgacagctgattctgcacatgcaaagccctgctgccatttgtcatttcaggaactgctttatttttgtcaaaatggaaggaaaaaaaaggagagagac

SEQ ID NO: 12104 - DNA, 201 bp, Homo sapiens
catgaacagcacctatgcccctggtacaggagtgcatttctccccaagcctacagtcttctgtgtgtcacagcaatgctgagtttcccacagaggtggcgytgatggactctttctcaactctttgctatggagtatcacctgggctaagaagttctgcttttgcatcaaatttcaatttttttctttttattggatttga

SEQ ID NO: 12105 - DNA, 201 bp, Homo sapiens
caacctccccctactccactggcccctgcagctacttagaatagctagctgttgattaaagggaccaagagtttgagcagttactgtatactttcaaaccycactgccatttggaagtgaagtcccaactgacatagccaaactgtaaggacaaaagcaactctaatacctgctttcctttgtttatagcaactgctcaaa

SEQ ID NO: 12106 - DNA, 201 bp, Homo sapiens
gtaaagattccaatggaccaatatggcttgtgacccatgcttcatttacctaaatgaggccacaaggctctgtgatcacgtggcagtcaaataacaaaacyctccaaaatcaggatttcttcttccattccttcaggttccctcccccatgggcatggttatctcatcctttacctcctggaaattatatattggaggttg

SEQ ID NO: 12107 - DNA, 201 bp, Homo sapiens
tgtctgtgttgctttgcactcttacattgcccatcctttacaacagcccttctcctgtccttctgattcctaaaactcaaaaccagaatgaagtaaggctrcaaaatgtcatttatggggatgggtgaggcttaagtctcctggaaccatcttgggtcactcagctctacggaagacccccccaagacggtctagacccag

SEQ ID NO: 12108 - DNA, 201 bp, Homo sapiens
acaaatgacaagatggaggcccagagagactacatggcttttccaaagttatgcaccacgtttgatgcagagacaaaactagaatcaaggtttcctggctkccagggtagggctctttctactccatcatgctgcctggtgggctgtgggcccttttccaagggtattgcagctgctgctgtgggggctgcctggggtgcc

SEQ ID NO: 12109 - DNA, 201 bp, Homo sapiens
tgaatactttaaaaagctggtggtgaatacgttacaggtggatcacacctgtaatcccagcactttgggaggctgaggcaggtggatcacttgaggtcgastttgagaccagtctggccaacatggtgaaaccccatctctactaaaataccaaaattagccaggtgtggtatccttcgcctataatcccagctactggag

SEQ ID NO: 12110 - DNA, 201 bp, Homo sapiens
cgcttctatccatatttggtttgctagacatgactccatcctacatgcaaaggaagctgggaaatgtagtcggctagtgcacccaggagaagaaaaactgrattagttgatatctagcacatgtaattctccatagtatctcatcatctttaaaattctttcctcactaggaaaaatccaacttttacatttggtttactt

SEQ ID NO: 12111 - DNA, 201 bp, Homo sapiens
tttttttttttttttttttttttgagacagaatctctctctgttgcccaggctggattgcagtggtgcgatctcagttcactgcaacctccgcctcttggrttcaagtgattctcttgcctcagtctcctgagtagctgggattacaggtgtgtgccacacaccacgtccagctaatttttgtatttttttagtagagacg

SEQ ID NO: 12112 - DNA, 201 bp, Homo sapiens
gtagcgaccaatttgttccaatttgcttacttctccagatctctctgtcagactttaagttccttgaatatagggtcctagtcttcttgcccatccttgtrtacatggtaggtgttccatcaatgtttcttgaatgaatgtataaaaagtgtattttaattgaaatcttaacaagtatgcattaaatgtatagttggtgct

SEQ ID NO: 12113 - DNA, 201 bp, Homo sapiens
gtaactctaagtgttttagtttttcagatggcaatttgtgactttctatagctttttcttgagatgaatttgtggaccagttgaatagtgatagaaatacrggacttgctaaaaattacaaagtgtttatggcagttctggcaaatatcctctagatcaccagataatgccaagtcagcaatattatcaataatgagttgc

SEQ ID NO: 12114 - DNA, 201 bp, Homo sapiens
aagcttctgcttatatcacatttgctagtgcccatatgcccaagcaagtctcacggcccacccagaaccccaagggtgaaaagatagattcaaactgttawgagaggagtaagagtctcactgccaagagacagattttgaaatgggattgtagctattttttttttttttccaatttaacacactggaaaagaagaaagg

SEQ ID NO: 12115 - DNA, 201 bp, Homo sapiens
agacttaagaaaggatgtgataggttctcctgaatgccattgccttctctctgtcttctaagcaacttctggttcaaagggagagcatgagctcctggggmtgtcagtgttcctactcagcctgtagatataacatccttacctattatacagaggacacgatatagaatccggagagaggaaaagcaaaggaggccagct

SEQ ID NO: 12116 - DNA, 201 bp, Homo sapiens
tccctattctctttgatacaataatattgacattaggccaattaatagccctactgtggcctccaagtgctcaagtagaaagaaagagttgcacatttctygctttaaatcaaaagctaaaaattaataagtttagtgagaaaggcatatctaaagttaagataggctgaaagctaggccttttaggcctagctgtaaagg

SEQ ID NO: 12117 - DNA, 201 bp, Homo sapiens
tgggttaggctttagaaatacaatgttgaacaagacaggtacatcgctgtttttatggagcttgctgcctagtggaatatttagccattaaataactgatyacaaacatggtgagttttataagaggcagagtgatgtattagttaagaacataaactctggggccagactgggtgagaaatctggccctcatgcagtgat

SEQ ID NO: 12118 - DNA, 201 bp, Homo sapiens
tcacctgaggtcaagagtttgagactagcctggtaaacgtggcaaaaccctatctctactaaagatacaaaaattagtcgggcatggtggcatgcacctgwaatcccaactactcaggaggctgaggcaggagaatcacttaaaccagggaggtggaggctgcagtgagccaagatcgtgccactgtacttggctctgtac

SEQ ID NO: 12119 - DNA, 201 bp, Homo sapiens
taggggatttggggagttttcatttaactctgctgttgtctaactgaatgaccctgagcaaatgttttaacctttctataattaatagcatttcttcttaytcgccaagctctccctgctccagccaaggctcctgggtctatgaactgtaacgtcaagagagaatactgtcaacaacagtaagcctgactgcagagagta

SEQ ID NO: 12120 - DNA, 201 bp, Homo sapiens
tatcgtttgtcatgcaagggctaattaaccttgaaaataagcattggcctaccttcccagtacctacaataaagcacactaggccaaatctctatgaggckgtagttttctatttaaaaaataataataataaggtataaaaagttactaacaaccatgcacttgttcccctcaacttaaaagttaaaaaaattagaaaag

SEQ ID NO: 12121 - DNA, 201 bp, Homo sapiens
tatttgtattgtttgtatatgaaaagatgagatgaatagttaagggtactgcacaaatactttgcttggtcctataggctctcaggtttttttgatatcawgtggcatttgtgtcaaattgagttgtgctgtaattttattaacaagcttcacatctcagaatattttacagagatgcacctaacacagttgacatgttgt

SEQ ID NO: 12122 - DNA, 201 bp, Homo sapiens
ccttgtgatggccataatgtaaagtgttcacacgaccaggtagcatttccattcttagaaagctacgcttcttagaaagctacgctacttgattctaagaratcagtcatacagacgtgtttttattcctttcagaggcaattcatttcatgaaaaaatgctgaaatgaaaacactttatagttaagcttggtgtagtcat

SEQ ID NO: 12123 - DNA, 201 bp, Homo sapiens
tctcatgatgcatggctagttaatggcagaactcatgttaaagcaagcagtccaaccctgcctgggctcttaaacagtggagtctgctgtctccttttaayaggatgaaggtgaagttctcagcttgatatttttgtttcattcagtgcaaagtgtcatcttctaccccagtgccaaaaattacttcaaagaaaacagctt

SEQ ID NO: 12124 - DNA, 201 bp, Homo sapiens
tttgtaccctttaacctatatctccccatctcctcttccactgcatctggtaaccaactttctactctgtgttactatgtatttgactgtttattagtgtygacttaggagtgagatcaaactctttcactctctctttctttcccgtttttttttttgtttgtttttgtttttttttaaacaagatctcacactgttgcc

SEQ ID NO: 12125 - DNA, 201 bp, Homo sapiens
gaaacataacaagctaacagctgtcaccaacaaatagcaattaatttcagcattcattcccttgctcatgcttcatgaaagtatataggtaaacaggattygtatcatgttctattttcttctctgggcctcaggcttccagccctctgagctactgtcttataacattctgaggatgtaagaaagaacttgatcctgttt

SEQ ID NO: 12126 - DNA, 201 bp, Homo sapiens
gagaaccatgagtataatgaaaagagcttggggtcttaaatcaacacaaccaagttgaattttgcttctgccatttgggtgatgcttacatcaacaccacrctataaactttttgagcctttgtttcctcttctctaatatggaatatcataatctcacagttctatctatgatgagggtcaaataagaaaatggcacaaa

SEQ ID NO: 12127 - DNA, 201 bp, Homo sapiens
ggaactgtcactcttcttcaaagagtaggacagtcaactggcctctagcctataaagaaatattcctttcagatagactctagtatataatatcattctgstattcatcaggaagtggctgaataatttattatacaacttgtctatagatcagagtagatgaataataaaatctttagtatgtaaaaaccttacaagaaa

SEQ ID NO: 12128 - DNA, 201 bp, Homo sapiens
tgttgaataaatgcacagtgcataaatttagcttttactacaaatgtactacactcttcttatttttctttctttctttcttttttttttttttttgttgkttttgagacggagtctcattctgtcacccaggctggagtgcagtggcgcgatcttggctcacggcaagctccgcctcctgggttcacgccattctcctgc

SEQ ID NO: 12129 - DNA, 201 bp, Homo sapiens
ttggtgaggatggcacaggggctctcaaaagaaggagttctcagaatcatagcaccaaaaagttgtgagtttgcaataatcagagtcatggtgagcatcayggaaatttagaactaaaagagatgttacagattatctccagtctgagtccctgccacacatgagaaactaaggccaagagatgttaaatggcttgaacac

SEQ ID NO: 12130 - DNA, 201 bp, Homo sapiens
agaaaaacaaatttcttggattttccctatgacttgggcttaagaagtctcttaacagttcctcagatgtagtacctgcggaagggaaggattaggttagwatatattcaaagtttgtataaaaaagagggtaaactagtcatttaaatgtaaacatataaacacttactttttactgtgttggctttgatattctttaat

SEQ ID NO: 12131 - DNA, 201 bp, Homo sapiens
atcttacaccttaagcgagtgtctcattcaatcttctcagccctgcctgaatgtgccaagcgtgcctgtgccttttcacctgccatttcctctgcctgcarcagcccttccctgctattcacagtactcactccctcacttcacccaggtttccgcttatattgcaccttccagaaaggaccttcttgaccgtctgtaaaa

SEQ ID NO: 12132 - DNA, 201 bp, Homo sapiens
attccgaatacacaggtctatcagttagtgtatcatgttatgtgtagatgtgtgttggggtgatcagatccaacaccaggtcgtgggggtgacaaaggccrgcaattcaaaggaatgagaaaaagacagtttgagagagaaagtgggaccagggggccatcgcgagtgtggaggctgtgaaggccccaagttctgggagcc

SEQ ID NO: 12133 - DNA, 201 bp, Homo sapiens
gaggctgaggtgggcaaatcacaaggtcaggagtttgagaccagcctggccaacatagtgaaacaccgtttctactaaaaacacaaaaaattagctgggcstggtggcgggtgcctgtaatcccagctacttgggaggctgaggcaggagaatcacttgaacctgggaggtggaggttgcagtgagccaagatcgtgctac

SEQ ID NO: 12134 - DNA, 201 bp, Homo sapiens
tgaaaccactgaagccatgatagtgaagaagacttcacagtccttgacagtctttgagctctccattgttgttctccaggcttgtatttctgaaatctacygtatgtactagttccagatcagtcttgcccaaataccatttttatcctgtcattcctctgctcgtgaaccttcaatgacctcttctcaatgtagtccaaa

SEQ ID NO: 12135 - DNA, 201 bp, Homo sapiens
ttctttaaaccaaagtttccattatagataataaaacaaccatcacaacaagaaactactaaatgattatttattcagatcccagaagaagtgctttacayggatactctacttcaaccctcacaactgctccataaagtaaatgctattagagtaaccgttttacagatgtgaaaaataagtcttagagcaatttcttag

SEQ ID NO: 12136 - DNA, 201 bp, Homo sapiens
ggacatgaacagacacttctcaaaagaagacatttatgcagccaaaaaacacatgaaaaagtgctcaccatcactggccatcagagaaatgcaaatcaaamccacaatgagataccatctcacaccagttagaatggcaatcattaaaaagtcaggaaacaacaggtgatggagaggatgtggagaaataggaacactttt

SEQ ID NO: 12137 - DNA, 201 bp, Homo sapiens
acagaggaaagaagagttgttctgaaaatggtatttcaataaaagttatagtgatgacgagcagtgtgatgatgtaggaagttccaaaactaggtagaggrtataatcaaaggtgggtacaatggaacaagcctggaggcaaggacgggccagtcaggaacaggtgggcttatagtgaaagaaagtggaggctttagaagt

SEQ ID NO: 12138 - DNA, 201 bp, Homo sapiens
attacaagtaattgacaagaattgtaccagtgattaggtgttgcccaaagatcttttaaaattccatgtgacccaaatactaccaaatcctaaaagatttmactaactggctcactaaccaatgcacacacatacttacttatttcacccagtatgtgttgactaccttttgcccaccaggagctaggcaggttcacagtg

SEQ ID NO: 12139 - DNA, 201 bp, Homo sapiens
ctttattgaggttcagagaggttgctacttatatggtagcaaaagtatttcccttccctacttaccctactatacaaaacaaacaaacaaacaaacaaacmaaaaaccagaaaacttgatgataaatgtcaatcaacactcagcctctgcatctgatgagcaacagaaattagcggggactgtggtgaattggaaaacctg

SEQ ID NO: 12140 - DNA, 201 bp, Homo sapiens
gtccatgtctccatccttggacccctaagacttttgccacacaaactcctttgaatctggagactgcaacggagctgcttccctcctcctgctgagccttyatggaaatcctcataggagatagtgtttcctttacccactctcggacccctgttcttcctggatctcctgaattcctggctatatcatttaggttcgctg

SEQ ID NO: 12141 - DNA, 201 bp, Homo sapiens
ttttcaggaagaaatttggaataatgcaaataagagatgaagtaaaatacccaaatatataaaaagaattcaaggaattcaagcatggtgtcctgtcccaragtctcactgttcagcatcactgttttggtattttcgtgaactctcaaaacccaaatatctccagagaggcaagtgttgaaacttcatgcttgttttttt

SEQ ID NO: 12142 - DNA, 201 bp, Homo sapiens
atataatttgtggaaaccaatgcaaaataaaactaagggcccccttgcccaaaaatccagaaaaaaaagtgttaaaagtgctagaatagaatttcttttcyctttcttcaatagtctatttgttatgttttttatttgctattgaatgacatttaagtaaataaaaatgtaaattagcatgaatattaccattcgtcctta

SEQ ID NO: 12143 - DNA, 201 bp, Homo sapiens
ccaagcactaggtctcaacaatggacttaaaatatttagtaaaccatgctgtaaacaactgtcatctaggctttgctagtccacttaaagactacaggcakagtacatttagcataattcttaagaaccctaggaattttgaagtggcaaataagtattgactttaagtcaccagctacattagcccttaactagagaatc

SEQ ID NO: 12144 - DNA, 201 bp, Homo sapiens
gattagagattcccattcccctggctgtggttgttttctttataggtggactcctaatgcagtttggacccataacatacagaggcacagaggaagaaggrgcgaaaccctcagctactggggacagggatacatttgaggcttatttcagtaggaaccaggtgtgaacatttagccaagcgtggctgtaaaaaagtggta

SEQ ID NO: 12145 - DNA, 201 bp, Homo sapiens
tgactgaaaacttaaattcaacaaatatttttatccacctagtttatactcaaagtgtgctagatgcaagggatagcacggtggtaacgatagacatggtyccagctctagtagagcctgtgatctggtggagaaacaggcactaaatcaatagctacaagagtgatgaatgttacaaaagaagagattcaagatgctaca

SEQ ID NO: 12146 - DNA, 201 bp, Homo sapiens
cttttaatgcgttgaatgttttttttttttttgaaaaataatagaatcccttcagaattcttaatatgatatggtgttctgtatattttcaagaggagagktatatagtgtttctcaaatttatttgcacatgaaatgcctgtgggacataatatctctgaaggccgatgttccttgaaagactgtgtgaaatattgaact

SEQ ID NO: 12147 - DNA, 201 bp, Homo sapiens
taagagacagaaccatgtctgcctagtaccttcacttggtcaaatacctcttttggtggaaacaacacaaattatgtaggttgtatatacaggatgaactyggtttaaagataagacatgaaattcagtggaaatattctttaaattctaaacagagaaatcaaaacaaaggtatattcatactgcatgtgggtataagtt

SEQ ID NO: 12148 - DNA, 201 bp, Homo sapiens
aaaaaaaacaaaaaacaaaaaaacaaaaaatccagtcaacagaaacttaaacacttgagggcaaacattgagcaatgttggggttttgttaccttgcactrattttgggtttaagaagggaaggaaatgatgttcgtaatccagtgttctggaaggaggagtgcttttggtagattaatttacaaagttttctgctgacaa

SEQ ID NO: 12149 - DNA, 201 bp, Homo sapiens
gggaataataaattcattcttaggcaagggggttcaaggatggtctaaaatgtctacaattttataaacactggcaattctataggatgtatacagaaggrttactatgtcataagtttcttgagcatcggagatattaataatagcatgactttcctgttgtcgggatgacaatgttcctgtgttgtgcagcggaattgt

SEQ ID NO: 12150 - DNA, 201 bp, Homo sapiens
tcaagcctcagcaatggcagatgcccctcccccagccaggctgccaccttgcagttcaatctcagactgttgcgctagcagtgagcaaggctctgtgggtrtgtgacccatcgagccaggcacaggagagaatctccttgtctgccagttgctaagaccttgggaaaagtgcagtatttgggcgggagtgtcccgtttttt

SEQ ID NO: 12151 - DNA, 201 bp, Homo sapiens
tacctgaaaggtaggtataaagagaattatggccaatgaaactccatatgagagccctcccctcctccccagagtatatcttgcttaaacaacacatttayggttaatgaccatctggtaaaggtgacagcctttagtcctcctaattcttaactgtctgaaaaaatgtgcccaacctgccacggcttgtgactgaattat

SEQ ID NO: 12152 - DNA, 201 bp, Homo sapiens
cgtgttcctgtttctccacaaccttgccagcatctgttgtgttttgataagtccgtataatttaattagaaacctaagtaggttttggaggacctactacstttacttaaacatcctgaattttatttatttgtttattttagaattggggtcttgctctgtcaccaagactggagtgcagtggctattcacagctgtaat

SEQ ID NO: 12153 - DNA, 201 bp, Homo sapiens
actaaaaatacaaaaagtagccaggtgtggtggcgggcacctgtattcccagctagtccggaggctgaggcaggagaattgcttgaacccgggaggcagasgttgcagtgagccgagatggcgccactgcaccccagcctgggagacatagtgagactccgtttcaaaaaaaaaaaagtaaagggcagacagaagctggag

SEQ ID NO: 12154 - DNA, 201 bp, Homo sapiens
tacctgctcgtgagcaataaatcttacttatgatttttcggtgttatctgtttttcttcttttgatagtgtacaacatttctccaggcatactgcctgggsctaagatgtgtcctgtatgttatcccacggagtgttttaccaagccactccctggatgataatagagctccaaatagagacaagacaatgtatactttct

SEQ ID NO: 12155 - DNA, 201 bp, Homo sapiens
tcggagatgagcctcaggggaggtacagattgaaattcgtaaggggataaaataaaactacagtcctgaacttctggttcctcatagaaaaaggcagtcasagtgcactgggtagtttatgaaggctgacttcagtttatgattatattccttaaaaaggccattcataaaccagacctttaaaaatgaagtcctttattt

SEQ ID NO: 12156 - DNA, 201 bp, Homo sapiens
cacctatagaggactaggagagaaaatatttttgaaagagaagactaaatgctagatgcactattaatgggaattggtcacgcccacaggactcttccctytagcataacataccgatatataaaaacatgcttgctgtgtgaccgaatgagccaatcctggcttaacatagacaaacaaaaaagaagttgccaatgcctt

SEQ ID NO: 12157 - DNA, 201 bp, Homo sapiens
tgaggcaccagaatcacttgaacccaggaggcggaggttgcagtgagctgagatggcaccactgcccaccagcctgagcacagagtgagattctgtctttwaaaaaagtattttgaaagagtaaaaggagaataataatgtcattggacacatttagaacctatgtatgccaagcattgggagtagaatgcaaggcaaaca

SEQ ID NO: 12158 - DNA, 201 bp, Homo sapiens
catcaattatcttagctggatgtaacggataacttgctgcagcgtctacataagcacttgccgctttaccttgtgcttttatgttatagagatgatttctytccttaaacctcatgaaccaatatcttctagctttaaacttttttctgcatcttcctcacctctcttagccttcatagaattggaaatagtttgggcctt

SEQ ID NO: 12159 - DNA, 201 bp, Homo sapiens
aacttttctgtgtctcagtttacttttctgaagtctttgccttttgattcaatcaacattttaaaaattacttaaatttgaaattatggagatctcctatragaaaataatttgtttctctgattctttactacttttaattatatttgcttcatcatgtgcttatgaagattaattgaattaatatcttaaaagcattta

SEQ ID NO: 12160 - DNA, 201 bp, Homo sapiens
gcagatcatgaggtcaggagaccgagaccatcctgaccaacatggagaaaccgtatctctactaaaatacaaaaaagcagccaggtgtggtggcatgcacytgtagtatcagctactcaggaggctgaggcagaggaatcacttaaaccctgcccagaggcagaggttgcagtgagccaagatcgccactgcactccagcc

SEQ ID NO: 12161 - DNA, 201 bp, Homo sapiens
gtcttgactctttatccaatttgccagtctgtgtcttttaattggagcatttagtccatttacatttaaagttaatattgttatgtgtgaatttgatcctrtcattatgatgttagctcgttattttgttcattagttgatgcagtttcttcctagtctcgatggtctttacattttggcatgattttgcagcggctggta

SEQ ID NO: 12162 - DNA, 201 bp, Homo sapiens
ctcagggatgcagatcactgggccttggtgcttttttctagagccgttagaaatccctcctttattgtcttaggcagacccaccggggtattggttatggycacatttcatttcccagttctggagggcaaggccagagttttagctggaaaaatcatttgtggtatcctgcccctgaccctgccaaatgggcggaggtgt

SEQ ID NO: 12163 - DNA, 201 bp, Homo sapiens
aggtgggtcatctgaggtcaggagttcaagcagcctggccagcatggtgaaaccctgtctctactaaaaatacaaaaaattagccaggcgtggtggcgggsacctgtagtcccagctactcgggaggctgaggcaggagaatggtgtgaactcaggaggtggagcttgcagtgagctgagatcttgccactgcactccagc

SEQ ID NO: 12164 - DNA, 201 bp, Homo sapiens
tagctcaagctacttaactctctaaggttaaatatcctcctctataaaaacctgatagtatgtactaaagagggtatttttgaaaattacatgagataaarcagcctagaatgctatctgatgcaatagtcatccagtaaattttaatatcattctactttgaaccaggttgtttatattaaatttaacagaattaagcaa

SEQ ID NO: 12165 - DNA, 201 bp, Homo sapiens
tgtctttctccagagccctgccacccaccttcttcctgcgcactctaccttttctctctgtgatatcttttctaatcctatgcttttcactactgttcaarggtggatgactccccagttgatacctctagccttgaactctctcagacaccttatattaccgggcttctggtcctctccacccacaggcacatcaggatt

SEQ ID NO: 12166 - DNA, 201 bp, Homo sapiens
gagtaaatgcatgatgaaaaatttacaagttagtatatccatctccacataaaagaattcaaaacttatttttggtaatgtcactcaacaaatatttaggrtcctcttgaatattaatcaggatgactaggcattcatgaagtgtgagacacagtgcttgccagagggttgcatgacttcacttgcagctttgggaacact

SEQ ID NO: 12167 - DNA, 201 bp, Homo sapiens
gtgtgctgcacccattaacgcgtcatttagcattaggtatatctcctaatgctatccctccccactcgccccaccccacaacagtccccagagtgtgatgytccccttcctgtgcccatgtgttctcattgttcaattcccacctatgagtgagaacatgaggtgtttggttttttgtccttgtgatagtttactgagaat

SEQ ID NO: 12168 - DNA, 201 bp, Homo sapiens
ttacaaagctcctcagtggtagagctctggaataagaatccagttttatctgactctagtctagctcttaactgaatcccagaataccagaaccttggggyagggacaccccttgaaatgtactacaggggaatctagggcaaacaatgagcaactccctttcatgcggacggtgataacctcaaggaatgtgtcccccaa

SEQ ID NO: 12169 - DNA, 201 bp, Homo sapiens
attgttttgagtttcttagaacgtgtacatgctgttccctttgtccccatcactagactgactcctacttgactttcaggacttctgactttttcttcctscaggaatcatcttctaccactcctctgcatggcaggttagatgcccctcttaaatgcagggttaacctctatcgtacatttcacaccttgtatttacttg

SEQ ID NO: 12170 - DNA, 201 bp, Homo sapiens
ctcttgaagttgacataagatctccatgcacagaaaatgaattcattagaatcaaagtgattgtataagaaactcaaattatccaggtgttgaaatgcatrtctactttcttttcagacaatggaatcatttataaaacatatagttatttaaaacacagacacacatacagagactatcatatgggattgtgagagattg

SEQ ID NO: 12171 - DNA, 201 bp, Homo sapiens
actacttgggatatgtttatgttgataatttctccccttttatttttctatcagtcagatttataataagaatcagctgttctttctaaaagactattgtrcctttatattactttctttaattttcaataatcctatgaattagcaattattatcctcatttttacaaatgaggaaactagagatccgaaaagtaaacag

SEQ ID NO: 12172 - DNA, 201 bp, Homo sapiens
aggagtgcttttggtagattaatttacaaagttttctgctgacaaaagaaagggaaaggaaaaaaatcagataataattccctttacaggcctaatttgamcttaattctctctctctctctctctctctcacacacacacacacacagacacacacacacacacacacgacaactgtgagctgtaaatccatggtcatct

SEQ ID NO: 12173 - DNA, 201 bp, Homo sapiens
gaaaccagggatctgaataagtactagggatccttgctcattttcccaatttggctacaaaagttaatgaaattggggccaacgcttaaaatgcagatatkgttatggatacattttatgatataaatagagatacacttgtttcatggaggggtaactagggacttagatttcatttggacctatgtgtgccgagcaatt

SEQ ID NO: 12174 - DNA, 201 bp, Homo sapiens
tctcctagagagggtggtgtggctccagaatgctggggcagacttcaacgcaaaaactgcacaaagagggcaggggtaggagaggccctgggaggtgttarccactgagcttgaaccttcgcatttttctctttcttaaaagaagttaccattaaccagtactttcaatttcttctcaacctacccaacgccttctacctt

SEQ ID NO: 12175 - DNA, 201 bp, Homo sapiens
cactgctgtcagggtacataatgagagaagatacaaactctagatcaaacacaaagatcattgattacttatggcaaatacagcaatcaaggtgatctctygcattagttctctgaatcctgatgcccatgggtgatgtggtaagggccagatggtagttgcacatatagtggagcctgttaagcaggagacaccccccgc

SEQ ID NO: 12176 - DNA, 201 bp, Homo sapiens
attccattaccctcccagctcttgtttctctacgtgagcatgttgtgtgaatgctgagtgaacttttagtttactatgcattcatagtgcattcattccartattcatttcttccttgggtcctggcctactccttccttttctctcatctattcattctaatctcatttgaacatcaggctcctcccactgtcgatactt

SEQ ID NO: 12177 - DNA, 201 bp, Homo sapiens
gttttacaaagttatatttctaccagcaatatatgtgtttgcttctcctcactcttgtaacacacatcatattatcaaactgtattttcattctcttaagmtagcttttcaaaatgttgctgtcacatatttatttcccatagatcttttcctcccatcctttaacatcttcaaatatacatagggatcattgtcattcat

SEQ ID NO: 12178 - DNA, 201 bp, Homo sapiens
ttttttttttttttacatttttattcattggccatcacattccaaagttttacagtcaaatggacagttaaatatttgtgtttgaatctgaccactgtgawtatctcaaggataccataagagctgatggacctccaaacgttagcatcactggactgagagaaagctcgttttatatctctataggtactgtcataccaa

SEQ ID NO: 12179 - DNA, 201 bp, Homo sapiens
aactggaaggctaggctgatggctttttctccattaagcagtaaacacgttaagcaagcttgagccaggttctggaggaggtcatcttgcaaggataaaaracattgcatttattggatgaatacttaatgcacggtttgccttatccctaccttagagatgagaaaactgaggctaagactagctaagtaatttacccat

SEQ ID NO: 12180 - DNA, 201 bp, Homo sapiens
cattgttcattcatggagttgtttctaaataatggtgactagagaggaggaaatggtgttatattagttctctattgctgcataacaaataactccaaaaygtagcagctcaaaaatcaacaaggcattacctcctaatttttgcaggtcaggaatccagatgtggcttagctgggtgcctctggcttagagtccctccat

SEQ ID NO: 12181 - DNA, 201 bp, Homo sapiens
tggcagagatgaaagtcctggctcctggcttggccttatctgataccactcaggctggcaagttgagaccccattatagcctaacaagtgtgagggtctakgttcctcagttgttcttcactggactgggtagatgtgggaccacactctttctgtgatgtttggctggagtatggaaattgctttgtgaaagttttttgt

SEQ ID NO: 12182 - DNA, 201 bp, Homo sapiens
tcataatttatgatatgttaaaatttccaaattttctgtttattttatgttagttacatcttagattgatgattccctggtggaatttggaaagacatctyaatcacaccagcagtatttatgtaaaccatttttaaggatggtttacttcttagttaactctaaaggaaggataatgtcatctattgaataaagattctc

SEQ ID NO: 12183 - DNA, 201 bp, Homo sapiens
tcttttcttttctttttttttttttttttttgagatggagtctcactctgtcacccaggctggagtgcagtggtgcgatatcagctcactgcaacctccayctccggagttcaagtgattctcccactgcaggatcccgagtagctgggattacaggcataccgcaccatacctgctaatttctgtatttttagtagagat

SEQ ID NO: 12184 - DNA, 201 bp, Homo sapiens
tatgactttttacagaaattttaccgatgtcaggattcactttaataaagtgtttcataaagtgtttgtttgtgccgtgatgggccatccaagattgtaaygggcgatcattggaaacaaagatgcttatagagcagcatcttgcatgtcacaaatatttgaatgaatgaaaaaatgcatatttctgttaagacatcacag

SEQ ID NO: 12185 - DNA, 201 bp, Homo sapiens
gggtgtggtggcgcatgcctgtaatcccaacgattcaggaggccatggcaaaagaatcgcttgaaacccaggaggcggaggttgcagtgagccaagattgygccattgcactccagcctgggcaacaagagcgaaactcatctcaaaaaaaaagatacttgccattggattcagagcccacctagataatccaggatgatc

SEQ ID NO: 12186 - DNA, 201 bp, Homo sapiens
aatatatacaatgattttcaaagagggtgatttttcacccctcttctctccctgccccacatacaaaggagactttgcctatgtctggaaacatttttggwtgtcacaattgaaaaggaatgtatggaggtgttgctgttatccagtgagcagaggccacagatgctgctatacattttataatgcacatgaactctggaa

SEQ ID NO: 12187 - DNA, 201 bp, Homo sapiens
agtcagagaggatttgacagaatttttaaagtaaaaagtgaaatgaaatttagatcagcctctgcaaaaggactttgtggatttcctgtcggttaaagatstggcagcattattgttcctgtttctggagatgtcaagagtaaaatggtgtgacgtttgtcaagtgcttggacttactataaccagacatgctgccggggg

SEQ ID NO: 12188 - DNA, 201 bp, Homo sapiens
actcaacttcatttcaattcaattccacaggtctttacttaacaaattctgggtaaacaggagattttgaaaaggcaagaaaaattgctgctcacagcgtrtggttaaaaagttgacatccataaatcaaataaccaaagaatcattcaagatttattgggcggttagacgttttattggcagcagagatttaacttttca

SEQ ID NO: 12189 - DNA, 201 bp, Homo sapiens
gattccacacatggttttgagaggcagcaagccatagtagaaagatgtgcttaatttgaaaccaaaaaaaagttggatttgagttccatttttcaatccayttctgtcagtgagctatgtgactttcagcaagtcattctactacttggagcttcagcttcctcttcttataaatgggcataaaatattatgttgcagggt

SEQ ID NO: 12190 - DNA, 201 bp, Homo sapiens
tccccttactttaaattctgaaaacgctaatgactgagcttttcatttagtactaactggatggttagttttctttgtgtatgtgatcgtttacgtggtcrttttgtttctcaccaacacattgtaaactcttttagaattgttatctaatagaaatataagtaacataaacctgtattatatttttggagcatctgaaag

SEQ ID NO: 12191 - DNA, 201 bp, Homo sapiens
aaaaaaaaaaagcagaaaaatgtgttgattacagagttaagggggagaaacttataaatcatggttatttaccacccctgagaaggtaggtacaaggttgrctactacttacctcttaatcctatgattttctggttctgtggcttagaaggtttaagctctgtcaagtggctcaagcaggacagcccaaggtgactccaa

SEQ ID NO: 12192 - DNA, 201 bp, Homo sapiens
aacatcacttacttcatagggttactagtaggaaaaattagttaataccagttaagatgatttgtagagaaatggcaccttcaattaatgttaactgttaytattgttgccacctctagacactcatcccttcgcactgcccttttctcatttttccctggattgttttgagtttcttagaacgtgtacatgctgttccct

SEQ ID NO: 12193 - DNA, 201 bp, Homo sapiens
gattgcagactatctcagtgttagtggaaccatttcacttctcgatgttttcttataaaacacacagtttgagctgtattgttaatctacttggaaagatrttatcattttttaaaacaaatatctgctgggtgagtgttaggcaatggctctcaaagtgtagtcccaggaccagcagcattagcaaattcccagttccca

SEQ ID NO: 12194 - DNA, 201 bp, Homo sapiens
gccataaaaaatgatgagttcacgtcctttgtagggacatggatgaaactggaaatcatcattctcagtaaactatcacaagaacaaaaaaccaaacaccrtgtattctcactcataggtggtaattgaacaatgagaacacatgaacacaggaaggggaacatcacactctggggactgttgtggggtggggggaggggg

SEQ ID NO: 12195 - DNA, 201 bp, Homo sapiens
taattctgcatcctgcttccttacagaatcttcttgttaatagtaatcattttcagttgtttcttctgagaactccaggtgctcagtcatatcatctaaamataattttatcactctctttccagttttatatctccaatttctcttgtttaattgcattagataataatcctatctaataatatagtaatgatattgtgg

SEQ ID NO: 12196 - DNA, 201 bp, Homo sapiens
aagtgggaccagggggccatcgcgagtgtggaggctgtgaaggccccaagttctgggagcccatgttatttatgggtgctcaaacaggtggtgaggatgtsgagtgaatgagaaacatatggctgtttgacataatgggagtactagaagcaagaagccagcaagtctagcagacatgcaagccctgcctcagcttctctc

SEQ ID NO: 12197 - DNA, 201 bp, Homo sapiens
aatatagccacaaacataattggtggttatgaaattatgcaatcacactgtctgaggcctcattaccctttaacttataaatctgccttgccatctttccrtgatcctcttaaagaatgtacctacccaccacctacataataaaaaaagccacaagccccagccttgggggaattgtattgatttataaagagagaggct

SEQ ID NO: 12198 - DNA, 201 bp, Homo sapiens
ggggtagaagtggggatatctggcatactatgagatttagagggccactgtagcctcataggtactcagactttatagtgttggtttaattagggattttyttaagctggctgccctgattcaaggtgatggttatctgagcaccaggtaaggcctgggaagggtagaggcaatatggctagatgtccatttcctataatc

SEQ ID NO: 12199 - DNA, 201 bp, Homo sapiens
aaacttcgttgttgttttattttaggaaattgcacagccaccccaacattcagtaaccactagcctgatcagtggttatcaaaactgaggcagaccctacrccagcaaaaagattacatctcactgaaggctgtcaacttagatgactgttagcattttttttaacaataaagtgattttaattaaggtttgtacattgtg

SEQ ID NO: 12200 - DNA, 201 bp, Homo sapiens
gtgatggcctgtcctgcttccacccttcatgaataaatacaaaatgccttgccacccagaagacgaaccctttgtagtcgtgcatctcttttgaacatgcrtctttaggaccctgtgttctttcatttcagtattcttgcttttgtgaggcttacgttagaaactgtgaaatatgctgttattgcaatggtaatatgtttt

SEQ ID NO: 12201 - DNA, 201 bp, Homo sapiens
gctagctagttctcccagcacaatttattaattagggaatcctttccccattgcttgtttttgtcagatttgtcaaagatcacatggttgtaggtgtgcgktcttatgtctgagttctctgtgcttttccattgatctatttgtctgttcttataccagtaccatgctgttttggttactgtagccttgtagaatagttta

SEQ ID NO: 12202 - DNA, 201 bp, Homo sapiens
caccaatccttttcagagaaaaattttataaacttacaagtatccattgcacgtgctttacatttgttttatatcaatatgactgtaaactttatagagakctttttaatacatgaataggacatcttatttttaaggcaggtaaatgtgctttttctcacttcaaacaaattatgtccacaagctgaataatgagaaggg

SEQ ID NO: 12203 - DNA, 201 bp, Homo sapiens
ctgggtgaacacgttaattagtttattcttttaatgcgttgaatgttttttttttttttgaaaaataatagaatcccttcagaattcttaatatgatatgrtgttctgtatattttcaagaggagaggtatatagtgtttctcaaatttatttgcacatgaaatgcctgtgggacataatatctctgaaggccgatgttcc

SEQ ID NO: 12204 - DNA, 201 bp, Homo sapiens
cctagcagaaaaattatttttcagccttctcagaagtactaaaagtcctttgccaacatcagcccagtgcaagttaacctgttatgagatttgttttgtgstttggaaatgcttgtcagacaagctttcaacattgagatgtgtgatttaaattagtttgcataagaaaatgtaatgccagggacaaatttctctctttat

SEQ ID NO: 12205 - DNA, 201 bp, Homo sapiens
catgtttggaccaataaagtgtaagcgcagtgttgtaaaagttattttccatgttatacaagagttctatttttcagttttttcacttgaaataattgtaktccttggagactgttaataaatttcgagtctcaccttaaagaggaattgatgtatattgaggcctactcaagggtcagtttgctttccgtttctttccct

SEQ ID NO: 12206 - DNA, 201 bp, Homo sapiens
tttcattgagttatatagaagaagtaaccaggtatattacttagtatacaacttaaagagcaaaggactactacagttttaagttggaggaagacattcaracctttaaacgtggaaaatcctcacggagtgttaactgtttgccctgtttttaatgtatgtggtctaattaaaaataagaataactctaaaaagcaaata

SEQ ID NO: 12207 - DNA, 201 bp, Homo sapiens
ctcaagaattgattagtcagatctctctgggaaagtagctgtagtcaggagtagaggggtagtttaaatcttgtagcccaggaaacctgccttgcctttcmtgatgcttgggtcagtcttgaacaggcaaagagcactttgtggagtgaatgatggcaactggaatgaaggagactcatcatctctagccagtgtaattca

SEQ ID NO: 12208 - DNA, 201 bp, Homo sapiens
ctggagatttttataaagtatagatcattttcactataacaaagttctctggccaattcaccatactgcagtgttgaaagcttccaaagggctattatttrtaaatcattcttgattaatgggcactatgagttgcctagtgtgcagaattaactcttgtctaaggagtatcctctgatcggatgagcattctcttctctg

SEQ ID NO: 12209 - DNA, 201 bp, Homo sapiens
gctattatttgtaaatcattcttgattaatgggcactatgagttgcctagtgtgcagaattaactcttgtctaaggagtatcctctgatcggatgagcatyctcttctctgccacttccatttctttcattgttatacattgagaaggtatttcacattatacaccaggaattcaaggacagatcaacattgtgtagcctt

SEQ ID NO: 12210 - DNA, 201 bp, Homo sapiens
tatgcaaataaaaattacttggtaaggatggaaaattaacttgaggcttttttacttttttttttttttttttttggtctgttgagaaaagggcttgtagrgtggtgcctgcataaactggccataaaaatatgggacaataagttgttgaaagccacaagaggcctctgaggaggaaagcctcctaaatgccatcatgtt

SEQ ID NO: 12211 - DNA, 201 bp, Homo sapiens
cttaaaaaaagttccacaacgaacaggggtcagcaactttttctgtaaagggccagaaagtaaatattttaggcttgtaggccacatgatctctgttgcarctactcatgtctgctgttgtagcatggaagcagccaaagataataatacatcaatgaatgagtccagccgtgtcccaataaaactttatttataaaaaca

SEQ ID NO: 12212 - DNA, 201 bp, Homo sapiens
aggatagctaaaaagtaaaatcattgagacattgctcatctgaagaatgttttattccattctcacccttgacgataatttgcctgggaaggacttgtatsttggaaattatcttcactaataaatttaaaagcatccgtccaatgtttttgggcatccaatgttgcagctgttgacatcacagtttggtgtctaattcct

SEQ ID NO: 12213 - DNA, 201 bp, Homo sapiens
cattttattcactacctaatgtgaaggtggtggcagggaatggaaaagggaagattatttagtcgataaacacttaatggccactgcctgctgtgtggacrgatctggatagagttaaaaagataataaagcaagtgtaggatgcctgtcttcatggtacttatatcatgggaagaaggcatgaacaaaccaattttacac

SEQ ID NO: 12214 - DNA, 201 bp, Homo sapiens
ctcccatttataaaaccatcagatctcttgagacttattcactactgtaagaacaatatgggggaaactgtccccatgattcagttatctcctccttaatratccccttgatgcatggggattattacaattccaggtgagatttgggcggggacacaaccaaaccatatcagggagttatccttctcctctgccatcctg

SEQ ID NO: 12215 - DNA, 201 bp, Homo sapiens
tataggttggctaagtgccaactcagagaaaatgacattatgggctatagatatttgaaagtggctggctataagcaaagcaagggattacttaggtaatkggattaaatcaagggggtaaacattttaaactcaatatctggatttattttgttgactataagaattattagattttagaactatcccataacctactgc

SEQ ID NO: 12216 - DNA, 201 bp, Homo sapiens
ctagacccaacaatttacatgtctaatgagtccgctggtgatactgctgctgggggtcttagaacctcactttgtaagcacataagtaaggtgtaagatgwtctggaaaaattccagatgagttaaaatgtgtttcctcatttcaaggactgtaatgtttgttgttagtgtgagcacagggcttaaggtttctttatgaag

SEQ ID NO: 12217 - DNA, 201 bp, Homo sapiens
gaatttttttttaaaatcctccatttgcagctttttgtactctgatcacaatatattaaatcccccagaagaactactaccttgaatacaaagcacatagyggtgctcttttaattgatttgtaaaggttagttgctcagtactagtggaaagtttcatgattacttaattgaattacctgcttcccccagtagagtgctt

SEQ ID NO: 12218 - DNA, 201 bp, Homo sapiens
gatccacctgcctcagcctctcaaagtgctgggattacaggcgtgagccactgagcccaccctccttccttccttttttaaattagaattttttatttttkatttttttttttaattttttttttggttgcttttagccacctcagttaccttgaccatccgatttcacttactgtagccagatttctaaagtatgtgttt

SEQ ID NO: 12219 - DNA, 201 bp, Homo sapiens
tattaatattaatatcagcaagataagctgttaaataagcattacatgtaagaatcctgaccttggataaaattaaatctttgtcataaatctactactgkgacaaaactgcaaaatatgcagtgaataattaaatccagatgtctcttccggcaacagcagcagcaaaaactggaggtgggggtgaagggaagatggaag

SEQ ID NO: 12220 - DNA, 201 bp, Homo sapiens
gggggccatcgcgagtgtggaggctgtgaaggccccaagttctgggagcccatgttatttatgggtgctcaaacaggtggtgaggatgtcgagtgaatgaraaacatatggctgtttgacataatgggagtactagaagcaagaagccagcaagtctagcagacatgcaagccctgcctcagcttctctcccaacactcag

SEQ ID NO: 12221 - DNA, 201 bp, Homo sapiens
tctaaactcaaattttctgagcactttaactattaaatagcaataacagaaagcattgtaaatcttttggagttttgcatgataatgtacctcttgttaaytgaattgagagatgattgccctatgattacctcgattcatttgctgcataatttaccataatgataattaactccttgtactgaatgaggtaagatgtgt

SEQ ID NO: 12222 - DNA, 201 bp, Homo sapiens
aaaagcttgctagggcaaggtcagaagataaatttattagccaggaccagtttaagtcaaaagttgaatataagtcatatctttagaaaaaaaaaaaaaawgcaggtagaaaggcacattgtttttagctaactctacaaaaagttcagagcgaaaagaaaaacagtgatgcagaactaggggagaaattaaggagcaaac

SEQ ID NO: 12223 - DNA, 201 bp, Homo sapiens
attatcagctacttgaacatttctcagggtagtcacttttgattaaaataaacaagaagctttgaatagcttcccaccaaactacttttttgtttgtttgyttgctttttgagacagagtctcgctctgtcgcccaggctggagtgcagtggcgtgatctcggctcactgcaagctctgcctcccaggttcacgccattct

SEQ ID NO: 12224 - DNA, 201 bp, Homo sapiens; identical to SEQ ID NO: 1320

SEQ ID NO: 12225 - DNA, 201 bp, Homo sapiens; identical to SEQ ID NO: 1324

SEQ ID NO: 12226 - DNA, 201 bp, Homo sapiens
taattcctttcaagtctggaaaactgttttgtttgacatttttggaatgctgtgatctgaaccattagactatttttttctcctttaaggtactaatattytgatttttaaacaattaaatatgctctaaatttgtctcgcccacttctacatcttcttccaacatttacatagacatccatgcacattcatgcacaccac

SEQ ID NO: 12227 - DNA, 201 bp, Homo sapiens
aaatactttacagacaagcaaatgctgagagattttgtcaccaccaggcctgccctataagagctcctgaaggaagcgcttaacatggaaaggaacaaccrataccagccgctgcaaaatcatgccaaaaggtaaagaccatcgagactaggaagaaactgcatcaactaacgagcaaaataaccagctaacatcataacg

SEQ ID NO: 12228 - DNA, 201 bp, Homo sapiens
cgataccagccgctgcaaaatcatgccaaaaggtaaagaccatcgagactaggaagaaactgcatcaactaacgagcaaaataaccagctaacatcataaygacaggatcacattcacacataacaatattaactttaaatgtaaatggattaaattctccaattaaaagacacagactggcaaattggttaaagagtcaa

SEQ ID NO: 12229 - DNA, 201 bp, Homo sapiens
gtaactaacctgcacaatgtgcacatgtaccctaaaacttagagtataataatgataaataaaataaaaataaataaaaataaaaaataaaaataaaaatmcaaaaaaaaaaaaagaaatcaggcagactggatctggaatctgttctcttaacctctctctctgctcaccggtaggttatagacctaacataaagtagtt

SEQ ID NO: 12230 - DNA, 201 bp, Homo sapiens
ctggccttcacatatgctttgctatctggtagaaatatctgcccaaaagattattttttatggaaataatagtgcacatgcagattctagatattattttstatttatcaactgcattcaggcagtgctaagtagatgactgatgctgaaattttactagataatctttgctctctattttgttatatgacacatggggca

SEQ ID NO: 12231 - DNA, 201 bp, Homo sapiens
gaaataatagtgcacatgcagattctagatattattttctatttatcaactgcattcaggcagtgctaagtagatgactgatgctgaaattttactagatratctttgctctctattttgttatatgacacatggggcaaatacgtgagatgagcaattagtgaaattctggaagggacagatttatgtcatactattgaa

SEQ ID NO: 12232 - DNA, 201 bp, Homo sapiens
cagaaggctataagtgaggagacagtactgagacactaagtagacattctagccaactctgtagaggattctcatgttatgagctgaagtagaaaggctaygtttgaagattctgtctgattttgggcatcttggttctagatctatcataggtgcagattaaattgtttccaggctgtacttgatagttggtaaggatca

SEQ ID NO: 12233 - DNA, 201 bp, Homo sapiens
caggtttggctgaattgatataagactggtagcataggctgggcgtggtggctcacgcctgtaatcccaacactttgggaggccgaggcaggtggatcacsaggtcaggagtttgagaccagcccggccagcatggtgaaaccctgtctctactaaaaatacaaaaaattcactgggcatggtggtgcgcgcctgtaatcc

SEQ ID NO: 12234 - DNA, 201 bp, Homo sapiens
tttggctgaattgatataagactggtagcataggctgggcgtggtggctcacgcctgtaatcccaacactttgggaggccgaggcaggtggatcacgaggkcaggagtttgagaccagcccggccagcatggtgaaaccctgtctctactaaaaatacaaaaaattcactgggcatggtggtgcgcgcctgtaatcccaac

SEQ ID NO: 12235 - DNA, 201 bp, Homo sapiens
ccgaggcaggtggatcacgaggtcaggagtttgagaccagcccggccagcatggtgaaaccctgtctctactaaaaatacaaaaaattcactgggcatggkggtgcgcgcctgtaatcccaactactcaggaggctgaggcaggagaatcacttgaacccaggaggcggaggttgcagtgagctgagatcatgccactgca

SEQ ID NO: 12236 - DNA, 201 bp, Homo sapiens
aaaaatacaaaaaattcactgggcatggtggtgcgcgcctgtaatcccaactactcaggaggctgaggcaggagaatcacttgaacccaggaggcggaggytgcagtgagctgagatcatgccactgcactccagcctgggcaatagagtgagactctgtctcaaaacaaaaaaacaaaacaaaacaaaacaaaaaaagat

SEQ ID NO: 12237 - DNA, 201 bp, Homo sapiens
aggctggtctcgaactcccgacctcaggtgatccgcccacctcggcctcccaaagtgctgggattacaggcgtgagccaccatgcccggccaatcaattgktattgatttattactgagattgctttaaataaattcatccttatttctgttgtagtctttaccttgtctccagatctttggaagtctcaggttcatttgt

SEQ ID NO: 12238 - DNA, 201 bp, Homo sapiens
caaagtgctgggattacaggcgtgagccaccatgcccggccaatcaattgttattgatttattactgagattgctttaaataaattcatccttatttctgktgtagtctttaccttgtctccagatctttggaagtctcaggttcatttgtctggactttgggggttttgtttaaaactgcctagtctctgcagccacatc

SEQ ID NO: 12239 - DNA, 201 bp, Homo sapiens
taaattcatccttatttctgttgtagtctttaccttgtctccagatctttggaagtctcaggttcatttgtctggactttgggggttttgtttaaaactgsctagtctctgcagccacatcctccaccactgtagcacatgatcaaaaaacttttctctgaggatactgagtatttcttagacctatgtcactagctccct

SEQ ID NO: 12240 - DNA, 201 bp, Homo sapiens
tccttatttctgttgtagtctttaccttgtctccagatctttggaagtctcaggttcatttgtctggactttgggggttttgtttaaaactgcctagtctytgcagccacatcctccaccactgtagcacatgatcaaaaaacttttctctgaggatactgagtatttcttagacctatgtcactagctccctgggaactc

SEQ ID NO: 12241 - DNA, 201 bp, Homo sapiens
ttgtagtctttaccttgtctccagatctttggaagtctcaggttcatttgtctggactttgggggttttgtttaaaactgcctagtctctgcagccacatyctccaccactgtagcacatgatcaaaaaacttttctctgaggatactgagtatttcttagacctatgtcactagctccctgggaactctctctaccccca

SEQ ID NO: 12242 - DNA, 201 bp, Homo sapiens
tcaggttcatttgtctggactttgggggttttgtttaaaactgcctagtctctgcagccacatcctccaccactgtagcacatgatcaaaaaacttttctytgaggatactgagtatttcttagacctatgtcactagctccctgggaactctctctacccccatcccatcaactctctgaccacaagttttcaaggaatc

SEQ ID NO: 12243 - DNA, 201 bp, Homo sapiens
ctttgggggttttgtttaaaactgcctagtctctgcagccacatcctccaccactgtagcacatgatcaaaaaacttttctctgaggatactgagtatttyttagacctatgtcactagctccctgggaactctctctacccccatcccatcaactctctgaccacaagttttcaaggaatcttcctcattatactcatct

SEQ ID NO: 12244 - DNA, 201 bp, Homo sapiens
gcctggcttatttcacttagcataatgtcctttagctccatccacattgttccaagtagcagaatttcctgctttttaaaggctgaatattattccattgkgtgtgtgtatatatatatcacatttaaaaaattttattcatccattaatggaaaaccttcattcttgaaaaaatagcttataaagctatttatgtccctg

SEQ ID NO: 12245 - DNA, 201 bp, Homo sapiens
gaggttgcagtgagccaagatggtaccgctgcactccagcctgggcgacagagtgagactctgtctcaaaaacaaaaacaaacaaacaaacaaaaaaacamaaaaaaaacaagaagaggtctccgggttgccctatctttccctttcatgtcatcgtctttactgtaaatggttggttgatacagagacttaagaaaggat

SEQ ID NO: 12246 - DNA, 201 bp, Homo sapiens
cctgggaagaacactgtattcacatgtactcatatagaagatcaacagaaaacaaatctttgggcaaagtggagcgcagagagggttaaaggtggaaaaarggggtcagaaggtgaaagatgatgtgtggggtctgcaatggggattaggggcccattcatgggatggaattggaggtagagaaggggtgggagagtgggg

SEQ ID NO: 12247 - DNA, 201 bp, Homo sapiens
aagacggttgtgagaatcacgtctaattaataactgtaactaaaaagtgtgtgtgtatatatatatatgtatatatatatatgtgtgtgtatatatatatrtatatatatatacatatatatgtatgtatgtatgtgtatatatatatgtatgtatgtatgtatatgtatgtctaggacagcatctggcttgtagtaattg

SEQ ID NO: 12248 - DNA, 201 bp, Homo sapiens
cacattcctgtgtatatatataaatagatatataccttgtatatatttgaagaacattttgttgtttcacctcatcttgtgccgcatgaatttttggtggytcaatttattttgttttcatatttactattttgatcattatggctatttttaactcattgctatacttttatgagtaactataatcattattttcaaata

SEQ ID NO: 12249 - DNA, 201 bp, Homo sapiens
ataaatggtagaggtaatattcaagtccaaatctgtttgaaaatagacattttctttatattacagtgtgccagtcattctttcaacacttctcaaagtaytaagttatcgaattttgacacgctcctttgtggagcttagcatgactcgggtttccctattgcctcaaggaggtccttggctttaactgtcttagataaa

SEQ ID NO: 12250 - DNA, 201 bp, Homo sapiens
cccattttatagtcgttcccaacatttgttgagttctccactaagtacatgagaccacataggatacaacaggacattaaaagcttttttttttttttttwtttgagacggagtctttttctgtcacccaagctggagggcagtggcacaatctcggctcactacaacctccgcctcccaggttcaggcaattctcctgcc

SEQ ID NO: 12251 - DNA, 201 bp, Homo sapiens
ctgtttttacaagaaaaaaagcccaatgaaatgtaaaccttgttttcttcagttattggtcctaggagtattcagagtaaataaaaaaaaaataccttacrtatacttctataaaatcttttatttgagcaattaaaaaaagctatcttctttcagtcttatcaaggagagcaaattcctcctagaagtcttatttctact

SEQ ID NO: 12252 - DNA, 201 bp, Homo sapiens
attctctatatgtgtgagtgtacatgcacacatgagccatttgagagtatgcatacaaaacatatttatgtagatatgtatttcccctgaaccatttgaawctcagttgtagtcatcattccttttttaaataattcagtgtgtatttcctaacaaggactttctcttacaaaatcagagtacagtgatcaaaatcagtaa

SEQ ID NO: 12253 - DNA, 201 bp, Homo sapiens
catgttggacaggctggtctcaaactcctgacctcaagtgatttgcccgccttggtcaattaaagtgttgggattacaggcgtgagccacagcacctggcygccacaaacttttatatgaccggatctcactgtcatgaggacagcaccaagccacaagagatccaccttcatgacccaaacacctcccaccaggccccac

SEQ ID NO: 12254 - DNA, 201 bp, Homo sapiens
aggcatggtggcaggcacctgtaatcccagctactcgggaggctgagccaggagaattgcttgaacccgggaggtggaggttacagtgagccgagatcacrctctgcactccagcctgggcaacagaggaagactccatctcaaaaaaaaaaaaaaaaaaaagtaaaattgtctttttttttttttgcgtaccaaatccta

SEQ ID NO: 12255 - DNA, 201 bp, Homo sapiens
aggaagactccatctcaaaaaaaaaaaaaaaaaaaagtaaaattgtctttttttttttttgcgtaccaaatcctatcaatgaaagagacaggaatagattygactggaatagtcatgggagccatttccaggctctcatagtcttagagatgacacttggtagttcagtgtcttattgtgcttcttcaagcacatacagcc

SEQ ID NO: 12256 - DNA, 201 bp, Homo sapiens
gtccccaggggacatattgtcaattgtctggagatgtttttgattgccacaactgggaagatgctaacggcatctagtgggtagaggtcaggggtgttgcyaaatagcctacagtgctcagacagcccccaccacagagaattatcccacccaaaatggcaatagtgtagaggttgaaaaatgtcactttaaaatgtaaat

SEQ ID NO: 12257 - DNA, 201 bp, Homo sapiens
caatacgaaaccagatctaactgaaacttcactcaacacattcccgacccgccaccccaaccctaatagcctctcataaccaccgttctactctacttctrtgagttcaacttttgcagtctccaaaaagaagtcaggtcatgtgatatttgtctgtgcgtggtccatttcacttagcataatagggggactaagttcaag

SEQ ID NO: 12258 - DNA, 201 bp, Homo sapiens
caccgttctactctacttctatgagttcaacttttgcagtctccaaaaagaagtcaggtcatgtgatatttgtctgtgcgtggtccatttcacttagcatratagggggactaagttcaagagatctactgcacaacatggtgaccatagcaaataataacatcttgtattttgaaaatcactaagggagtagattttaag

SEQ ID NO: 12259 - DNA, 201 bp, Homo sapiens
aaattatcactgctttctaagacttaccaagctaggggtgttgtaaagtatgtatgcaattgacttttgacttttgattcttatgttgaaaggcaacataraaaataagcttccattaatgtaatgatatagtgttaggaagacagtatctacagtccattcaaaatattctgaaaattatagtattgattttggaacagt

SEQ ID NO: 12260 - DNA, 201 bp, Homo sapiens
ttgcttttggattctttctaaaccaaataaataaatcttcgagactgcaggttaatcaaatgccttcaaacatgaaggctgtttaggagctaagctgcacrgacattttccaacatttaaactcttcatgcagcatcttcctatctcaatttgtacccgttagccagttccacagggcatattgggaaataccttttattt

SEQ ID NO: 12261 - DNA, 201 bp, Homo sapiens
agctaataaatactgtgcagagaatcatgaggagttgatgttcagttagtgagcaggctggttcgttactagggaagatgtgaagggcctctgagaagtaraattgtagcagagacctaaataacgagaaagacctagccaagcactgagcaaggcaagggatgttcctggaagggaagccagagagtatggccagagccc

SEQ ID NO: 12262 - DNA, 201 bp, Homo sapiens
tcatgaatcacaaatgttcttaatggtatctagaatggcggatccttctaacaattttttcaatttatttttcccagatccattagaagaatcactatctrtggcagctattgccttacaaaacgtgtttcttaagtaagatgttaaagtcaaaattgctttttgatccatgcacagcagaatggatgttgtgttagcagg

SEQ ID NO: 12263 - DNA, 201 bp, Homo sapiens
gaacagtactattttgaaaggaatcttttattccaagcactaggtctcaacaatggacttaaaatatttagtaaaccatgctgtaaacaactgtcatctakgctttgctagtccacttaaagactacaggcatagtacatttagcataattcttaagaaccctaggaattttgaagtggcaaataagtattgactttaagt

SEQ ID NO: 12264 - DNA, 201 bp, Homo sapiens
tttgatggctctgcggctcttttttccctttttccttgcttttttttttttttttttttgcaacacaacagtcgtgcgatggcctttcctacatgccacasggatgcagccttctgataggagggcaaagtcggcacatccacacacacactggcatacgctcttgcacacacagtctctgtcacatacacaggcgccaag

SEQ ID NO: 12265 - DNA, 201 bp, Homo sapiens
tctttattagtaattataagtgaaattggaaaacattttgcctaaaagaaaaaaatcacaaaatcctcagagcaaaatgctgatggtcttacctttctagmatccctctcccttcttggggctgaccctgaggagttagggagacagggttacgtcattgccagagaaaggggataaatggggagtaggatgccttggggg

SEQ ID NO: 12266 - DNA, 201 bp, Homo sapiens
ttacgtcattgccagagaaaggggataaatggggagtaggatgccttgggggtaaattattgtgcccaatgcagagaagagattgctcttggtatcccccrgccgtgttctccttacatgacccctcaggtgtggataggagacttgcaaaagaagaagcattccttctaaaacctcactgcctagaaatgtgctggcccg

SEQ ID NO: 12267 - DNA, 201 bp, Homo sapiens
ttcctggctgccagggtagggctctttctactccatcatgctgcctggtgggctgtgggcccttttccaagggtattgcagctgctgctgtgggggctgcmtggggtgccttcttagttctctttcttcagaggggagtgaggtcttggtggggcaggtgggtggtaggtgtgtctctaaggaaggcacacttgcagagct

SEQ ID NO: 12268 - DNA, 201 bp, Homo sapiens
ttcaggcttaggaggagggggctgctggttgtagcactgctgcttaggagtaatgctgctggttgtcttttgcatggcactaaggaaactctgtttcccarggtgtccccgttaccttcttccttgcttcatgcaccttgtctgaggagggagttgaggtgatttggggtggtgataggtgggcagaaggtagagaacctg

SEQ ID NO: 12269 - DNA, 201 bp, Homo sapiens
taaacctgcatgggacagccacactccccatggcccttgcagcagggactggccctcagcgtgagatttcagtgaaaggacaattatccagcacctgcttygagcagggcatcatgctctgctatttttcacttaggtgggtagtgtcctcatttatctgttgaggaaactggtgatcagaggggttaaatcgctttttta

SEQ ID NO: 12270 - DNA, 201 bp, Homo sapiens
aaacctgcatgggacagccacactccccatggcccttgcagcagggactggccctcagcgtgagatttcagtgaaaggacaattatccagcacctgctttsagcagggcatcatgctctgctatttttcacttaggtgggtagtgtcctcatttatctgttgaggaaactggtgatcagaggggttaaatcgcttttttag

SEQ ID NO: 12271 - DNA, 201 bp, Homo sapiens
ctgtgtacccagtctcgtgttcagcatgtgacatatatttgttctttgtttttttttttttttgtttctgtttttttgtttttttttttttcttgttttaracagaatcctgctcttgttacccaggttggagtgcagtggcttgatcttggctcactgcaatctttgcctcctgggttcaagggattctcctgcctcagc

SEQ ID NO: 12272 - DNA, 201 bp, Homo sapiens
aacttgctgcatattgaaatcaccatattaaaattccaaacccatgctgcacctcacaccaactaaattagactctttagggacaagagcctgtcctcggygtattttaaagcttccaggtgatcccaccaggcttgctaactgatagtttggaacagcctctcctgcaaagcaggtgttgggaggctggcatctcttcca

SEQ ID NO: 12273 - DNA, 201 bp, Homo sapiens
atcagagcagccaaatgtgaatgcaggtgagttctgtgtgtgcaaacttgggcaagtaatttcccttctcagagtctcagatttgtcatttacaaaatagsaatggcgtcatacctaccctacggattcctacaggttggttgggaatattgaggagttgtcagtaaattatctactttagtgctctcagaatgatgtctg

SEQ ID NO: 12274 - DNA, 201 bp, Homo sapiens
agtccttgagggccaaatgagaatgtctcaccctcctatcctcagttccctttcaggaactaccttccacagacaaagcctggaactttctcattttgaasaggaatacctgtgccatgtgcattgcaaaataacaacacaaactagaaaacaacaaaattcagaaaacagagaaattcatagaaaagaaaatgaagatca

SEQ ID NO: 12275 - DNA, 201 bp, Homo sapiens
accttagcctcccaaagtgctgggattacaggcatgagctgctgcccccacccagtgactctcttttatatatgaaaggaaatcgatttgtttctaaccakgtaagcgtcctacataagggaagacaatgaaatttcctcagaaaagtacaaggaaaattcattttcccttatttttcaaagcatctgcttggatagagct

SEQ ID NO: 12276 - DNA, 201 bp, Homo sapiens
gaagacaatgaaatttcctcagaaaagtacaaggaaaattcattttcccttatttttcaaagcatctgcttggatagagctgtaaaaccagaagaactgtrtgtttcattacaagcaaattcacaactggtggggtgtggggctgggccagggggatgaccattggtgaaggactaacttacatgtttcagaagctttaca

SEQ ID NO: 12277 - DNA, 201 bp, Homo sapiens
gggctggtgtgatggaggtgggaatgtgggagtggtgccaccagtgtgactgaatgaggaaaatcttgagatggaaatgatgggggaaccaagcagacccstaggtcactctttagctcagggcctcttgtggcaagtaccaccatgccgatgggtcagagttccagaaactgggatgagcaggggatattaaatcatccc

SEQ ID NO: 12278 - DNA, 201 bp, Homo sapiens
actgtaagtttgggtaggggagcctggaaaagcatcacatgaaaggcttttaaagagtcagggcagtgttaggaaacacaggctagccagggagtctgctrgagggtaagggcctatgtcttacaaacagaattggctccttttactaagaaacttgaatatcaagcacaaatggactgaagaggccaaagttaggtgtga

SEQ ID NO: 12279 - DNA, 201 bp, Homo sapiens
cctgcccttggaaagccctcctgccaggcactggacccatcaatgcatggtggcttgagggctctgcctttctctctctgtacctcacccacctgtcctgstagacatggtatcatagtgcccatcctctgcggctggctgctaggctaactctccccctctgcatctggactctggcccataggcatagaaagggggctg

SEQ ID NO: 12280 - DNA, 201 bp, Homo sapiens
gccatttgtctttgtgtctaatctgcaacgtgtgcagatgcagaagtggctcaattgatgacctgtcttctggagcactcaggggatcctgggaggctctsttgctcagacatttcagaggtgttaagaagcccttggtggagatctgtgtggggaggttaattatgactgtcccccgaccccccacccttttttttccct

SEQ ID NO: 12281 - DNA, 201 bp, Homo sapiens
ctaatcccattcatgaaggctccaccctcgtgacccaatcacctcccaaaggctccacctcttattatcacactggggatgatttcaacatataaacttargtgggggaatgtgagcattcaggccataacactgccatttatatttttgtgttcattcatttagtaagtaggtttccaaaaatttgtttgaggtgtaagc

SEQ ID NO: 12282 - DNA, 201 bp, Homo sapiens
actaggaagcacccttgtccacagctgtttcctgccgctgctttgttggtgctgggaagtttcgtttgtgctgggggggtttcgtttgtgctgcagggggktggggggggcaggggttagtttgtgcacctaggtggccactctttggatctcccacatctgttctgggttctgaactttgaccccgttcctgcttcttcc

SEQ ID NO: 12283 - DNA, 201 bp, Homo sapiens
ctaggaagcacccttgtccacagctgtttcctgccgctgctttgttggtgctgggaagtttcgtttgtgctgggggggtttcgtttgtgctgcaggggggkggggggggcaggggttagtttgtgcacctaggtggccactctttggatctcccacatctgttctgggttctgaactttgaccccgttcctgcttcttcct

SEQ ID NO: 12284 - DNA, 201 bp, Homo sapiens
ggcacggggatcaagcccgggcccctctcctatctaccctggatatgagccgtggccaccttattagtctgtctgtgtcctgctgtattcctttcaaaacmgggtcccacaccatcgaaaatacagactttgtctcatcactccctctgtttaaaatcttccaacagctccccaagactttcttagcttggcatccaggac

SEQ ID NO: 12285 - DNA, 201 bp, Homo sapiens
agattctggatattagccctttgtcagatgagtaggttgcgaaaattttctcccattttgtaggttgcctgttcactctgatggtagtttcttttgctgtkcagaaactctttagtttaattagatcccatttgtcaattttggcttttccaacaagactttttagccttacatttttttcccactattcgctcccaccca

SEQ ID NO: 12286 - DNA, 201 bp, Homo sapiens
tgatgttaaattgccaagggtatggagatggggagagtgaagaatttgagacattaatacaatcaaacccaatcaaaccactacacaacattatgggagaratcgctgaattttctttcttttttttttttttttttgagacagagtctcactctgtcgcccaggctggagtgtaatgcgtgatctccgctcactgtaacc

SEQ ID NO: 12287 - DNA, 201 bp, Homo sapiens
gaggctgggaagcaagattccacctcctacttctgcagagaagctctgcttttaactgtcttatgttttggggtttacttctttttttttttttcaatcaragtcttgtggcttaagaaaggaaagccctgttataatggaaataaacccggtcaaagggtcctgatagttgagctgtagtgccacttccgccaccgtcca

SEQ ID NO: 12288 - DNA, 201 bp, Homo sapiens
tggattgtattgtactccatgtatagacctacttagtactggacatagaacccctaaagatgtccagtctcttctgggtcatccccagtaacagggagccygcttcatttggaggtaatctgcttctaagataaagacataaatactctctgtagaacttccgttcactagacaaaattctatcctggagggcaatagaga

SEQ ID NO: 12289 - DNA, 201 bp, Homo sapiens
tcgtgacttcctaaatcaaacccacttgtagacagtccgacttccttgagtctgtctcaagctcagctaaagctccaggcagttggaaaagggaggaatgraattggaaggaggggtggggagggcaaatggcagccagatcttctgagccacaccttgtggcaaatagcccacatgtcagagttgtgtgagccccccccc

SEQ ID NO: 12290 - DNA, 201 bp, Homo sapiens
ctttctccttcacagggcagatgaggtggggtgtgtgttgcaggctgcacttgggggatgggactaccatgaccccctttacttgcagtcactggctccayagtatgggtccatcacagtgaggccccagaggcagagctagagtaagggaggctttagggcagggctccaaaggtcgagtgcccttccttacacaaaata

SEQ ID NO: 12291 - DNA, 201 bp, Homo sapiens
gcctgtgtctctgtcgtgagatggagcattgcctccctggatgcggatgataagcaaaatgtcaagttcctggtgcaggaggttatcagcttggcctgtcycaggggctttgttccttctagccagagagagagagagagagagagagagggagaataggaaagaaaatgaaaatgaatgaatatgagtatagtattcaat

SEQ ID NO: 12292 - DNA, 201 bp, Homo sapiens
gccgagatcacgccactgcactccagcctgggtgacagagtgagactccatctccaaaaaaaaaaaaaaaagattggaagttctggaatacattggagaaratgaaaaggggattggattagacttgcctaacaagcccatcatggtagccagagtcagacacaccaacagaaataaagatttcgctaaaaggcctagtag

SEQ ID NO: 12293 - DNA, 201 bp, Homo sapiens
gaatgtgtccaaaacatattcatgaagtcaaaacgtcaggaccaaaatagcctgtgttgtttatagagaccagccactcagaaggattaagaaacttaccygaggtcatacataaagtgggcagcagatatctgttgggtcactatagaatctacagcccctcttgttcagtgaggggcagagtaaggatgtaaaattggg

SEQ ID NO: 12294 - DNA, 201 bp, Homo sapiens
agtatggatgaaatcttctgaagacttgggatattaaaaaacaaacttggtgtgctctaaatttactggaccaccgttttgttttgttttgttttgttttkttttcaaagaacaactgttcacatcttgctggatgttgtgatgttgtatttttatggaatttagttttggatatgctaccccagcttttaatcctttctc

SEQ ID NO: 12295 - DNA, 201 bp, Homo sapiens
ccagagtcctggttttaagcattgcgtgtgtatagacaaatatatatgcacacacacatacatagaatcatgtgaactgatgcaggcatttatggataagwgtcagatgacttagaatggtttggagactattctgaactggctagaactttgagttaaaaagaataattaacttgaccaaataggaagggagcatcattt

SEQ ID NO: 12296 - DNA, 201 bp, Homo sapiens
tcccagcagagaagtgaccaggggtcaccacatagagctgggccctgcatagggtctcccagccaagggggtgaatgggggtatgaatccaacctgtgttyctcttgccaagcttgtgcccatgaggctgcctctgacaaaaggggcatctttttctagtgctcacacaggcgccatattggtcctgggtgagataacatg

SEQ ID NO: 12297 - DNA, 201 bp, Homo sapiens
gaagtgaccaggggtcaccacatagagctgggccctgcatagggtctcccagccaagggggtgaatgggggtatgaatccaacctgtgttcctcttgccawgcttgtgcccatgaggctgcctctgacaaaaggggcatctttttctagtgctcacacaggcgccatattggtcctgggtgagataacatggtggagtgaa

SEQ ID NO: 12298 - DNA, 201 bp, Homo sapiens
ctggcagtgtcctggttgcttctgaaaagctaaacagaaaagtccttaccaatgcactttatgatcctggtagcccatgctgctacctggaatgtcctccmtctaaaccctaaaccattttccaagacctgttaaaaattcctctgtcctccagaaaccttttctgagcacctggaaccctctttatagtccctactggtc

SEQ ID NO: 12299 - DNA, 201 bp, Homo sapiens
tccagaaaccttttctgagcacctggaaccctctttatagtccctactggtcttattgtctgaattaatcatttgacacttaggaattatccattcactcrttcaatcatcaaacacacactgaacacttattgtctgtcaggtactataataggtgttgccttacatgtcagtacatttccatagcataataaaaataac

SEQ ID NO: 12300 - DNA, 201 bp, Homo sapiens
ttatcacaaatcctacctattgcacagaacaacggtaaaaggaaagttctcgtgattaggcccagagcagttctgcaaacacaagactgtaagctagaaarccaggctttctgcccagcagcaggaaggctggggtgtccatgtttgttgcatgtcccagggtatgtgcatgtggagtctgacatgtgagcaagcgtgcgg

SEQ ID NO: 12301 - DNA, 201 bp, Homo sapiens
aggatgggactgagaagaaatgaatgggatggagcttgaacatgaagctgagggagcagccttgctggtcacagcgtttactgcttgtttaagcttccacrttgtatgtttgttttgcgctgcctccttaggatgttgcaatgctactgcctttactgttgtgagtttttgttttgtgtgttttatgtctctttgtgtgtt

SEQ ID NO: 12302 - DNA, 201 bp, Homo sapiens
ttcagtgcatttcatgttcagtgtttggggatgattctgtgttggcctgcctccctctaaactgagggcgggccttctgcatgatcttgtactctttctakcaggaacgggggagggtgttctaagatcccctcccagtaaatatattgagggaacaggggaagtatgaaattatgtatcattgttgctattatttggaat

SEQ ID NO: 12303 - DNA, 201 bp, Homo sapiens
gaaaggaggtgggtgggaaagcagggagaggaagaggaataaatgattaaagggctacatctggctgtatctccacctctccactgacgctacttagtggraggcactggtgacctcataggcacagccaccaatctgcctaggactcaacttttctgatgcgtgtggcactgttgcctcttctctcattggcaatacatt

SEQ ID NO: 12304 - DNA, 201 bp, Homo sapiens
gataagtagtgtcctagtgtaagagaagcaataggtcatggtgggaatcatggcaaactggagagtgcaagtcccatcaaaggcagtagtctccactctgytccagctgatcgctgccatgcaaggatgcaggcacagtcaccagatgctcaagaaaagccagaagtggacgtgataaaaatgtcatctgaaggtatcttc

SEQ ID NO: 12305 - DNA, 201 bp, Homo sapiens
tcaatagtgggaggtagtttgattaattttctctttgaccattgctgtgatcagttaccaagaatccttcctacccttggcactaccttcggagaggctgktctgtgtgttgggtaaagttgcttttgtagagtggtgtgggaaagtgtggggagggtatggagaatgcagagaatgacctgggagagaggtatctgacat

SEQ ID NO: 12306 - DNA, 201 bp, Homo sapiens
aagttaatttactgttgactcttaaagagatactgctctttttttcccccaacccacacaaaacagagaccttccacctggagctttgaaaagtgcttccstgcaggttggaagctttccagtcagttgtaacaacgatggcaagtattgggatgaaaaatgttgcttaataacattttcttgttttttttttatgaatat

SEQ ID NO: 12307 - DNA, 201 bp, Homo sapiens
atgtgcagatttgttatacaggtaaattgtgtgccataggggtttggtataaattattttgtcacccaggtaataagcattgtacccgataggtagttttyccatcctctttctcctcccaccctccatcctccaccctcaagtagtccctggtgtcttgttcctgtcttggtgtccatgtgtactcaatgtttagagatg

SEQ ID NO: 12308 - DNA, 201 bp, Homo sapiens
gggcctggtggctacagtgacagtctctgccccagtggatgagttgtgttctgtgcttctgtgttctgatcttgtgtcatgcgtattagctttcttcagcycaccttcattcaaacaaaggtgagtatggtttctatgagatagagaatcacttctcattcatttttctattacacacatgtatgtgtattttgtgtattt

SEQ ID NO: 12309 - DNA, 201 bp, Homo sapiens
ctgccccagtggatgagttgtgttctgtgcttctgtgttctgatcttgtgtcatgcgtattagctttcttcagctcaccttcattcaaacaaaggtgagtrtggtttctatgagatagagaatcacttctcattcatttttctattacacacatgtatgtgtattttgtgtatttttcttttcctttctttctttctttct

SEQ ID NO: 12310 - DNA, 201 bp, Homo sapiens
tcaaacaaaggtgagtatggtttctatgagatagagaatcacttctcattcatttttctattacacacatgtatgtgtattttgtgtatttttcttttcckttctttctttctttctttctttctttctttctttctttctttctttctttctttctttctttcttccttccttccttccttccttcctctccttccttcc

SEQ ID NO: 12311 - DNA, 201 bp, Homo sapiens
tgtatttttcttttcctttctttctttctttctttctttctttctttctttctttctttctttctttctttctttctttcttccttccttccttccttccytcctctccttccttccttccttcctttctctttctttctttctttcttttctttttatttttttttgagacagggtcttgctctgtcacccaggctggag

SEQ ID NO: 12312 - DNA, 201 bp, Homo sapiens
cttaaacaacaaagggcatttatgggctcagtttctaaaaagtccagtaactcacatgatatgaccaagacctagtgtttgtcttccccattttttggctygactttcttggtgttggcttcatttttggcagctcctgcccatgtgattttaagatggctgatggccattcccaggatgatttggtttttggtctttgta

SEQ ID NO: 12313 - DNA, 201 bp, Homo sapiens
atcccatttagaaataccttcccagacacactcagaacaatgtttaatcagagtactgggactcagttaagttgacacgtaaaattacacttcacaagtcyaccccttttcaactcgacactcatctatatctccttaaatgatacttaatctataaataaagataaaaagatcataatttcacctaacatgatacaccta

SEQ ID NO: 12314 - DNA, 201 bp, Homo sapiens
ccgtgagccccaagtcccacccccttgcccaaatttatcagggcttgccttacacactggtggttgctatgggcttgggtgactcccaacagcgatgacartatacattctcagtaacctggagctggcactgaggctgcagccctggacatggggtgtcctctgggtataatctcacttaactttactctgcaaatgcaa

SEQ ID NO: 12315 - DNA, 201 bp, Homo sapiens
gctgggcgtcggagattcagagaccatgttccttgataaccagcaattaccttctgaatgttacctgagtgcagatgaggaaggtctctgaaagcatacarggcgggggcttccaatacacactccctactttggactgttcaccactttgaataaaactaggatcacactcccattccttccaaaattcttactcctttc

SEQ ID NO: 12316 - DNA, 201 bp, Homo sapiens
ccgtccaaggatttatccttccataatttgaactgaacgtgaggaatggacaggggttatgtttcggggtgtgggaaggcacctgagccatggtggtcctyatagccacagtgttgcataggactatcccttcctctctcttcagtgtgatagggtcagaggcagaagtactctgcctttcacagtgtcacagattgcttg

SEQ ID NO: 12317 - DNA, 201 bp, Homo sapiens
gttatctattattatcgttatttttatcattatcatcattgccctgtgtgcccagtctgtacctgatggaatggcctttctcattcaagtaggggaagaarcatccagagaacagtttgaaaaaaatcatagggtgtaaaaaaaaagcctagggtcaggggatctagattctttcccaagctctgctatagctgaccttga

SEQ ID NO: 12318 - DNA, 201 bp, Homo sapiens
tcattatcatcattgccctgtgtgcccagtctgtacctgatggaatggcctttctcattcaagtaggggaagaagcatccagagaacagtttgaaaaaaakcatagggtgtaaaaaaaaagcctagggtcaggggatctagattctttcccaagctctgctatagctgaccttgaatgagttgtttcatctctctgcccct

SEQ ID NO: 12319 - DNA, 201 bp, Homo sapiens
ctccatcatattacattaatctcagagctaatctaaaactcaggttttaaatttttgattccatgctgtttctacaatataatgtatttccttgaaataargtatgccatagtgctgaaagccattgccatgtatgatatacttgggttttttgaatttgtccagtcttttccactttgtaggaaggttctaagattagcc

SEQ ID NO: 12320 - DNA, 201 bp, Homo sapiens
ttaatctcagagctaatctaaaactcaggttttaaatttttgattccatgctgtttctacaatataatgtatttccttgaaataaggtatgccatagtgcwgaaagccattgccatgtatgatatacttgggttttttgaatttgtccagtcttttccactttgtaggaaggttctaagattagccaaccccttaatgggc

SEQ ID NO: 12321 - DNA, 201 bp, Homo sapiens
aaccactaacatttcttgggtgcttacatatatgtcaggtaaattgtatgtttcacattcattatctgattaaatgttctctcagcaaacctgtgagctargtactattattttctcaattttacagacaattaacttatggtttagagagttgtgttgacttgtccagtcacatagctaatacattggtgttcaaatgct

SEQ ID NO: 12322 - DNA, 201 bp, Homo sapiens
atagtactcacagaaatggtttctatagttttctgcaaattgttctacatagtgttgatatgtttagctctagggcatctatttttgcctgctgtatagtrttctatcaataaatatactacattcctttcttctagtagtagacatttagattgtttacagttattagcttttgcaaacatttcagtttttgcatacatg

SEQ ID NO: 12323 - DNA, 201 bp, Homo sapiens
tgtatttattataggaagagatttacattcttttcctttatactaataacctaagccagtttatgggcataggtaggtggagaaatgtaattcattactgwgtaagtgggtctacagcccatttagtagggccattatatatttttttccagatagaatttatttaaagaaaatgattttcaaagctgatattaagtcaga

SEQ ID NO: 12324 - DNA, 201 bp, Homo sapiens
tactaataacctaagccagtttatgggcataggtaggtggagaaatgtaattcattactgtgtaagtgggtctacagcccatttagtagggccattatatwtttttttccagatagaatttatttaaagaaaatgattttcaaagctgatattaagtcagattctgtgacaagtacgcagtggttctcaaccttggctgca

SEQ ID NO: 12325 - DNA, 201 bp, Homo sapiens
atttatttaaagaaaatgattttcaaagctgatattaagtcagattctgtgacaagtacgcagtggttctcaaccttggctgcacattggaatcaatgggragctttaaaaaattctgatgtatggttctcagccccccagagagtctggttttaattggtctcaggtgtggcctgggcagtggacgtcttaaaggctctc

SEQ ID NO: 12326 - DNA, 201 bp, Homo sapiens
tccacaaaacagacaggtgtcttatacaaactcccaaagaaactgtgggtggaggagaaaccagcactgtatgagagcaacaatgaagtggccgagctgtyacttctcctgatttgagttctttgtccagccacattccacggtgaaaacactaaaggtacgttcagaaccgatacaaactcatccaccacaaatatcaag

SEQ ID NO: 12327 - DNA, 201 bp, Homo sapiens
aatttgttttcactattgttaatgattaacctttccctaagttccactgtacctggaaatgttgcctagtaatgcaatggaaccaacaggattagcaagamattaaaaaaaattaatctacatctcattctttttacattttatattttgatgtaggttttatagttaatgtaatgttgcaatagatcatgtacatgattt

SEQ ID NO: 12328 - DNA, 201 bp, Homo sapiens
ttgtccttagaaaaaagcatatttattttctttctttttttttaaaacaaggatatccacattttattgttttccttttatctgattctgaaaaaaaaaawtttaccagaactatgtattttttcctgtggatataatcatcaggctaatccctacgatgactaaaagttgtggtggttgcatggtcaccaacttctctct

SEQ ID NO: 12329 - DNA, 201 bp, Homo sapiens
agtgcagttcactgcagcctctgcctcctgggttcaagcaattctcctgcctcagcctcctgagtagctgggatcacaggcacccaccaccatgcctggcwaatttttttgtatttttagtagagatagggtttcaccatgttggccaggctggtctcccactcctgacctcaagtgatccacctaccttggtttcccaaa

SEQ ID NO: 12330 - DNA, 201 bp, Homo sapiens
ttagaacttcctggatttaatttctgactccatcacttgcaacatattggtgctgtgcatgttattagaatgatttgaggtcatctaaatattaaggatawgctaaggtatgttgaaaacatcatgcagagttacacatagtagggttcaaatattcatttctaacttttctttcattaaagagttcctcttcctcttgaa

SEQ ID NO: 12331 - DNA, 201 bp, Homo sapiens
aatctttagtataagttttatggttgtttattacttaaaataggaaagcttcactaatagagtggttgttataagtaagggttagagagagcatattaagktatacctgggagtttatagttctttaaatcttgtcaaactgtattattcttttaaatatgtcatatgacggtttataattattgtgaatactttaaaaag

SEQ ID NO: 12332 - DNA, 201 bp, Homo sapiens
gagagagcatattaagttatacctgggagtttatagttctttaaatcttgtcaaactgtattattcttttaaatatgtcatatgacggtttataattattrtgaatactttaaaaagctggtggtgaatacgttacaggtggatcacacctgtaatcccagcactttgggaggctgaggcaggtggatcacttgaggtcga

SEQ ID NO: 12333 - DNA, 201 bp, Homo sapiens
agagagcatattaagttatacctgggagtttatagttctttaaatcttgtcaaactgtattattcttttaaatatgtcatatgacggtttataattattgwgaatactttaaaaagctggtggtgaatacgttacaggtggatcacacctgtaatcccagcactttgggaggctgaggcaggtggatcacttgaggtcgag

SEQ ID NO: 12334 - DNA, 201 bp, Homo sapiens
gtttataattattgtgaatactttaaaaagctggtggtgaatacgttacaggtggatcacacctgtaatcccagcactttgggaggctgaggcaggtggakcacttgaggtcgagtttgagaccagtctggccaacatggtgaaaccccatctctactaaaataccaaaattagccaggtgtggtatccttcgcctataat

SEQ ID NO: 12335 - DNA, 201 bp, Homo sapiens
tttataattattgtgaatactttaaaaagctggtggtgaatacgttacaggtggatcacacctgtaatcccagcactttgggaggctgaggcaggtggatmacttgaggtcgagtttgagaccagtctggccaacatggtgaaaccccatctctactaaaataccaaaattagccaggtgtggtatccttcgcctataatc

SEQ ID NO: 12336 - DNA, 201 bp, Homo sapiens
attgtgaatactttaaaaagctggtggtgaatacgttacaggtggatcacacctgtaatcccagcactttgggaggctgaggcaggtggatcacttgaggkcgagtttgagaccagtctggccaacatggtgaaaccccatctctactaaaataccaaaattagccaggtgtggtatccttcgcctataatcccagctact

SEQ ID NO: 12337 - DNA, 201 bp, Homo sapiens
agtgaaaattctttttttaaaaatttttgctggttcaacttcttcctccttgatacacacacacacacacacacacacacacacacactcattctcctaamgataatatcatctctgctagatccattctttgagatttgtgatacagcactgaaagactgagaagaaagagagaattaaagtagcaggactaaaaatggg

SEQ ID NO: 12338 - DNA, 201 bp, Homo sapiens
aagagattgggagaaaggattaaaaacatgacccaactctgtgttatctatgagaaatacactttcgatataattatgtagacaaaatgaaaatgataggwaaatatatattatgccaacattaattgaaagaaaataggagtgatgatattaatatcacatagactttagagcaaagactgttgccagagacaaacaggg

SEQ ID NO: 12339 - DNA, 201 bp, Homo sapiens
ttggaggcttcacagtcttctcaaaattggtaataggtaattggtaataaattgatataggaaatcagcaaggataaatgtatgagtctgctagggatgcygtaacataatgtcacacacagagtggcttaaacaatgtaaatttatttctcacaagataatgtggaagctgaaagtccaagagagaggtgtcagaagttt

SEQ ID NO: 12340 - DNA, 201 bp, Homo sapiens
gtcacattgggagttagagcttcaacatatgaattgggatggggaaacataatttagtccataacaatataaaataactcaaaaccactaccaactaatasgaactaattgacatatatagaatacccaacagcagcagaatacatatttttttgcaggtgtccatagaacatataccaagatagaccacatcctgggcca

SEQ ID NO: 12341 - DNA, 201 bp, Homo sapiens
aagatagtacaaaaaccccactacataccaatgtccttcatgaatatgacacacaatctttaaaaaaatattagcaagtacaattcagcaatatgtaaaargaattatgtaccaggaacaagtaaagtagaagggtgcagggaatgcaaatctggctcagcattcaaaaattgatatatcccacaatattaacaggctaaa

SEQ ID NO: 12342 - DNA, 201 bp, Homo sapiens
caggtaagttcagcagtgtcacaggattcaatttaaatatacaaagaacaattgtatttctatgtattagtagtgaaccacatggacatcaaaattaaaayatgatgccatttataatggctcagaaaataaaatacttcagtataaatctaacaaaatgtgcacaacttgtatgctgaaaactgcaatgctaaaagaaat

SEQ ID NO: 12343 - DNA, 201 bp, Homo sapiens
gaagactcaaaatagtagagatttcaattctccctgaattgatatccaggttgtaatgagttgagtttggcccctcaaaagatgtgtttacagcttgcagygagccgagattgcgccactgcagtccgcagtccggcctgggcgacagagcgagactccgtctcaaaaaaaaaaaaaaaaaaaaaagatgtgtttacatct

SEQ ID NO: 12344 - DNA, 201 bp, Homo sapiens
cacacacacaggagtacacagacgcaaaggagaaggcaatgtgaagacagagcagagggaaatgcagccacaagccaagaaatgttaccagtgccagaagstggaggaattaagaaaagattcttccctaaaacctccagagggagtgcaaacttgcttgatcctctgatttcagactcctggtctttagaactgtgagag

SEQ ID NO: 12345 - DNA, 201 bp, Homo sapiens
ggggtttcaccatgttggtcaggctagtctcgatctcctgactcaaatgatccaccctcctcggcctcccaaaatgctgggattacaggtgtgagccaccrcacccggcctatacttaatattgtttttgaggttatctgcaatgctcacccccagctcacaagaccaatgtagtactttatgtataacaaatgtcaataa

SEQ ID NO: 12346 - DNA, 201 bp, Homo sapiens
tctgtgctcaatgaaatatgtgttttcctaactctgacactcactgttattgcaatgcatacagactcctcaaagatcgtaagccctaaaagttgataagwgttcagagaacaagctctcactcagtacaggaattctatcctgtgatatttcttgagagaatgaaattgttgaattcttagatcttgaaagcagtttaaa

SEQ ID NO: 12347 - DNA, 201 bp, Homo sapiens
tcctaactctgacactcactgttattgcaatgcatacagactcctcaaagatcgtaagccctaaaagttgataagtgttcagagaacaagctctcactcartacaggaattctatcctgtgatatttcttgagagaatgaaattgttgaattcttagatcttgaaagcagtttaaatcctcgagtagtggctaagactggg

SEQ ID NO: 12348 - DNA, 201 bp, Homo sapiens
gtaacaaccaggttattgacgctgatatcatcaagatacagaccatttccatcaccacaaggatccctcctgttaccctcttatagccatactaacttccygtaggcctatttatgatatccctattctgttccattgacctgtgtctttttgccagtactctgaagtatttattactgtagctgtacagtaagttttgaa

SEQ ID NO: 12349 - DNA, 201 bp, Homo sapiens
aaaaacaccaaagcatttgataagtgtatgagaaatgatggtcaattacagtataggctcattttggaaatacgaaggttcccagggagctgtccagggtrctggactctccttaaagctctcagactcagtgcatgagaattttccatttctctgtcttctaatttcttcttctgtttaacctttttaaataccagcctc

SEQ ID NO: 12350 - DNA, 201 bp, Homo sapiens
ctccagtcattttataaagcactagtggggtcccaaaatgccactttttattttttttgggatggcgtctttctctgttgcccaggctggagtgcaatagygtgatcttggctcactgcagccaccgcctcctgggttcaagtgattctcctgcctcagcctcctgagtagctggaattacaggcacccgccaccatgcct

SEQ ID NO: 12351 - DNA, 201 bp, Homo sapiens
tattttattggtgcaaagtggtatttggaagcttaaatgtggggcagaggtttgaagtagccaaatgaactctgtggccctgagagaagagaaaggataamcaaaagaaagggaaggggactcaggcatttttctcctaataaatctctaatttttcttggaaattttgcctccaggccgatgcctggccccagaacaggg

SEQ ID NO: 12352 - DNA, 201 bp, Homo sapiens
atacatacttttgggataagctcggattgatattctgggttctgcttagaatgataagatggagtaataagggagagtaatgttgattggtagataattaygaagaaatgagttctgttaaatagtagattaatatctgcaagtggaattattagacaaggacacacaaacacagggtctctctgcctgcctatcgtctgt

SEQ ID NO: 12353 - DNA, 201 bp, Homo sapiens
cgatcctgcttaataaaatattctattattttctcagctgcaaaagtacactattatcactgatcattccctcctcatctcagagtgtttgtcactggccmcagtttatatacaagctatacaggctgcctggaacttgaattggctttagagtggatgctggggaaggggcgggggggttccgggtatctgatgaattcc

SEQ ID NO: 12354 - DNA, 201 bp, Homo sapiens
ccaagggttgaccctgttttcatgctcctgtgatttacttacagaagggattatcacattggatgagaggctgaatttcatagacctcaaatgtccttttycaactctgagattttatgtgtctatgttttcatttccaaatagaaaataacccttatcattgctaatggtattcccttaaggaagttacttaatctttct

SEQ ID NO: 12355 - DNA, 201 bp, Homo sapiens
tctcggcctccctgagttctgggattacaggcatgagccaccatgcctggccatagtccaacttttaaattttggtttaggaagtgttttttatcccatcmatccagatctccctctcatagtcagttttcacctcttccctggggatacggctcaaggagaactttcatcatcttcaaatgcaaagaccacgtggcaatt

SEQ ID NO: 12356 - DNA, 201 bp, Homo sapiens
taactgactctttctcagctctcagtatcattcatagtcaggactttacatgtgtgtgtgtaatgtatatatatctgtgtgcacgtgtgtgcgcgcgcgcrcgcacgcacacacacacacacacacacacacgtaaagtcctgactaccagtgataataatacatagttttttgggggaagaagggatgcctcttgtatgc

SEQ ID NO: 12357 - DNA, 201 bp, Homo sapiens
tctcttgaacccgggaggcggagcttgcagtgagccgagattgtgccattgcactctagcctggtgacagactgagactccatctcaaaaaaaaaaaaagraaaaaaagaaaagaaaacgtgattacattgtaggagctggaggattgttactaaatcattcaaaacagcaaaagttaaaaataaaatagtgaccagttaa

SEQ ID NO: 12358 - DNA, 201 bp, Homo sapiens
aaaaaaaaagaaaaaaaagaaaagaaaacgtgattacattgtaggagctggaggattgttactaaatcattcaaaacagcaaaagttaaaaataaaatagygaccagttaaaaatattccactggtctaacaaggaggatataaataaattatgatgccttatagatataatattaggaatatttttcagccattaaaaac

SEQ ID NO: 12359 - DNA, 201 bp, Homo sapiens
tcacgtgattatggaggctgaaaagtcccaagctctacagggtgagttggcaagctggagacccaggaaagctgatgttgtagttctagtctaaagactgrcaggtctgagattgaggaagagccagtgtttcagttcaaaggccattagacaggacagattctgtcttactgcgggaggtcagcctttgtgttctattct

SEQ ID NO: 12360 - DNA, 201 bp, Homo sapiens
ctattctgctcttcacccaattgcatgaagcctatgcacagtcaatctgttttattcaacctacaaatttaactgttaatctcatccaaaaaaacgccctmacagaaacaactagaataatgtttgttcaagtatctgggtacctgatagcccaatcaactttgcacctaaaattaatcattttaatcatcacaccaatct

SEQ ID NO: 12361 - DNA, 201 bp, Homo sapiens
aagaccccacctctaaaacaaatgtttaaaaaaattagctgggtatggtgttgcacgtctacagtcccagccactcgggaggctaaggtgggaagaccacwtgagcccaggaggtcaaggctgcagtgagcagtgatcacaccactgcactctagcctgggtgacagagcaacaccctgtctcaatttttgaaaaatgaaa

SEQ ID NO: 12362 - DNA, 201 bp, Homo sapiens
ctattgggcccacctagataatcttccttttgccatgtacgttagcttgctaggactgccgtaacaagctgggtggctactgtgtttgaatgtgtcccccmaagtttatatgttgggtacttagtccccaatgcaacaatgtgagagttgggacctttaagaggtgattaggtcacgtgggctgtaccctatgaatggatt

SEQ ID NO: 12363 - DNA, 201 bp, Homo sapiens
agctgtggccaagaggaggccaggtggtgagaagagagggaaacagaggtgaataacagttccactaaaatccaagagacctgagcttgctagttgtctakagacaactgacagagaggggcttgcaggcggctaaagccattcaacaatttctggttgtccacatgccccttctatgggaacttgacttggtaccaggta

SEQ ID NO: 12364 - DNA, 201 bp, Homo sapiens
tgagggagagttggaattcaacccacaggtagcctgatttcaaagttcaggttcttaacaattatatggtggtttatttttttcttttcttttctttttcyttttttttttttatttttgagacagagtctcactctgttgcccaggctggagtgcagtggcatgatctcagctcactgcaacctctgcctcctgggttca

SEQ ID NO: 12365 - DNA, 201 bp, Homo sapiens
atgatctcagctcactgcaacctctgcctcctgggttcaagtgattcccttgtctcagtctcctgagtagctgggattacaggcatgcgccatgatgcccrgctaagttttgtagttttagtagagacagggtttcctcatgttggccaggctggtcttgaactcctgacctcaagtgatccacctgccttggcctctcaa

SEQ ID NO: 12366 - DNA, 201 bp, Homo sapiens
ttccttgagatgcaaaaaaaaaaaaatgtaatttgcaaagatgctttgttgggagataagtaggcttcctcttgggcacggagtttatctcactcgtgcayaggttcctagaggtcgtgcaactcacgagataaagctccaggatcctccccagggaaggccagagtcagtgttcagctgttttcctagatccagggttaa

SEQ ID NO: 12367 - DNA, 201 bp, Homo sapiens
tggctcatgcctgtaatcccagcactttgggaggctgaggcgggtggatgatctgaggtcaggagtttgagaccagcttggccaacatagtgaaactgcgyctctactaaaaatacaaaatgagccgggcctcatggtggatacctgtaatcccagctactcgggaggctgaggcagaagaaccacgtgaacccgggaggc

SEQ ID NO: 12368 - DNA, 201 bp, Homo sapiens
agtgagccgagatcgcaccactgcactccagcctgggcaataagggcaaaactctgtctcaaaaaaaaaaaaaaaaaaaaaaaaaggagtgtttgagtaarggagtaaggccacccaagatatttaatacaaggcaggttgtaagtttaagtgagtatagttggagtaaaaatagaagaaattatatctgttcttaaatta

SEQ ID NO: 12369 - DNA, 201 bp, Homo sapiens
ttcctcattccctccgcagcctcctatgacttctgatttcttgtctgaacttcaggaacagcacctctctctgtgtcttcctcatctcactcctatatggkgtttcattctctttatggtgttatcacatttatttatttatttttgagatggtgtctcactctgtcacctaggtaggaatatcgtggcgcgatcttggct

SEQ ID NO: 12370 - DNA, 201 bp, Homo sapiens
tcctatgacttctgatttcttgtctgaacttcaggaacagcacctctctctgtgtcttcctcatctcactcctatatggtgtttcattctctttatggtgktatcacatttatttatttatttttgagatggtgtctcactctgtcacctaggtaggaatatcgtggcgcgatcttggctcaccgtaacctccgcctttca

SEQ ID NO: 12371 - DNA, 201 bp, Homo sapiens
aaattttcttcagtgagatttttaacttttataatggaaaataaacattacaaagtggaaaaaaatgttttgtgccacaggtttgggatgtgtttgtgcakctgtgtgcatgggagtggctgttgccacattgtgttaaatgggatggaggctgggtagggcaggaactgtgctccagtcttctccaaggacaggtcattg

SEQ ID NO: 12372 - DNA, 201 bp, Homo sapiens
tcccttccttgcttccttccttcttccttctcctccttctcctcttcttctttctcttcctcctcctcatctcccttccctcccccatcccctctcccccsccacctcctctttctcctcccactctgtggtccaggctggagtgcggtggttcaatctcacctcactgcaacctctgtctcctgggttcaagtgatcctc

SEQ ID NO: 12373 - DNA, 201 bp, Homo sapiens
gttgttgggattttttttagatatagcaagtactcagcaaatttttgctgaatacatttacttagaacaaagggacactggcctcctccagccagccacayattattttatatatattattatgcaaaacacagttgttcagtattgcccctttgcaagatgctccttgacctttatctaagggaattaactgctattatt

SEQ ID NO: 12374 - DNA, 201 bp, Homo sapiens
gagacagaatcttgctctgtcgccaggctggagtgcagtggcgcgatctcggctcgctgcaacctctgcctcccaggttcaaacagttctcctgcctcacyctcccgagtagctgggacaggcatgcaccaccatgcccggctaatttttgtatttttagtagagatggggtttcaccgtgttggccaagatggtctcaat

SEQ ID NO: 12375 - DNA, 201 bp, Homo sapiens
acatgattcgtgagtgtcttcattcttctctttcttccctttcttctcttcaacacactcaacacacacacacacacacacacacacacacacacacccamgaaattcacctctggctctggaatctggagaaagttcaaagtcatgcagcaatgaccgtcagcatgattaggcctactggaatcaacaagataaattcag

SEQ ID NO: 12376 - DNA, 201 bp, Homo sapiens
attgctatatataataatttgacaaatccattaaactaatacttactgagtgcttactatgtgtcacacagtattgggcaatggagatacagtgataagasaagttttgtaatttcacagtgcctaatttttttaggccaggaaaaagactataaacaaagaaagacacataagaaacatatgagatagtgatttgtgcta

SEQ ID NO: 12377 - DNA, 201 bp, Homo sapiens
tgatggcagatgcctataatcccagctgctcaggaggctgaggcaggaagaattgcttgaacctgggaggcggaggttgcagtgagcagagatcacgccayggcactccagcctgggtgatagagtgagaccctcaaagaaacaaacaaacaaaaaacccaaaaaagaaatttggagaaataagcttcgtcatggggctta

SEQ ID NO: 12378 - DNA, 201 bp, Homo sapiens
taatcccagctgctcaggaggctgaggcaggaagaattgcttgaacctgggaggcggaggttgcagtgagcagagatcacgccacggcactccagcctggrtgatagagtgagaccctcaaagaaacaaacaaacaaaaaacccaaaaaagaaatttggagaaataagcttcgtcatggggcttatattataacaacagac

SEQ ID NO: 12379 - DNA, 201 bp, Homo sapiens
gtatttgttaaaagttagattcccaagtcagagctccagagagtcccagctctgggtggcatccaggaatctttatttaacaaaagtagattcttatacartgggtccaggaatctcattttaagaaatagtggattggagaatatgaagtataaaaattgttttcacagttgacctgagttgctaataaacaatttgcta

SEQ ID NO: 12380 - DNA, 201 bp, Homo sapiens
tagtcaatctgggttgcagttctgatttagatgtcaccgtactctgctttaaaggttattttggatctttgcctgtctttgatgtgttctagtacccatcktcctgtctccatccccagcatctgagaacacttctcatttccccactagattgtttttttaaatttttgagcatgctctgttttattttctgattatgaa

SEQ ID NO: 12381 - DNA, 201 bp, Homo sapiens
gtggctcacacctgtaatcccaacactttgggaagccaaggcaagtggatcacttgaggtcaggagttcaagaccagcctggccaacatggtgaaaccccrtctctactaaaaatacaaaattagccaggtgtggtggcatgcatctctagtcccagctactcaggaggctaaggcataagaatcacttgaacccaggagg

SEQ ID NO: 12382 - DNA, 201 bp, Homo sapiens
acatggtgaaaccccatctctactaaaaatacaaaattagccaggtgtggtggcatgcatctctagtcccagctactcaggaggctaaggcataagaatcrcttgaacccaggaggcagaggttgcagtgagctgagatcatgccaccacactccagcctgggccacaagagtgaaactccatctcataaataaataaata

SEQ ID NO: 12383 - DNA, 201 bp, Homo sapiens
atggataaagaagcagtttctaagatgccactcaagagctctctggagatttacagagagctggacttttttttttttttttgagacagagtctcacgctwtcacccaggctggagtgcagtggcacgatcttggctcactgcaacctctgcctcctgggttcaagcgattctcctgcctcagcctcctgagtagctggga

SEQ ID NO: 12384 - DNA, 201 bp, Homo sapiens
agttggccagaatggtcttgatctcctgatcttgtgatccacccacctcggcctccgaaagtgctgggattacaggtgtgatccaccacacccggcctccsaaagtgctgggattacaggtgtgatccaccacacccggcctgagttttctaaacttctgggtaaggctgtttgactttggacatgacgctaggcttaact

SEQ ID NO: 12385 - DNA, 201 bp, Homo sapiens
ttgataagggagtaggcaaaaaatgtctgagtcaccagaactggggtttcacaaatgaatggtctcgctgtaacctaaagtaagggttgaagtgggggaaratgaaacaataggtggctgtagcactggaagaatatttgcagccccacaaactaatgtctgaattacttaggatacatccctctgtctagagccagccca

SEQ ID NO: 12386 - DNA, 201 bp, Homo sapiens
gataagggagtaggcaaaaaatgtctgagtcaccagaactggggtttcacaaatgaatggtctcgctgtaacctaaagtaagggttgaagtgggggaagawgaaacaataggtggctgtagcactggaagaatatttgcagccccacaaactaatgtctgaattacttaggatacatccctctgtctagagccagcccaaa

SEQ ID NO: 12387 - DNA, 201 bp, Homo sapiens
atcctctggtttatggtttcttacaggttgcaatcaaggttttagccagggctgagttctcatctgaaagcttgactggagaagaacctgcctccaagttyacctggttgtaagcacaacttcattcctggagtgttgtgggattgaaggtgtcagttcctagctggctgttcactagaggctgccctcagtttcttgccg

SEQ ID NO: 12388 - DNA, 201 bp, Homo sapiens
tcctctggtttatggtttcttacaggttgcaatcaaggttttagccagggctgagttctcatctgaaagcttgactggagaagaacctgcctccaagttcrcctggttgtaagcacaacttcattcctggagtgttgtgggattgaaggtgtcagttcctagctggctgttcactagaggctgccctcagtttcttgccgt

SEQ ID NO: 12389 - DNA, 201 bp, Homo sapiens
tgagtttgactattacagatatgtcatataaatggaaccctgtagtatttgtcctgtgactggcttatttcccttagcgtaatgtcctccagtttcattcrtgttgcaaatgataggatttccttcttttaaaaaactaaataatagtcatgcttggatgaaactttgggttgtttccatatgttattgcgaacagtgctg

SEQ ID NO: 12390 - DNA, 201 bp, Homo sapiens
cacatatctcaaaggagtgctattgatttgatcattttatgaaattcttacccttttgctttcagaattctagctagatgacaaaaaggaaataactcacrcatgtaaattaatcaaactattttggaactcaaacattgcttgtggaagacttgcagattgagccaagccctgttctttattaactctggataatttgct

SEQ ID NO: 12391 - DNA, 201 bp, Homo sapiens
tgaaatcctatcccatgtttgcattgttaattatagttttcgaaagactgtcatctaggcaatctcatttcgcatgaccattctatgagacacaggaacawgcagtctattttggcagataaaaaataaatacatgaggagttaagtaaaaactgtgttactgagactgcagtaacttttataaatcaatgtgcaaaaaaa

SEQ ID NO: 12392 - DNA, 201 bp, Homo sapiens
tgcagtaacttttataaatcaatgtgcaaaaaaaattcaagtattttggaatgagatttgttggattgaaatattttatggtggtctgtaacatcagctcrtgagctcatagaccaaaccccatcccaaatacctggtgttcaggattatcaatataaaaattgatttaagatccccataattcatttactcctatttcct

SEQ ID NO: 12393 - DNA, 201 bp, Homo sapiens
acaagtgagaaagtattttaatcttcttacatttttaggccatgtccaaatcatttgttttttcactttattttatttgaatataatttaggttttctttytcatggggtgaatgaaaataaacactttagaaatgtataaatcagtgtgcatttattggagtatggccaataactttagataatgaaaaggatgattgag

SEQ ID NO: 12394 - DNA, 201 bp, Homo sapiens
catttcttatctggctggtatgatttaggcattattttatcactagaaaagccataacgatgaagggatggtatgttcaaagcagaggattaatatttackacatatctactatgagtaagttactatgcttttttacatatacttttttacatatcatttaatcaacagtcttgtgaattaggctattctgacagatgag

SEQ ID NO: 12395 - DNA, 201 bp, Homo sapiens
ggctgaggcaggagaatggtatgaacccaggaggcggagcttgcagtgagctgagatcgcgtcactgcactccagcctgggtgacagagcaagactctgtytcaaaaaaaaaaaaaaaaaaaaaaaaaaaaagaatacaagagagtgtgacccatagttcagactactcaagtctatgtgggtctgcttcctgaacagctg

SEQ ID NO: 12396 - DNA, 201 bp, Homo sapiens
gtcctgtgtttctctttctatattttgcttctgttgctcaacattactttataaaaattttttcatatcaaaaggcagtgctctaattcactctttttaaygggtgcataatattccagtctgatgatatgttatatatgtggtattctccttcctgtaaattataattttatttccatcttacttttttctaccatgcac

SEQ ID NO: 12397 - DNA, 201 bp, Homo sapiens
cacatactgtatgtaactgcacttcagaagtcaggtgcctagcttttaagaggataaatctaaattctttgcctgcttcttctagaatccttcccaaaccmttttccgttgccccctccctttttacctgttctacactgcatcccaactggttgttacattgtcccctgcacacgttttgcacattcctctgttgtttgc

SEQ ID NO: 12398 - DNA, 201 bp, Homo sapiens
tttacctgttctacactgcatcccaactggttgttacattgtcccctgcacacgttttgcacattcctctgttgtttgcccatccattcccctcactagaygtattctattcctttttctttcatgtaattctgattcgccctgtagggctctctgcacgttcccatcaaatgcttgttccattacccaagaccaggtccc

SEQ ID NO: 12399 - DNA, 201 bp, Homo sapiens
ctgaagaacctccagctgtcacagtctcttcactcctaggactgaaggacctgttctcttctccgcatctgttcctgcatccctgtgacatctgccccaaygaaatcagaagaggagaagggaccaggactctcacttcccagactatacattgttcagcttcctctttccccctttctgacatggaaatagcgagcgaag

SEQ ID NO: 12400 - DNA, 201 bp, Homo sapiens
cattcatagtgcattcattccagtattcatttcttccttgggtcctggcctactccttccttttctctcatctattcattctaatctcatttgaacatcargctcctcccactgtcgatactttatcatcattactatcccttttagtaacttagtaaaaaagcacctctaggatctttcaacttactaaagacttttcct

SEQ ID NO: 12401 - DNA, 201 bp, Homo sapiens
tttttttttttttttttgagacaggatctcactttgtcacccaggttggagtgcagtagtgcgatcacagcacactgcagcctcaacctccccaggctcargtgatcctcccacctcagcctcctgagtagctggaacgacagtcatgtgccaccacgcctggctaaattttgtaatttttgtagcgacagggattcagca

SEQ ID NO: 12402 - DNA, 201 bp, Homo sapiens
tactccaaggaggcataggagtttaaaataggaaaacagtagtacgttgtgatggattgtatttttcaaagaaagtcacaataatatttcccatcccatgmactcttctgcaatgtatccttgacattctgtcatcaagattaagaggtagactctctctctaccctcttgaatgtggataggccctatgatggcttcgat

SEQ ID NO: 12403 - DNA, 201 bp, Homo sapiens
ttaagaggtagactctctctctaccctcttgaatgtggataggccctatgatggcttcgatcaataaaatatggtggtttaacgctgaggcaggtggggcrcgatgtctcacgcctgtaatcccagcactttgggaggccgaggtgggtggatcatgaggtcaggagattgagaacatcctggccaacatgatgaaaccca

SEQ ID NO: 12404 - DNA, 201 bp, Homo sapiens
cgcgatgtctcacgcctgtaatcccagcactttgggaggccgaggtgggtggatcatgaggtcaggagattgagaacatcctggccaacatgatgaaaccyagtctttactaaaaatacaaaaattagtcaggtgtggtggcacacccctgtagtcccggctactcaggaggctgaggcagaggaatcgcttgaacccaga

SEQ ID NO: 12405 - DNA, 201 bp, Homo sapiens
aacccagaaggcggaggtttcagtgacccaagatcgcgccactgcactccagcctggtgacagagtgagacttatatctcaaaaaaaaaaaaaaaaaaaamaaaagtgctgaggcagtgaggcagctctggaaatagcccttaactggcttggcagcttctgttttctgactcttagaagccagttgccatgtaagtaatg

SEQ ID NO: 12406 - DNA, 201 bp, Homo sapiens
gattaaaccactcaattgaccccagccaactcatagcaccatgagaaataacattgttttaagccactatattttggaatagttttcttaaaaatataaartgatagataaccataatagaaatttgtgctagaggaaaatccttaagactcttgaaagccattttgtctaacaaagagtgtaaataagatatggccttaa

SEQ ID NO: 12407 - DNA, 201 bp, Homo sapiens
aaatggtgacttcaggtccagggaggctactgtcctcagctctgttttcatgtaaatgtcgctcctgctgaaaggaagtggatgcaaaaaaatatctgctrtggaagcagaactaccccagactaaaatgttggtttttttttttttctctcccccttttcttttccttcaagttttccatgtggcatcagcagctgagta

SEQ ID NO: 12408 - DNA, 201 bp, Homo sapiens
ctgggactacaggcgccagccaccacgcctggctaattttttgtatttttagtagagatggggtttcaccgtgttagccaggatggtctcgatctcctgayctcaggtgatcttcccgcctcggcctcccaaagtgctgggattgcaggcatgagccactgtgcccggccttttctttattttttgagacagagtctcatt

SEQ ID NO: 12409 - DNA, 201 bp, Homo sapiens
aggcgccagccaccacgcctggctaattttttgtatttttagtagagatggggtttcaccgtgttagccaggatggtctcgatctcctgatctcaggtgaycttcccgcctcggcctcccaaagtgctgggattgcaggcatgagccactgtgcccggccttttctttattttttgagacagagtctcattctgtcaccca

SEQ ID NO: 12410 - DNA, 201 bp, Homo sapiens
gctgggattgcaggcatgagccactgtgcccggccttttctttattttttgagacagagtctcattctgtcacccaggctggagtgcagcagcgtggtctyggctcactgcaagctccgcctcccgggttcacgccattctcctgcctcagccttctgagtagctgggactacaggtgcccactaccacgcccagctaatt

SEQ ID NO: 12411 - DNA, 201 bp, Homo sapiens
ctcagtgtctgggaggagaaatcctctctgatggtggcaggggtggggacagcagccccgctgggccctgtggggacagtcccagcagcagacagtcccakttgggcttatcctgtgatgttggcctcactgtcttggcagcctctggcatttctgttctctgttcatcttccacatatggttctcaggttcactcatcaa

SEQ ID NO: 12412 - DNA, 201 bp, Homo sapiens
gtgcctggctggactctagggactcacgcttgatcatactaggattcaagaacaacgcagttgtcactgttagcccatgatcccacacgtacccagacacrttctctcacggcaagtacatctgcacctggatgccttctactagtatgacatacttaaaagtatcttggatatgccttaaagatcattgttggctgcttc

SEQ ID NO: 12413 - DNA, 201 bp, Homo sapiens
tttgtgttgtttaccagtttttttcagcttctttaaaaatagaatctttagtttgctaccttcttcttcattgtctggatatcagctatttttttaatagstatatccagtattatccccatcactttctaattttttacttttaacttgattttgcacaaggactgaaataaccaagatgattaataatgtactcaaagc

SEQ ID NO: 12414 - DNA, 201 bp, Homo sapiens
tccatccccatcttgcatcttacaaaggacccaatagaagcttcatggggtacaggaaagaatatagcaaggaccttggaggcctcaggcctcaatctggytctgccattcaatagtttgaccttggagagcaatcagaattctcagggccttagatcctctgcccgtgaagctgaggtattggactggatatctccaagg

SEQ ID NO: 12415 - DNA, 201 bp, Homo sapiens
ggaaaggaaatgaggggaaatagcacatttcatggcatcgaagagggcatctttgaaacctagcggctttccacctacagacatttagaatgcaacttatkctggcaaagctattgagggtttaaatgatatgctttatagcgtgttgcatttcttcctttgaaaatgaggagcttgaattacctttcttgcttcataata

SEQ ID NO: 12416 - DNA, 201 bp, Homo sapiens
ctcaagactctgaacacccacaccggcccatgagggcagagagtggtggctggctttctaaaccagccttgtgtcttcagagtccttgatcagagataacytggggaaagctgtgtctcataaatccactttgctactgggtcagagagatgccttgagaatgaccttagctagggaagggatggaatattggtttccctt

SEQ ID NO: 12417 - DNA, 201 bp, Homo sapiens
ccatgacttggaacaataaagcaaacatatttccaaaatggccatggcagaacagtgaaaaggtactttggtatatctcatgccacatttcacagatcttytgttctgtgatggtttatggaagtgaagtactttattatgtaaaattcatcctgttttttgtttgtttgtttgtttgttttgttttgtgatactacagat

SEQ ID NO: 12418 - DNA, 201 bp, Homo sapiens
ggggtgggagccctggctctgcatctggctagctttgtaacccagtcccacgtctactgaccccttgacttcctgttcctttgtgtgtgtgtgtgtgtgtktgtttgtttgtttgtttgtttgtttgttttgagaaggagtctcgctgtgtcacccaggctggagtgcagtggtgcgatcttggttcactgcaacctccgc

SEQ ID NO: 12419 - DNA, 201 bp, Homo sapiens
tgaataaatgcacagtgcataaatttagcttttactacaaatgtactacactcttcttatttttctttctttctttcttttttttttttttttgttgtttytgagacggagtctcattctgtcacccaggctggagtgcagtggcgcgatcttggctcacggcaagctccgcctcctgggttcacgccattctcctgcctc

SEQ ID NO: 12420 - DNA, 201 bp, Homo sapiens
agtctgcatccattttagagaactctccctccccactccccttcaacatatcccatcctctttcacctatccattcagattctttcatttaattatttcaraccctgggaattagcagtcccttcttgaaagcattggaatggggcagttttaatttttattagtatcagctttctcctcctcactgccatatttacttct

SEQ ID NO: 12421 - DNA, 201 bp, Homo sapiens
agccctattgatcttgttcaggcattgactccaggtccttttaacaagccactctgtctagacttgcaggctagagcccacagtgctaacaaaggaggagstgggctgccctccctccccctgcaggggaaggctaagaggatgggcacagattcaggcttctcaatggggattttcttaaagaactagcatgattttatt

SEQ ID NO: 12422 - DNA, 201 bp, Homo sapiens
atctttctgaattcctctgtttctctgttcttgatgcggtggtcctactctattgcccctgtctctccctccgagactcttcagttgactgggaggcctgraaagtggaaggacccaaataaaaaagtcaactttggagcagcctttcctggttctgtccgtgcttgggaactcccatcgcttgccgattctaagcaggca

SEQ ID NO: 12423 - DNA, 201 bp, Homo sapiens
cctacctgcatcagaatttgtttcctcattttcctcctcattactaacaacctaccaatcatcaacccaatttcagtttcttctcttttatttttccccaytcttcattctcctttcatctttcatatatttgggggttgggtttggactttttcttttcttttcttttcttttatttagtaagggaggtggcaggcagag

SEQ ID NO: 12424 - DNA, 201 bp, Homo sapiens
tgcttttaggtactattgaccacttgactttcctgggatgactaaagaacatcttgacatggcagtggttgaatctttcaagaatcttctctgcctccccytgagctatcagatatgagaaaaagattatattaaaagcctcagcaaggctaagaggaatgattggaagttcctctatgaaaaatgggttagaaaaggcta

SEQ ID NO: 12425 - DNA, 201 bp, Homo sapiens
atgaaatacaggaaggccaagccaagactgagttacatgagtagggtccccatcaggctactcaagcccatcacagtttcctcccacgtgttggaccttcygtgtagtttgatttggttatttccacaccatcctcttttctcctcaatctgacactcctccattttcccaagtggagaagcgaaagtgccactgagacct

SEQ ID NO: 12426 - DNA, 201 bp, Homo sapiens
tctgtcttatattaaggacttgaagagacataagagaacatggcttgttaactttgtggatggcagggacagaaaatggtagaaattgtgcatctgtgttwtctgaggttgaattaatagaggtctgacctgtgcaacaaaggaggtaacagttctgcagtataatttattggttaagaaagcaggctctggagttagagt

SEQ ID NO: 12427 - DNA, 201 bp, Homo sapiens
attggccccagagggttagtttgctgactcttgctatagttaaatggcaggcaaaacttgataattataatgcaacatattaaactctatctatctatctrtctgtctgtctgtctgtctgtctgtctgtctatctatctacctacctacctagatctatctgtctacctagatagatagatcagtcaaagttttcacagg

SEQ ID NO: 12428 - DNA, 201 bp, Homo sapiens
gctatagttaaatggcaggcaaaacttgataattataatgcaacatattaaactctatctatctatctatctgtctgtctgtctgtctgtctgtctgtctrtctatctacctacctacctagatctatctgtctacctagatagatagatcagtcaaagttttcacaggtttacaatgaagccccagataagagcacttag

SEQ ID NO: 12429 - DNA, 201 bp, Homo sapiens
ggtcacttttgtcaccatcttggttttggtgggttttggctggcgggatttttttaaattttatgtatttatttattttttattatactgtaagttctggkttacatgtgcagaacgtacagttttgttacttgggtatacgcatatcctggtggtttgctgcacccatcaacccgtcacctacattaggtatttctccta

SEQ ID NO: 12430 - DNA, 201 bp, Homo sapiens
gattacaggcatgcaccaccatgtcagctaatgtttttctttcttttttttttttttttgtatttagtaaagcctgggtttcacagtgttaggctgatctygaactcctgacctcaggtgatccacccacctcggcctcccaaagtgctgggattacaggcgtgtgccaccgcacccggccatgtcacagttttataggcc

SEQ ID NO: 12431 - DNA, 201 bp, Homo sapiens
taagagtgaattgggctggccacagcctccctcatattgagaaacccaattggtaatactcagctagcatacagattagtaatgtgtgagtgtctgcatgygtgtgcatgcttccgtgtttatatattaccagtgtatgtgcgtacctttgtatatatgagtaaaaatatatatgaagtaaaaaatcaaaatctaataact

SEQ ID NO: 12432 - DNA, 201 bp, Homo sapiens
gtcataagaattagatagcctccagcacaacgaattacaaatacttcatactctaatgcacatgtttaatttttgcttggagttgaacttaagttatggtrccttatgagagagtcaggcagcttctctgtactacataagcatgtactcgatgaagcttggggtcaaaaacctggaaactaagtttagttggaaatttaa

SEQ ID NO: 12433 - DNA, 201 bp, Homo sapiens
tgattaaagccttcattaggctagaagcagaagtgcttcacaggccaggcaagaaatactttgtaattgcttctgacgggcagatctcctttggcggttgytgagccatcaggaagccgtacagcactggtccacgtgtattttgtataaattagtgggcttgacattacaagaggttgcccctatacgcagtcatcttct

SEQ ID NO: 12434 - DNA, 201 bp, Homo sapiens
taacttttattttgagctctagaacttggacattttctggctcctgccttgcaagtctgaacctcagttccagttttctatttttggtgcttagtgttttygtctttggcagatcctgaccactgttaacaaaatataaagcatgaaaatggtggcatccatgcgatgcagcagttgggactatgagccccaggttggatg

SEQ ID NO: 12435 - DNA, 201 bp, Homo sapiens
tgtgctgtacaaagataacaaagttgagagagttttaagtgatgagtgagtggagtggacagtttagcggagggagaaatcacagcaggcccaagtcatcrgctgcctgagggagagaagggaagtggggcagagacagtgggatgtgtgattccgtggagaccccagaagcaagattctttcacaacacttcttagtcat

SEQ ID NO: 12436 - DNA, 201 bp, Homo sapiens
aagcaagattctttcacaacacttcttagtcattcttttaccctgagtaggaacgttatgcaataataagattagcccagaagttttatctagaagctgtrtcatcctggaagctgaagagaataagttcatttcattattatctattgtcaaaggattaaatttggaagggagataagtatatatttatttttttgcttg

SEQ ID NO: 12437 - DNA, 201 bp, Homo sapiens
agaaagctctgctggacccccttgcaaggtgaattagtatctggttcagtattctttgtaaaatcagactctcaactaaatcaatgtccttgactgactgrctgaaatagggcttcagggtgtctcattctaccactgtacagagggcacatgcaatgtgcaaaaaataaaaacaaaaacagacctctgtccccaccagct

SEQ ID NO: 12438 - DNA, 201 bp, Homo sapiens
aaacaaaaacagacctctgtccccaccagcttttaacacttactcttttctttcaagtaatatatccacatggttgaaaaaaagtctaacactgtaagagsgcacagtgaaaagtaagtcaccctcccactccagaatattaatcccgcaaatatactccccaatgacaattttatagttccaaagagactttatgcttac

SEQ ID NO: 12439 - DNA, 201 bp, Homo sapiens
cgaaagctgtagcttctcagtttgttttttggctttatgtttcttaattttcacccttgcatgcttgttgattcttttgctactctctttaatggctgttktaaaattatgtttctgaaaagatacctgtctcatagatggctcacattctccgcttatctctcttgtcactcactgcgcaattgtctcagtgatagctct

SEQ ID NO: 12440 - DNA, 201 bp, Homo sapiens
ttgttttttggctttatgtttcttaattttcacccttgcatgcttgttgattcttttgctactctctttaatggctgttgtaaaattatgtttctgaaaasatacctgtctcatagatggctcacattctccgcttatctctcttgtcactcactgcgcaattgtctcagtgatagctctacgatcctggagctaaggatg

SEQ ID NO: 12441 - DNA, 201 bp, Homo sapiens
gagctaaggatggttttacaagtagcatttccactgctaccagagcaactctcatgtcactggtgtgatccgcccccattgccccattctttgcttctctytttcctcatcaccatggaaaccgattgtgacatcacagatgctgcattatgtgattattttgtaggataaacttcactgtgcaagaatttatgcaacaat

SEQ ID NO: 12442 - DNA, 201 bp, Homo sapiens
cctcactaactctctcttcctcttcataaccttttacattttgtttaaatggctttgtttctgcagctgcagatcaaacaagctagccccaggcagtacayagctactatggaatagtaacaaagtgggggtgggggtggggcaaaatagtcaggggtttttgaatgcctggacagtctgcctagctttctatggaccatg

SEQ ID NO: 12443 - DNA, 201 bp, Homo sapiens
cttggcacagcataaaagttaccttacccgtgtctcaggcaggctaaaacacacaaaattgccatttgttcatttctgtctgttcctaatacaaatttttytttcaaacaattttgaacaaaggggaacagtttttgttgtttaaaccaccagtggacccaacttcaacaaatatgtttgaatttcagaagtcttaaattt

SEQ ID NO: 12444 - DNA, 201 bp, Homo sapiens
tgttgtttaaaccaccagtggacccaacttcaacaaatatgtttgaatttcagaagtcttaaatttcatacctgggagctaaagcactggctaattctttkctcttttttttttttttttttttttttgagacagagtttctctcttgctgcccaggctggagtgcaatggcgcagtctcggctcactgcaaactctacct

SEQ ID NO: 12445 - DNA, 201 bp, Homo sapiens
ctgggattacaggagtaagccaccgtgcccggcctggccagttttttgaactactgatgaatttgatcaaagcctattaaaaacttactgagtaaacaaayaattgtcccatgaaagcagtataatctaaaattttaatacagtctgttaaactttcattttttcatgagaatgttttctggtaacttgttttagattata

SEQ ID NO: 12446 - DNA, 201 bp, Homo sapiens
gaaactgaggcacaggaaggtgaagtcacttcttcacggttatacagctcatacatattagagctggaatttaaatacaggcaggaactgtgctgctctcwacctgtatggtctcagccaagagggttaagtagagaaaagatacactagatgttaggtcactgagatttttctgggtcttcctaagggccagcttgactt

SEQ ID NO: 12447 - DNA, 201 bp, Homo sapiens
agagacataatctgcaaactctaatgcaatctaccagtgtcaatgattcaggaaataatcacaggaaagaaaaagataacaattagaaagcaagatatgaygcacattttataccattttataattagttctggattcactgaggtcttgctcagactatctcactggtgtgggaataagagaaacctgggcttccaaggt

SEQ ID NO: 12448 - DNA, 201 bp, Homo sapiens
caacaggtcagcatataatagtccagtttgcattggtattaattcaggaatgagagataagagccctccctgaagaaacaagagtggaggtcgagttttcraacatatctgataaataaaaaaggggcaatgtcaataggacttagttagtaatcaattacacacagctaaagaatagctgaaattgaattagagcaaggg

SEQ ID NO: 12449 - DNA, 201 bp, Homo sapiens
gacaaaactggatttgtgggggcggtggggaggtgcacagtggctcatgcctgtaatcccagtgctttgggagatagaggtgggcggatcacgaggtcatragttcgagaccagcctggccaacatagtgaaaaccccgtctctactaaaaataccaaaaaaattagccaggcatggtggcaggtgcctgtaatcccactt

SEQ ID NO: 12450 - DNA, 201 bp, Homo sapiens
actattcctgtaactcagtattagctatagagcggcaagattcagtgttgcttaaagtggacaggtgggcaggcatggaatgaatgaatctggaatagagygagaagcaggcttatgcatctgaggcaggcatttctaccatctaaaacaatggggtgactttgcagctctccttggtgaaaagagcacttcgtggatgat

SEQ ID NO: 12451 - DNA, 201 bp, Homo sapiens
tgtagaaaatttggcacatggaagtttattaattcaacttattctttggccgacattaactgagtacctgaatacaaaacctgtggtggttctacaaaacscatttcatgataaacaaaaataaatataattgagcataactgtaccaagcagaaatggttattattaacatatctgtatgctttattctattattttggg

SEQ ID NO: 12452 - DNA, 201 bp, Homo sapiens
aatagcaccagaattctaagtctgctggccaaggtgctgcctcctgcagagagagaaagcccatcaaagttgacttcagtgactcccccttcactcacccmtcatcttccacggccaaccaactccctttttgattgacacatcatttctttacatacattaatgccttccatattaccacagagagtttgttagactgga

SEQ ID NO: 12453 - DNA, 201 bp, Homo sapiens
aatggcacaaatgctgacctccattcaaatcttgccttaccactaactagctgcgtgatcttggagtaattgcattgcctttctgaggtttcattccccakatcttcaaaggaagtgacaattatataccttgaaatgttgttgtaagcatttgagataataggcatacagtgtgtggtgttttggtagattctcagaaaa

SEQ ID NO: 12454 - DNA, 201 bp, Homo sapiens
agtagagagaactcatctcagccttgtccctgggtcccttgaagtacaagtgtccttagtaaggacaatgacaattcatgtggaattaattagtagaaatycccacatataaaatttgtccttcactctatttcttaacaggaaaaatcaaatcaaatacattaacaccaattagatgacaacataatcgaaaacaaatgt

SEQ ID NO: 12455 - DNA, 201 bp, Homo sapiens
atctctggaagtctgggggtagggtttaaagttccaaccctctaatcacatggttggtttctttggcagtcagtccccatcctgaagctatctagggtccwttaagagttaccttattaggataaactcagattatggttcaaaagggctacttatgaataacaaaagacactctcctccctgtcactcaggaaatttcaa

SEQ ID NO: 12456 - DNA, 201 bp, Homo sapiens
ttctcatttcttcccttcttttccttttcttttctcttttcttttcttttctttctttctttctttctttctttctttctttctttctttctttctttctytctctctttctttctttccttctttctctttctttctttctttctttctttctttctttctttctttctttctttctttctttctttcttttccttcttt

SEQ ID NO: 12457 - DNA, 201 bp, Homo sapiens
catttcttcccttcttttccttttcttttctcttttcttttcttttctttctttctttctttctttctttctttctttctttctttctttctttctctctytctttctttctttccttctttctctttctttctttctttctttctttctttctttctttctttctttctttctttctttctttcttttccttctttcttt

SEQ ID NO: 12458 - DNA, 201 bp, Homo sapiens
tttccttttcttttctcttttcttttcttttctttctttctttctttctttctttctttctttctttctttctttctttctctctctctttctttctttcyttctttctctttctttctttctttctttctttctttctttctttctttctttctttctttctttctttcttttccttctttcttttttctacctcttctt

SEQ ID NO: 12459 - DNA, 201 bp, Homo sapiens
tccagaaagatatgataaattaaaagacgagctacagacttggagaaaacattggcaatgcacccagcacacaaaggattggtattctaaattgtataatkaccccctacatgtgatcaagagaaagaaaaataacccaatgaaaaatgagcaaaggatatgaataagcaaatgacagatgccaaaaccaaaatggatagt

SEQ ID NO: 12460 - DNA, 201 bp, Homo sapiens
tctccttaagcagttacacacagctctgcaaatgttagagtgacatttggactgggcttgcgtactcagcttgcccgctcttctgggcttccccgggggtstgccaagctccagcacattggtattagccttgcaggcctcacctcccagagctagcaataacatttaccagctacagttttctccattttcaaatatttc

SEQ ID NO: 12461 - DNA, 201 bp, Homo sapiens
tgggcttgcgtactcagcttgcccgctcttctgggcttccccgggggtctgccaagctccagcacattggtattagccttgcaggcctcacctcccagagstagcaataacatttaccagctacagttttctccattttcaaatatttcctctggcccacatgccagtgatccagctcctccatagagtagaacctgaaag

SEQ ID NO: 12462 - DNA, 201 bp, Homo sapiens
gcccgctcttctgggcttccccgggggtctgccaagctccagcacattggtattagccttgcaggcctcacctcccagagctagcaataacatttaccagmtacagttttctccattttcaaatatttcctctggcccacatgccagtgatccagctcctccatagagtagaacctgaaaggagtggtttaaagaaaggag

SEQ ID NO: 12463 - DNA, 201 bp, Homo sapiens
agcactttgggaggccaaggcaggagaatcacttgagtccaggtgttagagaccagccttggcaacatggcaaaaccctgtctttacaaaaacaaacaaamaaacaaacaaacaaaaaaaaaagtagccaggtgtggtggtgctcctgtagtcctagctacttgggaggctgaggtgagagaattatttgagcccaggaat

SEQ ID NO: 12464 - DNA, 201 bp, Homo sapiens
gacacaatgattaaataaaattaattacttatatcctctagaaatagaaatgggcttactatgacaaatacagatatataccatttgggactaagaaaaawtttatgaagaaaggtatgtgaaatatttttaatagccaaaaatagaggaactctggaatgggtgggaaaggagtgagcttagcagaccttctctgtgaaa

SEQ ID NO: 12465 - DNA, 201 bp, Homo sapiens
tgaaaatagaacaatagagattatgcaatctgaatagaagaaataaaaattttgtatatttataatatataactttaatgaatggcgtgtttgtatatgcrtgcacatacaaacacaagaacttccatcatgaagcattatggatgtgctttggtgcttggaagcatgggtgtgctccaggcatagctctatgacaatttg

SEQ ID NO: 12466 - DNA, 201 bp, Homo sapiens
agatatacctaatgttaaatgacgagtcaatgggtgcagcacaccaacatggcacatgtatacatatgtaactaacctgcacgttgtgcacatgtaccctraaacttaaagtataataataataaaaaaagtcttggttttcttgtctgcaagtaggaataatagaatcacactatagtgttaatcgaggtaacaaattgt

SEQ ID NO: 12467 - DNA, 201 bp, Homo sapiens
tgtcctggtgggaaggtggggtttttgaatccataccaatcttatctgctgtcaggtcaactggacacacttggaaaatgcctacatcataaacctaaagwctctgggacacaaaggactgttttgagcagtgacttctttagttatgtcttttttttttcttctagttttcagtgtttacagtaccgtgctctttttctt

SEQ ID NO: 12468 - DNA, 201 bp, Homo sapiens
gtcaggagaccagcctggccaacatggtgaaacctcatctctactaaaatacaaaaattacctgggcttggtggtgcgtgcctgtgatcccagctactcgrgaggctgaggcaggagaatcgcttgaacacaggaggtggaggttgcagtgagccgagatctcaccattgcactcaaacctgggcaataaagtgagattct

SEQ ID NO: 12469 - DNA, 201 bp, Homo sapiens
catctttcatttatttttccccatctagactgtatcaggataaactgtaactccagtaagttttccctcaagtttcattttgttctttaaaaaaaaaaaamaaaactgactttattttgtttactgttttatgagctgttttttatttgaattattttttcttttaacaatggagtgggggggacctggggctaagaagat

SEQ ID NO: 12470 - DNA, 201 bp, Homo sapiens
aaagcaaaaagaaccagggctgttttctggagaatttctggaggaaatgtcctgttcctatggctgtagttccataaggctggcagtaacctaagaggcaygcggttctgaaaacaggtatgaacttctcgttggtgtcatgagtgcgcaagtgaaagtatggaaaatgactttttgtctttgaccttgtctgattgtgcc

SEQ ID NO: 12471 - DNA, 201 bp, Homo sapiens
cttcttagacacagaggagaaaggaagtagtgtgctgtacaaaaatatattgaccttaagacacttaagtgccacaatagagttatttgtgtcagagaatwgctttgatgatcttgtgtattccctatataagctgatacctttgattcatcatagaggtgcacagtaatctcagagatgtatgaaaataacatcacaagg

SEQ ID NO: 12472 - DNA, 201 bp, Homo sapiens
acttaagtgccacaatagagttatttgtgtcagagaattgctttgatgatcttgtgtattccctatataagctgatacctttgattcatcatagaggtgcmcagtaatctcagagatgtatgaaaataacatcacaaggatatgatatctgcaaattttatctcccaagactactagtgtttgagtctttctcctcttgga

SEQ ID NO: 12473 - DNA, 201 bp, Homo sapiens
aaaataacatcacaaggatatgatatctgcaaattttatctcccaagactactagtgtttgagtctttctcctcttggacttgcttggataatttgtttcyttcttttttttttttttttttttttgccttttcccttagcttctctgccttaagtttctaagcagactccatttccagtgctttggaaaaattaacagca

SEQ ID NO: 12474 - DNA, 201 bp, Homo sapiens
taacatcacaaggatatgatatctgcaaattttatctcccaagactactagtgtttgagtctttctcctcttggacttgcttggataatttgtttctttcytttttttttttttttttttttgccttttcccttagcttctctgccttaagtttctaagcagactccatttccagtgctttggaaaaattaacagcatgtg

SEQ ID NO: 12475 - DNA, 201 bp, Homo sapiens
gttttatatttcttgtaacatatagaacacttcaagtgtaacaatatttatcgtatcaataacagccagattttagtatgatagtgggatgcttcctaaayatataatattaaacacttcttaataaatattaattcagattggtttattttaaaatagttaataagattatacatggaacaaaaggcaaaatagtaaaaa

SEQ ID NO: 12476 - DNA, 201 bp, Homo sapiens
catgactttgattatccatcctcctacatatctgatagaaaacacaaggagtaggaatctcatggttaacatttcaaaggcatgaaaattgaatactaagygaagatacaacttcattctttcccctcttcatatcttcctggaccctttttctcctttgtcacagcaaaataatataggctactaagtctatgcacaagg

SEQ ID NO: 12477 - DNA, 201 bp, Homo sapiens
aaagagggagagagagtctggttgtggcctcaggtgattggctaaagacaataaagaaatgggtcaccggcttctttttttttttttttttttttttccaragctggtttctgttgctccttaggaaagaatcctggttaaaggtgaataaggaaggggtatactgaggcatgaatatactaaggcatatctaccctccct

SEQ ID NO: 12478 - DNA, 201 bp, Homo sapiens
ggtactccttggccaataggggattctgttcattcagtcaagggacttgagattttatttttagttatctattctttatttgtttccatgagtatcttcaraaccaacctctggactcctcatgatttggggaaatgcactattcatcattgtatcttcaccatctagcacggtgctaatcatatagaaggcattagtgaa

SEQ ID NO: 12479 - DNA, 201 bp, Homo sapiens
aggaccgaaaaaaaaaaaaaaatacaaaagaacattccagaaataattacctattcaccatctttagtacaatgctgtacaaataattaatttttggttcrttattctctattcactttttcctaacatatggacgcatatatatgggtccagtgaatcccattcaaagagaatagatggtgggaaaactattggatgcca

SEQ ID NO: 12480 - DNA, 201 bp, Homo sapiens
ggatatgataaaggtacttgtcagcctagattttgttacaaattctcaatttatgtttgattctgaataaaattttattaaagatgtctaaatgcagcatytctgctaacataggatttccaaaattttaatttgtcaggaaaatgaagagtaagagattacattgtgtaacatagggcatttttttcctgcctcgtctta

SEQ ID NO: 12481 - DNA, 201 bp, Homo sapiens
attcctacatttttcacaggcagtaatccagagaatctgatatggtttggctgtatcccccacccaaatctcacctcaaattgtaatccctgttatccctrtgtgtcaagggcaggaccaggtggaggtaattaaatcacaggggggcggtttcccccatgctgttctcatcatagtgagttctcacaaaatctgatggtt

SEQ ID NO: 12482 - DNA, 201 bp, Homo sapiens
cctttctctttatcagaatcagggaagaaaaaagccaaatggtgactaatttatcaccaggttcataactaagttaccaaaagactgaaactaatcaggtytgattttcaaaataagcaataacatttaaagcatatttgaatatacagatgtttggatcactgatatcctaagaattctatagtctctgctgattttaaa

SEQ ID NO: 12483 - DNA, 201 bp, Homo sapiens
aatctcagcactttgggaggccgaggtgggtggatcacctgaggtcaggagtttgagaccagcctgaccaacatggagaaaccccatctctactaaaaatmcaaaaaattagccaggcatgttggtgcatgcctgtaatcccagctactcaggagcctaaggcaggagaatcacttgaacctgggaggaggaggttgtggt

SEQ ID NO: 12484 - DNA, 201 bp, Homo sapiens
aaattaatttatcaagccagattgtcatcttttcttaaaaaattacatgatatgaaattcacagctttcctattcaagtgagtttttcttatgtccagctrgaatcccctttgggttaatataagtctttagtgtacgaatttgaatctttgcctgaggtgctacactgttggttctcttaaaaatttgtggcattattta

SEQ ID NO: 12485 - DNA, 201 bp, Homo sapiens
cttttgcttggcatttctccttcctgctgtcatgtgaagaaggatgtgtttgcttccccttccaccatgattgtaagtttcctgaggcctccccagtcatrtgaaactgtaagtcagttaaacctcttgctttataaattacccagtcctgggtatttcttcatgtcaggctgagaatggactaatacagtaaattggcac

SEQ ID NO: 12486 - DNA, 201 bp, Homo sapiens
cctcttttctctttcattgctctgatctttagtcaatctttggttcagccagcttgttctccttctattgactaatctctctctgtatctttcataatggkggtgggagagtccatgccgaatctcctgttggttgaagaaggtgaaagtcaattggtaaagtcactgtgatttataatgttcaaactggggagggattga

SEQ ID NO: 12487 - DNA, 201 bp, Homo sapiens
gtgcagttccagaccaccacaataaagcagataccacaataaagcaagcatataaattgtttggtttcccagtgcatataaaagttatttttactctatartctattaagtatgcaatagaatgatgtctaaaataaaatgtacataccctaattataagtattgtgttgctaaaaattgctgatgataatctgagcatac

SEQ ID NO: 12488 - DNA, 201 bp, Homo sapiens
tttgatgtccactagggaaagtaaaacatattttttatttcagcataagaagcttatctcttccatcttgtaaaataatataataataatagaattagttraacatggtgattactattacgtattttatgattccaataattcaagcacagacactatcttgaatgcgtcctagtatattcagctccacaatgatgccta

SEQ ID NO: 12489 - DNA, 201 bp, Homo sapiens
gagtttctatatatggagtactgtgtggtttataaaacactggtatttaatatattttattactatataaatgaatgaactacgtttcccaaacatctttytacgtgtgaagcaaaaaaaaaaaaaaaaaaaaaaaaaaaccacacagaaaaaaaacaagcaagcaaacaaaaacagagggaacaagagtttagagaagtc

SEQ ID NO: 12490 - DNA, 201 bp, Homo sapiens
agcatgatttataatcctttgggtatatacccagtaatgggattgctgggtcaaatggtatttttagttctagattgaggaattgccacactgtcttccayaatggttgaactagtttacactcccaccaacagtgtaaaagcattcctatctctccacatcctctccagcatctgttatttcctgaatttttaatgatct

SEQ ID NO: 12491 - DNA, 201 bp, Homo sapiens
aaatctagctaatttaatcataatttaaatagctagatctaaccattttgttattgacacttcaaaacacacaaacacacataatgaaatggtcaaatctrgctaattaacaaatacattacctcacatagttatcatctttatggtgagaacatttcacatccactctctgagcatttttgaaaaatacagtatatcatc

SEQ ID NO: 12492 - DNA, 201 bp, Homo sapiens
ctcttgaaattatttctcctaactaactgaaaatatgtatgccttggaccaacatctccccactccccacccccaaccaccccagcttctggtacccaccsatcttcagctgtttgtaaatacctacggttgatgaggaaatgcatttgttgaaatatactgaagcctgtggattattgtaataatccttttatgctatca

SEQ ID NO: 12493 - DNA, 201 bp, Homo sapiens
tcattctcagcaaactatcacaaggagaaaaaaccaaacactgcatgttctcactcataggtgggaattgaacagtgagaacacatggacacaggaagggraacatcacacactgggcactgttgtggggtggggggagtggggagggatagcattaggagatatacctaatgctaaatgatgagttaatgggtgcagcac

SEQ ID NO: 12494 - DNA, 201 bp, Homo sapiens
tgtctcttgattcctaaagctggggtatagtagatcagctgcatgctacaaaactaaatgagaccacgtatgcaaagcaactggtacttctttatatatgktactttcattcccctatcacttccccaaaaagctgcattttttctggccaggaagaatatatattaaaaggaaaagtagtgacttcatttatatctatct

SEQ ID NO: 12495 - DNA, 201 bp, Homo sapiens
aagaatatatattaaaaggaaaagtagtgacttcatttatatctatctgctgcctgatatctttcagctccaaatttgtcaaattcactctactgccaagwtccttctgctcctcttccttctccccctctaccctccataaatttactctcctttaatttattcatccatttctatgtattcacttattaattcaattat

SEQ ID NO: 12496 - DNA, 201 bp, Homo sapiens
gaactttgattcatacgtctcagcagcaggaagctgccgggagctggttatcaagtgtgactcataggagagacacaataccagaagtagccttctctggmtagtaggatcaatcatgtcttacttttttctggaatctttcccttttcagtgaggctgttttcatctacccagtttgtcagagcaaaccctaggaatcaa

SEQ ID NO: 12497 - DNA, 201 bp, Homo sapiens
aataaaattgtaccctttttataccatatacaaacatcatctcaaaacatattaaagattcaaatgttagacctgaaactataaaactactagaagaaaaygtacaggaagtgctccattgcattgtttctgggcaaggatttcttggatgtgacttcaaaaccacaggcaacataaacaaatgagattgcatgaagccaa

SEQ ID NO: 12498 - DNA, 201 bp, Homo sapiens
aacttcagactgcatttgaatgtcctggaagcttgtaaaaacagatgtgtgcctccctgcaaaagtttctaattcaatgggtctggggtgagctccaagcrtttgcattcctgacacattcccaggttgtggtcgtctgagaactacacattgagaaccactggtatagtccacagcatgcgttttagagttactttacct

SEQ ID NO: 12499 - DNA, 201 bp, Homo sapiens
taggtatgtctttttctgtctttgacaagttcctgtctgtcacccaatgccaggcattattttctggtaaaaatcaggaaggattctttctagcattctgkgactgtttctggttttatcaagagcagattgtgtctcattctgggatgtggagtatcacactgtctgacttggggaatttgttgggatataatgaagcac

SEQ ID NO: 12500 - DNA, 201 bp, Homo sapiens
ttctgtctttgacaagttcctgtctgtcacccaatgccaggcattattttctggtaaaaatcaggaaggattctttctagcattctgtgactgtttctggktttatcaagagcagattgtgtctcattctgggatgtggagtatcacactgtctgacttggggaatttgttgggatataatgaagcactagaacttacatt

SEQ ID NO: 12501 - DNA, 201 bp, Homo sapiens
tcctgtctgtcacccaatgccaggcattattttctggtaaaaatcaggaaggattctttctagcattctgtgactgtttctggttttatcaagagcagatkgtgtctcattctgggatgtggagtatcacactgtctgacttggggaatttgttgggatataatgaagcactagaacttacattgggaaaatgtcagcttt

SEQ ID NO: 12502 - DNA, 201 bp, Homo sapiens
aggtgtgtgccacacaccacgtccagctaatttttgtatttttttagtagagacggggtttcaccttgttggccaggctggtctcgaattcctgaccttgkgatccgcctgcctcggcctcccaaagtgctgggattacaggtgtgagccactgcgcctggctgccttgaaaatttacaagtaggttcaaagcaaacatgg

SEQ ID NO: 12503 - DNA, 201 bp, Homo sapiens
agtttttgagcaagtgtgtgatatgcccaaagatatgccttagaaagattcctcctggcagagtgtgagaagcaggttgagagaaaatagtaagctttgtkgagagaagattgtaagcctttctgagagcagacaacacgtggctgcataaacagaccctagtgcaatgtctgatatatagtgcagattcaatgaatattt

SEQ ID NO: 12504 - DNA, 201 bp, Homo sapiens
tattatatttacagaatttgcctattttttgaaatcaacactttgttaatcaccagacccatgacaatctataagtagccactttacgtggcttatagatytaaagtgaatgttggttttcacacattcattcataactattatttttactgatatattaggcaaaatataagattcatttatgagtttgttcatcagcta

SEQ ID NO: 12505 - DNA, 201 bp, Homo sapiens
ttgttgctttcatcttctttgatgcccttgggggcttgattgtggtataaggtaggttcagtcaactcatttaagttcgcttttccaggagtcactggggmccaggaatgagtcctggtgcatggtaatcccatgcagagttcccagccatccctctgtcagcccagcacctgtgtcttcccacatccactgtcaatgcct

SEQ ID NO: 12506 - DNA, 201 bp, Homo sapiens
aacccagtctgtgggcctttcgtgtcagaatctagtgaaatgattttgacaccacacacggcaaatctgtgcatgtttttctgtaacaaagaactgagaawatcaggagtccttatcaaagggaacctttgatgaccctctggtggtcaccttttatagtgaaaatgtttggtaaatagagaaaaaggggccaggcatggt

SEQ ID NO: 12507 - DNA, 201 bp, Homo sapiens
tgcagggtaaagagggaaatactggatatggataaggctagggatggcttcaaggttgctttcttttcctttcccttcccttcccttcccttcccttcccwtcccttcccttcccttcccttcccttcccttcccttccctcccctcccctcccctcccctcccctcccctcccctcccctcccctcccctcccctcccct

SEQ ID NO: 12508 - DNA, 201 bp, Homo sapiens
gagggaaatactggatatggataaggctagggatggcttcaaggttgctttcttttcctttcccttcccttcccttcccttcccttcccttcccttccctycccttcccttcccttcccttcccttccctcccctcccctcccctcccctcccctcccctcccctcccctcccctcccctcccctcccctcccctcccctc

SEQ ID NO: 12509 - DNA, 201 bp, Homo sapiens
aaggttgctttcttttcctttcccttcccttcccttcccttcccttcccttcccttcccttcccttcccttcccttcccttcccttccctcccctcccctyccctcccctcccctcccctcccctcccctcccctcccctcccctcccctcccctcccctccccttcccttcccttctagatggatttccgctcttgttgc

SEQ ID NO: 12510 - DNA, 201 bp, Homo sapiens
ccttcccttcccttcccttcccttcccttcccttccctcccctcccctcccctcccctcccctcccctcccctcccctcccctcccctcccctcccctccsctcccctccccttcccttcccttctagatggatttccgctcttgttgcctaggctggagtgcaatggctcgatcttgtctcaccgcaacctccgcttccc

SEQ ID NO: 12511 - DNA, 201 bp, Homo sapiens
attgatattaaggaatttgctcagggtcgcctggcttgttaaggtaaactttgaggttgcaggtgcgggtctgggaccttaaacatcatcatgtcacctakctacagcaagagccagcagaacaatactcttcagcctggttttgatatggaagatgctcttcagcttcatgctggcttgaatttcctttgcagtgaaggg

SEQ ID NO: 12512 - DNA, 201 bp, Homo sapiens
atatatatatcatagcacattcttagcctacccacctcccactaccccaaaaagcaggacaacattttccatatattctattgaagttttttttttttttwaaacttgttggcacagaagcctatatctgtagatattttaaaaactttacttatatctatttgaaatgtgttaaaaagccatatattctttttttttctt

SEQ ID NO: 12513 - DNA, 201 bp, Homo sapiens
gtgttaaaaagccatatattctttttttttcttttgataaaaggaaaagcaacaccctaccagatgttgggaggaatagtaagcaagtgattcaatcagawttctcctatggggacatagactctctcggtcaatgtcacagaatgaaatagtctcagattcacccagcagtgagttattccatctggttgtggcaattag

SEQ ID NO: 12514 - DNA, 201 bp, Homo sapiens
ggcccattatagaacatttagcagcattcttagcctctacatagtagatgccagtagtagcccccccaacataattgtcacaataaaaaaatctctaaacwttgccaaatgtcttttggagagggccacaattgttcccagttgagaatcacttcttcaggatagactgttgttaaaccattgattcagattcccagggaa

SEQ ID NO: 12515 - DNA, 201 bp, Homo sapiens
cactcagcagccgagcatcctgctgacccccagaaccctgccttgacacctgctcacaaacccctcctctccaccctcaagggcaaggtgtaatttagctrcagccttttcccaaatgcctgtagcttctacaattcaatcttttttatttgtaagtatctttgcagttttctactttcaaaagactcttagtgatttcta

SEQ ID NO: 12516 - DNA, 201 bp, Homo sapiens
ctattgacttcccttcccctttctgcctttcttttgaaaatggcccatctggattaagtttctatcaagatctctttctataagcaggatttttctcaggyatgtaatggaaaccttttacttctgttgaatggtaatcctaaggggaggtcagggaatggacttttcagttaactgctcagaggcaattgtttgttttac

SEQ ID NO: 12517 - DNA, 201 bp, Homo sapiens
ggcaagatcttctcctttacaaagctctcagctgattaggaatctcataaattgtcaaatgtcactgtttcagctaacaatgtttctaccataaacagaastgactcaaaggggcaaaaagtaaataaagtacatgacatgggagcatactctcacctgagccttagagaggaaactgacatctgtcaattcacttgttct

SEQ ID NO: 12518 - DNA, 201 bp, Homo sapiens
cccacttcaaaaaccccagggtcacttaattaaaatgactgattcctggagcctcaacatgtgccttctaaatcagacagtctatgaatgtgagactaaarccaaagtttgtactgagttctcctgtgactcttatgctccctcatgtttaagattctaccctgagtagaggccacttcaaaaatagaaactttttaatag

SEQ ID NO: 12519 - DNA, 201 bp, Homo sapiens
agtttgtactgagttctcctgtgactcttatgctccctcatgtttaagattctaccctgagtagaggccacttcaaaaatagaaactttttaatagttctstgtttacaaggtcaattctgttaagccataaaccatcccatttggaattagtactataattatggttcttatttcttacacacacacacacacacacaca

SEQ ID NO: 12520 - DNA, 201 bp, Homo sapiens
aattctgttaagccataaaccatcccatttggaattagtactataattatggttcttatttcttacacacacacacacacacacacacacaggttttttgraaaaaaaacatgttaagagaagacatttaaaagtttaaagaacttagatgttttattttgtgagaagaacaattttggggcaagtcgcttaactgtctga

SEQ ID NO: 12521 - DNA, 201 bp, Homo sapiens
atttaaaagtttaaagaacttagatgttttattttgtgagaagaacaattttggggcaagtcgcttaactgtctgagccccgttgtaccatctgggaaatrggaaaagtggcatctgcccttgctccgcacttgggatgggagagtcaaatgagaaagactgaaagcaggtgtaaaatctaaagtactaggaaaaacaagg

SEQ ID NO: 12522 - DNA, 201 bp, Homo sapiens
actgattgccttaaatttatatatgatcttgttctaatgtcctttctaaaaataagaaaaaaatattccacaagtaaaacgagagtatgatagatacttcmccatggtgctggtgtatgtagacttgcgtgagggggaggacatggaatggtatgttctccattcatctctagttttatttcctagatgagttatgggtga

SEQ ID NO: 12523 - DNA, 201 bp, Homo sapiens
tcagacctgttctttcacataatatattgaatgtccattgaatacagggaacattacttacaatttatagagtatttatctgggaaaaactgttgagaacrttattttttctccacatcccagagtcaacaagcagagaccgaaaggcataaaaatgtggaatgaaaagatagagaagagataagcagtttattctctcct

SEQ ID NO: 12524 - DNA, 201 bp, Homo sapiens
atgtatacctgaatgaataaaagctcttagagtgacagaaatgtaaacaaatacttctaacgctaagaaaagtttgttacatgttctaacaaagatttaascaaaatgttgtggctacaaagaaaaagatgggtgaagaagaatggacaaacactaggggaacatgagaaagttcctggaagaatattgtcatatatgaat

SEQ ID NO: 12525 - DNA, 201 bp, Homo sapiens
tgaattgtggtatcacttagtaagtacatacttaaagagaagaataggaggggagggaatgttagaagaatagtgaacaactaaaaaaatgtgagagatarcctggagagaaaagcaaaaggacaaggcaacacaggaaaaagcaaagtggagaaacagatatgcctagcaagaggaaaccaaagttagcccggtagggta

SEQ ID NO: 12526 - DNA, 201 bp, Homo sapiens
ccttacatgcagctggttctctaaatattccaacgattcctatcattttctgtaggagtacctgcaaaactggaaggctaggctgatggctttttctccaytaagcagtaaacacgttaagcaagcttgagccaggttctggaggaggtcatcttgcaaggataaaaaacattgcatttattggatgaatacttaatgcac

SEQ ID NO: 12527 - DNA, 201 bp, Homo sapiens
ggatgttcacagctgctgactgatcagggtggtggctgctgaaggttggggtggctatggcaatttcttaaaataggccgggcgcggtggctcacgcctgkaatcccagcactttgggaggccgagacgggcggatcacgaggttaggagatcgagaccatcctggctaacacggtgaaaccccgtctctactaaaaatac

SEQ ID NO: 12528 - DNA, 201 bp, Homo sapiens
gttggggtggctatggcaatttcttaaaataggccgggcgcggtggctcacgcctgtaatcccagcactttgggaggccgagacgggcggatcacgaggtyaggagatcgagaccatcctggctaacacggtgaaaccccgtctctactaaaaatacaaaaattagccgggcatggtggcgcgtgcctgtagtcccagcta

SEQ ID NO: 12529 - DNA, 201 bp, Homo sapiens
gagatcgcgccactgcactccagcctgggcgacagagcgaaactccgtctcaaaaaaaaaaaaaaaaaaaaaaaaaaaaaaaaaaaaaaaaaaaaaaaaawaataataataataataataataatatgatggggtgtgctgcattgactgattcttctgtttacaaagaaagatttatctgtactatgtgatgctgtttga

SEQ ID NO: 12530 - DNA, 201 bp, Homo sapiens
gggcgacagagcgaaactccgtctcaaaaaaaaaaaaaaaaaaaaaaaaaaaaaaaaaaaaaaaaaaaaaaaaaaaataataataataataataataataygatggggtgtgctgcattgactgattcttctgtttacaaagaaagatttatctgtactatgtgatgctgtttgatagcattttacccaaagcaaaatttt

SEQ ID NO: 12531 - DNA, 201 bp, Homo sapiens
aataataataataataataatatgatggggtgtgctgcattgactgattcttctgtttacaaagaaagatttatctgtactatgtgatgctgtttgatagyattttacccaaagcaaaattttcaaaattggagctaatcctgttaagcccagcagctgcttcatcaactaactttatataatattctaaattatttgttg

SEQ ID NO: 12532 - DNA, 201 bp, Homo sapiens
atgaggctggagaaatgagtaggaagcagatcaaaggccttgaaatgtcaagaactttgtaccttatgggtactgaagaagtgaaatgtttaaagaagccraattatatgatttcttttgacttcaaaatggaaaatacatgtcgatactgggggagaaattaggaggttcttgccataatacaggtggcatatgatggta

SEQ ID NO: 12533 - DNA, 201 bp, Homo sapiens
ctaattggagaaagtcatagggaaacatattttaatttcaataaaatctgatgctccaaaaattgaaaacataacttaccattcatctctgaatgtatccrtgcattttttttttcattcaagttacatttttaaatgatttgcaagttctatagactgggtaacagtgtacataacacttaacaactaactaaaatcagt

SEQ ID NO: 12534 - DNA, 201 bp, Homo sapiens
aaatgtgccacttcatattctacgactgaaaatggcactataaacaaaatggtttaggaaccagtgtagagagcaggagccaaagatggaatccagagtcmcagcatgagggatgagtaaggaagatgactaaactggtagattttagaatgagctatagcagtatcaccaaaaccaagagtggagagaacttcaagagga

SEQ ID NO: 12535 - DNA, 201 bp, Homo sapiens
ctgatggttttatgaacgtgtggcatttcccctgcttacacttctctctcctgctaccatgtgagaaggtccaagattgctttccattcaccttacgccgkgattgtaactttcctgaggcttccccagccatgtggatctgtgagtcaattaaacctttttcttttataaattacccagtttcaggtagtatcttcatag

SEQ ID NO: 12536 - DNA, 201 bp, Homo sapiens
tctctctcctgctaccatgtgagaaggtccaagattgctttccattcaccttacgccgtgattgtaactttcctgaggcttccccagccatgtggatctgygagtcaattaaacctttttcttttataaattacccagtttcaggtagtatcttcatagcagtgtgaaaatgaactaatacagtatgtaaaaatggaagtc

SEQ ID NO: 12537 - DNA, 201 bp, Homo sapiens
taactttcctgaggcttccccagccatgtggatctgtgagtcaattaaacctttttcttttataaattacccagtttcaggtagtatcttcatagcagtgkgaaaatgaactaatacagtatgtaaaaatggaagtcctgtatatacctgtctctctcaggattggcctcaaggaaccttaccaagtagatgacatttctc

SEQ ID NO: 12538 - DNA, 201 bp, Homo sapiens
ccccagccatgtggatctgtgagtcaattaaacctttttcttttataaattacccagtttcaggtagtatcttcatagcagtgtgaaaatgaactaatacmgtatgtaaaaatggaagtcctgtatatacctgtctctctcaggattggcctcaaggaaccttaccaagtagatgacatttctcacttgttcctctcactt

SEQ ID NO: 12539 - DNA, 201 bp, Homo sapiens
tcttttataaattacccagtttcaggtagtatcttcatagcagtgtgaaaatgaactaatacagtatgtaaaaatggaagtcctgtatatacctgtctctytcaggattggcctcaaggaaccttaccaagtagatgacatttctcacttgttcctctcacttgttcctctcacttcctgttgtagtatcatcttctattt

SEQ ID NO: 12540 - DNA, 201 bp, Homo sapiens
ggcttttgatccctggaattaattacatgcaaagattttcattgcttggagcagcaagcagctggttcctacgggacccaggctgaactctcttgccaatytccctctcatgcttgtccctccctccacacctacaccctttctttctttcattatgctcaatgggttcaatctaatgagggaaattgtaattaaacattt

SEQ ID NO: 12541 - DNA, 201 bp, Homo sapiens
atttcaccacatcatcacaggcatttctatggtgacgaagcgatgtgccatgaacaaagttatgccattttttaatacaagccgaggaaagagaaaaaaaycaggagcaagccactgcttcagggattggcaacctctttatgtttgctcaagatagagcgaaaaactcctaaggttttaccattaaagaaccaaataaaa

SEQ ID NO: 12542 - DNA, 201 bp, Homo sapiens
aactagcatattaacaaatatatatgggtaattatataaaattatttatacatatataattacccatatatatttttcataattacccatatatatgtatrtgtatatatatataattacccatatatatgtatgtgtgtatatatatataattacccatatatatgtgtgtgtgtgtgtgtgtgtgtgtatataattacc

SEQ ID NO: 12543 - DNA, 201 bp, Homo sapiens
attatttatacatatataattacccatatatatttttcataattacccatatatatgtatatgtatatatatataattacccatatatatgtatgtgtgtrtatatatataattacccatatatatgtgtgtgtgtgtgtgtgtgtgtgtatataattacccagaattaaacacctttaggtgtaattagagtacattaaa

SEQ ID NO: 12544 - DNA, 201 bp, Homo sapiens
tatatttttcataattacccatatatatgtatatgtatatatatataattacccatatatatgtatgtgtgtatatatatataattacccatatatatgtrtgtgtgtgtgtgtgtgtgtgtatataattacccagaattaaacacctttaggtgtaattagagtacattaaaatttggcatactttcctttagttctttt

SEQ ID NO: 12545 - DNA, 201 bp, Homo sapiens
atagtttcagtagaaatgtgtactagctcttctttgtacctctggtagaattcagctgtgaatctatctggtcctgggcttttttagttggtaggctattytctactgcctcaatttcagaacgtggtctattcagggattcagtatttttcctggttcaaatttacctttcttataaggaaggcaatcatgttggatttg

SEQ ID NO: 12546 - DNA, 201 bp, Homo sapiens
aagagaaaagcaatatgataatttgtaagtgagctgcttataataagcaggatatgacagtcaacatttttcctttttacctttccttccatctctacctsttttctttgttatagactttgagttttgtatgtgtcaggtttcattcatttgggaaaccaatgtcacatcaaattaggaaggatgttatgaccctctaat

SEQ ID NO: 12547 - DNA, 201 bp, Homo sapiens
tccttccatctctacctcttttctttgttatagactttgagttttgtatgtgtcaggtttcattcatttgggaaaccaatgtcacatcaaattaggaaggrtgttatgaccctctaattggcctttgcattgtacacaagcctcctatgtttgttcgggatagcaccacgcatccttttaaattggtagtttgactgtcag

SEQ ID NO: 12548 - DNA, 201 bp, Homo sapiens
agaaatcagtggtttcagctggaataaaaaagtaatactatggtatagcataacggagataatacaatttttgtggttttaaaacagagaaaaaagtcccycttttaatgcaaaatcacctgtaaccttgaatgtatcaaccagtgtgacttagctgataatttaggcctatttcatagagctgttatgagaactaagtaa

SEQ ID NO: 12549 - DNA, 201 bp, Homo sapiens
gatttgaatttaatgttcaagagaggggaaggcataaatatataaacatatatgtttcatacatatgtgtatacatatatatgtttcatacatatatatayacatatatacacatacttatatatacatacataaatatatttatatatccacttaaaacatatacaaaactacctatacatatatacatctatatatcac

SEQ ID NO: 12550 - DNA, 201 bp, Homo sapiens
tcgacccccacccctaagctcaagcgatcctcccacctcagcctcctgagtagctgagactacaggcctgtaccaccatgcctggttaatttatttatttwtttttttgtagagatgggggcctctatattgcccaggctggtctcaaactcctggccttaagtgttcctcatgcctcagcctcctaaaatgttgggatta

SEQ ID NO: 12551 - DNA, 201 bp, Homo sapiens
gctgagggtattattgtaaaggtgattgtttaagtcagtgggtgacggtgtcaggataattatagccaggagatatatgatcataaagacctagttagtaycccaggagaccccaagacagggcttctgcccatacttttgcaatcacacattctgaagtaaggtggcaccatttaccaagtaggaacaaaagtgaatgat

SEQ ID NO: 12552 - DNA, 201 bp, Homo sapiens
attaaaaaaatgagcctttttaaacaagaaattcctgctcatacatttggcttctgagagagagaaagagagagagagagagagagagagagagagtgtgwgtgtgtgtgtgtgtgtgtgtgtgtgtgtgtgaaatggggaaaaatatcaatgcatcaaaatggacaggtcattttgttgaatgtaactgaactcctaagc

SEQ ID NO: 12553 - DNA, 201 bp, Homo sapiens
ctgctgagacagccactttactcctgcttaattttctccctaatggtagcagtagggacttgggtatctacagtgagcttttaccaatttaacttgctgcygctataggccgttataaattattattcttatttagcacttgaatctataatttctttctttccctcatgttctataaaatatagacttagacctaagtta

SEQ ID NO: 12554 - DNA, 201 bp, Homo sapiens
ggggtttcactgtgttgcccaggctggtctctaactcctgagctcaggcaatccgctcaccttggcctcccaaagtgctaggattacaggcatgagccacygtgcccggcttccgcctctcttttttttaatgagcaatcataagttattatcaactagcatgcaggtaataattttcttatcttgttacttgtgttccac

SEQ ID NO: 12555 - DNA, 201 bp, Homo sapiens
cttagctcttcaaaggcttccaggtttttagattttccttctaagcctcaaatcctgttggtcatcaccctaaataatctatcacttatcacctgcaacakgctcaactgagataggtcttgtagaaatgaagcatagcctgaagttgagaacagaagaaacaggaggagaaaaagcaccagaagcaaatttattctcata

SEQ ID NO: 12556 - DNA, 201 bp, Homo sapiens
aaacctgccctgaagatcaaataaatgatatacatacgaattcctaataagtgctcagcaggttgtttgggcttatattagtctcctacagctgcctctcrggaagggataccccaacaaagtgtttgttaatgcttgccacctttagagaagtctcctgggatgctgcctaaacctacactgtaagcaaagtggaataac

SEQ ID NO: 12557 - DNA, 201 bp, Homo sapiens
atgctttaaaaaacctatttacttagcagtttcattttgtttgcagcctcattgcattttcttctctaattagcagatacatgcatcatctcttggagatraagcaaatatttttcttttcctcattgggtagtttcccaggaaagaagctcacggcctcactctggctccgggtttgctgtgtgctttcccacacattct

SEQ ID NO: 12558 - DNA, 201 bp, Homo sapiens
ttattaaattgtgttgagtatttagttttctgtcttattagaatggaagttccatgtcaataggacatgtggaaacatccacatatttcccttcctctggyactctacatggcaaaagtgggcagtagtctttgtatactacaggcacacatgaatgaattcatagacgaatggatgaatgagttaatgaggctatgagta

SEQ ID NO: 12559 - DNA, 201 bp, Homo sapiens
gatgaataaagggtcctgggaattcactatttttgcaagtcttctttcaatgagaaattattatatttatttatttatttatttatttatttatttatttwtttattttttgagacagagtctcgatcagtcgcccaggctggagtgcagtggtgtgatcttggctcactgcaaactgcacctcccaggttcatgccattc

SEQ ID NO: 12560 - DNA, 201 bp, Homo sapiens
tgggaattcactatttttgcaagtcttctttcaatgagaaattattatatttatttatttatttatttatttatttatttatttatttattttttgagacrgagtctcgatcagtcgcccaggctggagtgcagtggtgtgatcttggctcactgcaaactgcacctcccaggttcatgccattctcctgcctcagcctcc

SEQ ID NO: 12561 - DNA, 201 bp, Homo sapiens
ggagtgcagtggtgtgatcttggctcactgcaaactgcacctcccaggttcatgccattctcctgcctcagcctcccaaatagctgggactacaggcaccygccaccacacctggctaattttttgttcttttagtagagatggggtttcaccgtgttagccaggatggtcttgatctcctgacctcgtggtctgcccgcc

SEQ ID NO: 12562 - DNA, 201 bp, Homo sapiens
tgcctttcccaaaaagtctaaatgttttcctataatttgctgtctctccacaagtaatacatttttaaaagccatacttggtgagattatatgatccttgktcattattaaatattgccttttatttaacactattaaaaagatatattcttataaacagcttatttaaagtcaggaaccatctggaagtttcatctccca

SEQ ID NO: 12563 - DNA, 201 bp, Homo sapiens
tcaaatggccagcgagatctcttttaaatgggctccttattctttcagcactttatttgatatttgtggccacatacttgtattttgcaataaaaaaaaakttagattctttgcaattattttcttccgctaagcagaaaatcaacaaaattccagagaaccttgtgcaaatgagtgttgattgtggccatggtgcacctg

SEQ ID NO: 12564 - DNA, 201 bp, Homo sapiens
aagtaatcttattgtatcacatttctacttcattgcattgctctctaggggggaaattaacagcagaagacttgtcacttgagttctattcatgaccactytactctgagcattacagatggaatgcagcaaagaggagatacaattctaggggaatatgggcccatagatctttcaaaacaaagaagaaaagctttctca

SEQ ID NO: 12565 - DNA, 201 bp, Homo sapiens
atcttattgtatcacatttctacttcattgcattgctctctaggggggaaattaacagcagaagacttgtcacttgagttctattcatgaccactctactytgagcattacagatggaatgcagcaaagaggagatacaattctaggggaatatgggcccatagatctttcaaaacaaagaagaaaagctttctcacaatt

SEQ ID NO: 12566 - DNA, 201 bp, Homo sapiens
ggggggaaattaacagcagaagacttgtcacttgagttctattcatgaccactctactctgagcattacagatggaatgcagcaaagaggagatacaattytaggggaatatgggcccatagatctttcaaaacaaagaagaaaagctttctcacaattgctatagcaaataatgctttccactgctttagagtcatcact

SEQ ID NO: 12567 - DNA, 201 bp, Homo sapiens
acaccatgccacaaactttgtgccttataataccttggctgaatatcttctcagaggatgatcattcacttttacctttgtttgccaacttattccactgyggctctttttgtcttgcaatgcattctgtgtactggtgaagaagttttgaccacgaatagctgacaaatatgtgcaggtggtcatgcacagaagcagaaa

SEQ ID NO: 12568 - DNA, 201 bp, Homo sapiens
tttgtttgagttcattgtagattctggatattagccctttgtcagatgagtaggttgcgaaaattttctcccattttgtgggttgcccgttcactctgatsgtagtttcttttgctgtgcagaagctctttagtttaattagatcccatttgtcaattttggctttggttgccattgcttttggtgttttagacatgaagt

SEQ ID NO: 12569 - DNA, 201 bp, Homo sapiens
agattgtgtatgtgtttgagtatgtatgtatgctttaagccttgttccaagattggtttatattagaaactaaacaaatacagcccagcacggtggctcaygcctgtaatcccagcactttgggaggccgaggcgggtggatcacgaggtcaggggatcgagactatcctggctaacatggtgaaatcctgtctctactaa

SEQ ID NO: 12570 - DNA, 201 bp, Homo sapiens
tcaaaaaaaagaaaaaaaaaaaaaaggaaagaaaaaagaaactgaacaaatacgttatttactgaaggagtaaatatgtgtgacaaccagtggtgtcctcrttccgtatctccatcttcagagaatgcttgtgtgccttcaaatttatgacattttcctctcaccccttagtggtgaagaaactgaaatattgaccccatc

SEQ ID NO: 12571 - DNA, 201 bp, Homo sapiens
gcatatgtttttttctctgatattagggtataggacaggacgaggaataattaaagtccctccaaagattaggtcagaaagggaccataaaagcttttccwttaggaagctggctttggcgtttcattgtcattggagaaggcccatctgtacctatggcacgtgttatgctaggaaaatacctcctgaatccttttgtag

SEQ ID NO: 12572 - DNA, 201 bp, Homo sapiens
taggatgagaggtgttattgcatatttttacaagtatcagacatgtatgttctgaaaggcactagaatcattgaaaataagtcactgtgaagtgcaatgaytcttgaagataggggatagcagaagtgtgaaactttgtaggctaatcattatggccaatgcctaattaggatttatagtaccaaggcctgaccaaagtca

SEQ ID NO: 12573 - DNA, 201 bp, Homo sapiens
ggcaaaaagatagaataatgtttacctgatgtttatagtagtagaaaacacttcattgttagaaatagccaagaaggcacttacgttgtgggacactcatycgtcccgttgacaaaagttggattcattttatcttgcagaaattgcaaactagcatcccctcagacaaaatctagccctgataatacgtatttggacaac

SEQ ID NO: 12574 - DNA, 201 bp, Homo sapiens
ccaccatatccaaatgagaagtacagaagctattaccttaaaagtaagcagtgagaatcctaacatctttttttccatccccacattctcctcaatatgtkccctgtcctttgatgcataagagggtgaaaacctcacatgagtattttatgcactaccattttacaagtgtttcagtaaatattacttcatgtaattctc

SEQ ID NO: 12575 - DNA, 201 bp, Homo sapiens
ttttttttaagcaaaagtgttctcacacagaacacaggcaagcatgtctaacatgttccattctaagtcttgcccttgcatgtggttgaaaatgactatgsactatccacatcacaaattatgggttccagtgtgtatatggacacttctgaattcactcaaaatttttcttactgatccctattgccagatgggggagat

SEQ ID NO: 12576 - DNA, 201 bp, Homo sapiens
ttaaaaatgatttacaaatggccatcacaatgcaactggggatcaggaagagaatgttctatttgctccaatattaaaaacgcatgcccttctacagttcmttctgcagctgcctttgatttcagtactggtttactccctttttagaaattatttttttgatgaatatcatgttaaaatagttcctcctaaataatgtat

SEQ ID NO: 12577 - DNA, 201 bp, Homo sapiens
ctacctgccttttcttttctttctttctttccttgttttttttttttttttaccttcaggacttatgattctcagagaaaagagatggagaaaccagcccrtaacttatctatctgagctgaaacagaatcaatgacaatagtggcataagtatccaatgattttgagctaggccttgtgagtctctgactgtaaggtcac

SEQ ID NO: 12578 - DNA, 201 bp, Homo sapiens
cagggaaaaaaattccaaatgacaatttgtcttaaatgtagacagtgctttaaaatatatgcctgatcataagagtggatatagtatttaagtgtgtcagwactttcttgctcttctaccttcctcctttttggttattgttgaaaatatatggggaaaaaatggcaaaagaaataggccctacatctgaattttaagttc

SEQ ID NO: 12579 - DNA, 201 bp, Homo sapiens
aaacatacatattttgacttcagtaccataccagatactggaaaccaagtgataagatgactttactctgggatgtgaatgtcattgagtcagcagctttmtaccaaatcattaatctctgcccaggtccaaattgcttcagtgattttcctaccactcagcattttccttggtgaaggacccttccaatacaagtcttct

SEQ ID NO: 12580 - DNA, 201 bp, Homo sapiens
atactggaaaccaagtgataagatgactttactctgggatgtgaatgtcattgagtcagcagctttctaccaaatcattaatctctgcccaggtccaaatwgcttcagtgattttcctaccactcagcattttccttggtgaaggacccttccaatacaagtcttctggcttttctttctactagagggaaggctttctct

SEQ ID NO: 12581 - DNA, 201 bp, Homo sapiens
caacggcatcctgtttcttcacctgtttttcttttgcttacctgacaagctcttgcattcataaaagtcgaaaggattccagcttaacgtttcaatcccayaaagttgacttccatagcgtagcctggaacaccttgtctgtgaatagatatggaatcctcaaatggttttgaagccactaccagcaacaggtctgagatc

SEQ ID NO: 12582 - DNA, 201 bp, Homo sapiens
aggcatggccagtagccagagcaggagtgcctcagaaattgatgatagatgaagacaatttatgtagcagttcgtctaatggcagttctgcagggaggcakccttttgaaggtgatggctcaggttggcctacatgttcctgcccaattttaaaggtgtcataagccagtgtaattggggatctgtctggcttctgacttc

SEQ ID NO: 12583 - DNA, 201 bp, Homo sapiens
atattcctagaataagcagatgaaaatttaactatgatgcacagaagttaaatgtcagtaattccattcaactaggtcagtggaattggggcaggaacttkcttcattgtagcagtgaagctgttagctggtttacttagaaaccttgaatctgaggaatcatctccagagaacacctgatataagctacagttttcttga

SEQ ID NO: 12584 - DNA, 201 bp, Homo sapiens
aatggcagatgactgtggaaaaataatttggtgaaaacttataaaaggcccggaatgctgagatagaaccttgggttctattcagtatatattttgagaascactgatggtcactatggagaagaaagacgtgtgctatataatagaacaagaattgagaggtcattgactgggggagtttcctagacccagagaagggta

SEQ ID NO: 12585 - DNA, 201 bp, Homo sapiens
tgtttatcctcaggggacagaaagaacatatggcaactatctctcaagtaataatccttcaattttggaaatacgtattatataagatttttcctctctarccttttattctttgagctaaataatactaagaaatttaggctttctttatggtcatttcttcccaggacaatggcacagactgagtcaaattcagttcct

SEQ ID NO: 12586 - DNA, 201 bp, Homo sapiens
tatacacaacagacaagcaagataatatatatacctccaggttttgtggcatcaatagatttgataaacatactttgtgtcttcattagagcagtagatamatgaattagggctgtacagagtataaatccctgcggcacacccctacatatgccccatctagaatttctcaaatatccaggccacatctttctgtcctag

SEQ ID NO: 12587 - DNA, 201 bp, Homo sapiens
gataatatatatacctccaggttttgtggcatcaatagatttgataaacatactttgtgtcttcattagagcagtagataaatgaattagggctgtacagwgtataaatccctgcggcacacccctacatatgccccatctagaatttctcaaatatccaggccacatctttctgtcctagttacaatgttaattgccaat

SEQ ID NO: 12588 - DNA, 201 bp, Homo sapiens
aggctagttgtatggattaaatactatatacatgtaaaattattagcagatagtaggtgcttaattataattgtagacatttgtcaagaatgactcatttrgccaatggagtgttggcaaatgtttacttaataattaattggctttctgagagaaaaagctctggtttggagcatttgatgatttccctggtataaacac

SEQ ID NO: 12589 - DNA, 201 bp, Homo sapiens
atagtgtacctttataatatttcattgagaagtgtattaggcactttatcttgctaatgtaagatggttcactttaaagtgctctgtgtttgaaacattgyctttcttcacctttctaaagaacgctctaagatgatatatggcaaccaatcaatattacttttttcatttgtgtagcttatttaactacaactatttaat

SEQ ID NO: 12590 - DNA, 201 bp, Homo sapiens
ttggtggaaagatttactaaataaagcagagagacttttccaaattgtatttattatctttaaaggctttcccctgaaggtacactgggatactaagaagmcctgaatagcttaagatctctacaaaaggattccacataccggtttgggacttctaagggaaaatgcaaagattcacaacttttaatagacagtgatttt

SEQ ID NO: 12591 - DNA, 201 bp, Homo sapiens
atctgtaaactgagattaagatctgcttttctgtttaaagactattgcctacatcagagaaatcatccttcagcacttgaaagactttgaaaacagaggcytcctaggcagataatattttgtttactatggttggttttcttttttccttttgaatagactttattttgtagagaagttttaggttcatagtaaaattga

SEQ ID NO: 12592 - DNA, 201 bp, Homo sapiens
ccatcacacatgatagcttcccccatcaggagcattccatgcctgagtggtacatttcttacaattgatgaaacagtattgacacgtcatcacccaaagtmcatagtttacactaggattcactcttggtgttgtacattatcttcatgtgtcaccatcataatatcctacagaatagtttcattgccctaaaagttctct

SEQ ID NO: 12593 - DNA, 201 bp, Homo sapiens
tttacttagtaacatgcatttaagtgtcttccatatctttttttaatatatacatatatattttttattatactttaagttctgggatacatgtgcagaaygtgcaggtttgttacataggtatacacgtgccatggtggtttgctgcacccatcaacccgtcacctacattaggtatttctcctaatgctatccctcccc

SEQ ID NO: 12594 - DNA, 201 bp, Homo sapiens
tgttcctgtattagtttgctgagaatgatggtttccagcttcatccatgtccctgcaaaggacatgaactcatccttttttatggctgcattgtattccayggtgtatatgtgccacattttctttatctagtctatcattgatgggcatttaggttggctccaagtctttgctattgtgaacagtgctgcaataaacata

SEQ ID NO: 12595 - DNA, 201 bp, Homo sapiens
agagtttttatggttttaggtcttacgtttaagtctttaatctatcttgagttaatttttgtataaggtgtaaggaaggggtccagtttcagttttctgcrtatggctagccagttttcccaacaccatttgttaaatagggaaatcctttccccattgcttgtttttgtcaggtttgtcaaagatcagatggttttagat

SEQ ID NO: 12596 - DNA, 201 bp, Homo sapiens
gaggctactgtattcctagcccatggtgcctttcttccgtcttcaaagcctgcattcttctgcttctttgtccttttttaaagactcatgtgattagatcrggcccacccagataatccaggattatctccctttcttcaggttggctgctgaacaacctcaattccacctgcaacctaattcccttttaccatgtagcct

SEQ ID NO: 12597 - DNA, 201 bp, Homo sapiens
ttcaaagcctgcattcttctgcttctttgtccttttttaaagactcatgtgattagatcaggcccacccagataatccaggattatctccctttcttcagrttggctgctgaacaacctcaattccacctgcaacctaattcccttttaccatgtagcctaacatattcacagctctagggattaggatgtggacgtcttt

SEQ ID NO: 12598 - DNA, 201 bp, Homo sapiens
ccacccagataatccaggattatctccctttcttcaggttggctgctgaacaacctcaattccacctgcaacctaattcccttttaccatgtagcctaacrtattcacagctctagggattaggatgtggacgtctttcaggagccatgatccttccttccacacattatctgcagctaagcaacatgactccccatcacg

SEQ ID NO: 12599 - DNA, 201 bp, Homo sapiens
caggattatctccctttcttcaggttggctgctgaacaacctcaattccacctgcaacctaattcccttttaccatgtagcctaacatattcacagctctrgggattaggatgtggacgtctttcaggagccatgatccttccttccacacattatctgcagctaagcaacatgactccccatcacgacagagtagaagga

SEQ ID NO: 12600 - DNA, 201 bp, Homo sapiens
ctgcaacctaattcccttttaccatgtagcctaacatattcacagctctagggattaggatgtggacgtctttcaggagccatgatccttccttccacacrttatctgcagctaagcaacatgactccccatcacgacagagtagaaggagaaactgaactgtgagaggggaaacagctttatcaaaacatagcaaatgtc

SEQ ID NO: 12601 - DNA, 201 bp, Homo sapiens
ttgtttcatctcatgtatttattacactgttcacatatcaccttctattttcatgccccttgtaaacagcctaagaggcacattactggtaaagcctcagrgtaaacaggcattgcctcccattttgatttcagctccatttaatgactttttatacccaatgtggacacatactcatttttagttttccaatgcagattt

SEQ ID NO: 12602 - DNA, 201 bp, Homo sapiens
catttttagttttccaatgcagatttcagctatattttggctttattcctcttttttcatcctttttttcttttttttttttttttttgagacagagtctygctcttttgctcagtctggagtgcagtgacatgatctcggctcactgcaacctccaactcccaggttcaagcaattctcctttctcaagtaatcctcctg

SEQ ID NO: 12603 - DNA, 201 bp, Homo sapiens
gcgtgctccaagttcatcccgatttctttaatctagccttgttaaaacacattttaaggtcagtttttaaggcacaaaatgtaggatgagtgagttgatakgtagatatctattagcttgaaattgtattcaaaacagaacctcattcttaaaagtttaaaaatctatatcaattacccagcctcaaatatagttttcttc

SEQ ID NO: 12604 - DNA, 201 bp, Homo sapiens
acttatgtggaatccaaaacaatcaaatttatagaggcagagaatagaatagtggttaccagaagtagtgggtagggggaatggagagatgttggtcaaayggtacaaaattttagttagaaggaattgatgataagtatttaagaaaatggatatattaattagtttgagttaatcattctatactgtacagatataaca

SEQ ID NO: 12605 - DNA, 201 bp, Homo sapiens
tgtggaatccaaaacaatcaaatttatagaggcagagaatagaatagtggttaccagaagtagtgggtagggggaatggagagatgttggtcaaacggtamaaaattttagttagaaggaattgatgataagtatttaagaaaatggatatattaattagtttgagttaatcattctatactgtacagatataacatcact

SEQ ID NO: 12606 - DNA, 201 bp, Homo sapiens
aataaactcaatgcacaccagtgagagatcatgcccttttcttctgacaactttgtggcatctttggctgccctttttatgtgcttgtctttgtgctcccytacatcaatctcataaaacatcctttttttcatgcttgacatattgatatcatcccaccgcagataaaacacagagcagtgtaatatggacaggtgttgg

SEQ ID NO: 12607 - DNA, 201 bp, Homo sapiens
atgttgccacactctatgcaccatgctttgcatacttcatgtcattgactcctcagaatccagagagacagggagagaccatgggaagagaaagggagagmccatgggaagagaaggagagagagaagagaggagtagggagagagagagaagacagaggaaaggaaaaagaagagagagaaaaaagcgagatgagagaga

SEQ ID NO: 12608 - DNA, 201 bp, Homo sapiens
tgtccattttgcatatatggctttctaaagatccatttggaggagatcagatgttaaaagagaggatgtttgttgggggggtggtggtgggaggtgggtakggatagtactttagaaactgtttcagatctaagagggaattaacaggatttcagagggtgcgagaaaagtgggataatgttaagtattacattgaaagca

SEQ ID NO: 12609 - DNA, 201 bp, Homo sapiens
ttttgcatatatggctttctaaagatccatttggaggagatcagatgttaaaagagaggatgtttgttgggggggtggtggtgggaggtgggtagggatastactttagaaactgtttcagatctaagagggaattaacaggatttcagagggtgcgagaaaagtgggataatgttaagtattacattgaaagcagcgaat

SEQ ID NO: 12610 - DNA, 201 bp, Homo sapiens
atatggctttctaaagatccatttggaggagatcagatgttaaaagagaggatgtttgttgggggggtggtggtgggaggtgggtagggatagtactttakaaactgtttcagatctaagagggaattaacaggatttcagagggtgcgagaaaagtgggataatgttaagtattacattgaaagcagcgaatgagacctt

SEQ ID NO: 12611 - DNA, 201 bp, Homo sapiens
tgtttaaagtgtgtgtgtgtgtatgtgtgtctgtgtgcacatgtgtgtgtgcatgcatacatgtgtgtgacagaaagagacagaaagaaaggctgcctgamtgattataggtttataaggttcacttcttagttcatctctgaaaacaagagattttggctgctgtcttatttgtccttaaataatttgggtgatccacct

SEQ ID NO: 12612 - DNA, 201 bp, Homo sapiens
ggtttcttctgagatctcctctctccttggcttgcaaatggctgccttctctgtgtgtttacatgatgtgtgtgtgtgtgtgtgtgtgtgtgtgtgtgtgygcgcgtgcatgtatgtccccaaactccgagtgtttctttgccttcttataaggacaccagtatattagattagtgcctcacccttatgacctcacttaac

SEQ ID NO: 12613 - DNA, 201 bp, Homo sapiens
tgcttgaacctgggaggcggagattgcagtgagcagagatcacgccactgcattccagccagggcggcaatgcaagactctgtggccaaaaaaaataaaawaaaaaaaaaaaaaatgggtgggagggagggtgtttactccctgccctggagatttgtataaacaggaaaagaagactgttttcttgtttagtcttttaaa

SEQ ID NO: 12614 - DNA, 201 bp, Homo sapiens
actccgtctcaaaaaaaaaaaaaaaaaagaggctaagatcttggccacgttttcacagcagctaacaagcagaatcaggatttgaacctaggccgtggagyaccagagcccattctaaatctgaatgcactctcaaagtgtcttgcagggaggtgagcccagtctgtctctctcagacttcaagaccatttgcagtggtcc

SEQ ID NO: 12615 - DNA, 201 bp, Homo sapiens
tatgtaaatatcattttttatcaaagtgcaaggtagtttagtgattacagatatataaatagtaaaatatatttgtttaccaagctttaattacataagcracttttgtatattttttccttctttttttccctctctctcttaaaggtcattggacctttaagaaatccaatgtgtctgggcatggtggctcacacctgt

SEQ ID NO: 12616 - DNA, 201 bp, Homo sapiens
aaatgtctgagaccaaggtgtcagcaggtttagttctttctgacatctctctccttggcttgcagatggctgttttctcactgtgtcctcatagggtctcmccttgatctacatgcatgcatccctggtgtctttgtgtgtccaaattctcccttcttataagaacatccatcagattggattagggtcctccctaaaagc

SEQ ID NO: 12617 - DNA, 201 bp, Homo sapiens
cgtcaggcttcaacttcaatgttatcccctcaagagcccttccttaatgacccagtctaaaaagcactcttttttagaaggatcaagattatatgaaaaawtttaaaaaaataaaaaataaaaagcactctttcaaatgtctctccagcataccaccttgttttgttttcactgtagcttgaatatctctgttacagttcc

SEQ ID NO: 12618 - DNA, 201 bp, Homo sapiens
agggggttaggacttcaacatatgaatgttgaaatgaagtaatttggctcataataccatctttgtcctttgtatgtcttgagaatttccttttacactgkcttacctattacttatgtcatttctccattcttaacctctctttgcctcaagttcccaaagctattgtgcagccaactttaagagttaactgcctgcctt

SEQ ID NO: 12619 - DNA, 201 bp, Homo sapiens
gtcagggagttccctttccgagtcaaagaaaggggtgacggacgcacctggaaaatcgggtcactcccacccgaatattgcgcttttcagaccggcttaaraaacggcgcaccacgagactatatcccacacctggctcagagggtcctacgcccacggaatctcgctgattgctagcacagcagtctgagatcaaactgc

SEQ ID NO: 12620 - DNA, 201 bp, Homo sapiens
ggagttccctttccgagtcaaagaaaggggtgacggacgcacctggaaaatcgggtcactcccacccgaatattgcgcttttcagaccggcttaagaaacrgcgcaccacgagactatatcccacacctggctcagagggtcctacgcccacggaatctcgctgattgctagcacagcagtctgagatcaaactgcaaggc

SEQ ID NO: 12621 - DNA, 201 bp, Homo sapiens
tttccgagtcaaagaaaggggtgacggacgcacctggaaaatcgggtcactcccacccgaatattgcgcttttcagaccggcttaagaaacggcgcaccasgagactatatcccacacctggctcagagggtcctacgcccacggaatctcgctgattgctagcacagcagtctgagatcaaactgcaaggcggcaacgag

SEQ ID NO: 12622 - DNA, 201 bp, Homo sapiens
aaaatcgggtcactcccacccgaatattgcgcttttcagaccggcttaagaaacggcgcaccacgagactatatcccacacctggctcagagggtcctacrcccacggaatctcgctgattgctagcacagcagtctgagatcaaactgcaaggcggcaacgaggctgggggaggggcgcccgccattgcccaggcttgct

SEQ ID NO: 12623 - DNA, 201 bp, Homo sapiens
ctcccacccgaatattgcgcttttcagaccggcttaagaaacggcgcaccacgagactatatcccacacctggctcagagggtcctacgcccacggaatckcgctgattgctagcacagcagtctgagatcaaactgcaaggcggcaacgaggctgggggaggggcgcccgccattgcccaggcttgcttaggtaaacaaa

SEQ ID NO: 12624 - DNA, 201 bp, Homo sapiens
gcaaggcggcaacgaggctgggggaggggcgcccgccattgcccaggcttgcttaggtaaacaaagcagccgggaagctcgaactgggtggagcccaccayagctcaaggaggcctgcctgcctctgtaggctccacctctgggggcagggcacagacaaacaaaaagacagcagtaacctctgcagacttaagtgtccct

SEQ ID NO: 12625 - DNA, 201 bp, Homo sapiens
attttaacattttaataattgatacagttatctgggtgcatgccagttgacaacttgccctgcatattgataattttaccatgcagactccactcctcagrtaactcttgttctattacactggactttatcatcatgtaatctgtcctgtccctctctctctctctctctctctctctctctctattgaattctgggggt

SEQ ID NO: 12626 - DNA, 201 bp, Homo sapiens
ctgtgtgactctactggctgcatacccatgaagcttcacctgggttttgcaagccatatggtctctgtctcaagtatttagctgttgtaccatgaagtgcrgctataaatgatatgtaaacaaatggacgtgactgtgttccagtaaaactttatttacaaaaaacaggtagcagccagaatctggtctgtgggccattgt

SEQ ID NO: 12627 - DNA, 201 bp, Homo sapiens
aaaattctatgattctttcacattaaatgcaactccttttcaacatatgtgtatacttggccctttattgaacctttttataagctgccaattggaaatamacagtcatggtagatatgacaatgagcaagtcacttaataactatcagcctcagtttcctaatctacaaaaggaggctattaagagcacctacctcacag

SEQ ID NO: 12628 - DNA, 201 bp, Homo sapiens
ccctctgccttatcctcatacccttaaagatgtgacttaaaagagaaaaaattatgttgttaatttcatcaactagggcaaaggggaaaaatgttcatttygatgcaggaagttaatgggagatgggaggaagctacggttacaattcccataatacattaatgtatatttaatataccaccttgatttgtggcctcaagt

SEQ ID NO: 12629 - DNA, 201 bp, Homo sapiens
tatatcacttttacatatgtaatataagttgaacatctcattagaataatgtgacttttttaaaatttatttttgcttcctagagttcataaatcttcagrtggtaagtaggggttctttagctattcataatgcaacttgcttaggttaattagtagagaccctttcccttcacagctgaatatgagtgcccctacttac

SEQ ID NO: 12630 - DNA, 201 bp, Homo sapiens
ttatttctttctttgtatttgccatctcaccacagaagagttttattggccgggcgcggtggctcacgcctgtaatcccagcactttgggaggccgaggcrggtggatcatgaggtcaggagatcgagaccatcctggctaacaaggtgaaaccccgtctctactaaaaatataaaaaattagccgggcgcggtggcgggc

SEQ ID NO: 12631 - DNA, 201 bp, Homo sapiens
tggcgcattcttggctcactgcaagctctgcctcctgggttcatgcctttctcctgcctcagcctcccaagtagctgggactacaggcgtccaccaccacrcctagcttattttttgtatttttagtagagacagggttttactgtgttagccaggatggtctcgatctcctgacctcgtgatccaccagcctcagcctcc

SEQ ID NO: 12632 - DNA, 201 bp, Homo sapiens
gtgaatatatgtacatatatgtattatatatggtatatggtatatatgtgtatatatgcaagatatatatgagtatatatacatgtgggtgtgtgtgtgtrtgtatgtatatatatatatatatatatatatatatatatatatatatatatatatatacacatacatatgactccaaaaacaattcctctacaaattgtg

SEQ ID NO: 12633 - DNA, 201 bp, Homo sapiens
atatgtacatatatgtattatatatggtatatggtatatatgtgtatatatgcaagatatatatgagtatatatacatgtgggtgtgtgtgtgtgtgtatrtatatatatatatatatatatatatatatatatatatatatatatatatatacacatacatatgactccaaaaacaattcctctacaaattgtgtgtcac

SEQ ID NO: 12634 - DNA, 201 bp, Homo sapiens
gtgtatatatgcaagatatatatgagtatatatacatgtgggtgtgtgtgtgtgtgtatgtatatatatatatatatatatatatatatatatatatatayatatatatatacacatacatatgactccaaaaacaattcctctacaaattgtgtgtcacttccttgacccattacctccccaatgtatatatcatgtgaa

SEQ ID NO: 12635 - DNA, 201 bp, Homo sapiens
tgtttttccaacaaaaaataggatgagttcacctgtgaagcatcctgaagggaaacaccggtgcactgggcagggaacaggagacctagatatacttcttyttttttttttttttttttggtagatatatttatttatttatttatttttattttattattattatactttaagttttagggtacatgtgcacagtgtgca

SEQ ID NO: 12636 - DNA, 201 bp, Homo sapiens
acccagtaatgggatggctgggtcaaatggtaacaacaggtgctggagaggatgtggagaaataggaacacttttacactgttggtgggactgtaaactasttcaaccattgtggaagtcagtgtggcgattcctcagggatctagaactagacctagatatacttctaacataatctgtgactgtgtgcaggtcatgcta

SEQ ID NO: 12637 - DNA, 201 bp, Homo sapiens
ccttctctgtgcctcagttttctcctctgcaaaatggaacaatagaatccttttcattgagttattctgaggattaaatgagtgaatataggtaaagcacrtaggacatccctggtatatagcagtcaatcccttgtaaaatgttagctgcagtgggtgcaactgactgcggccagttgtcaccacctgtgacatttacca

SEQ ID NO: 12638 - DNA, 201 bp, Homo sapiens
accatcttaccccaggagagatcaaaagacattcacagattatgttaacccaaagttttggcctcatttctcaaggaaggggctacatcttttagaccacrggcatttttccccagttttgaaactgtgaaggtgtttaggacctgagagattattaataacaggtttcaatgcctgacactcttggacttaaatgttcac

SEQ ID NO: 12639 - DNA, 201 bp, Homo sapiens
acattgtgcaggttagttacatatgtatacatgtgccatgctggtgtgctgcacccactaactcgtcatctagcattaggtatatctcccaatgctatccytccccccgcccccaccccaccacagtccccagagtgtgatattccccttcctgtgtccatgtgatctcattgttcaattcccacctatgagtgagaatat

SEQ ID NO: 12640 - DNA, 201 bp, Homo sapiens
attgtgcaggttagttacatatgtatacatgtgccatgctggtgtgctgcacccactaactcgtcatctagcattaggtatatctcccaatgctatccttycccccgcccccaccccaccacagtccccagagtgtgatattccccttcctgtgtccatgtgatctcattgttcaattcccacctatgagtgagaatatgt

SEQ ID NO: 12641 - DNA, 201 bp, Homo sapiens
caggttagttacatatgtatacatgtgccatgctggtgtgctgcacccactaactcgtcatctagcattaggtatatctcccaatgctatccttccccccscccccaccccaccacagtccccagagtgtgatattccccttcctgtgtccatgtgatctcattgttcaattcccacctatgagtgagaatatgtggtgtt

SEQ ID NO: 12642 - DNA, 201 bp, Homo sapiens
ctttgagtgttttttgttaagtggctaatgcagtttgcatatttgtcccactaaatctcaagttaaatgtaatcctcagtgttggaggtggggcctggtgrgaggtgttagagtcatgggctgagcactcagacttgggcaccatccttgtgacagtgagtgagttctcacaaggtttggctgtttaaaagtgtgtggcca

SEQ ID NO: 12643 - DNA, 201 bp, Homo sapiens
ttcaactcccacttatgagtgagaacatgtggtatttggttttctgttcttgtgttagtttgctgagaatgatgatttccagcttcatccgtgtccctgcraagtacacgaactcatccttttttatggctgcaaaatattccatggtgtatataccacattttctttatccagtctgtcatcagtaggcatttgggtttg

SEQ ID NO: 12644 - DNA, 201 bp, Homo sapiens
caggagaatggcgtgaacccaggaggcagagcttgcagtgagcccagattgctgccactgcactccagcctgggtgacagggcgagactgtctcaaaaaamcaaaaacaaaaacaaaagttatagttcagaatatttattgcatacaactcagcaaacaaagttgacctagatacaagagtattattggaatttgttagtg

SEQ ID NO: 12645 - DNA, 201 bp, Homo sapiens
ggctcaagtgatcctcccaccttggcctcccaaagtgctgggattacaggcgtgagccacttcacccagcctttttttctgtgtctaaaattcagttactytctcattcacttaacagtttagaaaatactaactatacaacatgtactacgctagatgattttttaacttaaaaatgtgcaatgcacatgcatattcata

SEQ ID NO: 12646 - DNA, 201 bp, Homo sapiens
ttctatgtcagagtttgcaagcatgtggcttataaactcaagatggctggtacaatgttgttcaatatttaatggaggggtattaccaagatctagttttstaggttttcttgagaaattagaaaatctggcaacactaagtttgtaataataccagggacaactagccaaactgccctattttgttgaatcatgtgctgt

SEQ ID NO: 12647 - DNA, 201 bp, Homo sapiens
acagcagtcaataaaaataaggtaacacaaagcagctctcttgaaaacaaaatcagagcctatactcttaagaagttcatagccgtcacaaaagggccctygtggcagtagaagctaaatggccaagaatgctggaaatggggctgcaagtcataaatggagaaagtctaaactaagagggtaaacagcaggtgacagtaa

SEQ ID NO: 12648 - DNA, 201 bp, Homo sapiens
aagaacaagcattgcaggccccagatatttagagactccagtgacatttgggcttttcctgaactttagtgtgcaatgtcattttaaaaagtattttaggrgaaatgataaattatagccagtttcataaaagaggtatacattatatttttaaaagactttatatgaactgaatcatttgactttaagtttgggtgtaaa

SEQ ID NO: 12649 - DNA, 201 bp, Homo sapiens
gtaagtccagacccgagtgataagatggatggctgtctagattgagcatgcaattctaatacttcagttccacattcttttttttttttttttttttgagrcggaatcttgctctgtcacccaggctggaatgcagtggcacaatctcggctcactgcaacctccgcctcccaggttcaagcaattctcctgcctcagcct

SEQ ID NO: 12650 - DNA, 201 bp, Homo sapiens
taggaatagtctttcactttccattttgtactctgggtcttctctgattatatatctcttttggttttcctttccaagctccatctttatcccaacctatwgggtatacatctgatcactgctttgctaacacgataatacttgagactaattaacaataccttagtgatactgcattctcaaataggaaaatttcaaatg

SEQ ID NO: 12651 - DNA, 201 bp, Homo sapiens
ttgtataagaaactcaaattatccaggtgttgaaatgcatgtctactttcttttcagacaatggaatcatttataaaacatatagttatttaaaacacagrcacacatacagagactatcatatgggattgtgagagattgctaattaacacatacaaattaagacaaatattcattaaaacaaatattaattcctcaaag

SEQ ID NO: 12652 - DNA, 201 bp, Homo sapiens
tagtgtaccagatgaaaagcagaaactttaggtagccgtctgaatgtgtcaaatgggaatatcagaataactcactaaatttcctttttcaactttcctckcaaggtttgtctttttatgtggtaaatgttggtgagttccatttttaagttttactcttcccattctacttcagtctccttagcaaacacacacacaaac

SEQ ID NO: 12653 - DNA, 201 bp, Homo sapiens
ccatgtctgcctagtaccttcacttggtcaaatacctcttttggtggaaacaacacaaattatgtaggttgtatatacaggatgaactcggtttaaagatragacatgaaattcagtggaaatattctttaaattctaaacagagaaatcaaaacaaaggtatattcatactgcatgtgggtataagttttttcttacata

SEQ ID NO: 12654 - DNA, 201 bp, Homo sapiens
ctcataatttaatgatctctgcaatctctaagctctgctgggaaatgagctccagcataacacgggttctgggtctgtagtggcatcgctgactgaaagayaggtcatttttaaaatagtggtatgacctttggctgtgatttcctcataataaacataatatgatttttgtgccaattttctgttaattatgggcttctc

SEQ ID NO: 12655 - DNA, 201 bp, Homo sapiens
aagtatgaggatcatataaatcaggcatttaaatcaaagcactggaaataagcaactgctttttatgtgtattgtttttccagagaatattcaatacttakctaccccttcattgttcttattaaaaaaggtatttcaaggctgtgaaataaaaggaggaaaagaagacaaatgtgtatgttccaaacttctcctttcctc

SEQ ID NO: 12656 - DNA, 201 bp, Homo sapiens
cgatagatcactcacttaattagctatatatatatatacacacacatacatatattcacatatatatatacacacacacacaaccaatattgtattattgkattttagtacttttattaagccattttacctgtaattatttgatggggtaaataataaatgaattctagtctattgtattttttaactgaaccttttttg

SEQ ID NO: 12657 - DNA, 201 bp, Homo sapiens
attaagatacttttataacttttacaatctgtaaaaggtggttctgtttgttgaatggtttgttttcttgtactaaagaaaattactgaagagagaaagarctttggggccattaatgaaagtggaagggattgagcataaggcagaagatgctatttctccttacagtttgcctagaagagaaacctcctgggaaaaaga

SEQ ID NO: 12658 - DNA, 201 bp, Homo sapiens
actaaatggttatgaaattatctagccctttattaagtgcaaaaggtagtacttaggttactaaacttttttgaaaataattccgctggctgacttttcayggctaaaaacccatattcttatctgtggagtgtatctttttgtaatcacatctgtgtttgctgtttttttaattgtccaggcagtatgttagccattttg

SEQ ID NO: 12659 - DNA, 201 bp, Homo sapiens
tgggggtggttaatgagtattaaaaaaaaaatagaaggaatgaataaaacttatctggtagcacaacagggtgactgtagtcgataataactcatctgtasattttaaagtaaagagtataattggattgtttgcaactcaatggataaatgtttgaggggatggatactgcattcttcatgatgtgattattgcacattg

SEQ ID NO: 12660 - DNA, 201 bp, Homo sapiens
agtgaagtacctttttttcttatttgagcctgctctgcattgagggagagtttgacacacctctttagggttctgagaatagttaacagctctaagaaagrgatttttgttcataagaaaaaacaagagaaactggaagcagttctcattcatattctctctctcgccacaccccccaccccacctcctcccgcctctccc

SEQ ID NO: 12661 - DNA, 201 bp, Homo sapiens
agaatagttaacagctctaagaaagagatttttgttcataagaaaaaacaagagaaactggaagcagttctcattcatattctctctctcgccacaccccycaccccacctcctcccgcctctccctctccctcttcctctctctccctctcttcagtatctaatgtaaacccaggctttctttatgttctgtgcagttgg

SEQ ID NO: 12662 - DNA, 201 bp, Homo sapiens
agttctttagtatttcagtgatttggttatcactcaacagtgcacacatttcttctataaaatttgatagttacttatctatctctgatttttccctctgkgttttattatatctagtttaatttttcccctttgttgatttctgttttgtatatcttgttgcgggatatacatggaagggagacgagtttccaaagataa

SEQ ID NO: 12663 - DNA, 201 bp, Homo sapiens
agtgtggaaaatgaaccacctcttttgactctttgcaagatttgtgatgtcctactgggatgcctgggcccaggcacattcaccttgattctacatcagasacttctgtgtcttctttctcatagtatgggttattgggttgagcaaatactttgtcatcagtgtgtcttatggagtaattgagagccttggatttgaact

SEQ ID NO: 12664 - DNA, 201 bp, Homo sapiens
atgaactgcatgaccttgagcaaatcactgaaactctctacagtccagattcgtaatctattaaatggggctaataatacctcatgcatatggctgccaaygggagttagtgaaataatgtacatgaaatatttaacactaaacttggtgcctaatgtatcttcagtaaatgataactattgtcatagtcatcattgcttt

SEQ ID NO: 12665 - DNA, 201 bp, Homo sapiens
cttgaactcaggaggcggaggctgcagtgagccaagatcccaccactgctctacagcctggccaatagaggaaggctctgtctcaaaaaaatatatatatwttatatatatgtgtgtgtgtgtgtgcatgtatgtatatatatatgtgtgtatatatgtatatatgtgtatatatgtatatatgaaaagagcagaatttaa

SEQ ID NO: 12666 - DNA, 201 bp, Homo sapiens
ttgaactcaggaggcggaggctgcagtgagccaagatcccaccactgctctacagcctggccaatagaggaaggctctgtctcaaaaaaatatatatatawtatatatatgtgtgtgtgtgtgtgcatgtatgtatatatatatgtgtgtatatatgtatatatgtgtatatatgtatatatgaaaagagcagaatttaaa

SEQ ID NO: 12667 - DNA, 201 bp, Homo sapiens
ttcaatagtactttcacattctgtagctatatgggcttggatacaaattgtaatgtcagtctgtcaggagagtggatggcagtgcataattacaagttctygttcagcacttcaggagctaatcagagcaaggatgtgaatctgtaatttgcaaatgtgcaaagacagaggttactatggcactaacgactctgctgataa

SEQ ID NO: 12668 - DNA, 201 bp, Homo sapiens
tcgtaaagcaatatatagagcaaattaatacataaaatacagagaaatatagaaaattaatatactacatcatgcaacctgcttctaaacaagtgtttctytcataggactgaatcaggaaagattaaataaggagttgagtagaaacatatatagatatgtagagatagagatataggcaatgttttctttttttttatt

SEQ ID NO: 12669 - DNA, 201 bp, Homo sapiens
tggtatgtgaaaatggaatttcagtgtagttttattttctttttcttatgatgagtgagattgtacatctgtttatatgtttaggaactttttagaaatcrtttgtatgaactttctattgatattttttgaccacttttgtagtagtttgctgcttttgtttttaattgatttctactagagagactaatctccatgata

SEQ ID NO: 12670 - DNA, 201 bp, Homo sapiens
ttccttttagcattgcacttgatttgtgaagtagtgttgactgctagattcccatcattaacattaagttttattgccttaaatctctgtcttatgttcamtataaatgttttaagtcaacataatgctagcaagaggtgctgggttaacagactacagttggcatatgattctcatttggggcagggaattgtgcagggt

SEQ ID NO: 12671 - DNA, 201 bp, Homo sapiens
ggagtgcaatggcgtgatctcggctcactgcaacctccacctcctgggttcaagcaattctcctgcctcagcctcccgagtagctgggattacaggcatgygccaccacgcccagctaattttgtatttttagtagagacggggtttcttcatgttggtcaggctggtctcaacctcgcaacctcaggtgatctgcctgcc

SEQ ID NO: 12672 - DNA, 201 bp, Homo sapiens
aaacctatcattggcagcaacccaggcaagcatttatttctatatcttgctgatggggttgatggggttagcaattgctatagtctccctagtaggggatwtaggagacagatgaaaaactgttagactatttacgtatttaaccaaaaggttccattttggggtattcatcctatggaaatagtcatgaaagtaggtaaa

SEQ ID NO: 12673 - DNA, 201 bp, Homo sapiens
tcagctttctctctgtgcttgttttctctgctctctctgtttggatttgaagaaaaagaggttttttgttttttttttttcctttttcttttgtctctatyttatttattttttaagtagactgtcaaaattttagctgtgattgaagaaaagaaataagacaaataaaattagtgggaaaccaaggagggggaaatggga

SEQ ID NO: 12674 - DNA, 201 bp, Homo sapiens
gtagactgtcaaaattttagctgtgattgaagaaaagaaataagacaaataaaattagtgggaaaccaaggagggggaaatgggattgccacttcctcttktacagagtcagcagttttaatacctgtaaacaaaaagttctttgctggaactctttttagaatggaaaatgggatgaataggtacagcattatcaaacca

SEQ ID NO: 12675 - DNA, 201 bp, Homo sapiens
aagcttttcttttcttatttttaagttttgtttattttttttctctcctctctccaattggtataggaacatttattttggatttccagtagcaggcattmtacctttttgtaataaattatattaatacctgttatacattgagcacatgctatataccaggcattctatatactttatcatctttaaccctcagagcaa

SEQ ID NO: 12676 - DNA, 201 bp, Homo sapiens
catcactctgatctctggctgtctttacattgccttctctgtgtttctccttttctgcctgtatcttctcttcttctaaagacacttgccaggccaggagyggtggctcaaacctgtaatcccagcactttgggaggccaaggcaggcagaccacctgagtttgagaccagcctggccactgtggtgaaaccctgtctcta

SEQ ID NO: 12677 - DNA, 201 bp, Homo sapiens
cagtgtccctgcaaaggacatgaagtcattcttttttatggctgcataatattccatggtgtatatgtgccacattttctttatccagtctatcattgatrgacatttgggtttgttccaagtctttgctattgtgaacagtgctacaataaacatacatgtgcatgtgtctttatagtagaatgatttataatcctttgg

SEQ ID NO: 12678 - DNA, 201 bp, Homo sapiens
tgacaaatatttttcaaacacattgaaatgagtttgatcaccacctgggcattcacagtagtccagaggtcccctgcactgtgagtgtgactaaagctcakgaaagtcagaaaggccagccaaggaaggaagatgctggcaagactcggaaagtgcaggagtgtatgagattgaatcacctggacaggggcacccaaacaa

SEQ ID NO: 12679 - DNA, 201 bp, Homo sapiens
gatgaaacaggcattccaggaaaagggaatagcaagttcagagacttggtatagtcctaaattatgtttgtcttcatttcagctagtgctatttcattgtygctggagataacacacacttggattccgttacgtattttcaccttgccaacttgctttgtttgcagaccataatttctgagtttatctctacagcaggtt

SEQ ID NO: 12680 - DNA, 201 bp, Homo sapiens
ttgtctgcattgaaaatctagtgcagccatctttatcaatgatcttagctagaacttctgaatagcttgctgcagcttctccattagcatgtgctacttcmccttgcacttttatgtatggaggtgacttctttccttaaacctcatgaacaaacttctgctaagcttcctacttttttttcctacagcttcctcactctt

SEQ ID NO: 12681 - DNA, 201 bp, Homo sapiens
ttgtctttctccagctgttgaatacaactcataatgctattcaataaaaccagaaagaaaatgagagtacaagggaaagaagagatgtcagaaagagagamcaagagaacatacgagtctgccttctcttggaatagacagcaaagccatattgtgatgttgactatatcatgcagtaatggtgaacaaatgtagcaagaa

SEQ ID NO: 12682 - DNA, 201 bp, Homo sapiens
tgctaattactcacaacccagataatacttcgtttaatgattttatcccatttgttatcccctataacattcatctgcataaattagtttcttgtcaaccyttcagaaagggtttaatgacagttcatggtgtttacttattttctaaaagtagtctaagtgagtcattataaattgaacattcaagttaaatttgtctga

SEQ ID NO: 12683 - DNA, 201 bp, Homo sapiens
ataaaagtactttgaagtcccactgatttccatgtaaatatcatacaaatttggatttgctttaacattataattccatcagcttagaagttaaaatttasaaaagctgtagttcattagtttaagtcacttcaaaacttaccttgcttagttttcagatagactcccatcctatacttctaggactgtacaaataaaaaa

SEQ ID NO: 12684 - DNA, 201 bp, Homo sapiens
aataacaaccttgctaacatatgactaaaataggaactggcagctgggggtgatgagagaaatgaaggcagtcagctacacactgactgccggggagcatyctgcacctcagataagggagcttccgcaatgaatgcctgggcctttggctttgtttcaagtcttttgatctagcggagtccataggatcatttttcccgt

SEQ ID NO: 12685 - DNA, 201 bp, Homo sapiens
tgcattcacaatctgcactgttattataccaactctaggtgaaggatgcatgatccaaaggtccagagtttgaaagcttgcagtctgcaaaactgccctcrcttctgatttgaattgcaagttcaggggtttctccaaatcactttcagatttgataatttgctcataggacttacaggactaactgaaagctgttggact

SEQ ID NO: 12686 - DNA, 201 bp, Homo sapiens
aacgggaaggcagctataaatagcatggtccattttatctgtttctttggtgtgtaggaagagcattgctaagattctcccttgaagttcagttaactcaraatgtgttctgcttttgttattctgctttggcttaaaaaaaagtctcctgatgctgttcaaagtggggaaaagaaaacaaaaacaaacaggagtcactct

SEQ ID NO: 12687 - DNA, 201 bp, Homo sapiens
agcctgggcaacatggcgaaacccaatctctacaaaaaatataaaaattagccaggcatgctgacatgtgcctgcagtcctagctattcgggaggctgacrtaggaggattgcttgagcctgggaggttgaggctacagtgagctgtgatcatgcccctgcaccccagcctgggtgacagagcaaaactctgtctcgaaac

SEQ ID NO: 12688 - DNA, 201 bp, Homo sapiens
ccttgccttccaccatgattgtgaggcctccccagcgatgtggaactgtaagtccattaaacctttctttcttttgttaaaaaaaaaaaaaaaaaaaaaarattatgatagtgctagtcaatactgagttgactgtcaaaaataagcacactttacattagccagttacttctgggacactgttgaagagtatgtcacatg

SEQ ID NO: 12689 - DNA, 201 bp, Homo sapiens
aaaataagccatcaagtactttaactttctggtatttcaaaagtaaaaacatatactaatcacttgtttttatttcacttatttgacactacacatctgtyttagtacaaactcatgtttatgcaatgagatttattagactgatagttcatatcttagccccttttcatagagaatcattgaaaaaaaaactgttcactg

SEQ ID NO: 12690 - DNA, 201 bp, Homo sapiens
ctggctaacacggtgaagccctgtctctactaaaaatacaaaaaaattagccgggcgtggtggcgggcgcctgtagtcccaggtactcgggaggctgaggygggagaatggcgtgaacccgggaggcagagcttgcagtgagccaagatggcgccactgcactccagcctgcactacggagcgagactccgtctcaaaaaa

SEQ ID NO: 12691 - DNA, 201 bp, Homo sapiens
ctggagtgcagtggtgcagtcttggctcactgtaacctcccttctcccctcttgggctcaagccaacctcccaccttagcctcctgagtagctggaactayaggcatgtgccaccatgcccggctaattttttgtcaagacggggtctcactatgttgcccaggctggtctagaactcctagactgaagtgatccaccagc

SEQ ID NO: 12692 - DNA, 201 bp, Homo sapiens
atccttaagggaaaggatgaggaaaggaagacaagagagaaactagcatttgttgactggctactacgtgccagccacagcactagctactaaacctgtgkcactttatttaaatatgaaggtcagaaagcatttctcatgttcctggtatctcctgcactgcctagtataatatttcatacttacaggtgcttcatcaat

SEQ ID NO: 12693 - DNA, 201 bp, Homo sapiens
acagcactagctactaaacctgtgtcactttatttaaatatgaaggtcagaaagcatttctcatgttcctggtatctcctgcactgcctagtataatattwcatacttacaggtgcttcatcaatatttgtgttggttgacttagcaatttaaactgcttctaaatagagttacgtgagtttttccccaaagactcatgcc

SEQ ID NO: 12694 - DNA, 201 bp, Homo sapiens
ttcatacccagcagtatgaagaagtgaaggatgagttgggaatacagaacttgatcattgagagtcatactagtcacaccaaggaagttagagttaatcarttgacaacggggagctcttgaaaagaactgacaaggtcagatttgcattttagaaatattgttgtggaaacagaaggattgattagaaggaagccagaac

SEQ ID NO: 12695 - DNA, 201 bp, Homo sapiens
agacaccaaagagccacgttattgtcccctcacagggagctctagaaatacatgacctaaattgtttcttctaagcatattatcagttccattttcaaggkatcaacatgatatctttccattggttcacaggaagaccaaagagtgacaagagaaaaatgtttccatttgtagtttttctacagactcatggtataggtc

SEQ ID NO: 12696 - DNA, 201 bp, Homo sapiens
atacatgacctaaattgtttcttctaagcatattatcagttccattttcaaggtatcaacatgatatctttccattggttcacaggaagaccaaagagtgmcaagagaaaaatgtttccatttgtagtttttctacagactcatggtataggtcagcttttttattgtaaatatttaagatgtacatttaaggtgtctcca

SEQ ID NO: 12697 - DNA, 201 bp, Homo sapiens
aggaagaccaaagagtgacaagagaaaaatgtttccatttgtagtttttctacagactcatggtataggtcagcttttttattgtaaatatttaagatgtmcatttaaggtgtctccatatatgtatatatatatatatgtatacatagtgaaattactagtagagtcaagaaaattaacatatccatcatctcagttacc

SEQ ID NO: 12698 - DNA, 201 bp, Homo sapiens
tgttactatgtatttgactgtttattagtgtcgacttaggagtgagatcaaactctttcactctctctttctttcccgtttttttttttgtttgtttttgkttttttttaaacaagatctcacactgttgcccaggctggagtacagtcacatgattccagctcactgcagcctcaacttcccaggctccagggattctgt

SEQ ID NO: 12699 - DNA, 201 bp, Homo sapiens
tattagaaaataaaagaagattaaaataaaaaaaggtttccttttaatcaatctattaataaaaagataagtactgagattccgttgacataaaagtaatkgaaagtttataggcaaattcttgaaatagaaaggcactttttttcctcataagaggacagtttagaggatttaaaaagcaatcaaaggtctcatgtttta

SEQ ID NO: 12700 - DNA, 201 bp, Homo sapiens
gtgagtgggaaaggaacaggatggtagagtttggattggggaacagactttgagcactgaacagcaggcagcattgctgttggcagagtaacggagaaggygctgaggcttacccatgccatcatggcaaaaaatagcacggaaacagctggtgagctgtcagaatgatcttaaggaggaaatgtgaaatgtttctgcttg

SEQ ID NO: 12701 - DNA, 201 bp, Homo sapiens
gcaagtttatttaaatctagtctttcttatgagtctgcctaacagtgatagattttgttgttgagccacagtttatgaaaagtgcattaaaacctcgagcygacccatctctctgaagcagcagttgggccattacattttggcaggcacttcagatgtgtgtatgattttatgatcaggtctgcttaattcatcccaact

SEQ ID NO: 12702 - DNA, 201 bp, Homo sapiens
atcaaatgaggaagcagaaaggtaggattgattgtaatgtgtgcacagaggagtgaagcctgattacctgtactactcattgccagaccttcaagaatcgygtgccaagtgccaggtgcagaagttgcaaaactgtttgggagatcaaagagaaaatatcaacctggctttcaagtcttttcagggtgctttcttagaaaa

SEQ ID NO: 12703 - DNA, 201 bp, Homo sapiens
tactcatattgtggtttaactatgtggttgtcttctccaccctgacaatagatacatctattgtccatcagcccaatttacaacttttgcatctcttctgwtttctatcctctgctaatgacacttattaactactgcctttccactggactttgcatttagttttatatatatatatatataaccttacttctgctttta

SEQ ID NO: 12704 - DNA, 201 bp, Homo sapiens
ccttccactttctccaacactagattgcaaatttctacagggtgaagcttatgttttcatcccttaacacccagcttaaatgtcacctcacatactgactratgctttttatctcagttctaaaacattattaatgtacatcacataatttaactccattttgaaaattagttcttgttccagtatcttatctcttaaaat

SEQ ID NO: 12705 - DNA, 201 bp, Homo sapiens
cagattttgtatccacaggggtcctggaatcaatccccttgatggatacagagggaagactcactctcactctctcttgatatatatatatatatatatayatatatatatatatatatatatgcacacatacacacacacacacacacatatatatacacacacatacacacacacgtatgtatatttacatgtatttat

SEQ ID NO: 12706 - DNA, 201 bp, Homo sapiens
gtggtgcaatctcagcttacagcaacttccgcctcctaggctcaagcaattctcctgcctcagcctcccaaagttctgggattacatgtgtgagccaccaygcccacccttctctataatttaaatgttatctctctttataacattttcataagaggatccacaattctattttcccattcacttataaagaacaaaaat

SEQ ID NO: 12707 - DNA, 201 bp, Homo sapiens
atttttttccttttaagaaaaggaaagccattaaaaattctcttttgctaattctagaaaatttaagcttcatgaaaaaataatctaataaaaataaaaascttccatttctgacccctaaatgatttacaagatttcaaatctgttgaagcctgactgctttggtttcttgcaagtggaattggatccaggaagttctgt

SEQ ID NO: 12708 - DNA, 201 bp, Homo sapiens
aattctcttttgctaattctagaaaatttaagcttcatgaaaaaataatctaataaaaataaaaaccttccatttctgacccctaaatgatttacaagatktcaaatctgttgaagcctgactgctttggtttcttgcaagtggaattggatccaggaagttctgtgggttcatacccttagtatgacacagggacacatc

SEQ ID NO: 12709 - DNA, 201 bp, Homo sapiens
ctaaagctaagaccttttttttttttttttttgcatgtctttttttctctgataatcccagagtttatataacctcaaactataagcttgatgaattttaragttcattgtaatgcttttggtttaggtgacaaaactgatgcctacaaagataaactgatttgctgaaggtaatggacctagtctttattggagttgtaa

SEQ ID NO: 12710 - DNA, 201 bp, Homo sapiens
ttgttagcttgaactcgataaatgtgtgttcaccctatcagttgtcattcatgctgacttcttcctctactctcttcactctgattctgttttcatttaaraaaatttcagaagtagtgaagctaggagagttaatgagtagccacgttgaccctagtaggatcttacccattggagaaaagccctgttttaaaacgatgc

SEQ ID NO: 12711 - DNA, 201 bp, Homo sapiens
gcttattgtgaggagggtctacttttggtctccccatttcatgtgggttctggttgtggatttttttctctcttgccctgccaggctgtcaaaataaagaycaaatttgccagactcacaagatgtcttcagggcaaaagtgattttcatacttgtctggattcctgtttcctttcacttttagactagtctttccttact

SEQ ID NO: 12712 - DNA, 201 bp, Homo sapiens
acgttagctttgtctttcacacatctgcttatcttctctagcttcatgtggttgaaagcagaagatatgacatacgtagcatggaaaatgtgatgtgggtraaaggaggtttctttctttttattctcagaaatgtctttttcacaatgaaaccagcaatatttattgtttttcctggttatgtaaataatacatgctcac

SEQ ID NO: 12713 - DNA, 201 bp, Homo sapiens
cctccattgcaagagggaatcattagtctcttcctttagaacaagttcatccaaccccaggtctgcaggctgcacacagcccaggatggctttgaatgcartccaacacaaattcttaaactttcttaaaacattatgagatttttgtgtgtgtgaattttttttctaagcacagcagaaatcattagccttagtgtattt

SEQ ID NO: 12714 - DNA, 201 bp, Homo sapiens
tcctagattctttcatctactgtctctgtcatgcctccagctgacaaatgaaaaaacagaatgtggaagataaggttttgcaggccagatctggaagtagstatatcacttctgctcatattctattggctagaactcagtcatgagctcattctcaactgcagggaaagccgggacatgttgaccggctatgagtccagt

SEQ ID NO: 12715 - DNA, 201 bp, Homo sapiens
agaatattgtcgttagaatttgatgtactgaagtttgttcataaatctaacaaatgtttactgagtatctattatatgccaggcactcttcttggctctgragatgtagcagtgaacaaaacagatacaaatttctaccaagaatcttatgtttgagagggtaccccgaatgaaagaggagcaaccaagagtggagaaaag

SEQ ID NO: 12716 - DNA, 201 bp, Homo sapiens
atggagcgtggaaataaattttacttgcaggcgcaacaccagattgtggccagggttgtctggggttaaacgtgggtgccctggtgggattttatttctawcatgtacatgttttataaaatgggatgtaaaaaattggagatggccgggcacagcggcttacgcctgtaatcccagcactttgggaggccgaggtgggag

SEQ ID NO: 12717 - DNA, 201 bp, Homo sapiens
caggattctgtctcaaaaaaaaaaaaaaaaaatcaaatcattaaaccaaatgaaaatgtaacatattaaaatttgtgaaactcagccaaagcaatgctgaraaagacagttatgtagctaaatacatacattagaaaagaggaaaagtctcaaatcaataatcaaactcacatcttaaaagctaaatacatacattagaaa

SEQ ID NO: 12718 - DNA, 201 bp, Homo sapiens
atttaatacaaggcaggttgtaagtttaagtgagtatagttggagtaaaaatagaagaaattatatctgttcttaaattaaactccagggctgtgttttgygaaccaattaactaaaacttggagtcatcctgttaggctttgctgagcagtggagggacttgtggggaaatgtggttgcaaaggagacaggagggaagct

SEQ ID NO: 12719 - DNA, 201 bp, Homo sapiens
ataaacatatgagtgagtgccagtgtctttttaatataatgatttcttctcctttgggtagatacccagtagtgggactgttgaatcgaatggtaattctrtctttagttctttgagaaatctccatactattttccatagaggttgtattaatttacattcctacagtgtataagcattccctttcctccataccttgtt

SEQ ID NO: 12720 - DNA, 201 bp, Homo sapiens
tctattcctagcattttttgttgagttgatgatcatggtcgtataatgtctgatatctatgaagtccagtcttctgtcattgctctttttttttcatttawttttttttgagacggagtctctctctgtcgcccagcctggatgcagtggcgagatctcagctcactgcaagctccccgtcctgggttcatgccattctcc

SEQ ID NO: 12721 - DNA, 201 bp, Homo sapiens
tttctgactcttagaagccagttgccatgtaagtaatgtgactaccaaaaaatgaccacactgtgagaagcccaagtgtggtggagaggccttggggaaasagataacccatgaggcaagaaagaggcccaggaggtcccaggcatgggaatgaagaaaccagcttgcacatcctgcccaggctacaatggactgtaacca

SEQ ID NO: 12722 - DNA, 201 bp, Homo sapiens
ccacgatctgtgttaaggtttctgtggatgtgtgtgtgtgtctacttaaagaaatggcagtctatccctcttacatcctcagatattcacagagcccctcrgtgacattttttggcctaggctttttaacattctagagtagaagagttgactggtaggaacatttctaagtgctcttttgcaccataaagcaagaggagt

SEQ ID NO: 12723 - DNA, 201 bp, Homo sapiens
agctgccagatgtcaatttgaaatttaatttaattggttccttgagttttcggttccccatcatcctgctccacctttcgcttagcgtggccatcctggarttcaagatgtagttaaaaggcaagatggtgtgatggatagactgtaggttttggtggcaggcagaattggtttgaaagcctaatagctacatcatcgaag

SEQ ID NO: 12724 - DNA, 201 bp, Homo sapiens
gtacacaaagttagagttgtgagatttctctttattaattctcttttttctcttagccacatccactaaaaaaggtacttttatttcatgtcctgtatgarttgtatgtaacgtctggctctgtcaccattcctttgtgttctcattccatagctaactttccttaagaagtgttgtaatagcatatatttcagtgttcac

SEQ ID NO: 12725 - DNA, 201 bp, Homo sapiens
ttatgtgtctaattgctatagtcagatatacaaggtgacaaattctgtaagtacagttggtcctccataactgctggttctgcatctgcagattcaactawcaaaaaaattgaaaataattttaaaaaacaataaaaaaccaatataacaatagaaaataatacaaataaaaatacatataacagctatttgcatagcatg

SEQ ID NO: 12726 - DNA, 201 bp, Homo sapiens
ccagcctgggcgacagagcgagactccgtctcaaaaaaaaaaaaaaaaaaaaaaaagaattgacccatttacaatagtataggcagggtaagtctgttgtmagggaagccaataaaggatggagaagcacctttttacccattacctctcttaggcttgaagggggaaagggagtgaatatttattggaacaaagagccag

SEQ ID NO: 12727 - DNA, 201 bp, Homo sapiens
tgccccagcagacccctacatcagtgcctagaaaacaaggaaaagcagacagactcctcagtttacattttctaaagaatcattgacttatgagggattgkgtatcactttgaaaagagttatttgacctttgtgacccaggcatcccatgaaaatagggtgggttgaggaagaaggcttcatgctaccagccatcctctc

SEQ ID NO: 12728 - DNA, 201 bp, Homo sapiens
ttattcagaactcagttggttgtttatatggtattcagcaagatacttcccccccacctccaacttcttataacacaatttcaaagcaccaatcgtcttcmtcttttaaagtaacaccatgactgattgccttaaatttatatatgatcttgttctaatgtcctttctaaaaataagaaaaaaatattccacaagtaaaac

SEQ ID NO: 12729 - DNA, 201 bp, Homo sapiens
attaattcaataactatttactgatctgaacaaagtggacaaaaaaccctgtctctgtggaattttcttccaggcatgaggggcttgggaatgggtaacargtaagtaaattatgtaacttgtttgacagtgctaagtgctacaaagagaaactaggtagataaaagaaatagggacttgggaggttgaaattttataaaa

SEQ ID NO: 12730 - DNA, 201 bp, Homo sapiens
ggtgtgaagcccagatctagaccaagcctgtctgctcttggtaagcctctttctttttttcattttttctaatactgtttgatgtatttcctgttattttyatttactgttttctacttatccaatagtaacatggccatgcctatactttattactttgtaaacaagtacctaagtaacagctaaactaaaacatacatg

SEQ ID NO: 12731 - DNA, 201 bp, Homo sapiens
cagaagattgagaatttttttggagctgttcctgattagatgttagaagattttggttatcaccaatccttttcagagaaaaattttataaacttacaagkatccattgcacgtgctttacatttgttttatatcaatatgactgtaaactttatagagatctttttaatacatgaataggacatcttatttttaaggcag

SEQ ID NO: 12732 - DNA, 201 bp, Homo sapiens
aaataggtcagtggaagactgggtcaaatctgagattccactttgaccttttgatctttatctgaaagaagtcagatgatttcccttttctggtacaagcytgtaagttagcacaacattttatttccctggactatgtgaagtatatagtagatatttaggacagagagaaacctatggtggggagtaaaatttaactag

SEQ ID NO: 12733 - DNA, 201 bp, Homo sapiens
atatatatatgtatgtgtatttatgtgtgtgtatatgtacatatgttcacatacatttatgtatatgtatgtatatatgaatcataatttgctgataagckttagacactattattataaatttcccttaatacacaaatttctcaatatcttagaagaaaattttcaagtatatgagagctcttctttctatcagcatag

SEQ ID NO: 12734 - DNA, 201 bp, Homo sapiens
actattttttagacatcatgtcaaagactgaagtgaaagccaccctcttgtgatcaactgaggtcagaagttggcaaatttttttgttgggggtggggggstaaagggccagataataaatatttttggcttttcacaccagaaagatctccattgccactagtcaattctgcatttataactgagaagcaaccacagaca

SEQ ID NO: 12735 - DNA, 201 bp, Homo sapiens
atatatattcatatgtgtgtgtattatatgcatatgtgcatatacatgtgtgtaatgaaaaaagaaaacagccctgaagaatcctcaagaaactgtcagaygtccttgtcctttaaaagctccagttgcccttcttgtctaaacacatcagtgcagtgtgaatcctgcattattcatgaacacataaggtctgtatttgta

SEQ ID NO: 12736 - DNA, 201 bp, Homo sapiens
ccgaattaattattccctgagaaatggggcccctcagtgtaatatctcatctcaatcatttttttctttagttttgcagatagcacctgccatttctaaakatgtgtctttaattcatcttaaccacttcggattatgacatcctaaaattgccatatatttttatatttccatacttttgctcaggatcttctttggtta

SEQ ID NO: 12737 - DNA, 201 bp, Homo sapiens
cttgttcttaagaaagttgtcctcagtctactactctattgcctctggctggaaaaactcgggtaggtgcaaggtgtccaccagcattttctcctgggatygggctgctgccagctctggcactttgcctgggactgtagccttgtctggactcccctttccctctgcgtgggagtgcttccttatcaatcatttgccctc

SEQ ID NO: 12738 - DNA, 201 bp, Homo sapiens
gccgagtttgtgccactgtactccagcctgggcgacagaatgagactccttcgccaaaaaaaaaaaaaaaaaaagaaagaaaaaagtaatggcagtagtascaggagtagtagtagtaacagataaaacctatcattggcagcaacccaggcaagcatttatttctatatcttgctgatggggttgatggggttagcaatt

SEQ ID NO: 12739 - DNA, 201 bp, Homo sapiens
aagaatcttttagaactgttagtcaagaacttcataggtggtttatataaaatttattgtcacttgctaactgcatggctttcggcatttcttaacctttytaaacttcaatcttttcattcatggaacgtagataattattgtacctgtatgacagggtcaatgaaaggttaaatgagtgaagatacataaagtagttag

SEQ ID NO: 12740 - DNA, 201 bp, Homo sapiens
tcttgaatgcatccactcttccctaaggaaatgccatcaactcatcatccccataccatgcaaatgccttttacagctgcagagcaggtgtgggcagatgmatacagcagcatatgaacacatgtttaccctccttggccacactttgtcttactctatgttttctaggaacacattttggggtggaaatgcctttattcc

SEQ ID NO: 12741 - DNA, 201 bp, Homo sapiens
tgcttttagttcttcattgagcatgacatacttcaaatactcaaacctatttccttcttgtaggaatagctaggcatttcctcccacggtccaaggtgagrctgaagataagtagaatctccacacttatttgtttactttggtccagactatagagtcaggttaaaagccatctggggaaatagccagtagccaatgctt

SEQ ID NO: 12742 - DNA, 201 bp, Homo sapiens
ctgagtcattgaacaagcgctacaggatagcacaatactaggtacacaaagtaggcgagcacaggctccctacctttgaaaagtttataagttcattaacrgtattatgtttccatgcactggagcattagaggaaaaatgccacgataacatctaaacaagagtgcagtgggccctgagaagtatgatgattctgtttcc

SEQ ID NO: 12743 - DNA, 201 bp, Homo sapiens
tgtatggttgcagagtttgatttctttatacggtagggtggtttctgtactcctagtgacacagttaaacagagaatattttaaaatcttaggaatttaargaagcttagagataattaatccaatctcctcaccctttcattttcttgaaacagagagagcttgaggaatgggtaagtgtgacctagatgtcagctgcag

SEQ ID NO: 12744 - DNA, 201 bp, Homo sapiens
ggtctgtttcttaggtgtgtagggcagtgtatatctgagtataggtacaatttgcacaagtacatattaataggcttatactggtgtattgtgtttttatrtgtagttgccatttgtaggtgtactgaaaataatagattccagggtgacatgtatcagaattaagcagatcctctgcttcaatattagaaaagcaatgct

SEQ ID NO: 12745 - DNA, 201 bp, Homo sapiens
ataacataagccaatgactactaagtgagaatcaaacccagaatctgtgcccctaacccctactctatactgtctttcccggatacaagggtgacctccaygtttaagccttctagctacctctctacactgacctgtcataagttccagcctaccaccttgcattctctgtagcatatgtctctgtaaatgccccactaa

SEQ ID NO: 12746 - DNA, 201 bp, Homo sapiens
caacccctatcttggagaattagcagcaggatctctctcttctgagtctctggaaatcatcatcatcatcagtccagcaattcgatccattctcagtgctstgtaaagcttgcataaaagccaaaatcctgtatgtaaatcctatatgattatcctgagtgttagctcataattgctgttaggtgattatttgaagctttg

SEQ ID NO: 12747 - DNA, 201 bp, Homo sapiens
gatgctggatagacagtctggcagatagacactgctaaggttttgatccttacctgctagccatccccctccttcgtctacctcttacctttgccatttcrttctgtcaatcagaattgagtccagagattcaggtcactcactgcttcttgggccaggggccaggtgataatgtgtctctattcctaaagttggaataat

SEQ ID NO: 12748 - DNA, 201 bp, Homo sapiens
ggattgcatacatgcttctggcagaactggctttactaccattattcctgtgtggcagaagaggaccatgaacctaagaaatttgccaaaaatattttaartgacaagtggcaaagctgggattcaaacccaggctaccttactcccatgcctgttctcaaaacttctaaagcatttaaaaaaaaaaaaacaacaaaaggg

SEQ ID NO: 12749 - DNA, 201 bp, Homo sapiens
gcctggactctggagtcagactgcctaggtttaaatttcttctacttgctgagttagcataggtgggttatataatctgtctgttcttcaattttctcacstataaaatgggcgataatattaatacataatttgtagggtgttagaaggattcaatgagttaatatttgtgatatgcttaaaaaagtgcctagcacatag

SEQ ID NO: 12750 - DNA, 201 bp, Homo sapiens
ttggtgccttcttggggggtcttcctaccacccattctttttttcttccattttcttttttcctgacatatggtggtagaaatcttaaggaaataaaactragcacagcattccttgtgtgaaatactgccttgcctgtaaaatctcattaatgtagcctaggcagtggctaatagcctggactctggagtcagactgcct

SEQ ID NO: 12751 - DNA, 201 bp, Homo sapiens
caatgggccattatcagctttcaacagaacactttggtgccttcttggggggtcttcctaccacccattctttttttcttccattttcttttttcctgacrtatggtggtagaaatcttaaggaaataaaactgagcacagcattccttgtgtgaaatactgccttgcctgtaaaatctcattaatgtagcctaggcagtg

SEQ ID NO: 12752 - DNA, 201 bp, Homo sapiens
cagcacagtggcaggcgatcttgggaaggaggccaacccaaatcttcaaccatctgttaatggggtaataggttatgttgtagcatgagtgagttgtcttrattgggcagaaacttcagatatggttgccgatgcggaaggagactgagcaactgtgcatcggttgtgaatgtgcaacttgggggatggggttcatggaaa

SEQ ID NO: 12753 - DNA, 201 bp, Homo sapiens
ttttgtgtcccaccctctgcgtggtgcctactggaacactgtccctgcctgctcacccaagttgtgtggtcccctggcccaactgagctgaccagtagatrtgagtgtaggtaggaagaagtacagggacttagttatgaattctgtctagagccaggagaaggaggcaagaaggtgaagaaagagaaaggagatgtgtca

SEQ ID NO: 12754 - DNA, 201 bp, Homo sapiens
tcaggatacctgctcagagggatgtgaggacagctatgatgaataaaaagaatactgctgaccatggtgagaacagctacagaggagtgggtgaaggccaygatcaatgggttgcaagtgaacaagaagtgaagaaaatgcagagactgctccactcaagaagcagctgtggccaagaggaggccaggtggtgagaagaga

SEQ ID NO: 12755 - DNA, 201 bp, Homo sapiens
tccaattctgtgtaaactctggaattctatttaaaattgcagattttaaatgtagggaccaagacaggatgtaggttgtgtcaacttgggaatgctgaatractgaactgtcatgacatttacaatccagatgtcatggcaagctgggagacaagacagcttggttgataattagatggcagatgtccatgcagtctcacg

SEQ ID NO: 12756 - DNA, 201 bp, Homo sapiens
aaccatagatttcattaaaggagagtaaaaacccaggctttggatacagacagacttgagaaacagctctaagatttgggcaaggctggtcttgaactccygacctctctattcatcctctctatgcctcagtttcctatttgttaaatggggatgatatttagcttgcatgactgtcatatggatgagatgacagcatgt

SEQ ID NO: 12757 - DNA, 201 bp, Homo sapiens
ttggagggcagcatagaatgaaagttttagaacatctatttatatttattttaatcgtattcctttatatttttgttatagtctgtttcatagcacatttwgtgtataaatataataatacatgtctacgtgttaaaaatgaatgaaaatacctacattgggagtgggctgaatccacagaaagttttactgatggtggtt

SEQ ID NO: 12758 - DNA, 201 bp, Homo sapiens
ctgcgtgacagcatgtaatttgggcaatgcctgattgaggccaagtaaggtatctaccatattgaatatttggttttcttgaactcacccaagaaagctgratattctgtgtggaaacaggttacacccaaaaaatatacttgagggtgctgtgataaatgatggtaacttttctgtttgtacctcatttacaattttcac

SEQ ID NO: 12759 - DNA, 201 bp, Homo sapiens
caagagcatcactgtgaaacttgttagaaatgcagattctcaggcctcaccccagacttttgaattctaaactctgagggcctaagccccccaggtgattytgatacaccctaaagtgtaatgaccgctttttaagtctgtagtccaaagtctgtgacagttaggggggtaaagtacattgagtggtctaggctgagtagc

SEQ ID NO: 12760 - DNA, 201 bp, Homo sapiens
catgaaagggagtctattgccacacagtttgaaaaagccgggaggtgcctggcttgatccagagtctcaaaggacagcacagatgattctcttcatttggyaattgtcttctgggttgctagtcctctgatccctctgattttcttatagcctctagggactcaaagctttcttcttacccctccagcagtccttgcttgc

SEQ ID NO: 12761 - DNA, 201 bp, Homo sapiens
agtttccaatggttccccatacacttttggaaacagagctttgtggcatatggaaggaatttctaccccctgcgtatgagcaaacccatctggtttagttrgtttggccaggtcttagaaatacattgacaaacacgtgtatgtcaggggtaacttgtagtcttgctgcttatattgctcctggggggaataagaaattca

SEQ ID NO: 12762 - DNA, 201 bp, Homo sapiens
aggtaggctgttggaataaccaggatatgagttgctaatcgttcatttattaatcttcatggaattaaatacagaaaggatgaatacagaggagatcctgygctggacacattctctgtgttagttcatttattcgtcaccatatccccttgattaaagtgatgatgagtctttccattttgtaacttggagagactgagg

SEQ ID NO: 12763 - DNA, 201 bp, Homo sapiens
tgtttgtaaatacctacggttgatgaggaaatgcatttgttgaaatatactgaagcctgtggattattgtaataatccttttatgctatcaaagatttacygctctttgagcttaccttagttgggtcttgtaaattgagtgttatttgagaacagaacacaggagggcaccagaggacaagaaaacgacaaccaaaaaaa

SEQ ID NO: 12764 - DNA, 201 bp, Homo sapiens
ggcctgtaagtaatagaccaatgtcagtggaggagacatgtagatgttaagaatgaactaagtttgtaaggtaaaaagccaggcttcctatatgcctcagyagatggtctgataaggacgctgagagagagtatcatgaaatagaagtgaagtggattaacaagaaaatccatgttcctggcacactaaggtgataagtaa

SEQ ID NO: 12765 - DNA, 201 bp, Homo sapiens
gaagtttcatcttctttttttttttttttttctgagacagagtcttgatctttcacccaggttggattgcagtggtgtgattatagctcactgcagccttratgtcctgggctcaagagatcctcccgcctcagtctcctgagtagttgggactataggctcatgccaccacagctggttattttctttgtagagataggg

SEQ ID NO: 12766 - DNA, 201 bp, Homo sapiens
atcattcagcttcatattggaggccttcaggctttgatttatttaggaaacattggtgaacaatgggatcatgatctgcaacatgacagatgtaggaagtycatgtcccctaaaggaggttttctggagactcctaacaattaagagaatctgttctgtttctaagttgacagcaaattattgaattctgagtatccagaa

SEQ ID NO: 12767 - DNA, 201 bp, Homo sapiens
tgatgtcatcagcagcttaatagagcattagatgagaatgtctgagcattactatgctgactttgtaaaattgtaatccaaaagcaaagaatcttgacagmttagacagttggtttgatcttattattaatgaacagaagatatatcttaggctattttaaaagtgaatttataataagatttctacttcctatgttagct

SEQ ID NO: 12768 - DNA, 201 bp, Homo sapiens
gtttgcaggggtacatgtgcaggtttgttgcatagctaaatatgtgttatgggagtttgttgtcagattatttcatcacccaggtattaagcctagtaccyattagttatacagtaatttcttaatacatattataacatttgttaattgtataagttaaaaattttattactataatatttgttaattttataaattttg

SEQ ID NO: 12769 - DNA, 201 bp, Homo sapiens
tcaactggtgagtttccagctgctggtgtgcacaaacagaagctgaaggaccaatggcaggagaattacaaggcaagtttatgaatcagatggatatttgsaccagatgacacccaggggccctccaacctagaggtctggtagttctaaaaattccatgatgtcccacaagagctaactgagatgtggggataataatga

SEQ ID NO: 12770 - DNA, 201 bp, Homo sapiens
aaaaatgatgcatgatgttatctgagaaaatagtaaagtcacattatggtgtgaccacatgggagcagacaccaattacaatgctatgccccccagatctrtgtggtttttttgattctttatttctcagctttttatctgtgtgcagctgtctgttgttgttctttttcccgttttttctcagtagttttggtcccatat

SEQ ID NO: 12771 - DNA, 201 bp, Homo sapiens
aataaatgtcagtgccagtcacaggttcttctcccatagagctaaatgtttctcgggtgggcctgttaaacagtgtccttttataacattagaaagacacrtgatttttttcccctaacttttgccctatgttttggataatttttattaatttatattcagtttcatttttcttttttaccttgaatacctctttcatac

SEQ ID NO: 12772 - DNA, 201 bp, Homo sapiens
tgagatcatcctggattgtacaggtgggccctaaatccagtgaaaactatctttgtaagagacagatgaggagaagacgtagagacttgtgaaacagaagsccatgtgaagacagaggcagagattggagggatataaccagaaagaatgcccataggcagcagaaattggaagaggtaagaattggattgttgcctaaag

SEQ ID NO: 12773 - DNA, 201 bp, Homo sapiens
ttatagctcagatacattagtagaaataataacattagtaactagcatttctgaatagtagtaggtactgtgttaaccatctaacatataaaaaatacttratatgcattattttaatatttgcattgatggtttgaggtagggtattttattattctcattttccagagtttaagaaatttgaccaaattcctagcacta

SEQ ID NO: 12774 - DNA, 201 bp, Homo sapiens
gtcaaacaaccagaaaggacagtgcaaatggccctcaaagcttgagcttagcaactgctcccctgttcttagtcttgccactgtgtggaatttaggacttmtatatgcagatagtttgttacttgcaaaccattagaccaagcttgtcctacccacagcacacagggcgcatgcagcccaggacagctttgagtgtggccc

SEQ ID NO: 12775 - DNA, 201 bp, Homo sapiens
atcataaagcgtaatggtatcagttcaggagaaaggtcccactgctcctgtgttctacgtcagtggctgcagggccacagcaggcagagataaccaagcaygctttcactgccctgatcaccattcccccattaataatttgcttggccctttccttcctactgcctgaagaaaatcaatgtttggcagctctaggttgaa

SEQ ID NO: 12776 - DNA, 201 bp, Homo sapiens
acatcttcgtcttcctgtggagcatttgtcttttcatagcagaggacaatctctgtgactttcttatatcactgagaccatcttgtacagtttatttcaamagcaagagtgttctttttcgttccatgccaccagtgacaatacgaaaccagatctaactgaaacttcactcaacacattcccgacccgccaccccaaccc

SEQ ID NO: 12777 - DNA, 201 bp, Homo sapiens
tgtttcatctagtattcattccttagagagcacggatataatagtctgacaatgctttttattaatgttttcacttagctgcagattgagcatttactgtrtgctaagcactgaggatgcaagagtaagcaagaacagagatggcccttgtgggcctagtgggggacactgtcatgtaattaagtgacctccaaataaatg

SEQ ID NO: 12778 - DNA, 201 bp, Homo sapiens
atttttagaattaaaattatggcaaggaaggacctgtgtttcatctagtattcattccttagagagcacggatataatagtctgacaatgctttttattartgttttcacttagctgcagattgagcatttactgtatgctaagcactgaggatgcaagagtaagcaagaacagagatggcccttgtgggcctagtggggg

SEQ ID NO: 12779 - DNA, 201 bp, Homo sapiens
aaatgccattacgtaacttcctttgtcagaccaattggtgaaataattctttgtgtgctttttttttttttttttttacggccgtccaattttcaaattayatgtggattttctgagtcaggcattgcacaaatgctgatttgttagcttgaactcgataaatgtgtgttcaccctatcagttgtcattcatgctgacttc

SEQ ID NO: 12780 - DNA, 201 bp, Homo sapiens
tatataaatttacatataacggatgcataaagatttgctttcttattctaagaatgttcttatttgataacatctatgcatagtccagaagattgacatgraaaactgataatgtacttaggtattaccaatcctataacccaatttgtgaaaaggtcaggcactcctactaaagaacaaacgtttgtatttgtagcattt

SEQ ID NO: 12781 - DNA, 201 bp, Homo sapiens
aagtttaaaatttctgcttggaacccaggaacacagatggaacacgaagtggctttcaccagagtcttgggaatatgcttgatcctttaaccccagcttcrggtgttgtgtacatacttaatgcctgaacagttctcatctgtacatctgctggttagatgaaaagatgcagttgcagacaagtaatttaaaactttacat

SEQ ID NO: 12782 - DNA, 201 bp, Homo sapiens
tcagacacacagtgttttttattcttttgtttcttaaattcctttaaatatagccctttcataaatttggcaggatgtgctctcagtaaaatttctggttkagtaaactcttggtgacattatcaaattaaacagcaatcccttccaaattcccctaaagctaagaccttttttttttttttttttgcatgtctttttttc

SEQ ID NO: 12783 - DNA, 201 bp, Homo sapiens
ctgaactgaagagaacctgccctcatttaaaggcatccaaatgaaacattttaaaaacgctaaaataaagagaccccatgaaggtcaaacaaggcataatsagacacacagtgttttttattcttttgtttcttaaattcctttaaatatagccctttcataaatttggcaggatgtgctctcagtaaaatttctggttga

SEQ ID NO: 12784 - DNA, 201 bp, Homo sapiens
tgaaatagaccagaccagatgcaatctgcagtcatgggaactctgaactgaagagaacctgccctcatttaaaggcatccaaatgaaacattttaaaaacrctaaaataaagagaccccatgaaggtcaaacaaggcataatcagacacacagtgttttttattcttttgtttcttaaattcctttaaatatagccctttc

SEQ ID NO: 12785 - DNA, 201 bp, Homo sapiens
aaacactctgtccccaggggccagctgcataatatgaatagatgaaatagaccagaccagatgcaatctgcagtcatgggaactctgaactgaagagaacmtgccctcatttaaaggcatccaaatgaaacattttaaaaacgctaaaataaagagaccccatgaaggtcaaacaaggcataatcagacacacagtgtttt

SEQ ID NO: 12786 - DNA, 201 bp, Homo sapiens
tgcagtaaattcatatttcattgtcctttttctctttgaatccaagaagaaaaacggatgagctggagagcattcaaataacccctaggaaaaggataccytcatgagattatggaagccaaatagcaattaagatcattagtaaattcacatttgtaatctaaaatgtgggaatgaattctgaaattcagagaaaataat

SEQ ID NO: 12787 - DNA, 201 bp, Homo sapiens
acaaaatctatatttttaacaaatttgttttagaatttttatttctttattttgagactgggtaacaagactggctaacttttgtatttttggtagagacrgggtttcgccatgttggccaggctggtctcaaactcctgggctcaagtgatccatccacttcagtctcccaaagtgctgggattacaagcataagccact

SEQ ID NO: 12788 - DNA, 201 bp, Homo sapiens
agctacatatgacctaatgtccagcaggcaattgcagtccctgattatttcctatcaacttttcccagttgtctgttttgagacttactataagttaaacrtttatatgtatataatagagaacagatatcatcgaatttctgtgtatgtttaatagaattaatagctggagttgggccaggatcttatttctgtgaagac

SEQ ID NO: 12789 - DNA, 201 bp, Homo sapiens
ggataagttttctgtgccacatactaagttttgggatgtactaacatgcactcttttcttgtgtttacatcttcttgagcttgcatctctttcttagaggraaggcatgagggaggaaaataagaagaaagaaagggaaaaagggagggaaaaaagtagatttggtctttggagcttcagttaaatttcccttataatggt

SEQ ID NO: 12790 - DNA, 201 bp, Homo sapiens
aaaagatagccttgtatttctagaagttgtattttatattcacttcattgcatttgattgttctggataagttttctgtgccacatactaagttttgggakgtactaacatgcactcttttcttgtgtttacatcttcttgagcttgcatctctttcttagagggaaggcatgagggaggaaaataagaagaaagaaaggg

SEQ ID NO: 12791 - DNA, 201 bp, Homo sapiens
tgacttctggggttgagtgggcccatctgggtttctgaacttctcaatttaatagcacctgaagacattccctacctagagattttttatataaatcatasagctttatgggaacccatcctcccacatttctctgtgggaggttggtatttccttctaggcatgaatagggataaattctcaatcgaaagctgacctcct

SEQ ID NO: 12792 - DNA, 201 bp, Homo sapiens
tagtatgaccttggacatgacctttcaggaccttgatttcttcttatgtgagatgaaggattaaaatccaacagtttgttaaatcactctcaactttttakatactattaagtttaggatcccgtggagaggcctatcatccgagagaccatcctatcatcaaaaggtgaatatcaggtcaaagcaaaagaaaccacatta

SEQ ID NO: 12793 - DNA, 201 bp, Homo sapiens
aacgtgaaaatttgattcttcttcctatttttctcatgccttcctttggtctttctttctgcttggtggaaactgtggagttcagtggaagttttcctgcrgtctaattagcccctctgtttaattttgtaataaaaacgctgaaccagaagctggagataatgtgcccaattcaattcacagatgtcaatttctttttaa

SEQ ID NO: 12794 - DNA, 201 bp, Homo sapiens
ttttttttttttttttttaccctctctctgaaatatccttatcagtggacctcaaagtagcacttacaactcaggtctcttgaaccacatgctgctgcccyctatagttcttgcttttgtaaagttgtggttatttgccgattagctgccctgtgttggcatcctgactttggtatgatttgatgagctaagctattacta

SEQ ID NO: 12795 - DNA, 201 bp, Homo sapiens
tattctcaagaattgattagtcagatctctctgggaaagtagctgtagtcaggagtagaggggtagtttaaatcttgtagcccaggaaacctgccttgccyttcctgatgcttgggtcagtcttgaacaggcaaagagcactttgtggagtgaatgatggcaactggaatgaaggagactcatcatctctagccagtgtaa

SEQ ID NO: 12796 - DNA, 201 bp, Homo sapiens
tatgaaccagttgggcttcaatactttcacctcaaagtattctgttcttcacaatattataattccacagtgcatgtgcttgttgcacacgtctccaggarttgaaatacttgatattagagccagtggtccaaatgaaaatgaccagaagaggccaaatgtataatgttctcaatcccttatcaaaaatagatgggaata

SEQ ID NO: 12797 - DNA, 201 bp, Homo sapiens
ttgaggccatgttgcagttctcacaaacaaatcaatttgaattaatttgccaagtagaattaacgaggcattgtatgaattcaagacatactacaactackgcatcccctgaggttatttcttctctgggaaaattttgattcttgtaccacattttaatagtgtatatctgacctttgaatcttgcactaaatgatacat

SEQ ID NO: 12798 - DNA, 201 bp, Homo sapiens
gctgtggtcactgtccaccaagggtcaactctgagattccacacagatatgtttgccctcatttgccctcacaacctaatacccaggttgcccactccacytttccaatgtcttccaagagcactccagtttgcatcatctacagagctcaaattcacatggttgacagatacaaattcacatgcaaatgtactattattt

SEQ ID NO: 12799 - DNA, 201 bp, Homo sapiens
tgataccttcaacacagtcaaaataaacacattcatcgtaccttattttacttagtgtcatctccccagtggttccaaggtagaagtattaatctccctcrtttacagatgagtaaaccaaggttcagggaggttgagcacatttgctgtggtcactgtccaccaagggtcaactctgagattccacacagatatgtttgc

SEQ ID NO: 12800 - DNA, 201 bp, Homo sapiens
ctcaatcagtcccaattcttttgattctaaatctcaaattcttctagaacacaaagtagacattttcctctcccctgcttttcctgccacagccacacttsagcttctcaaggggaggggactgggtcattgtcatgaggtgatcatggactttgaaagatcttcaagctctacagccgtggtcttgtcagtttgggtgat

SEQ ID NO: 12801 - DNA, 201 bp, Homo sapiens
gtaaaacctgaagaatcttttagaactgttagtcaagaacttcataggtggtttatataaaatttattgtcacttgctaactgcatggctttcggcatttyttaacctttctaaacttcaatcttttcattcatggaacgtagataattattgtacctgtatgacagggtcaatgaaaggttaaatgagtgaagatacata

SEQ ID NO: 12802 - DNA, 201 bp, Homo sapiens
gccaaaagcatctgttattataaatataataattactaatcagcacccaactatgccgggcacttttgtagttacacatttgaataagatgcaaccctcartttcaaagaggtaagtgtcaatacaaagataaagatgtgaagaatagatagataccattttgtggtattgtttctacaagaaagatgtaaatacaatgga

SEQ ID NO: 12803 - DNA, 201 bp, Homo sapiens
taaatcattatgtagtgattagaggaagaggaataaagggtaatgtgagattttagaaataggtgctttgaatagataaagagatattgcaaggatagatraactcactatcgtctttgcagtatagtatcgttggtgcagaggatttgggatagaaatccagtctgggggccgagatgtgatcattatgtgcaatatcat

SEQ ID NO: 12804 - DNA, 201 bp, Homo sapiens
aaataaatattatatacttttggttctacatacttttaaatgaagatggtccatgaagtaagttatgatcaaaactaatgcaagggcttacagcctaagargaaagtccagaatttagagaatggtgacctgtcttttcttggcaactaatattatgaacatcaatttctcatcactttgtggcttcaagaaattctccca

SEQ ID NO: 12805 - DNA, 201 bp, Homo sapiens
gtggtctatctgactaccatagcttcgtagatcaaaatattgttatggtcatataaatgactataatgtgggtgttttagaattgcacttttgtttatgcrtaactggtcccaactcaaatctgcttcatcattttttagtcaaaggatagtttttcatgtcagtagtacctcaaactccgcttgtgaacttaacacccag

SEQ ID NO: 12806 - DNA, 201 bp, Homo sapiens
gaaaagaaaacaaaaacaaacaggagtcactctcagtcattttagcatatggacagaaggaacacagaatgaaatagagttggggaggggtgtgcacggtrtaagaaaaaaaaatgtgggcctaatcctttccgataacttttttttctgaaaacaactattaataaatcttatttccaagtctgtagaatattggttctc

SEQ ID NO: 12807 - DNA, 201 bp, Homo sapiens
tttttagttttgctgcatcattttttgaatttacctttctcccctcttttgcctattcattattcaaaaccagatcaaacactctttctgtgaagtcagtracttactccttcagaaatgtaggtacattgaaattggtaaacattatcacactttgtacatacttttacagtgactatgtatatgtgtgtgtttgcaaaa

SEQ ID NO: 12808 - DNA, 201 bp, Homo sapiens
ctttatcaattacccggtctcagatatgtctttattagcaccatgagaacagacaaatacactgtttatcatattcttgacagcaataaaacaattgcttwctgtcagctcttaacaatctttagtataattaagatagtctatttggattctttttcagagccttctatttttcagtcttttgaatgtactcttattgct

SEQ ID NO: 12809 - DNA, 201 bp, Homo sapiens
tatttaacaataacaacaacaaaaatcaaagtgcttgtttatcattgggactcaacttttgcagagtttttgccttaatttttttctctctaaagcagaakttcccatcactttagattcctttccgtgtcaatgatggcttttaatcccaatttccatcattacccctcagtgaaatgattgcttccatgtttgagtata

SEQ ID NO: 12810 - DNA, 201 bp, Homo sapiens
taaacacaaagtagaataagtaggccagaatatgattgtattctatcaacaatgttatatttgcttagaaatctcttatatttcttcctccaaatatgcgygcatgcacccacacacacacacacacacatacatatatacatatatgtatatctgcaattgtctaaaggtagatggtatagcataaaggttaagagtgta

SEQ ID NO: 12811 - DNA, 201 bp, Homo sapiens
aagtatgatagaattcctccttagttatacacattactgttattttgctagtaagtggctttgtatccacaatcaggacactcttatgaactgtttacatytgctattgactgatctcgttgcgtttcctcatgctttcatcaaaaggtagcagttggcagggccattcactggagaatgaggaacacgcataattagatt

SEQ ID NO: 12812 - DNA, 201 bp, Homo sapiens
tcattcctggagctgagaaaaagggtctatgttttgctttattttatttctttcatttagtttggtaggctatgtaatttgattcaagtatgatagaattyctccttagttatacacattactgttattttgctagtaagtggctttgtatccacaatcaggacactcttatgaactgtttacatctgctattgactgatc

SEQ ID NO: 12813 - DNA, 201 bp, Homo sapiens
acagcaaagccatattgtgatgttgactatatcatgcagtaatggtgaacaaatgtagcaagaagtaaaagacagagctatttaaatatatctgtgggcarttgcacaaatctgccacttttgtaggtatactgatgtttcctcattcctggagctgagaaaaagggtctatgttttgctttattttatttctttcattta

SEQ ID NO: 12814 - DNA, 201 bp, Homo sapiens
ttttttcagagatgtgtcttcaacactgaatgcaacagtgacacttgacaaatatttttcaaacacattgaaatgagtttgatcaccacctgggcattcasagtagtccagaggtcccctgcactgtgagtgtgactaaagctcaggaaagtcagaaaggccagccaaggaaggaagatgctggcaagactcggaaagtgc

SEQ ID NO: 12815 - DNA, 201 bp, Homo sapiens
ttgctgcctccttgtttgtgtctttcattaaactgtaagctccacacatgcagggactgtatttattttttcagagatgtgtcttcaacactgaatgcaasagtgacacttgacaaatatttttcaaacacattgaaatgagtttgatcaccacctgggcattcacagtagtccagaggtcccctgcactgtgagtgtgac

SEQ ID NO: 12816 - DNA, 201 bp, Homo sapiens
catgttgggccgtatctattttaaagacaagaggagctaactgcaaagttccttgtctggtaagctgtttcatctgatagttgtaatagcattttctcccrtctcactgtagggcctaaccccacaagcatccttgtgaagaaagaccccacagtcctctttttaagctttctccctccctttcctggggtgccttatcta

SEQ ID NO: 12817 - DNA, 201 bp, Homo sapiens
tcttttggggagacactatttaacccactacaaggtataaagatgagctataggcctgatgaggtaggaaagaggcagggcaaggtctcccagacactcaygtacctgacaaggtgagtctcaagagacacaagaaaaccttggaactgtaattgtgaaattgacatctatctctggaaaatgactattactcctaatgcc

SEQ ID NO: 12818 - DNA, 201 bp, Homo sapiens
gccattggattcagagcccacctagataatccaggatgatctcatctagacagcctttactaattccatcttgcaaagactcttttttcaaataatgacayattcatacattccatatcttttggggagacactatttaacccactacaaggtataaagatgagctataggcctgatgaggtaggaaagaggcagggcaag

SEQ ID NO: 12819 - DNA, 201 bp, Homo sapiens
ctccaaatgagcagaagctcaaccagctttgctgaaatgtgtttgatgagaggatggtgtgttttacttttgtgacatctttccccagaggtggttgcctraagagttgaactttagagaacaaaaagaaagaaatgtaggatccatttatggtctctcctagaatcatgccgtatgttggactctatatggaaagggagg

SEQ ID NO: 12820 - DNA, 201 bp, Homo sapiens
gaaactgtcaaaagtgtcttctagagctatttttgaggtctcttttattccttcattcctgatctgaaattcattaaggctaagagtgccccttaaattaygttctgctgtatcctggaggaacacctgaagaagttaataataaaccctagagattaggcaagtggaaagaattatgaaataaaacaaagcaaagaaatt

SEQ ID NO: 12821 - DNA, 201 bp, Homo sapiens
ctctgtggaccatgcaaataatatcattttcgatgtgttccatgatgcgaaaaagttagagaagtaccataggtctttgtatcaggcaccaatataaccamccctacactccagatcttctttccccatactcatttctccactctcctccaagtcctgcctcaaacgagttattattttcacataaaactgagaaggaac

SEQ ID NO: 12822 - DNA, 201 bp, Homo sapiens
aaatgttatgttcaggtttggcaaataccaataaggtcagagaaaaagcaatatgaatcagtattaagaaaattataagatagtgtatgtctaggtcatgwtctttagtatcatcaataaaaccactaaggatgcctcactatagctgtgagatgggttcggaccatgatatccagtttaatactatttgggagcagaagt

SEQ ID NO: 12823 - DNA, 201 bp, Homo sapiens
tagtcatgaaagtaggtaaagatttagttccagagatgtttattatagtttcttgtgaacattcttatttgaaaagaagataagtgcccaataatatcagwttgattacagtacactcaagcggttagcacagatattcatcatagctgtacttgataacagttgttactattatcatgttcttgtgtgagaggtaaaggg

SEQ ID NO: 12824 - DNA, 201 bp, Homo sapiens
tctctaagcaattcccttaccaccagctatctaatgctgtcagaggaccaactatttgctgttaacagtaatgctcatttgaagctattcagcctagattktctttgtattaggtaactgtttaataaattaattccaaacagtacctcccatctctctcagtctgaccattgagcgctcttagtcaatctttgcaaactt

SEQ ID NO: 12825 - DNA, 201 bp, Homo sapiens
gccatgcctagtcagagttctgaattcaggttctcaaagcaggaacagggagatgcagcagctgcagttgggaactcttctttctttctacattttttttktctttttgaaagtccacatctctatcaatccagaatcctaattacatatgatataaagggccctcaaaagacccattacccctgttaaagtatgtaaatt

SEQ ID NO: 12826 - DNA, 201 bp, Homo sapiens
ttcagggacagacgtcagagggaactgtataactacattagcctcacagatagtaccgacagccagacctgtcatttcctggcctgcgatgacacctctgsagcctagaatcacttaaagatatttagataggccctgttgatacgaccaagctaaccttcatcctgaaatcaattcatactcaggatgacaggaaatgag

SEQ ID NO: 12827 - DNA, 201 bp, Homo sapiens
aatcctgaaatgtgcgttctaaaaaaaaaaaaaagctccatctgagaacccattaaacctctagtttaaatacccaggcattcttaaaaatcgaatttgcmttgtctttgctgcagtgtcttctcaggtaaccaatgcagccatgtcagattgatacatcatgttgttaagacccccatctgtctctagggtagtagaaaa

SEQ ID NO: 12828 - DNA, 201 bp, Homo sapiens
caagactcaatatctggccagacttttagatgataatcacaagaagcaataacatttttctgaaacaaaacaagtggcaaatgatactgtgaaatctctgrcactggttacccaatatccacacataccccacttagctctagattagaaaataaagaatgagattcagcccagaggcagccatgcgcacaggtgcacaat

SEQ ID NO: 12829 - DNA, 201 bp, Homo sapiens
ctgcaggaggagaactgctttaatgtgaattgcattagaaagctcccctccacttttccttccccagtgtttgtctactgaatagcagggtgaaagcgtckgttgctctcatcgcctcacaatcaggccaattgggcataactgctttctggtagaattcatctcataataaattgcattcatggaagatgcctagtatgt

SEQ ID NO: 12830 - DNA, 201 bp, Homo sapiens
tgccccatgatgtgcccactgttcttttgctaatgtgttcatcctcagtgccttcattaccagtttctttcatttgacatgcaaagatcttttttcttggytcatcccagagaagtggccgggcaagtgttctcctgagaaaatgttgatgactctggcacacagaccacatacaatttgctgcttcctcacattcacact

SEQ ID NO: 12831 - DNA, 201 bp, Homo sapiens
ctgtgtagctctttagcccctgtttctattataaaaattaaaatttttaaaaggcacctgggaatctataggagagagtcagtggttaagtgagttgcctratatctggcaattaatgtttgagccagggactaaaatccagatatttttgattcctaaagtgtgattaaaatatgtctcaaccatgacatattaaactat

SEQ ID NO: 12832 - DNA, 201 bp, Homo sapiens
taaattttgaaataataaatgactataagcttttcataaagtatatacctgtattattaatgttcttatgctaacatatctggttattaaaaaatggtgcwtatgcactaataaccaatcagtatacagagagctgtcaagtcactcatctgtaagtgctaccagctggggttaataagcagaactgtgacatgtgaatat

SEQ ID NO: 12833 - DNA, 201 bp, Homo sapiens
aaaatatatattttttgtatggaggttacttcttattgaagtgtgttagatctggccaggcatgctggctcacacctataatgtcagcactttgggaggcygaggtgggaggatcacttgaactcaagagttggagaccagcctgggcaacatagtgagatgctgtctctaaaacaaaaatttttataattagccaggcat

SEQ ID NO: 12834 - DNA, 201 bp, Homo sapiens
acaattaagagatccttttgaagtgcccatgtttaagttttatttgtttggttttgtatttttttctaaatattctttcagatcaaaccaagtctaaactkgttactatttgacttaatgaaaggcctgacatgaaggaaggatgtaaataattttgagagaaaatacttttgaaatgttaaaacatttcttttgagcaat

SEQ ID NO: 12835 - DNA, 201 bp, Homo sapiens
gatgttggaaaattctatagtttgcacccgaaagcgtttgaaacattcctttgtataaacacattttcttgattgtgtggtcaatctgctggacagatccrctatgaattcagacagatctgggtttgaatcctggctctgctaccgtttaatgactttaacaatcttatttcatcatgcctccaaaaactgggagaaaat

SEQ ID NO: 12836 - DNA, 201 bp, Homo sapiens
ggtgtgcccaagataaacaagagtcacagaaatcctctgtggcttatgttctccctgaagaggttttcaggaggctcagttttatacatttccttgggggraaaatgtgtgtaggaagagttggggggtaggcagaagaatgattgctctcatattgtctttgttccatacctgagaaaataaggattattagtgtgaagt

SEQ ID NO: 12837 - DNA, 201 bp, Homo sapiens
tgaaaacccaaagttgattttttcatgctttcagtaattacattgaagttgtcccaaaggcagaagaaagaaaaagaaatcaagtctccaaaatttctctrtcctttagaaagaaactccaccttaatttttggtgaggagtaacagatctcacttgggtggtagttacattttgtgatgtgagggtgtcagctttttctc

SEQ ID NO: 12838 - DNA, 201 bp, Homo sapiens
agagattctatgtcagtcagtccaaaaaagatagaaatttagtacagaaaaccaaccaactatggaaatgaatagtaagatagtaactaaatatgtatagrtgtgtgtatatgtatgtgtctgtgtgcatatatatatatatatatatgcacacacacataggcatgaagtgccaaactatttttaaaagtatgaacttgg

SEQ ID NO: 12839 - DNA, 201 bp, Homo sapiens
gaagaagatatccagagaacattgtgaatatatacttagtttctccaacctggacagaccaggagcctttatgtcaagatcctgcacggataattcccctyaggtggagagctggtggtttttccaagcacccagccacaactgccactgcattctatttctttaatgctcaatcagtgcccctggccatttgatgatcat

SEQ ID NO: 12840 - DNA, 201 bp, Homo sapiens
catgagcatagccctgcttcatttcaacttagcctatctttatggccttcaggtctcctctcatctggaattgagttctgtagattttgtcctgtatgccyataatccactaaatagtgttcccattgttttcaaatataattcacaggggtaaagatagaaaatgtattttttagggctttttctaacaattatattttc

SEQ ID NO: 12841 - DNA, 201 bp, Homo sapiens
tcgtctcacctaggtccaggcatgagcatagccctgcttcatttcaacttagcctatctttatggccttcaggtctcctctcatctggaattgagttctgyagattttgtcctgtatgcccataatccactaaatagtgttcccattgttttcaaatataattcacaggggtaaagatagaaaatgtattttttagggctt

SEQ ID NO: 12842 - DNA, 201 bp, Homo sapiens
tccattaagaagataataatttctttttcctgacatggccttgtatttttaacttcttgctccacccatactcaaatgcaggttgatttattctcctttaygctaggtgacttccccctgtgtatactctctttcagaagtatttctttctatctccctaaaatcaaaaccaatgttcaccttaggttgtgtagaaaagtc

SEQ ID NO: 12843 - DNA, 201 bp, Homo sapiens
tgcattttatctgcagtcaactagttagaaaccagaaacaactatcttgcatctcattatcttgttattttcacctttaaaatccctttgcagaataggtrcatagtattaatttgataactaaatgaaaacaaaatggagttcatcaaagtggatttgttttgaattggcttggagttactggcagtctatgatgacata

SEQ ID NO: 12844 - DNA, 201 bp, Homo sapiens
agaactgggaggacagcgatagaatgcttttgcattttatctgcagtcaactagttagaaaccagaaacaactatcttgcatctcattatcttgttatttkcacctttaaaatccctttgcagaataggtacatagtattaatttgataactaaatgaaaacaaaatggagttcatcaaagtggatttgttttgaattggc

SEQ ID NO: 12845 - DNA, 201 bp, Homo sapiens
tgagcattttgagaagaactgggaggacagcgatagaatgcttttgcattttatctgcagtcaactagttagaaaccagaaacaactatcttgcatctcaytatcttgttattttcacctttaaaatccctttgcagaataggtacatagtattaatttgataactaaatgaaaacaaaatggagttcatcaaagtggatt

SEQ ID NO: 12846 - DNA, 201 bp, Homo sapiens
cagggcctcaaggaagtcagcctctgagaatctgagatttccagactctgataatgggaatctcacctatttgtccacttttggggtagatctagacaccrtgatgtgtcagcagcctcttagttgctgagacaattgtcccagagtgcacagactaaatctaaatccctacaatatgttttcaatgaatttatgccacac

SEQ ID NO: 12847 - DNA, 201 bp, Homo sapiens
ttctgtttttatcttacttaactgtaaggtccttgagggcaaaaacagtcaagtctttctcattcatcctttgcaaacccagcaccctgattcccaacagrgtagaactcagcacatatttgatgaattagattgaatttaaatctatatatagttataggaataaatgcttggaggattttcctatctctgtttcaattc

SEQ ID NO: 12848 - DNA, 201 bp, Homo sapiens
ttgataactgtagccataactaagggaaatatattaagctcctcttctcaataaagattagatttaattacgaaaatatcatctatttatttgccatcttkttttacaataatatatcttgtatcttcatataaaagcagttacggcagccctctgcactgtattttcatagggttctgtttttatcttacttaactgtaa

SEQ ID NO: 12849 - DNA, 201 bp, Homo sapiens
tgaattctccacatttaaagtctccacttgtcacttgaattaacatagtattttagcatttaatttcctggggataccagatgttttattttgtgagtttsttttatttatgttatagttgtggtttaaacaactatatgttcatttaaaatgaaactcaaaaaagaggaaagaatggcacaactcaataaatatgtagtt

SEQ ID NO: 12850 - DNA, 201 bp, Homo sapiens
tataactttctcaattacttaggcaaatatattcttgaaaataaaaagttagaaaagagggaaagactgagaccctcaatgttaaataacattttataatratcacatgctgagtcaaaggcaaaagcaatttctaagtcgcctacttaattctctagaccatgcctgctatcttatatttatatcttaataaatgtacat

SEQ ID NO: 12851 - DNA, 201 bp, Homo sapiens
ggattggaattttggatcactcaaatgtgatccaaaacctctggacacccttaccctttctagatatattttttccccttaaagaactcaaaggagaacaragacctggaaaaatatctgtggatatctggaagtaagcactgtactagaggttatcttgtatttgtctctagtttttatgttcgattctcagaggcaggt

SEQ ID NO: 12852 - DNA, 201 bp, Homo sapiens
ctttgggggcaggacttaatttgacccttaacatgaagtgataaaaatattttttagacttgataattgtagctcttgtttgatggctgaagtatcaagargattatgagaacagacatgaggctatgaatatgttgaaggattggaattttggatcactcaaatgtgatccaaaacctctggacacccttaccctttcta

SEQ ID NO: 12853 - DNA, 201 bp, Homo sapiens
tatgatgaaaagaatttggtttcagaattaaaaagaaagcacacatttttgagttctcgctcaaaaacaattttgtgagggtaagttatttaacttctccrtgtctcagcttcctataaaactagaattatgagatctctcttataggtttgaaataggatgaaaattcctccctctttttttttcttataacctctctca

SEQ ID NO: 12854 - DNA, 201 bp, Homo sapiens
ggatagagcagcaacacaacagtgtccctagcggaagaagtaatgtctgtgatggtaagggaaaagagggtgaaagtgagaaaagagtgagagagaggctyggacaacttaaacaactggaaggccagcaggataatggttatggtagaggtggagagaaatatgaagttggaatgggatgggatcagggacacatcatgc

SEQ ID NO: 12855 - DNA, 201 bp, Homo sapiens
taaaacacttaggagagtctctgctatgtaataagtgttcccaatatatagattttatttcatctagttgaatttagagagtagcaagccactcccttccygccccacccccgaaaaaaaaaaaaaacacaccaccaccaacaacccacttttagtgtggcaccatatctaagaaggtattctccaagacttctttatgtg

SEQ ID NO: 12856 - DNA, 201 bp, Homo sapiens
ctttaatctctctaggccttagttttctggattttgaggcttaaatgagttattaattgtaaaacacttaggagagtctctgctatgtaataagtgttccyaatatatagattttatttcatctagttgaatttagagagtagcaagccactcccttcctgccccacccccgaaaaaaaaaaaaaacacaccaccaccaac

SEQ ID NO: 12857 - DNA, 201 bp, Homo sapiens
ctctagctcagcgacttctttactgtgtgaacattgatatgtttactttaatctctctaggccttagttttctggattttgaggcttaaatgagttattamttgtaaaacacttaggagagtctctgctatgtaataagtgttcccaatatatagattttatttcatctagttgaatttagagagtagcaagccactccct

SEQ ID NO: 12858 - DNA, 201 bp, Homo sapiens
ggtatcaaaagaagtctccaattaatttgtagccagtgtaaccatatagcatctatttgcttagttttcaataataataatactggttctgattaaataargcatattgtcaaacttattatttgcaaacatattactgttgtaactggtaattgctcagatctctttcggttcctgccccgacacccaaaagtcaagagg

SEQ ID NO: 12859 - DNA, 201 bp, Homo sapiens
tcttgttccagaccaagtgcagaaatctttacagagagaaagcattgggatggggatgaggctatgctcagccagtctgggagatctctaggggaaaatgwcataggaaaaaatagtgataaatatgcttaaaagaaggcaaggaagcaagcaaggaaggaagaaataaagaaaaagagagagaggaagaaagagagaatg

SEQ ID NO: 12860 - DNA, 201 bp, Homo sapiens
tggagtttcagggaaatgagaagagcatggagaggacttttgaattaatccattgatccacgagttaccatagcctccgtgctgcatacagaaggtaccaygaaggggtatagttcttttgctcttttctcactgcctgatccattctaaatgtaactcttgttccagaccaagtgcagaaatctttacagagagaaagca

SEQ ID NO: 12861 - DNA, 201 bp, Homo sapiens
gtgttcccccgataccttgtctcaaactgtatgccctactaaaagggcctccaccttttctttacattctaaaaggtccagatcaatttttccctctaccrtgaaatttattttcccttctcctggcatattgatctttccctgtgaacactttctgtaaacttgaaaggtctataaaatggtcctttttatatagtcttt

SEQ ID NO: 12862 - DNA, 201 bp, Homo sapiens
cttaaaatgtttggggccctaacatcagtgttcaaaatcccaaaatattattctcatcagcaaaatattgctcctacacacaaggtacctcttctcctttyttcacttgctaataataatggcaagtattaatataaggtatttgttgagcaattattaaatatgtcatctctaacacaacagtccaaaaagacaggccta

SEQ ID NO: 12863 - DNA, 201 bp, Homo sapiens
tggtccaaggtagtctctaaatccaattagagaaaatgaaattcaggaagcacatcactgtagattttggtacagtgacttgagtatataattgccatctytttctatgttagctcaggggtgggttttgtgccataaaccaaccatccaaccaccagtctacccacctacccacccaactaaccatcatttgggctatat

SEQ ID NO: 12864 - DNA, 201 bp, Homo sapiens
ctgctgttgagtttttctttccttcaaacatcgaaaaatgttgtgtagaatagaaccctcctgcatgcacccacacatgtgcaaaagggttgtcatttttrtggactttgtgaaaatagcagttttaaacatttcatacctatccttaacaacattgttggcttttaccatgtacatgacaactgttttgagtggcataca

SEQ ID NO: 12865 - DNA, 201 bp, Homo sapiens
acattttaaaacttagtctcatttagtgtgagttggccaagcctggatgttttcactttatttctttattctttgtgtgaccctggtgggttgatggaggsagtgggatgaatttcagtttcactcttataaacatagctgtgcaaagctgatattctttagagctgattgtcttgtataagagtgactcccttgtatggg

SEQ ID NO: 12866 - DNA, 201 bp, Homo sapiens
tacattttaaaacttagtctcatttagtgtgagttggccaagcctggatgttttcactttatttctttattctttgtgtgaccctggtgggttgatggagrcagtgggatgaatttcagtttcactcttataaacatagctgtgcaaagctgatattctttagagctgattgtcttgtataagagtgactcccttgtatgg

SEQ ID NO: 12867 - DNA, 201 bp, Homo sapiens
gtgcagctgtctgttgttgttctttttcccgttttttctcagtagttttggtcccatatgctctttcattctcttaaggtacactgaggagaaacaagtgragaagttggcaatatagagagaaaattatgtaatacgcattcatctaattacataagcatatgtctctgtatctgtcatgtgaaggatacgatgtctgga

SEQ ID NO: 12868 - DNA, 201 bp, Homo sapiens
cctgtcctgcttccacccttcatgaataaatacaaaatgccttgccacccagaagacgaaccctttgtagtcgtgcatctcttttgaacatgcgtctttargaccctgtgttctttcatttcagtattcttgcttttgtgaggcttacgttagaaactgtgaaatatgctgttattgcaatggtaatatgttttaccctgt

SEQ ID NO: 12869 - DNA, 201 bp, Homo sapiens
aagaaatggttcattttctctgataacctcgggaatgtcatgctgtgggggctgagagatgacaggatgagtgtcaaagtgtgggaagggccgtaatacaraggaaggaatataggctttggaatttcagctgaatcatttaatgtctggtgtcatcagtaaactgtcttagccttgttcagcttacatttacttttcttt

SEQ ID NO: 12870 - DNA, 201 bp, Homo sapiens
tccttacctacatagcatgtatagcaccaagctgtaaaaagtcattttgcaaaattttccatttaaaatgtatttctcatagtaatttttaaaaacttgayaaaataggattgaggagtgtgcggtcaaacaaaatgaaatggagttctttattgccaggcttattaggagactttaataagctaatgtacattgcaaatc

SEQ ID NO: 12871 - DNA, 201 bp, Homo sapiens
ccatgtcagtgtgattccacaaaatcattctgcttgctgtacttcaaaatccatcataagaaaataatttatcttacaatatgggaaaaatataatggaawgggttggagtgaggtagggaatgcattagcttattaaagtctcctaagaaacttacaggaggtaggccacaacacttgacctctccctcacaaaaacaaa

SEQ ID NO: 12872 - DNA, 201 bp, Homo sapiens
caggttatactcttcattatcctcctagaattagattttctgtttcataattagcaatagtctcccatatcctccatgccctttacccagcctcaccctaktcctctttcagtcctgagacaggacaactcagggatgtaaacatggagaaactgtgagaacaaaccagagaggaaggatttttcagacaggctgactagg

SEQ ID NO: 12873 - DNA, 201 bp, Homo sapiens
ttgtcgagttagccctgaagtggcaaggaccctatttcagtgctcatatttaaaaagcaccaccatcagcaaaaggggtgtagagaggaggcaccatttaraatcttggaaaatctgaaaaaacttgcttctaggccagagagtagagagaactgtgagattgtgtgctagccacagtagaccaatgttggattggagatg

SEQ ID NO: 12874 - DNA, 201 bp, Homo sapiens
tgtgctttttctgttctggtcttcacgtaatccgcttcacattctttttaaattcacctttcccaagattcatcattgcttacaggacaatgtccaattcyttagcattacatgcagtccatctatctttcctaccttagctctcacttcacagctcataatccctctcctccccaatgtacacaaacacacccacctttc

SEQ ID NO: 12875 - DNA, 201 bp, Homo sapiens
atgctcaaatccctgacaaaatggcatagtatttgcatgtaacctatgcccaccctctcacatactgtaaaatcatctctagattacttgtaataaataayacaatgaaaatgctatgtacacagttgttactgtttcgagaatattgacaaggaaaaagttctgcgtgtgtttagtacagaggcaaggttttgagaatat

SEQ ID NO: 12876 - DNA, 201 bp, Homo sapiens
aagcataaagccgcagggaagtggacagaggtcttaagggttggaaaaaggagtgggcacatttgtgaaatgtagcagagctatgggatttggactttgcratgtacttgtacagtaggactaaagcagacaagcatagaatgcatgccattaattcttagccttgaggcataccttctcaataattaggagaatgaaaag

SEQ ID NO: 12877 - DNA, 201 bp, Homo sapiens
taatgagattcagtccaactggaccgagcttgtgaataaaacaagatgctccagtctgtggttcaaacattttgaacttcccagaatataattaggtataraatatagttcttatctttctttgagaactttttgaattattgttatagtttctaaaatatcttttctattttgagggtaaggtcacaaaacagaaaaaaa

SEQ ID NO: 12878 - DNA, 201 bp, Homo sapiens
taaaacagaaagaagctttttagaagggaacaaaaaacactggggcttacttcaggagggatggtagaaggagaaagaggagcagaaaaaataactattgratactagggttattaccttggtgattaactgatctgtgcaacaaatcctatgataggagttcacctatacaacagacctgcacatgtacccttaaaccga

SEQ ID NO: 12879 - DNA, 201 bp, Homo sapiens
taaagaccctatcttcaaatatggtaagcctctgtggtattggggtttagatttcaacatacgagtgtttggagggacagaattcagcccacaacacctcrttaagcctggaagagaccgtaagaatattcgattaactggataagaagcacttaaacccaatttctaagaaaagagggataaaaaggtatactgtttcca

SEQ ID NO: 12880 - DNA, 201 bp, Homo sapiens
agcaatcagttcttactgtcagttagaaaaagctatcccagttattcaagagaaacacagtatagcttgagactatatgtctccataggcctttttgtaaraagtattcagtgatataatttcccctatagcagacctacaatgaactgcttagtttcatgtcactgctgctcatattgtcctttgctaaaagctgagaat

SEQ ID NO: 12881 - DNA, 201 bp, Homo sapiens
gagtgcttgaggagaaataaaagcagaggaggaataaaaggagatgaaggaggaggaaggggaggaggagaagttataaataaagattagcccctaattckaaaacattttttcttgatctaaatatatgaacaacgaagtccaaattatttaatgtttcccattgactataggatgaaatttaatactttagcctgatgt

SEQ ID NO: 12882 - DNA, 201 bp, Homo sapiens
aaataactggaatgcttgataattatataagaaacttaaatacttggcctattcatttatcctagagttttagggaacatcttggtctagcataggcattytcaaccatcatattgaaaaaaattgtggagcattatagcacaaatgattttacaaaataaaatgattgttaaaaattagaataggttcatagtagcctca

SEQ ID NO: 12883 - DNA, 201 bp, Homo sapiens
cattaaaatatttaacagtcttatgaaagactaaagaatcattttgagttcatctactaggcatggacaagccacttcaggaagtttaatatccttctttktgcctttgggtttaatctgtgctagtgataccccagccttgacagaattgctgccccaatggcccaggctgtgggattctgcacaggaaagaccacttca

SEQ ID NO: 12884 - DNA, 201 bp, Homo sapiens
tacagacatcttctttattccagctcaacagcccaaattcttttcaccttctgtaaagaagagtgactggaagagagactaagttaattgagataattaakaagtgagtgagagaataaatgaattatagaggaggaaccaaaagcacagagctggaagtggaacaggaggttctcagcaattttaaaagtgaaggcaccg

SEQ ID NO: 12885 - DNA, 201 bp, Homo sapiens
tatttattcatatggtacatgtgcttacaagcaggaagctattgtgtatatataagtgttatgtatttacgcatatggtacatgtgcctacaagcagaaasctattaatcctttcaagaacctttacaggcattattcatttaatattgataaaaccatttcaaatgagctgataatggtttggctgtgtccccacccaaa

SEQ ID NO: 12886 - DNA, 201 bp, Homo sapiens
aagtgattttcaaacatagttgatcataagaaccttgaaggggattatttgtttaaatgtagattcttctttcttttacattgtcgtaagtaatgtaatcmatgtggaatagggctgtaaacctattttaagggcttctgagatgctaatcagtcagatttgggaactatcagggaaaattttcaacccttttcatcatga

SEQ ID NO: 12887 - DNA, 201 bp, Homo sapiens
cgtgttacccccagtttattaacattagattgtactcttttgtcctccaattatacttccatgcacgactgtccactctttatcaaacctaagcataaaawtacccagatttccctgtgtcttcgggccttcatttctgaaggctcctgtgtataagttttatataaataaatatatgcttctttatgaatgaatataaat

SEQ ID NO: 12888 - DNA, 201 bp, Homo sapiens
aacccaccaatgacagggctatattgtaaatttatgatgaatgaacacagtttagcatttttagcacttgttggggaaaataagaagtctgcattcatttycttgattagactgcaaagtagtacagagaagctcataaaaaattcttcataatgaaatagtgttcctactgatagattaacctatcatagcttccaaaat

SEQ ID NO: 12889 - DNA, 201 bp, Homo sapiens
gttgtaggttttattttgctttacaatttgacagtattttaagattctgtatttattctctttttgagctgaattatgcaggactaaacagatatcttttstaaaaccttttatttccctgacagttaggagaaatatgaagtaggaaattctttggtaattgttggaggttggtatagtgcagtagataatgtcccttta

SEQ ID NO: 12890 - DNA, 201 bp, Homo sapiens
agcactgtgtcttccaggcctctggtaaacactgttgcatacattatttgtcttagttctcaaaataatcttgagaggtttgtactattctttccatcttwcagatgcagaagttgaggcacatgaagagaattcttaggatcctaaattttcataaatgccttcaggggaatttgacaatcaatctccattaggatcaca

SEQ ID NO: 12891 - DNA, 201 bp, Homo sapiens
accttcaggtccagttaaacctgctctgctattaattagtttttggttttgaggtgatttttccaagccgtcattattagtaataagagctacaatatcaytggatgaagaagaaaaatttctgaacagaagcatagctcccaaccatatgttttccataccagcatctatacaggcaccaaaaatcatggatgttcttat

SEQ ID NO: 12892 - DNA, 201 bp, Homo sapiens
ggttccatgctgggaagggcaagctgaaaaggccagagtccaccatctttcccaaattcccacttatacaatggtagtgtcactcgggtggaagtgggccrctatttgtgcaaccaactgggctgtaatggcacagaaattctgcccagggatagatgcagagtgtcacaataagagtttccactctgcctggagtcactg

SEQ ID NO: 12893 - DNA, 201 bp, Homo sapiens
atgggtaggcatagccaagaacattgggctcacttcttttatccagcccccgtttatagggtataagctctataccaattgtggcagaccaataataatgygtgtccaattgtctcttcctcagcttgcttataaggcagaggttccatgctgggaagggcaagctgaaaaggccagagtccaccatctttcccaaattcc

SEQ ID NO: 12894 - DNA, 201 bp, Homo sapiens
agcaaggtaaaagggaatgacatggcaatacaaatgcaaagcaacagaacaataaagttaaaaaaaggaaaaaaagcttagaaaagtcaaataattcgatytagagaaaaagcaaaagaacagaaaatttcccgtgagctacattctatggctcaatttgcattattgaatgactcaagaaaaattgaattcatgtcacaa

SEQ ID NO: 12895 - DNA, 201 bp, Homo sapiens
ccagcattttacagaagaggaaatggaagcttagagcagtgggtaacttacccaggttgaaattggcagagctgaggtccaaatcagagaaattcagcatygatggtgcaatagactctaggaagtggcctcatatatggtctagtcaatagaagaagccagaaaacgcttttcagagaatgagatctagtcttgtcacct

SEQ ID NO: 12896 - DNA, 201 bp, Homo sapiens
agtcagtccccacaaacctgattagaaaggaattacctccagcattttacagaagaggaaatggaagcttagagcagtgggtaacttacccaggttgaaaytggcagagctgaggtccaaatcagagaaattcagcatcgatggtgcaatagactctaggaagtggcctcatatatggtctagtcaatagaagaagccaga

SEQ ID NO: 12897 - DNA, 201 bp, Homo sapiens
aacttcctattgcccagtagcattttttttatgctctcagtgaataatgatgataatggcagctgagatttgaatggtaacttgggtctaagtactgcatrtgatacatttagtcagtccccacaaacctgattagaaaggaattacctccagcattttacagaagaggaaatggaagcttagagcagtgggtaacttacc

SEQ ID NO: 12898 - DNA, 201 bp, Homo sapiens
gattacaggtgtgagccatgtctcccggcctgatatcctgcagttttgagatacagttttgtgtgtttgccttggagaaaaagagaatttcagttgcccaygattcatacatttttatgtggcagcttccttgaaagggaacaaacgttgaagggattcatttggcaacattattcccattttatagatgtgggtttttag

SEQ ID NO: 12899 - DNA, 201 bp, Homo sapiens
aactccgtctcaaaaaaaaatgctgtgggcccacttcaggtaacatcacatttaccacctcgtcttattcctcaaaatagtcctagattgagtgtgttaartcacatatctcaaaagcaaagctaaatttatttttgaccataggaacatcttagggtaccactagacaaggaaatcatgattttgacgagtgtcagctga

SEQ ID NO: 12900 - DNA, 201 bp, Homo sapiens
atatgtactcttatctacatatgatgtactaaatgcttagcagtggttagcttatttaatctttgcaataactacataagatatgtgctattttcattctwaatttatatctgaggaattggggttaaggataggttaagtaacttgctcaaggtcacccaagaatacgttgaggtgatctctgggtcttccactcctgag

SEQ ID NO: 12901 - DNA, 201 bp, Homo sapiens
cgccatagttatatatcactcttgtaatatccattagaatgcaaacagctttgcttgattctctcctggtgatgagagatgggaactaattctacatttaratattggggattatatgatatgtgctggagtgacccatccaattaactttgtctcacagatatggacagatgaggcttattttagaaattagccattgtt

SEQ ID NO: 12902 - DNA, 201 bp, Homo sapiens
gagtcattttcaatgcttcgccatagttatatatcactcttgtaatatccattagaatgcaaacagctttgcttgattctctcctggtgatgagagatggkaactaattctacatttaaatattggggattatatgatatgtgctggagtgacccatccaattaactttgtctcacagatatggacagatgaggcttattt

SEQ ID NO: 12903 - DNA, 201 bp, Homo sapiens
agccatgggggcggagaggaagaaatcagctgtgggtgggaatggagtgggtagaaatattgaagaaggtttctaaaaagaggtgatgcctaaactgtgcytcaagtggcgaatagtagttatccaggtagagaatccaggcaagatttatccctggaatgataaattggaggacctgctgaacttttgtcaaggctggta

SEQ ID NO: 12904 - DNA, 201 bp, Homo sapiens
ttttttttttttgatgtggcaaaaacaaaacaactcagcagctaaacagatgaaaagccaagctgtgggctaaggtatgtatttgatgaagctctctcttytctagatctttagtgggaagagttttgccacttgacacatatttaccccgcaaacctacactggcaatgctaaggcagtgagcacagaacacaggcctga

SEQ ID NO: 12905 - DNA, 201 bp, Homo sapiens
agatgagatttattcctaccaaatttattatttgagtgaaactgaacagttccattctgataagtaagggaagaaccaggcatactatgttgctattctcyacgatctgtgttaaggtttctgtggatgtgtgtgtgtgtctacttaaagaaatggcagtctatccctcttacatcctcagatattcacagagcccctcag

SEQ ID NO: 12906 - DNA, 201 bp, Homo sapiens
tggattaatattttttctttatcacttggcatgttaaacttaattatatttcttgaaagacctctaaacagttataattagaaattatgataatagctgcrgttgccttacacatgttcattttactgcttgcttctttgtgaatgtgggctgtgattaataaataaccaccaacatcattaggacaagacctctccttgc

SEQ ID NO: 12907 - DNA, 201 bp, Homo sapiens
ttttcttctcattataggaccaaaagtgcccttagagatcaagtagcccagtgatccccagactttgcttgttggtcgcgataccctgggcagcatttgamagccaggccctgcctccagtggtggttctgaatcaaaagatcagtgtagaggcttggagtggcatttgtgtggggtgtgccagaatatatttattttaat

SEQ ID NO: 12908 - DNA, 201 bp, Homo sapiens
gggcaatcttgcctggcctaaaggttggactgtaggtagcacaggacttccgggtttggagatttagaggataagtctaggcttcacccaaataccaacartaagaacttgagtagttcctgggacctccctgagcctaagtataaaatgaggacagcaacacatatctatactgccatgctgttataagaaataaatgag

SEQ ID NO: 12909 - DNA, 201 bp, Homo sapiens
acttgattactcttagtttttacatttcagctcaggtgtcaactgctccaagaagcctttctcgagctcatgctccccttcaccaaactgccacaacaacstgtgtgaatcttgatcaccaagcttacagtgctgtttgagataattatctgctcaagtttctggtgttcccattagactgtcagtgcctcatcgatgtgc

SEQ ID NO: 12910 - DNA, 201 bp, Homo sapiens
agaaattcagagttatcccaggctgggtatttgcataccacaatgagaattgctacaactaatgttgcttgatggaagggcaggagctgaaattttacctkagccaccaattttctcaaaaccttggcctgagagagaattcaagttttacccagaagtatctacattttgttttttacaaaagggctcatgatagagctc

SEQ ID NO: 12911 - DNA, 201 bp, Homo sapiens
ctgagaaaaagaagtaaatcatccatagattttggcattttgttattatcacaaagtatgctagacatacacctcataagtgattttgacaaaaagatgtkctgcaagcacagtgcttgaggggtggtcacgattatggatatcactgtactaatctcagaaatcttagtgtatgtttttttttgtctttactggatagtt

SEQ ID NO: 12912 - DNA, 201 bp, Homo sapiens
tctatgtgggtctgcttcctgaacagctggtaaacagtggagaaagccatactcaaatgaatttcctttcaatttcagtgcgtcctttcactacaaaacarcccaatcaatgtcctgggttctgttcactcagactgagaaaaagaagtaaatcatccatagattttggcattttgttattatcacaaagtatgctagaca

SEQ ID NO: 12913 - DNA, 201 bp, Homo sapiens
aaatcaacacctacaccaaaccaggctaatataagacaaaacctacttaaggtccagatttttttgtcccagcatttaaaaacagtgccagcatggactgragtaaacacgctgcaatgatttctcagcttgggaaactgtcctttcttatatgtgagatgcctacagaggaagcagaaagatagtaatttctttcccttg

SEQ ID NO: 12914 - DNA, 201 bp, Homo sapiens
gcttggaaggggagatacttagagaaaaaatgactttcagtgctatagcaaaaaggaatttaaaacatttcaaaagcccccaacctcagtacattccaaarcaggataaaataaatacaaacaaaaaatcaacacctacaccaaaccaggctaatataagacaaaacctacttaaggtccagatttttttgtcccagcatt

SEQ ID NO: 12915 - DNA, 201 bp, Homo sapiens
ctgtttcctcatgagtcaaaactgggaataaataataataaccttttagggttgttttatctctatgattaaacaaaataatagatatgacatacattatrggtctatcacatgataaacgcttaagaacagagactccttttactttccagttatccaaggtatagagtatgagaggggcaggtggctgtgcagtggtac

SEQ ID NO: 12916 - DNA, 201 bp, Homo sapiens
ctgggtccccttggacctgctgctgccggtcggctgggaagagttataaagaagaaaggacattttcaagctaagctctcctggaaactggtaggatggcrtgagctggtccacaggccccagctgccagatgatgggaattgggatcagctgtgacctaattatgagtctcgtaaacctgcattgtgcccttcattttcc

SEQ ID NO: 12917 - DNA, 201 bp, Homo sapiens
ttttccattgctttttctgtgctgtctggagaatcactttccataccattgggtcttcttttccccagttaatataccagagcctttctgctcattcattstctacatttcatgcctctctgaagtattaatacctttctctttacactggttacagatgtatatgcaaagatcaagtggatagattgtgtttgctgagaa

SEQ ID NO: 12918 - DNA, 201 bp, Homo sapiens
agccatttattatttctcatgagtattaggttggctgtacacacctgctgatatggtttgggggcataatggggctgtctctcatctttggtcagttgcasgtgggcttgttggctttgctgatgtggctgagcttcctcacatctttgaagccttgtctgagatggtttggctttgctccatgtgttttcttcacctcca

SEQ ID NO: 12919 - DNA, 201 bp, Homo sapiens
aagtttcgtgctctgctacaggtataaaaccaaaacgagtttaaacattataaacaacacaagcacaataaaattaaatgaagcagtattaatttaatagrcccatttgtaatcaatatgaaaataaatctttgtggacgatgtgaatatagtactaactgctacagcccaggttattaaagtttggcctttcccatactc

SEQ ID NO: 12920 - DNA, 201 bp, Homo sapiens
gtcattcactggttcccattcctcccctaaagccctggctgatgattttcgcacgctttacttaataacttcctccctacctggagcccggtggaatccayaaagccataagcacacaccagcctggtaggttggggcaggtgggaaggagctctgggaggctggggcatcagaacttcaccctctctggtcagagctgtg

SEQ ID NO: 12921 - DNA, 201 bp, Homo sapiens
ctccaaggacaggtcattgtgtcattcactggttcccattcctcccctaaagccctggctgatgattttcgcacgctttacttaataacttcctccctacytggagcccggtggaatccacaaagccataagcacacaccagcctggtaggttggggcaggtgggaaggagctctgggaggctggggcatcagaacttcac

SEQ ID NO: 12922 - DNA, 201 bp, Homo sapiens
atttggaataaacatgttcagccctcaagtttgatgctgtttgcagaatctcatagtttcctgattacttcaaaaggaaaatcaggctgggaggagaaaamtgtttttaaaagccccaaggaggaaaagactgagggggaaggaggagcaaaagggtcaaggggaaggtaagggcaagtctaggagttccttaggaggcag

SEQ ID NO: 12923 - DNA, 201 bp, Homo sapiens
tttattgttatataaaatgtttatgtcatagacctattattttctatcaagtatttaagttttcctcttattattttgatgagcttttaattgattaataktattgttgcttggtattataaatacatactcatggcaaacacttttctttcaattttgcctcaattttgtttatgatgttctttgaggggcagaaatact

SEQ ID NO: 12924 - DNA, 201 bp, Homo sapiens
gactaataaagaagaaaagacagaaattgccaatatcaaaaatgaaataaaggatatcgctatagacattgtagacaatgaaaggcaataaaagaatactkcaaagcaaccctacacacaaaagtttgataacttagaagaaacagatcacattctgaaaaaaaaaatctaccgcaacttggtaatataaaatagataata

SEQ ID NO: 12925 - DNA, 201 bp, Homo sapiens
agaacaggattctgtctcaaaaaaaaaaaaaaaaaatcaaatcattaaaccaaatgaaaatgtaacatattaaaatttgtgaaactcagccaaagcaatgmtgagaaagacagttatgtagctaaatacatacattagaaaagaggaaaagtctcaaatcaataatcaaactcacatcttaaaagctaaatacatacatta

SEQ ID NO: 12926 - DNA, 201 bp, Homo sapiens
gcaaacccactgttgccacatgtcccaatttttcaagaatagtaacagatctggtttttacattagatttttcaattttaaaaacactgccacagggactyccactcccaaaaaattggatagacatattggtccctgttccatccttaagtacaattaaaacccaatgacattatatataagaagactctgaaacatgag

SEQ ID NO: 12927 - DNA, 201 bp, Homo sapiens
agacatttcaggacatgattcatccactcattacatacttagtaagctcctattatgtgccaggaactgaggatacaatggtgaacaagagagacaatccytccatgctctaagggataggcaataaacaagtatatatatgtattttgttttcaggtaaatgttaagtgctgtgaagaaaaatacaatgaatgtatagaa

SEQ ID NO: 12928 - DNA, 201 bp, Homo sapiens
gatagacttactttttctaaattccctgcaattaagcctctacttagcttaaccaccttcagtgattgggagctcactctttcgctgttaaagtgtttctrtttattagaaagtctgtctttatagtaggaaaaactttgcctctttgcaaattaaccgtagggatgccatttggaacaacatggcacatatttatttcct

SEQ ID NO: 12929 - DNA, 201 bp, Homo sapiens
ttaagtaaaaatcagttagttcatacttcatggtagcaaggactccaaccttttgatagacttactttttctaaattccctgcaattaagcctctacttakcttaaccaccttcagtgattgggagctcactctttcgctgttaaagtgtttctatttattagaaagtctgtctttatagtaggaaaaactttgcctcttt

SEQ ID NO: 12930 - DNA, 201 bp, Homo sapiens
actattcttgagttgcaactgtaacatacccttaagtaaaaatcagttagttcatacttcatggtagcaaggactccaaccttttgatagacttacttttyctaaattccctgcaattaagcctctacttagcttaaccaccttcagtgattgggagctcactctttcgctgttaaagtgtttctatttattagaaagtct

SEQ ID NO: 12931 - DNA, 201 bp, Homo sapiens
tctatggtacctgcaaactacagctgttcatggagacagtgcttgtattatgtggctgtgggtgtctcctggatggaacatagatagatagtgcctattcyttcctcaatgtggtgatccaacagcaaaggaaggactgctggatgtgtaggagtgggaggaggagaaagtggtgtgatggaaatgcaaggcagaaaggga

SEQ ID NO: 12932 - DNA, 201 bp, Homo sapiens
aatccacccaatgttgcccatgcaccagccacacagaatttcccaattttactgagacacttttttttttttttgagtgctgcatactgtttcctcttgaratgtcctttggcctctgtttggtagatgcctcttcatccttccagatattgctcaaatattagttacttctttaggatactttccttgaaatagttgaag

SEQ ID NO: 12933 - DNA, 201 bp, Homo sapiens
actcattagcctggttaaaaaaaaaaaaaaaaagattaaccttatttgtctgctcaagttaaatatattaccaagaatggcaaattagggtatttgaggtycgtctttttccctggtcactgctcatttatcaccaatccagccaatgccacttactgaagatctgtcatagtcattccctcctttccagccacaatgcca

SEQ ID NO: 12934 - DNA, 201 bp, Homo sapiens
agaaaagttagcttttaaattgtatatgtatgctttttaaaatatatttacatttaaattttctttctattctattcaaagctaaagttaagaagatcagyagaggaactccaaatctgatggatttctatttttggcagctctccatgtagttaattgctcctgatgcagttacttgggaaagttgtcttttccctctga

SEQ ID NO: 12935 - DNA, 201 bp, Homo sapiens
agtaatagcgcctaccccacaaggttatgctagatttgggtaagttaatacacgtaaggtacttagaacaatgcctgcacatagtaagggttcaagaaaarttagcttttaaattgtatatgtatgctttttaaaatatatttacatttaaattttctttctattctattcaaagctaaagttaagaagatcagtagagga

SEQ ID NO: 12936 - DNA, 201 bp, Homo sapiens
tggcacttttccctcacctaaaaataacttttctcaaagtactatacccttcaccaataaagttttaggaacaggagctgcccctcaccaactccatgtcstcataaccattccttaactctttgcagcttagctcgcaacaccccagcttcctgaaagggctttcttcaaggcttctaattccctcctgattgtgaaaat

SEQ ID NO: 12937 - DNA, 201 bp, Homo sapiens
ctttacatacgctgttccctctacctagaatgcttttccttttctccttttctgagattttacggatacgtcatttatcaatctttaatacatgattggtwaggagagttgaggcattcagagaatcatataaccgtaataggaaaagggctagctccagctgcttccagcactaggcaacagttgagctccttcattcat

SEQ ID NO: 12938 - DNA, 201 bp, Homo sapiens
gtcacacttaatgctcataactcatctgtgaggtaggtggtggcattattcttgttttacggataagaacaataagactcagagtcagataacataagccratgactactaagtgagaatcaaacccagaatctgtgcccctaacccctactctatactgtctttcccggatacaagggtgacctccacgtttaagccttc

SEQ ID NO: 12939 - DNA, 201 bp, Homo sapiens
taattgaacttaatgtcagtgaaagtctttactattgtaatgtcagtggaagtctttactatttttgtgcccatttctctccctttcctggacttgtgcarttggtttatttaactaaagcttgggatcattctttgactttgttaaatccagctttggattttaaaaatccatcacaccatgatctatgtgggtgcagtg

SEQ ID NO: 12940 - DNA, 201 bp, Homo sapiens
aatctaacacactagaaaacctgaaggggcggtgtggctgaggcatgattcagagctttctagaagtttctttgggcagatacagcttctaggggaggcarggtgggggctagagaagtgctcagctgttgctatgggtatgttcattctggggcacagcttagttggtcagcacctggatttcctggggcaagggcccta

SEQ ID NO: 12941 - DNA, 201 bp, Homo sapiens
gatgttgtgatgttgtatttttatggaatttagttttggatatgctaccccagcttttaatcctttctctgaaatatggctcctgagatcccacgcagcaytggacgttgtacatacaacaatgcacattatactctaaaatacttaatgaccatcagttccttccatactttccagtggtctcagcgagcacacactgat

SEQ ID NO: 12942 - DNA, 201 bp, Homo sapiens
gctgaagagagaaagcatctgtctaaggaaagagcccaggcagtggatgtggaatttgagctctttactcatctctctctctcaccccctattcaatctgrcattgaatgggggcgggggggctcctgtggatatcagtgactgaaccttgtcctcggctggcccagctggggggtctctagcatgcaaagacactgccag

SEQ ID NO: 12943 - DNA, 201 bp, Homo sapiens
tgctgacatgagaagctgagaaccaaccatacaggtatgtatgttgagaggttagggtgacaggaggcaaggaagtcacatttccttctatccttttaggrttaagccctggtttctcttagacgggttttatgttgccatcccctactggtctcttcgtggaggtggtgtaaggtatagggcagaacagtggttctcaat

SEQ ID NO: 12944 - DNA, 201 bp, Homo sapiens
tggagaacctcccaggttcaaccgtgacttcccagggagaagcagggaggcacagaggcttaggttgccctcccttgctcaccaaatctgactgtttgggrttagatctaagagaggtggctcaaactttaacttgacaaatacttaaaatccaaattcctggacttactcacggcttagatttgggtagcaggaactgct

SEQ ID NO: 12945 - DNA, 201 bp, Homo sapiens
gccccgacaaagcaggctaagtgcccatgatcttcccccacaagggaatgtttctgggcagcagagtttttcattcatgggtttcctcaggtcactaagcrtgtgctgctttgctcattggggtcatgtgaggttggcatccagagaggcatgggggttcaggattgatgtccttgtgtaaagtggggttgtgtggaggcc

SEQ ID NO: 12946 - DNA, 201 bp, Homo sapiens
caaagcatggtggatatttgcccttagttttctagaagagaggttggttttgacttggggaactgtaagaaggaagttccagcctacaaaacaggaactastaataattttctttaaaacccttcttcaagtgacataacaaaaataatagattaacatatatatgtatcaggaagtgcattaagttgcttttattgaaat

SEQ ID NO: 12947 - DNA, 201 bp, Homo sapiens
acatatgaggacacagaggggcagagccattagaacactagaataaagcaacacagctagccagcaagtagagatagacatctaggaccacagcctggtcrgggctaccatccccctctacttctctggctggggatggggcttgttggctctttcaatacatgggcatgtcaaggctcatatctgagtccccatgccttt

SEQ ID NO: 12948 - DNA, 201 bp, Homo sapiens
taaggtaggtatcatatttctccatattacagataaggaaactggtgttttgaaagcttaactgactgtcccagggccacacaactagctccaggtgaacwggcataatgtggttcctggcttctctgaccccatgccaagctctcaatgaacccactctgctatttgattggttaatgtgcactgggcctggaacctcaa

SEQ ID NO: 12949 - DNA, 201 bp, Homo sapiens
agaatgacttgtccaccagccactgaacaaaattctcaggctttattttggttggaccaacatggatcaaatatctgtctttggaccaatcacaatgggaygctcctgtagctagaccatgggtggggactagagtggacttggggagatgcaagagagtgaacacaagcatttggactttagtctgtgtgtccttggagc

SEQ ID NO: 12950 - DNA, 201 bp, Homo sapiens
aaccattgcaaaagtatagtaaatccaggccaatccacaggtgagattgagactacagaatacattgttctttggttagaattggcttaacaacaagtcamtgacctaagctagggtaggcataagctggcgtgtcttatctcttatgcaaaattgtaagttctccgagaatagtcttccacacttggcatattacttcta

SEQ ID NO: 12951 - DNA, 201 bp, Homo sapiens
ttaacaacaagtcaatgacctaagctagggtaggcataagctggcgtgtcttatctcttatgcaaaattgtaagttctccgagaatagtcttccacacttrgcatattacttctattacacattttaaaagataattttgattatatgggttaagttaaatgtactccatgctcaacgttaattgatgaacacatatctat

SEQ ID NO: 12952 - DNA, 201 bp, Homo sapiens
gcgtgtcttatctcttatgcaaaattgtaagttctccgagaatagtcttccacacttggcatattacttctattacacattttaaaagataattttgattrtatgggttaagttaaatgtactccatgctcaacgttaattgatgaacacatatctattaagcactattgtggaaaatctatttggtgaggatacacagga

SEQ ID NO: 12953 - DNA, 201 bp, Homo sapiens
gtaagttctccgagaatagtcttccacacttggcatattacttctattacacattttaaaagataattttgattatatgggttaagttaaatgtactccakgctcaacgttaattgatgaacacatatctattaagcactattgtggaaaatctatttggtgaggatacacaggaactccaaggaagggtaagacctttat

SEQ ID NO: 12954 - DNA, 201 bp, Homo sapiens
tgtgatttatatgaaatggaagcatgttctccttcccccttatgtgctcttgttttgaattgcaaatattcagttttgcatatatttaaaagttattttgmcagtatgtaatgtagatttaaaacattctgaagttggctgttttcccttgatcaattcttcttttagaagaaacactgtaaataaaccaacaagtgtcag

SEQ ID NO: 12955 - DNA, 201 bp, Homo sapiens
tgaattgcaaatattcagttttgcatatatttaaaagttattttgacagtatgtaatgtagatttaaaacattctgaagttggctgttttcccttgatcarttcttcttttagaagaaacactgtaaataaaccaacaagtgtcagagcatacagtatagggaacagccaaggacaatctgttatgatattctgtgtatta

SEQ ID NO: 12956 - DNA, 201 bp, Homo sapiens
tgcagtggtccagacatttttactctagtataactgctgtgtgtgtgtgtgtgtgtgtgtgtgtgtgtctgttgatcagaaactttataacgaggattagmcttaaatttggcaagcttttctagataaattctagagaaaggtcccatgatgatcctagaaaatttaattaagagtaacaattaagagatccttttgaag

SEQ ID NO: 12957 - DNA, 201 bp, Homo sapiens
ttcaaaaagcactttgtcatttctcgaagtactcttagctttgtgtggctgtctggacacaagcatcagcatctccaggagaaggaggaaatcgagtgaaktgagagcatggaggggccagtatgccacttcctagggaaaggcaaaggcatttcttctcaggaaaagagcagagaatgatgctgtacctcatttggttat

SEQ ID NO: 12958 - DNA, 201 bp, Homo sapiens
gcaaagctcacagaaccagtgtcagctctgctgtgaatgctgctgttttcccatcttgttctaccactacacaacacagcagtggggaagctacagggttycttgttctctagctggccagagcccctgagcttccctgtggctggcaaaggcaagttggcttgagacaatgttttcactggttggtaggagaatgaagac

SEQ ID NO: 12959 - DNA, 201 bp, Homo sapiens
ggttgtagtgagccaagatcatgccacggcactccagcctgggtgacaagagcaaaactctgtctcaaaaaaaaaaaaaaaaaaaaaaaaaaaaaaaaaaragagagagagcaagaagagtgaaagttataaatgaaaacaataaaaaaaaatccaagaaactcaaggaacctttgatgggaaaactgggtttttctctga

SEQ ID NO: 12960 - DNA, 201 bp, Homo sapiens
gttgtctgataatggtgggactgggaattggaagaatgcagcttgtgtcagtaacatttatttatttatttatttatttatttatttatttatttatttayttacttacttacttaattacttacttacttgcttacttactgagtctcactctgttgcccaggctggagtgcagtggtgcgatcttggctcactgcaacc

SEQ ID NO: 12961 - DNA, 201 bp, Homo sapiens
ggcttattttacttaacataatatcctcaagatttgtccatgttgttacaaattaggagatttttatctttttaaaggctcaataatattggttgtgtacrtataccatgttttctttttccatttccatttatgtgtcgatgaacacttaggttgattccgtatgtttagccaaggtgaataatgctgcagtgaatgttg

SEQ ID NO: 12962 - DNA, 201 bp, Homo sapiens
gagatgggaggaagctacggttacaattcccataatacattaatgtatatttaatataccaccttgatttgtggcctcaagttaaataactacatatgttkgcagcataattcttttcataattgtgtagcctcaatgggataacatttgtattagtttccataatcgaaaatgtcaaatgcctgtttccaccttccaagt

SEQ ID NO: 12963 - DNA, 201 bp, Homo sapiens
ttcatgtcacaagaactcaaagaaaaaaaaaaaacaaattatctgaaaggaaaagggagattgtagactaaaggcaaaaaaaaaaaaaaaaaaaaaaaaarggaaagccaaaacaatgtgatcacataactaatttgaaataattagtaacaacagggggtggaaaagatatggctaaaaattgaaatattgccagaggga

SEQ ID NO: 12964 - DNA, 201 bp, Homo sapiens
atgtcctggtgggaaggtggggtttttgaatccataccaatcttatctgctgtcaggtcaactggacacacttggaaaatgcctacatcataaacctaaartctctgggacacaaaggactgttttgagcagtgacttctttagttatgtcttttttttttcttctagttttcagtgtttacagtaccgtgctctttttct

SEQ ID NO: 12965 - DNA, 201 bp, Homo sapiens
tgtcctggtgggaaggtggggtttttgaatccataccaatcttatctgctgtcaggtcaactggacacacttggaaaatgcctacatcataaacctaaaawctctgggacacaaaggactgttttgagcagtgacttctttagttatgtcttttttttttcttctagttttcagtgtttacagtaccgtgctctttttctt

SEQ ID NO: 12966 - DNA, 201 bp, Homo sapiens
atcagtagcaagatacatctttgcagatacctacatggagatttcactacatctggcagggatgagccaccggtcctcattttcttaattcctggacaagktttttgtgtattctaaccaagtattcttgcttttctttgttctgattcattcatctacaaagtgtggtcagaaaccttgaccaactgctgatatatacaa

SEQ ID NO: 12967 - DNA, 201 bp, Homo sapiens
ggtgataattgttacagagaattctttacttgttttcatcttgggctaaagagatatttgatagaaataaacattttaaagttcatatggtaaaaaattcmtacttattgctttgaaatatctaaatatctgtatgagttttcccaaattctgtaaaccttcatgacttctatattattttctaaacatgtatgtgtgaat

SEQ ID NO: 12968 - DNA, 201 bp, Homo sapiens
agataatcctaaatgtatagatttatctttaatcccaaagttaaggcagaaaatgtcagtaaaagagagagaatggttgaagagaagtgccaggcggaccraaagagtttaatggcaatctgtaagagagagatcatcaaaaaaattttaatgcccccacatgtcagtaaaagatttggagaatgccttcaaaataggtaa

SEQ ID NO: 12969 - DNA, 201 bp, Homo sapiens
ccccaaagcaatagaaaggatatttttcaactaacgatttaaataggtcaaagcaaacaggatactcacattaaaggaagaagaaactgcatgttatagamagacctatgcattcagatacctttgcctgccctgaaattccatttttcaaattcatttgcctgttagctgaggacctttttaatggaactgatgttagtg

SEQ ID NO: 12970 - DNA, 201 bp, Homo sapiens
ttctggaagggggggaaaaggctggacactggaagttcgctattaaagtgagcaacagggctgggtttattttttaaaaacaaccggactgtgcgaatgcmcttttctggagctttctggccctttctagtgaaataataatttaaaaaaaattgcttcttgagaagaggagggggcagaaattaaagggattctagattt

SEQ ID NO: 12971 - DNA, 201 bp, Homo sapiens
gaacggagggacagacgggccaacatggaagtgcatttgatgaggctgtgggaggaggctgagaccttcccagggaggacccctgcaggcattggcctccrctgcaatagtccctttcccatagctccccaccctgatctagagttgcttggctgtgtggccagatagactgggaaagcctggtttcatctctttggcttg

SEQ ID NO: 12972 - DNA, 201 bp, Homo sapiens
gcctgccgggcctggctgcatctggcagaagaagggaggacccgctcatctaccatggttgcctagggccttgggaagagtgggagagctacctatgctgygggtgggttagaaggagaagggtggggtgagccagaatgagcagaggggctccagaggcggatggctacggacaggtggcagtagttgcagaggagagaa

SEQ ID NO: 12973 - DNA, 201 bp, Homo sapiens
gtgaataccaacgccagcatataaattatccagcaggcctcagccctcgcccaaccagactcttcgctcagtggcgtgcatgcataatcaatacaggaggstgtcactgcttttagctggggtgctagaaaagaacttcggctttcagagcttggctgcatgccagcatttactccccacgcctccctccttcttgcttct

SEQ ID NO: 12974 - DNA, 201 bp, Homo sapiens
agagataaatatgattccgaagggatctttgcccatcttggaaagatacgaccaggccctgctctccacactcatcctgcggccactgccctgttggtcaytgtattggcacagctctgggtggggaaatgctctgctgggatggtttctatctggcacatgagtttgattttctttttctgttctcctccctgctcagcc

SEQ ID NO: 12975 - DNA, 201 bp, Homo sapiens
ataggaggggcttctaggagaccagagtcaaagtgcggagaccaagagtagctttctatctgaccttctgccctttgtgttgatgggggcacaggtagtgmaggagaaatctatttaggtgcccgctgccccagcccacagggcacgctgaacatgccacccaaggtaccagtggatctcaggatcactgcagttggtgtt

SEQ ID NO: 12976 - DNA, 201 bp, Homo sapiens
tgtcctcttgaaagagatctcagtggtgcacttccatggctaccctcataggggagggccaggccacccagagagcaatgaggcatttgctgaaacacagygagaggggagggagagcaaaacatatttttccagacccggggacagctatagtgaactgttgtctgtttattcgccagaaactcagtgtccaagcaagtg

SEQ ID NO: 12977 - DNA, 201 bp, Homo sapiens
ttatctgactctagtctagctcttaactgaatcccagaataccagaaccttggggcagggacaccccttgaaatgtactacaggggaatctagggcaaacratgagcaactccctttcatgcggacggtgataacctcaaggaatgtgtcccccaaatgagtatttactgatggttccctcatgctcagatgtgtgaggtt

SEQ ID NO: 12978 - DNA, 201 bp, Homo sapiens
tctgggtttaaattcagctgtgcctgcctccaaagcccatgttctctctcactagcctgaactacttttatatctttgagagaattcatgccttaacctcyctcactacatgcagtagagcctttgctgttgtattaagatagatagtgctgactatgtgagcttgccctaatggtgtggtgtctggaggggtacagttta

SEQ ID NO: 12979 - DNA, 201 bp, Homo sapiens
gcaaagaaggctgaaggataaacgctggcagcagttggaggcctgcgatatttagtgtaagggcatctctagcttttggccattttggcaatttcccagargctgcaggaatgtccaaaactaggaatgaaaaggaagggctgtaggaaagaatgtggatagaccatagagggttaagtctacataagcccacttgtgatg

SEQ ID NO: 12980 - DNA, 201 bp, Homo sapiens
accttgtgatgtgaatattctaataatgtgctgatatggctttggggatttttattatttttacatatggaaaacctgagtgcatcattaggacctggtcrtcttgtagtggctctggaagaacccacggcctccctcctgtttgaagcactaagcactgtagcaatcactagaatagcttggctcgaagtcagcattcca

SEQ ID NO: 12981 - DNA, 201 bp, Homo sapiens
gttaacacagattggggctattttttcctcgtgtagaatatataaccagtggctacattttaatgtgtctcttggctccctttggcttttctatccttaaygcaagttgcgattgctcaactgggtttcctgattcctgtggcaggagtatgtgaggaggtattctctttaggaactgtaagacgtgaaaccaagggtgga

SEQ ID NO: 12982 - DNA, 201 bp, Homo sapiens
cagaccccatcctgtataacagcacacagagaatgcttaataaatatgagctttattaggattaatattgcttttatcccattttgtcctcacgttcaccstctgatgggctgatactgccagaatggtaattgacagaaaggggaatccacagctggatgtccaggattcaggttctggctccacaggctgtgtgacttt

SEQ ID NO: 12983 - DNA, 201 bp, Homo sapiens
agatcctaagggaggtggctgcaactgggacagagctagttttcatcaggattactttttccccctgaatatttcttgagtacctgttacctactgaggaygtgtgtgaatggtagagctaggaaggtgggagtaatgtgagccagtcctcagtttttctatcataacttagaaataactaactgaacaggtacagcctag

SEQ ID NO: 12984 - DNA, 201 bp, Homo sapiens
tccagacctccatactctgattcttaggatcatctttccctttttccttatatgaactatgcatatgtattcattcctttatttgtatagcatgctgttaygtctcaaccatgtacctggcagtgtcctggttgcttctgaaaagctaaacagaaaagtccttaccaatgcactttatgatcctggtagcccatgctgcta

SEQ ID NO: 12985 - DNA, 201 bp, Homo sapiens
aaggagtcccaatgggtcatgaagtaagaccacgtgttctggctccacttccctcctcactaaggccttctcttggccctgtgtgtgcaagtgtcagaggsaaaattttatagattacaccagaataaacgtgggaaaggtcttgaatttattcttagacatttgtcagagaaaagaaggactatgcctcagatgttgtca

SEQ ID NO: 12986 - DNA, 201 bp, Homo sapiens
taaacgtgggaaaggtcttgaatttattcttagacatttgtcagagaaaagaaggactatgcctcagatgttgtcattcttttaaagctgaatgatgaagyagtaaatccataatggaaagaattgtcaagttaaatctacaaaactgagcagggtgggtaggctataacaaaaaccactctgttgaggaggccgttgggc

SEQ ID NO: 12987 - DNA, 201 bp, Homo sapiens
gtcaagttaaatctacaaaactgagcagggtgggtaggctataacaaaaaccactctgttgaggaggccgttgggcaggacatggccagaaacaagcgtgracttacctagaagtggctcacacagaggacttcagcaaccagccttggtcaggtatttcgaaagcccctgtttaagtgttgagagtatattttggccttc

SEQ ID NO: 12988 - DNA, 201 bp, Homo sapiens
taagtttagtgcccgtccgtgaggcagccttgggggatgttgatgggtgcaggaaatcggttcttaaattgttgcaaaattgccttccttcagactgtttkgatcacgagggctctcaagtgtcaaagtcatttgtagaactagatagataaaatgcatgagcactaagctttttttccaggatagaataaataagtgtgt

SEQ ID NO: 12989 - DNA, 201 bp, Homo sapiens
tttaaaacaagctgcgtttatgtataccaaatctatttgttatacgtagatttttgttgtagttcttgttttaagggatgtgacctctatcttgcatccayaacccaaaagtgattgggatcttagcttgagttgatggagtggggccaaatgcctgattcaataggattttgttttattgtgatcactgggtaaaaatat

SEQ ID NO: 12990 - DNA, 201 bp, Homo sapiens
agatcacccagccctaaattatccctgctgggattgctgggattcaagtccagggtgctcttcataaccccatcttgagctctttccagtgtctcgtgcawgctgctactttccatctgccccaaggcagcatatctaataaaaacattgaaaaactttcccaaggccaggaagggagaagtaaatgggtcaggggttaca

SEQ ID NO: 12991 - DNA, 201 bp, Homo sapiens
tttgaaaatgctttatgcctccaaggtctcataggcttcaaaacattgctggtttccccttccagatccattgcttgagtgtctgttgtgtgctgggcgtyggagattcagagaccatgttccttgataaccagcaattaccttctgaatgttacctgagtgcagatgaggaaggtctctgaaagcatacagggcgggggc

SEQ ID NO: 12992 - DNA, 201 bp, Homo sapiens
gcgctctggagtccaagacctccaatagtagtattgtgtaatgttgtagccttatttaatgtctctttgttttctgattgtctctgtcatgttgcttgccrtgatataccaccttctgtggggctgcagacaaataaatcctccctcaactctgtgctccatgtgtcactctcccaatgaaaagacttttgatggctgccc

SEQ ID NO: 12993 - DNA, 201 bp, Homo sapiens
attcggtacttcacagtttggctaacctcagctcccatcccacttgctgaaaccttggctagaaccccaccctgctaatccatgatgcttcactatcccakgtgccgtcttatctctgctcgtgcttgcccatttatcagggacatttctcccatttgtagccatatcttgaagtttaatttgagcctcacacactctgtg

SEQ ID NO: 12994 - DNA, 201 bp, Homo sapiens
gactggagggagcctgtggtcagatcctgtaggccctcccatctgtacgaatattctcatgccaaggaagtgcttccctaggccttgtgaataaagataargtgcataggtcctaaccttacctgtgacaggtacaagtgggagcccagtcccaggatcctgatggtcagatatcaggttttggggtataaatatgaacac

SEQ ID NO: 12995 - DNA, 201 bp, Homo sapiens
ataattaatccaatctcctcaccctttcattttcttgaaacagagagagcttgaggaatgggtaagtgtgacctagatgtcagctgcagtcaccttgaccstaagagatttggctaagcttgacaggagtccccacaatgtgccttatgagttaaactctgcactcccacccccattctctttcctgttctctccttctgg

SEQ ID NO: 12996 - DNA, 201 bp, Homo sapiens
gaggtctactgaggtctctgagtcatgacaaaaatgacttcagagaccgaagcactctctgcatgaaaagccctgtctccagctccatgaaatgtaaatcygggaactgctggggaaggcacaggcagtcaggtgaggctaatgggaaaagcctgagtctagagagagcatcgctaaggtaaccagaaccctaactctgaa

SEQ ID NO: 12997 - DNA, 201 bp, Homo sapiens
atttctgagatttcctctcttcttcctggttacatccaggcacctgctgggcaaaccggctgccacttgttgcaaaaaatgttgacaataccgagggaaaytgagacttgaaagaactggagggagcaaagtgctgcttttctgtagcatcaggtccctggggacaggccctgagtgttgtacctactctagctctgaagg

SEQ ID NO: 12998 - DNA, 201 bp, Homo sapiens
tctgtttttcttcttttgatagtgtacaacatttctccaggcatactgcctggggctaagatgtgtcctgtatgttatcccacggagtgttttaccaagcsactccctggatgataatagagctccaaatagagacaagacaatgtatactttctaagctgttgccacgctgaaatttccccttcattcccctacccatat

SEQ ID NO: 12999 - DNA, 201 bp, Homo sapiens
tgtcctccaacagacctgaccctgttgtgccacaaaactctctgattatttattatcttcaccaccaaactagagccccttgaggccttagtctctgtgaygttgggaacagcatttagcttggaatcaggagtccttggttgtattttgagagctgctgcaggctggctgtgtacttagtatatcagaagctcgtgattt

SEQ ID NO: 13000 - DNA, 201 bp, Homo sapiens
actaggtgtggcctgtaagtttgctcaggaagcatgggagaaactaacatcttattcttaatcttcactcttcccccatatggttcttggggatgaggaaratgttaccttggagtgtaaggctgcgtatcattctttggggccatgcttctcaaagtgtggtccccggaccaacagcatctgtatcacttgggaacctac

SEQ ID NO: 13001 - DNA, 201 bp, Homo sapiens
ctgtcctttgtggcagaccccaagtgctccagtgggcaccgaggtcatgttacaactaaatgatcatgtaaaggtggtcactgtgcagagggcacacaagmagccaatttattaaccaagagcaactttctgtaaattaaaaattgttagtgatcagttttgaagcgttgagagcctatcagggaccacatgcctggaatg

SEQ ID NO: 13002 - DNA, 201 bp, Homo sapiens
gactgtaagctccttgaagacaaaagatatgtcccatccttgctttgcattccccttcaaggactagcaagtgcttcatagacactcaatataggatagcygttgttaccagtattattcctagtcattgtcaaatgaatgaataacacaactcagggtgctactgtgtgctcagtgggtgtttcatatttgcatgcatat

SEQ ID NO: 13003 - DNA, 201 bp, Homo sapiens
tctccacttagttccatccactactccattgccagaggcaatctttgccaggaattggcatttatcacagtagtccagactttcctatgttagtctcatasttaagtgttcataaacattatatagtactcacagaaatggtttctatagttttctgcaaattgttctacatagtgttgatatgtttagctctagggcatc

SEQ ID NO: 13004 - DNA, 201 bp, Homo sapiens
tgccaaagtttccaaaacgcttaggatgaaaacaaaaccatataaggctgcctatcttgttcccttatctctccctttgagggagcacagtgagagatggragaacaagataggcaggagctggcttgtgcaataggctctaaccatattgactttttttttttttaatcaggcctcatatgaacccatttctttcagtca

SEQ ID NO: 13005 - DNA, 201 bp, Homo sapiens
cctttaaaggcagcctcagagacaggtggcgaaaaatcttaacttagttctggagaatgtttgatgagagaggagaattttacaactgtgattgcaaaggkaaaggccaattgttgacacagaaattctcacccactttgccttcatgggcttggttggccctctctcttctctgatgatcttacaagccttaaaaaatct

SEQ ID NO: 13006 - DNA, 201 bp, Homo sapiens
acccagtctccctccaagtggaaactcattcctcggggtaatcaatgtccctctcagccagaaccccgttaccagggaaaccattccaggcagccgacttygactcattgagatgcagctgcagaacccagggcctgtgtaagggcaactgctatcagagtgggcagtttttggcaactctggagtgtattgtaccaaatg

SEQ ID NO: 13007 - DNA, 201 bp, Homo sapiens
ttataaaattccctgatgaggaatctatcccagtagcagtacctttttcccaactgaaggtattactttggtctacatggagtctacatggtaaaagccarttggtcctgtggcacagagaaaagaggagttgattatctgtaaggagtaatgggttctcatatacagtctatgtaccaggaagtgcttcataaaataaac

SEQ ID NO: 13008 - DNA, 201 bp, Homo sapiens
ccaagtcagagattagataaatattcatttgcgttgtgtgatttttaaatttaactttttaatctttatgaaattgatttttgcataaagtactaaacaamattacttatatttgctttccaaagtataaacttttccagcataagtaattcatcttatccctcactgattttcaaggattcctgtattacacaagctttt

SEQ ID NO: 13009 - DNA, 201 bp, Homo sapiens
cacaggagtacagaagttgaccacacatctggattagctgagggctcaagataagaaagtctgaggtgctttgatgggaggagtaggaggtatgagctcaygaaaggcaacaatgtttactaagaaggttaattcttcaagtgtgaaggtgtatctaaaagttccttcatgaccttttttgtggcaggtgtggctatgtgc

SEQ ID NO: 13010 - DNA, 201 bp, Homo sapiens
aaaagagataggtttggcatgacacaatctgcagattcaaataaatcccctgggagaggatgaggctgctgagagtcctctttgctggctgaagctcccartgtatgcacaaaacaccctgtcccgggccccagatgtgtgcaggtttctaattgccggtgctgcactaagatttgaagggtgagagagttgcaaaatcac

SEQ ID NO: 13011 - DNA, 201 bp, Homo sapiens
ggcttgaggaatgtggtggtccctctcttcgttgtttctgccccctgaggttgtgctttctcagggatatgcactctgcacttccattcctgcagtgaaaytaactcgagcttggcaggtaagtctttcggctcacctttaaaaagaaaagatatgtgagctgcggtgggggtgggctgttccccatttgccttacattgg

SEQ ID NO: 13012 - DNA, 201 bp, Homo sapiens
ttattttaacctcttcttccactaatctcatgcttgatgctacaaacctagagtaaagtagatgaatgttctggccctgctgtgggtcccagtgaggtaamactagcaaagggcagataacagtcatgcaggggattgagtcatacatggagggttgaatgttttgccctttggaggtgataaagcagataattgggtggc

SEQ ID NO: 13013 - DNA, 201 bp, Homo sapiens
tatttgaaactgaatcaggaagatcatatttcccttccgatcctgcttaataaaatattctattattttctcagctgcaaaagtacactattatcactgawcattccctcctcatctcagagtgtttgtcactggccacagtttatatacaagctatacaggctgcctggaacttgaattggctttagagtggatgctggg

SEQ ID NO: 13014 - DNA, 201 bp, Homo sapiens
tatgctttggaaggccatttttttcctgtgtttgaaccaaattgaatttagcaggtgcaaagggctgcagaagagacttggcaattgatagaattatagcmaggattcagagggccctcaggagtcctaggcattgactctttgagccctgtgctgaaatcacctctcaagctttcctctatccaggctcttctcttgtgt

SEQ ID NO: 13015 - DNA, 201 bp, Homo sapiens
ggccctcaggagtcctaggcattgactctttgagccctgtgctgaaatcacctctcaagctttcctctatccaggctcttctcttgtgtgtgtaacaccaygccatgcccagccacacttgggaataatctcagattccgtatctttacctctctttttaattttgctgctcagcctctctgtgctgccttcacacatccc

SEQ ID NO: 13016 - DNA, 201 bp, Homo sapiens
acatctcaccactttgctgctttggttgcagcctagtgatggaatgacaagcccactccataggtgcctctgaatagcttatttcagggagctgcaagacractatttgctcagaaaattctcacgagggtgatggttttcaaagcaggaaggagagggaattcctggtacacttcccctctgcattgctggagaaatgaa

SEQ ID NO: 13017 - DNA, 201 bp, Homo sapiens
taactgtgcccatggaaataaactacactgattagcttaggccaatgggtataagaataaatgaaagtggagaaccagtaagtctctgaggaaattcagtytacgctggagaatggtagtgacatcttcaatggaagcttcttgagtgacctatgttatagctctgttagatggcgtggtccctccagggctaacagcatc

SEQ ID NO: 13018 - DNA, 201 bp, Homo sapiens
attctcacctgaaaactatgaatttcaagatcacacttaaggtccacttcaatttaaaaaatgtcctgaggatctgaataatgacaattggaaaattaaawgagcattgatagcttaagtgccaatgaactcaaggccaagatctcagttttcatgcaaactggtggctctgacttcgttccactgctatagccttggctg

SEQ ID NO: 13019 - DNA, 201 bp, Homo sapiens
tatagatataatattaggaatatttttcagccattaaaaactacgttttaggagagtatttaataatggggatattatagataaatacagatagatttagstataaaatggagactatttctttctttaaagtactttcttgatttttttaagtcagtatatccatctctctttccctagcaaatattctccagagaaaca

SEQ ID NO: 13020 - DNA, 201 bp, Homo sapiens
tccgtttattagttggctcatggaggataagcctgagcttctgagagtctggggtaaacaagtggccatgccttcctcacaggtccctggaggatcggagragtgatgtgtgctgtgcaaaggtgaaggtttctagccaaggccactgctggacttgcacttctgcctttctcctgggggtcactttttcactcttcaggg

SEQ ID NO: 13021 - DNA, 201 bp, Homo sapiens
tcacagcctgctaggagcgcttatacctcccctcctccaaccttccactgcccggtacattattttggaaatttgagcagagttgtctttggaatgacggygcctcatcaatacagaatttgtgataatctggtccttgggtgggcttgagtttatccacataatggaggtggagtggggagacagaagtatgttaattaa

SEQ ID NO: 13022 - DNA, 201 bp, Homo sapiens
gacatccccagagcaaaagcaaagtatctgggctgatgattcaggtattacctttggagggaagcaggatgagatttctagagttgctggagtttgaatcwctgggttgactcagtagataagcctaaaatctgtaggaggtacaatgcctgtgcacggtcccagtccttccaacaacaaaatgagggggtcattcccata

SEQ ID NO: 13023 - DNA, 201 bp, Homo sapiens
tcagaataatatattttctaccccttcccccacccactcttggctcctggccctacctccttcacccctcttcgatttgtaccacagttcgtggcattttytgaacctcagggctcctgtctggctagttatttatttagctgaggaactgcagcacctaattaataggaaattagctgtgagtgtaacatttggcccgta

SEQ ID NO: 13024 - DNA, 201 bp, Homo sapiens
cccccacccactcttggctcctggccctacctccttcacccctcttcgatttgtaccacagttcgtggcattttctgaacctcagggctcctgtctggctrgttatttatttagctgaggaactgcagcacctaattaataggaaattagctgtgagtgtaacatttggcccgtagtcaaggcccaagaagttataaatac

SEQ ID NO: 13025 - DNA, 201 bp, Homo sapiens
tcagggacccaccttaggaccctcatagcgagtggtcctccagctcagcccatgtgcatccagctgaaaggctttcatacctctgccctgcataggtcttkttcagagaagtgggtgcactgtggcagaaacaattctctactaacccatttggaacaataaagaaataaatcctaatccaccaaccttgaccagacagct

SEQ ID NO: 13026 - DNA, 201 bp, Homo sapiens
tgtgtatttcccctaggtgtggttccctctttattaccagagggtacataggagattctgcattcatttagtcattcattcaaataatgtttatggatttmattttctttaggtccagggaacttgataggcactaagggaaactaaggtgaattactgtcatcgcttgacctcaagaagcttaaatctaatgggaaggga

SEQ ID NO: 13027 - DNA, 201 bp, Homo sapiens
gcactcaggttttttttttttttgacatgtctcagctcctttctccaccatgtgtgcctgcagtactgtctccttttatctaaaggtgttttgcaacttgwccccttgctgcctgccaaggtttacctctgagaagtatcaagctgttcagcattggctagaacaagctcttctgaccctgtcgacccaacagtgaaaaag

SEQ ID NO: 13028 - DNA, 201 bp, Homo sapiens
agatgtggggtgtggtgatggggctcattagtacagtgacagagtggacagggagggagggacagattctttggatgttttatagtaaaattgacaggatrtggtagattactagaaactgaggagaaggaaaattaattgagaatcaaaaataatcctcaggtttctatgacacctgagtgggtaatgatattattaacc

SEQ ID NO: 13029 - DNA, 201 bp, Homo sapiens
gagggacagattctttggatgttttatagtaaaattgacaggatatggtagattactagaaactgaggagaaggaaaattaattgagaatcaaaaataatyctcaggtttctatgacacctgagtgggtaatgatattattaaccaagatggacaaggaattttggagattcagataaacttgaggacttctttggacatc

SEQ ID NO: 13030 - DNA, 201 bp, Homo sapiens
atagtaaaattgacaggatatggtagattactagaaactgaggagaaggaaaattaattgagaatcaaaaataatcctcaggtttctatgacacctgagtrggtaatgatattattaaccaagatggacaaggaattttggagattcagataaacttgaggacttctttggacatccaggtggagagaatcattaagcagc

SEQ ID NO: 13031 - DNA, 201 bp, Homo sapiens
tagctgtacgacactgccccaagctcttagcctctacacacctggcacctcggggtctaagcctactgggtctgaccctattgagagcactcgggtgctgyccatgccagaagagaaggtcaccaaagcctagcccctgagggacaataacactcgagggctaagaacaggagctagtgaaagaggcataggaaaagtaga

SEQ ID NO: 13032 - DNA, 201 bp, Homo sapiens
gcaagaatttgtaattggaattcttgcaagtgtaaatctaggttgtctgtttaaaacaagggcattggtgaagaacaaggataaacgtggtaatgtctacwgcacattgagcatctgcacctgtgtgccaggcattgtttagcgctctttgggaattgtcttttttattcctgaaaggcaaatgtaattggcatacccatt

SEQ ID NO: 13033 - DNA, 201 bp, Homo sapiens
aggaccctcagggaagctgcccacccctggcacatgagtcacccacagtcccagcacaatcctgccctgcaggccccatcaccttcttccctgaggaatgrccaagatgcaggcatcagctgatgatgatgatgattactgttattgcagctattatttttataaatactcccttccttgagatgcaaaaaaaaaaaaatg

SEQ ID NO: 13034 - DNA, 201 bp, Homo sapiens
ttcctagatccagggttaaagaggtgaaatcaactatgttcgtcctgtaggctccctggggccgaggctgcttttattagagcaaatcaggcctgtccagragctgtgctatgggggaggagagagccaggaggaggtgaggaggggttggggtggggtgtgctgcagggattgctgtctgcacctgggctgcccaaactg

SEQ ID NO: 13035 - DNA, 201 bp, Homo sapiens
ccccatgttctctgttctacagtgccttgagcacagctttattatcttaaagcatttaccaagttctagtgtctttgggcagcaagtccctcaacagactrtgagctccatgatgggaaagaccaactattgttcactgtgatagttgaaaaaatgaatgcatccaaatgcttttggattccagtttctctagagatgtct

SEQ ID NO: 13036 - DNA, 201 bp, Homo sapiens
agtgtctaggccaggacctggcacaaagtaagaacttagtagacattaattgatgttgttgctactgtgttcacatttgatagtttaagggtcttcatgayattctgcaatgtaaaaggagaaaacaaacttggttagttggagatagtccatcatttgtagagcaggataaatattgctgatcattaaatcatctcagac

SEQ ID NO: 13037 - DNA, 201 bp, Homo sapiens
tgcatagtatgattatgctgcaattgcctctcattcttttaatcatacattttgactgtatcgttttaatttacggaggcaccctaaggcctaataacatmtaatgcagcatgcaggaaatcaaacaaacagataaatgcactggaggaagaaagaaataacttttttaatatgttgtttgcaagtggctgtatggctgta

SEQ ID NO: 13038 - DNA, 201 bp, Homo sapiens
cttttttagcttggtattccttgtccttcacagaatagttgcaatctccctttttgagttaatcatgcttgctatggcctgagatttgaaaatggagtctktgggtttaagttcttcttttcctagttatagaaacttcataaagcaagtgaggctcttatagcctacctttcttcatctgtgaaatgggctcagtagtca

SEQ ID NO: 13039 - DNA, 201 bp, Homo sapiens
cagagcaattgcccaatacctgttttaattggaatgcaggatgaatattacacagcactcatggccttaggcttttgtaaaaatacaagcgttgctggagraggtgactcaataggtcatgggtacttgcatatgcattaagaacattgggtttgggtagccaaatgaaggtggaaaatctggaaagaacaagttgaataa

SEQ ID NO: 13040 - DNA, 201 bp, Homo sapiens
gcctgcattccactcagcttctttatgatgtataaagatgaaactgaccccagtcttcagcctgaagagtgccttccattgggcttccacatttgggaagrttcccgctgagatgggacagaagtgtctcagcagtctctcagttcctgcgtaagttcagaaccaactcaaatcatgctctctgcagtggaatctccccac

SEQ ID NO: 13041 - DNA, 201 bp, Homo sapiens
atgtataaagatgaaactgaccccagtcttcagcctgaagagtgccttccattgggcttccacatttgggaaggttcccgctgagatgggacagaagtgtstcagcagtctctcagttcctgcgtaagttcagaaccaactcaaatcatgctctctgcagtggaatctccccaccctgggcgcggagagagtgagcactcg

SEQ ID NO: 13042 - DNA, 201 bp, Homo sapiens
agagtgccttccattgggcttccacatttgggaaggttcccgctgagatgggacagaagtgtctcagcagtctctcagttcctgcgtaagttcagaaccawctcaaatcatgctctctgcagtggaatctccccaccctgggcgcggagagagtgagcactcggtgcctttttggataaaccaggtaaagaagaaaacaaa

SEQ ID NO: 13043 - DNA, 201 bp, Homo sapiens
tgttttcatttttctgtttctatgttttcaaaattttcttcagtgagatttttaacttttataatggaaaataaacattacaaagtggaaaaaaatgtttygtgccacaggtttgggatgtgtttgtgcagctgtgtgcatgggagtggctgttgccacattgtgttaaatgggatggaggctgggtagggcaggaactgt

SEQ ID NO: 13044 - DNA, 201 bp, Homo sapiens
gtagggcaggaactgtgctccagtcttctccaaggacaggtcattgtgtcattcactggttcccattcctcccctaaagccctggctgatgattttcgcaygctttacttaataacttcctccctacctggagcccggtggaatccacaaagccataagcacacaccagcctggtaggttggggcaggtgggaaggagctc

SEQ ID NO: 13045 - DNA, 201 bp, Homo sapiens
actctggccattcttcagaccagccttatttgcaggcgttagaatgggattatgtgctagatcaagtggacatttttctcaaaactcacctagtgttgtcyttttcacatttccccatgaaatttagaaaataatagaatcttatcaaatatggactacatcctcaggagaagacttccagacagttctggagaaggcatc

SEQ ID NO: 13046 - DNA, 201 bp, Homo sapiens
agccttgttggagcagttgaataaggcttattaataggtttacttagctctctgtgccttagttttctcatatgttaaatggagctattaatggaaacacrggtatgtaaagggttttctgctttaatgacataagcattttgggagggacttcttgcaacactatttttgacttcacacttttaaaaacctatcactaac

SEQ ID NO: 13047 - DNA, 201 bp, Homo sapiens
agattctatccctgttgggtcaataattagttggtatgtgactaatgtattgggaagatgcccggtggtctatgatattgggattttttttttctttttgrttctttgggcctctgaagataattcagcagtttaccagaggagtacccattctgcctgctccttccctctctaacttcctttctccctccctccacaaat

SEQ ID NO: 13048 - DNA, 201 bp, Homo sapiens
ttccctctctaacttcctttctccctccctccacaaatatttatttgtaccttgtttgtaactgaagataagcacctctgaaatcaggcctgttggcatawgtctaaatactctttaactgagagacatatattcaaagaaacgtttttatatgtccataaactgacacatagattgtcaaatccctaataacaaggttca

SEQ ID NO: 13049 - DNA, 201 bp, Homo sapiens
acgtatgtgtgaagaattggaggcacttttgcaatcaatccagtagagcagttaagaacattgaaatctattaggaagtgacatagatcttcttggtgagmgggatcctgccttaggaaagaatgaatgtgtgaggtgctctgccagtctttggtgtgggagtgagggagagggaagagtcaaagatggctttgaggaacc

SEQ ID NO: 13050 - DNA, 201 bp, Homo sapiens
aatcctgcatcaagtagagatggtgggaaatcgccctgaaaagctctatagtgtataaaatgtcatgatgctattgaaacccctgttgtcccattcaaacygagctttctttacagtagcacctgaaaaatacaacttccaccatttcctttgagaaggtaaattcagtctgagatctcagtatttgttttccttgattgg

SEQ ID NO: 13051 - DNA, 201 bp, Homo sapiens
gaggagaagttggggcaatttcttttctcggtgggagaggctttgctccataatcctcgtcagtaatcaagagatacacctttccttaaagagtttccaamaatgttctgcatgaggaatcaccatttcatgtcagtcttgtatatcagtggggctggttggttaatacatatggattgtattgtgttcatctgacattaa

SEQ ID NO: 13052 - DNA, 201 bp, Homo sapiens
cattggtctaggcatacttgtataattctgtagatcagctacccccctagaaagtactaaggtaaatttatgcacagagagggtgaaacaatgcaaagggwcactctattgctagttggggcttaggcccctcaaatactgaacaggattttggtgaactgggctgcaccacaaagagaagctgggtggacttgaaccaac

SEQ ID NO: 13053 - DNA, 201 bp, Homo sapiens
aagactcactggaggcctgcttggagcctggctactgtatgaagacatattaaacgtatgtccatctgtaatattagtggtcctctgaaaaaccagcttasaggactaattatcattcatctgataagaagagagagtaagagatagggaatggtgtaattaactttctggttatttgtagttttagaaaaaagagccacc

SEQ ID NO: 13054 - DNA, 201 bp, Homo sapiens
tcacccaaattctcttctatgtctctgggaagggaagcaattctttttgcaggtcttcactattgtctttttcttttttccattgctttttctgtgctgtstggagaatcactttccataccattgggtcttcttttccccagttaatataccagagcctttctgctcattcattctctacatttcatgcctctctgaagt

SEQ ID NO: 13055 - DNA, 201 bp, Homo sapiens
ttcactcaagaatcctctcccaggcagaaagaaggaaagaaagtcttgctagaggagaaatcttattaaggctcatggtgattcaggagtgacagccgggkctttttcaatggacttatctgctgtcacagagacccactatcctggaagagcccaggcaaagtctgagggttttgaccatcaaaatgaatgactgcaata

SEQ ID NO: 13056 - DNA, 201 bp, Homo sapiens
ctctcccaggcagaaagaaggaaagaaagtcttgctagaggagaaatcttattaaggctcatggtgattcaggagtgacagccggggctttttcaatggayttatctgctgtcacagagacccactatcctggaagagcccaggcaaagtctgagggttttgaccatcaaaatgaatgactgcaatatgttttgaattgca

SEQ ID NO: 13057 - DNA, 201 bp, Homo sapiens
ttatatcagctgactactatatcttttctcaaactccaaagcccacatagctgatatactcttgtcaactgatattgtttccatgttacagatcaggaaayggaggctattcaaagttactgtatatgcgttgtctaagtgctatttgtatacttgtttatcactcctttgatctgccccattgaggtagacaatgattct

SEQ ID NO: 13058 - DNA, 201 bp, Homo sapiens
tagtacttgtctcatgtacttcaacaaggactttagactaaactgatttgattggttatatttttagacttgttacttctgttttgacagaaagaatagamaatacgactacaagcatagtgaccttctggatttgttcctgtggataatcttaagataatttgaaggaagtttcttaactttttaaaggcacaggtgtca

SEQ ID NO: 13059 - DNA, 201 bp, Homo sapiens
cttgtctcatgtacttcaacaaggactttagactaaactgatttgattggttatatttttagacttgttacttctgttttgacagaaagaatagacaataygactacaagcatagtgaccttctggatttgttcctgtggataatcttaagataatttgaaggaagtttcttaactttttaaaggcacaggtgtcagaagt

SEQ ID NO: 13060 - DNA, 201 bp, Homo sapiens
ccactagattgtttttttaaatttttgagcatgctctgttttattttctgattatgaagggcatttctagtagtcctgggaagagtgagctcacaaaaagrcagctagagaactagtgatcatgactattatcacatcaagactttggcttaagcaaaacagaacaacaaaaccccaaaaaaccccacaaaactgggaagt

SEQ ID NO: 13061 - DNA, 201 bp, Homo sapiens
ctctacttttctgtaagggccccaggctgtatgtcttttatatcgtcttcagatgactacaataaacacacactaattgggcacttcctgtgtccaagcaytgtagaataaacagagagaaataaagcaatctccattttcaagttttctcctttaagggtgtggagtagtgcttgacatgtagtaaatgctcaacaaatt

SEQ ID NO: 13062 - DNA, 201 bp, Homo sapiens
tttctgtgtggaatctggttgatatttttggagaataatttaaatcagttctaattccaccctgaagagctccttttgacacacaagtggctttgtgtcaktgcaactctggaggaggccagggcaggcttcctgggtgctcagaacactggctgcccttggaattatggctttatctctgggggatagtacttcaagaaa

SEQ ID NO: 13063 - DNA, 201 bp, Homo sapiens
aagctaagctctcctggaaactggtaggatggcgtgagctggtccacaggccccagctgccagatgatgggaattgggatcagctgtgacctaattatgartctcgtaaacctgcattgtgcccttcattttccagctcattgaccactcagagggggagggaaaagggatgagattctggtcaagtccttcctgccacta

SEQ ID NO: 13064 - DNA, 201 bp, Homo sapiens
agacagagaacactcaccaggggaatcaatggaggagggaagtgaagaatgtaactgtgcaggaagagtatgctagggatagagggatgctcatcttcgamctggtaatcaatggaatccagactgacctattacaagagtggggtccctatgctctttacatagtctcccttgtcagtttcctgaaatttattgtgccaa

SEQ ID NO: 13065 - DNA, 201 bp, Homo sapiens
acatccatgcttgcagtataaaattctaggtctgtgtccctgaaaagaatgttggtgtgagctaatgtgaaagatttggggagaatttgtgtaaaaagtarcaacaaacaccaaatgcctagttgagttctctgatgggtaaggtagaatatttgagagatttttttgagaatatttcccactgaaacttgggaaataact

SEQ ID NO: 13066 - DNA, 201 bp, Homo sapiens
aaatgccttccttattttcttcttaaaaagattatcatttgcttattttcttcctcctctgtgaagtaaaactttatcaagaagaattaaacatttaaaaragatgtgcagtaattggtagggaaggataacgagaagaaaagcagacaactgtctgctgcttagcatatccatgagtgtgttaatttaattagaactgcc

SEQ ID NO: 13067 - DNA, 201 bp, Homo sapiens
aataacctagtataaatcctggcacatttttctctatacacatataatttatacatatagaaatgtatacaagtttttcaggtcattgttttataaaatgsgatattatatacttattttgcatcttgattttctttttagaagaacactattgtgcatcatagaataaatacaaaaaagtttaaaacatatttaggtact

SEQ ID NO: 13068 - DNA, 201 bp, Homo sapiens
ccaaaacaggcttcgtggggaccaaattggcttttggatctcaagtgtgtctctgagtcactccagtgaacacgttataggtcactctgtgcaggttagtrgcccgaaaatctgcccttcaaaggaaaagaaaagtgaaattctcatgacttttacactttttgtcaaatcttctgcatagagaccttctgagttggctct

SEQ ID NO: 13069 - DNA, 201 bp, Homo sapiens
taataaatggaaaaattgagtcatgtaatggattagagactttcccaaggtttacaactacagaggaatagaattggctctagagctaagtcttctcattmtagtttaattgtttgtttatttgtttctatgcaaacatgttcatactcttccttagcatgtttcatcctatctctactagtgcaacaagatgctgagaag

SEQ ID NO: 13070 - DNA, 201 bp, Homo sapiens
atatacccttgtaagatatgtaacatgcttttcttgttatttatttaaaatttattttactggcagcatgctgtatatcttaatgcatttttttacctttkccattcaacactgtttataagatctttcatgttgctatgttttcatttagttggttttctgtaactgctgcatagcatttctctgtatgcatccaccaca

SEQ ID NO: 13071 - DNA, 201 bp, Homo sapiens
attcacgcaacacaaagtgcacgcacatattggtcttgaaattccccaaggaccaaaatggacccatgtgatgagtctgtgttataacagggaatctaccrtaggttcttggctaccttttgtgaaccttctgtcttctttcctctcacttacaagtaatcccctgagtttttacctcctgaaccctgtgatttcaagggt

SEQ ID NO: 13072 - DNA, 201 bp, Homo sapiens
tcttaattcagcccatgagcacatggtagattatgaatggatgctttaggaaccatgtagatggaggtttgtgaaaatttccacggaacatggcagttgaraattggtgactgatatggtctagctctgtgtccctacccaaatctcaccttgaattgtaataatccccatgtatcaagggtgagactaggtggagacaat

SEQ ID NO: 13073 - DNA, 201 bp, Homo sapiens
acagggtagtctcaaggtgtgattaagacacttgggagtggtggtggttaaaaaaaaaaaaaaaatagagccaaagtgtaaggaggcaagctggaggcacrtggttatatgaggagaaaaattgcagtgaggccttctcatcaccctcttcagggtcaatgtgatggcttcgtagaatcaagtgcaagtctgtggctccat

SEQ ID NO: 13074 - DNA, 201 bp, Homo sapiens
gagatgtgaacaaccctaggatctaggcttggctctgccactaagtgactatgtagaactaggcaaatctcttggcctctctgggccatgagatgcaacaytataaatcagtacgataatactcgcttctccttccttatagcagtagagcaagaatccaaataaatagtacaagtgagaactcaacacaatctacatctg

SEQ ID NO: 13075 - DNA, 201 bp, Homo sapiens
ataaatcagctttgcaaagtgggggctgaagcttttctactaactgaaccatcttttcttttttattcttgttactttttaaggagatgatggcaagtgayttctttttaacccattttaagggcccagttcatcttgtacaattcttgtgcaaagtctctactgagactttggcctgatgcaaaagaagaggcccttaga

SEQ ID NO: 13076 - DNA, 201 bp, Homo sapiens
gaggctgaggtctgatgtcgtcgtcatcggcagagcgaccttgctcctcatttgtgcgcacaggcactgaatggagggagccttgaatcatctgattttgytcctcattagtatttctccactgtgttctctgaccacactttcctcctcggtgcatgcaaagctattagcaatgcacacacgcggcacatctgtggagcc

SEQ ID NO: 13077 - DNA, 201 bp, Homo sapiens
ggctaaggtttgcagaggagcaaggcagtctggggtatgtgccatctctgggacgcggggtctttgcagaatgtgttattgtggtgtagtctttaagtgarttctcagataaactggaaggtgggtctaggtggagattatttcaagaaggttagaactctggtctctggttacaataaaaaagctggattgctgaagatc

SEQ ID NO: 13078 - DNA, 201 bp, Homo sapiens
agagagggagtgccaattgggaggacaggtgaccgaggggggcagagggacacattcatttattacccagttttgtcctggattgatgctggtcttgggtrtccgacagtggaaccactctagtacctgacacacctactcttgacccagctttttcactcccaatttggttgttatacagcaccacaaatagggaaagat

SEQ ID NO: 13079 - DNA, 201 bp, Homo sapiens
tcatttattacccagttttgtcctggattgatgctggtcttgggtatccgacagtggaaccactctagtacctgacacacctactcttgacccagcttttycactcccaatttggttgttatacagcaccacaaatagggaaagatggctgggactttgaagagaacaggtggctcctatcagctggtgctaaaagagccc

SEQ ID NO: 13080 - DNA, 201 bp, Homo sapiens
ttgatgtcacagttttcactcttcaagaacaaggagtcattagtatcttgacatctaactgtataagttaaagcacttcctggaagctcaaagggaaacaytgaactcttaacacacagattctgctggaagtaaatgactctgccctataaaaggaggagaaagaaattctatttgagtaatgccgttgaaatattaaaa

SEQ ID NO: 13081 - DNA, 201 bp, Homo sapiens
tcacattttatacgtgttaaatggtgtagtagtaaaccatgtttaaaaaagcttcagttttcattggtgtacaaagctgctacatgtaaatattggaaccrctttttaaaagaggattgctgcagtcagattttttaaaataataaaataatcacaaagttcaacatatggtgtcttcatgtgattataagtgtgcgagtg

SEQ ID NO: 13082 - DNA, 201 bp, Homo sapiens
tatgctgctagtttaatgctccagttcctgatgaagccagggctttctttcccaggagacagtcaactcagggggcatgtttggtttagtacctgccagcrtgttgttgacaaacaccatatactctctgttgcaaagccaaaacatgaccttttccacaaatggagtaagcgtttattggggaataaaaaagtatgatga

SEQ ID NO: 13083 - DNA, 201 bp, Homo sapiens
tttgtaatggggaaacactcactggtttctaaaaccctatgtagatttaagtagttgatgattctgtgaaaaaaccaaataccttctagagaaaacatacrggttgggcagagcccaggtattgatgtccttgatgaaactggtttttgtattctgaatgttggagattgagagatccaaagccattctctaaggttgaca

SEQ ID NO: 13084 - DNA, 201 bp, Homo sapiens
gctgaatagtcaaaatgctatatccacctcaaatggagtcaggataagcattatgaaaagtcagaattggcagttgctaggtgatgtaatttgagggactycatggagcataccctccaaaaaactcttactgatgcctgaaatttcacagttatgtcttgattacattggattgagcaacagcccctcctttaaaaaatg

SEQ ID NO: 13085 - DNA, 201 bp, Homo sapiens
ttggattgagcaacagcccctcctttaaaaaatgcaaattcttctcacacagggaggtagctattatgcccctgacacactgggtgcttattaagcactcraagcagaacagaggatgtggatggatgaggagatggaaaaagttgtgcagtgaacagtttccctgagagctggcatggcaagaggggggcggtatgccca

SEQ ID NO: 13086 - DNA, 201 bp, Homo sapiens
tattaatcttggtaagatcccacaaccaacactatgcttttgcaagagcatccaaagttgtgattttgggttttgttttgatttcttttgttggttttttwatttagcttgtgactaatagaaaaccagaaatactaatctcttacatcaaaggaaggttactggcaacctccttgtactctccagggaggcatggttctc

SEQ ID NO: 13087 - DNA, 201 bp, Homo sapiens
cacatcctcagaacttccccaggcttgcatccctggaaagctgaagtagtctttggggcttcagagaaggcatcaattgatggatctcagtccatgtgtgygtgaggctcaaggttacctggcaaggcagtacagggcagtagtaaagagtgagtaaaggatttggggtcagcaaaacctggttttgatcctcgatgctac

SEQ ID NO: 13088 - DNA, 201 bp, Homo sapiens
gagcagcttggctatgtgagcactaagcagtgcattacttacccagagcccttttccagaggcaggtgctgcccagtgccagctccagtgactctgggacrttgatggaaatgtgaatctggatgaggcacacatgcaggaggcttggagtaaggactcaactgggaattaggaatctaacatcctggaaatcaaagttgt

SEQ ID NO: 13089 - DNA, 201 bp, Homo sapiens
gttctgctgtcttgccatagaaaagggagccaaagggttttaactagagctctgtcaccttgggagaaccctcgggaaagaaccactgtccaggctagcarccacagaagccctagaagatcacacagtgaattgcttagcttctgctctcactgcagtgccttttacccaaaacaaactcttgttttggtaggagaaaca

SEQ ID NO: 13090 - DNA, 201 bp, Homo sapiens
aggtttctaggatttgcacctccgcattggcaaattttcccagtctgtgtctccaaacagggttttaatcacctgggctcttgtccttggcattgaaagckttaagagtactgcagaaatggtaaattaaccacatttaacaaaatagaaagttttcattgtgtcataaaaagccctattgatcttgttcaggcattgact

SEQ ID NO: 13091 - DNA, 201 bp, Homo sapiens
ccatcataacagattaacgtgtcttccatatccctcagcttccagcaacatttcctcctgttgcccttaggaaggtaggctgaactctgatgccaacgcasggagcagtgggtctccagaaagagcgtggaaagcaacgatggggcaggaggaggaattggcaactttagaatcactgtgaccaactcaacttcatttcaa

SEQ ID NO: 13092 - DNA, 201 bp, Homo sapiens
ctagggacacagacctctcctctccagctctgtgtccctcctaacatttttgtccttatgaagtccacagaatgtagtgtgacagcatggcatttgctatyccagtataatcgccttagttattgagtacttttgatgattctttttggtcttggccaagggtgaaaggatatgtaagtttgtgagtatgtatatattgta

SEQ ID NO: 13093 - DNA, 201 bp, Homo sapiens
gtcttggccaagggtgaaaggatatgtaagtttgtgagtatgtatatattgtacaattttttttgttcaaaaacttcaaaattctatgtgaaacttatttrtaggaagtcaattctggttaagttctccaccatcctaattacttatatactctgtgtaacttcaggaaatgtatttttaggaaacactgtaggctagagc

SEQ ID NO: 13094 - DNA, 201 bp, Homo sapiens
ggtgcatagtaggcacctgtgaatctttactttttaagtgaataaacaaaaatgtaacttttattgtaatgcagttgacagcaattcagtctttaggatamcattagctttctagtgatttcagtgaagcgtggttttccaggccattcttctgtggacggaggcagcttccctcaccaggatgctggctgtttattttcc

SEQ ID NO: 13095 - DNA, 201 bp, Homo sapiens
gggcacacaaggtataacttaaatgtttatagaagacacccattaatataccacttgcggtgccaaggacatgcacagtagttggctttgtggacatccaygtctgtagaaaaagagcttagttgtgataacgccatttgatttgtcaccttctactctagatcagggtcacctccaggtctcctgagcagggccttgtcc

SEQ ID NO: 13096 - DNA, 201 bp, Homo sapiens
tactttatgatgaaaaaatattcattttgcctaagaaatttacctggggctgtaatggttaacacagatctgagttgaagtggacttggctttggttaatwagcctggagtgtagttccggcagggaaaatataattctctcaaccttattttgtagcctccaatctttagagggaaactgtatacctcaactattgttgc

SEQ ID NO: 13097 - DNA, 201 bp, Homo sapiens
ctagagagtcctttgtcagaacagttaattatccattctaaaccagctcttctacaagcatttaaaagcaattcctgaagcaaaagcaactcgagcctcayttgatcattttgcatgaaacctccctttaggtttttcttgagaaaattcgaaggaaaggcagcaatctcttttgcaccatcttgttttgtcttctaccct

SEQ ID NO: 13098 - DNA, 201 bp, Homo sapiens
acctcatcagctcacatcagtaaaagaaaaccgtttcctataaaaatcaaagtctgtgctgagaccgccttttccaggttgccattttcacttggtttttytatttgcgaatctgttgttaaacccagttggatggcatccaggctttattaaccagaaaacactatactttctgaagtgcttatcaaaaagtgcttacca

SEQ ID NO: 13099 - DNA, 201 bp, Homo sapiens
tatttttattgttttggttattattcctcatcattcattttattgttgttcttagagttgcctttttggtttgggtcatttcttctcttggaggtggtgaygggagccaagggagggtagggattggtgtcctggggcagtccatggcatgtatcatccatgaccatatcagaatcaagacccttctccttccctccctga

SEQ ID NO: 13100 - DNA, 201 bp, Homo sapiens
cagtgttccttcttgtagataacaatcccttgtgacatcttatgagtctcctcttggggcatatgttttattcttactatggttatttgaaatttgttgarcatcatttgtatatgagatggcactgtccatgcattcattcatgccactgccctgtgagccttgtccaggcaggaattgtgtctgttaggcatggcacat

SEQ ID NO: 13101 - DNA, 201 bp, Homo sapiens
atgtgagaagaatggggcgtggttatgtagaattcaataggtttagaacagctcatactgtcattacctattcactcgagttagaaacctcaaagtgagaygtgatctttctttctcattccccttcttcctttttgccctcatttaatcaaacacaaaattcccttggcaatgccctgtatatttctgactcatctctgt

SEQ ID NO: 13102 - DNA, 201 bp, Homo sapiens
tctggtttggcaacattaattgaatgtaggtatgctggaggagaggcaggcctaatggggaaagtgctgtttttgatgggttgagtgggaagtacctgtgktaactgcagaacaaggtcaagtcaaatagctggagttgtaactgtaattagaatataagcaatagagttaaattaattgaaattgatgagatcagttaag

SEQ ID NO: 13103 - DNA, 201 bp, Homo sapiens
ggaggagaggcaggcctaatggggaaagtgctgtttttgatgggttgagtgggaagtacctgtgttaactgcagaacaaggtcaagtcaaatagctggagytgtaactgtaattagaatataagcaatagagttaaattaattgaaattgatgagatcagttaagaaaccacatcaaaaggaagaacaatgtattttaaag

SEQ ID NO: 13104 - DNA, 201 bp, Homo sapiens
gctgctgatttgggtttggaactgggattaaaatccacattctcatgggttccaagcccatggttatagtcagtcattatgttccacttcctcactagctsttcatcaagtattatcagaaagcaaggaattatttttcagactagcagaaatttactagtgacttagtaatatgtcagaatgtcatggtagaaaatcatt

SEQ ID NO: 13105 - DNA, 201 bp, Homo sapiens
gggaagcctctttttaagaaatttggaaaaggagctgacagaaaatgagtctgaaaatgagaggcagaaatgagtcatcaaagagttacttggaaagtgtrcagtcaggaaacccaggaaaagaggatgttgaggaaggagtgagagaaatgccagctattgcacagatattgcatattatgagaatggaggcctatataa

SEQ ID NO: 13106 - DNA, 201 bp, Homo sapiens
tccacgtgtattttgtataaattagtgggcttgacattacaagaggttgcccctatacgcagtcatcttcttagccccagagttctggaacttacccattrgcctgcacctctttatagaacccgtcttacgcatggttctgaactaactgcttctgtcacctggattgcttacaatacctgcttgcctcatgtgctacta

SEQ ID NO: 13107 - DNA, 201 bp, Homo sapiens
ttttgtctttgagcctctcagattagctttttctacaaaagctgtttggcatgcctattgtcatctattttctttcagagtagctgctaacagccagaagstgctagttatggccaaaggcctcattgttggagagtcgttcttgttctttgactctaggtagagaggatgaaggctctgagatactgtctcaaaacattc

SEQ ID NO: 13108 - DNA, 201 bp, Homo sapiens
ctatatagttaggagcaatttcagatgttaaaaggtgtaattcatatttcttgctcataaggtgttcgaaatctattgaaaagacaagacttgtgctgtasaaagataacaaagttgagagagttttaagtgatgagtgagtggagtggacagtttagcggagggagaaatcacagcaggcccaagtcatcagctgcctga

SEQ ID NO: 13109 - DNA, 201 bp, Homo sapiens
tgtcaaaggattaaatttggaagggagataagtatatatttatttttttgcttgttgtgagtaaatgactttgcagttaggtatacagttgaaaagctttrttgagatttgtagtcaactctgctccactcatggtaccccaatactggcttctccaccattccatttctccaacttcagaaaatgtccacagcgtcctta

SEQ ID NO: 13110 - DNA, 201 bp, Homo sapiens
tccacagcgtccttactttccaacattctccactgatgtggagtggatcattggtgctcaggcctcaagtcacaaacctgtgagtgacatggtcttatccrctgacctggtgttttttattgaagttgtcctctatgcagatagtttaaaaacaagagaaaagaaagaccaggtggtaaacctcctattccttgtcaggag

SEQ ID NO: 13111 - DNA, 201 bp, Homo sapiens
tattgtgtatgatataaaacagtgtttgcaaagtacctggcacatggtaggctcttttcttatattgttccggctctcagcttgctttactcctggtattkctcctgtgtgtctctgtattaaagatcatggaggaatataagtatatttttttcctgagagactttgtcttaactttgagattctgtcctcagctgtttt

SEQ ID NO: 13112 - DNA, 201 bp, Homo sapiens
ggtttgtgtgccggtttagaattgtctgtgtcctactatgtctaacatcccacttgatcttgacaacagccctgtgagctgggaaagagggacagtttgtrgaacagatatcgaggctcttacctttggaataaataaaatgggactcagaagggttattcagctgtcagtgagagtggtgttggctttttattcacaaca

SEQ ID NO: 13113 - DNA, 201 bp, Homo sapiens
ttctaccactgtacagagggcacatgcaatgtgcaaaaaataaaaacaaaaacagacctctgtccccaccagcttttaacacttactcttttctttcaagkaatatatccacatggttgaaaaaaagtctaacactgtaagagggcacagtgaaaagtaagtcaccctcccactccagaatattaatcccgcaaatatact

SEQ ID NO: 13114 - DNA, 201 bp, Homo sapiens
taacaacatcaacacaatcactcagtttgccattctctctctaatttttattatgtagaagcattctagaatcaagtctaagtctagaatggatcatttgyactaaatgtgttaagcctaagacaattcttaaggctgtgtgtcccagtagctcaaactgtgttctctactggaacttccttgggggtgagtccattggta

SEQ ID NO: 13115 - DNA, 201 bp, Homo sapiens
ccaggtcagacactagacactacatcaaaatagaccaatgacccaagcaaagtcagcaacagataaatctaagagacaattcctggatcaaagtcatcagscaagtataagagagtcagagaataaggcctgggaagtagaaagtgtgtatatgatactaagattaatttgcatgtgtatgtttctcttacagtaaaattg

SEQ ID NO: 13116 - DNA, 201 bp, Homo sapiens
gaaccctagctgagagttattccaccaggtgagagtctgagctacctctgatcacagctggtcctgttactctaaaaaagagtatcaggattgtagattcyggttattctagagtcttgaaggtttcgaggtctaagaaggacaggctggggactttggagatcttttaagaatcgacacctgcattcaacctgagaatgt

SEQ ID NO: 13117 - DNA, 201 bp, Homo sapiens
ggcaccattgctcactggttaaactgactccatttgcctgaatgattatcgcctgatgtcttgaggcttacagacccagagaaacctttattcttttctcrtaacagttaataataaagcacttgttcccttgtctccttttttttttctgccacagtatttctcaacctactatctttccatcttttgtcagctagtagt

SEQ ID NO: 13118 - DNA, 201 bp, Homo sapiens
gaaagcctattttaactatgtaatactattcttattccattatgtaggtaatgaaagtttgtatgtaaataaaagtttaagcttctctttataataatttrtcacaggaactgcctgcaaatagattctaacgataagaatgttcttcttttagctataaatccttagttttctacttcttgcaaataaacagcttagtta

SEQ ID NO: 13119 - DNA, 201 bp, Homo sapiens
gagaagctaaattataatcagaaagttgttttggtgagcttggaatcagaaaataggagtttaagtcatctgttcaacatgcagctttcctcagctgtgayagctttttcctgctgtccagtcttcatgtggagcctggtcaatagcaccagaattctaagtctgctggccaaggtgctgcctcctgcagagagagaaagc

SEQ ID NO: 13120 - DNA, 201 bp, Homo sapiens
gcttcatcatacttttggtagcgcctttgcttgctacatgataactgtcattttagctgcaatttttcaaaaatctcctaaaacactcttctcacacaatyggcctctcttaactaacttgtagacaattttgcccttctgctcaagatcttttctgcctcctttagatttcctccctatccatttctgtctcttctccct

SEQ ID NO: 13121 - DNA, 201 bp, Homo sapiens
aaccattctagaggataaagcccaccactgcaaaagtgtgatccagcctcacacactgccttgcaaatattcttcaggccaactgatgggtgaaggccagrtttgagaacagcacctttgtagcccatgaagtttcttgacacatttagcctcaaacacttgcagagcagatatagtcgatatatcctgggttcatgaatg

SEQ ID NO: 13122 - DNA, 201 bp, Homo sapiens
tcatctccatatctatagactgcatagacctctcacacaaatttgcattgctagttgaggtgttctttgagcttctcagtggttatgacaaaaaggacttyagcagtttgtgactgtgccctggaatccttcagcagactgaaataccttcagctgaaggagatggtgtttatgcagaagcccagcacctagcccatcaag

SEQ ID NO: 13123 - DNA, 201 bp, Homo sapiens
tgggttactaattgttacagtgaaattagattcctctttccaaagaagtcagagttgtgaaatgcttgggaaactatgagctgtttccccatcccttactsgtgtagacaaaaataactgatacagggcttttatttcctgtgggttcacacttagtctcggaatgctttaaaagacaacacactagacagaagctaacat

SEQ ID NO: 13124 - DNA, 201 bp, Homo sapiens
tggtaaatgttgggtttaggaactgaacccaggtctagctggttccagagcacacattggtgctttccgtggcgtggcctgtaggtgacttctgagggaawtcagctccttggtgctgagggcttagccatgattcctttcagagtgagttctccatgtcttctttggccaggttcctgtgctcagggggattttcaaaga

SEQ ID NO: 13125 - DNA, 201 bp, Homo sapiens
tgcccatggtcatgcatactgaggcagaggatgtgtccttccgcttcatgtcccagcgagcttatgggctgctggtggctacgacctccagggactctgcygacaccctgcgtctggagctggatggggggcgtgtcaagctcatggttaacttaggtatcgtatgaagtaccctctgccacttcgtttgggcttgtcttc

SEQ ID NO: 13126 - DNA, 201 bp, Homo sapiens
ttttgcctagcttcagattcagtctactccattccaaagcctctgctcctcaccattgtacatattgcctctgccacttgtatgctgaagtgttaatgccwaaatgaatgaaatctatcactctagaacaagtgctgatggtcccatgaaagaggccacttctaatcactaatacctcctatctctgtaggtagtctttct

SEQ ID NO: 13127 - DNA, 201 bp, Homo sapiens
ttgtgtctaaggccctctttgttggctttaaaatgtttattgatttggggatttaatgttggatccaactgtgaatagtggccactttgggcctggtgagygatcctggaatttgtcaaacaagtttatggaaggaaacctgaaaatgcttcaccctagtcctttgcctctttatttttgtgggttttttttttttctctt

SEQ ID NO: 13128 - DNA, 201 bp, Homo sapiens
ctccattaggatcacattctagtagttttggccaaggagagtaaaggaaaagcttgtctttcttgcctagaagtttaaaggtcaaatcctctctctagccrtattgcaattctggggacagttcctattgattgggcacttccatctaatatgctgttcaactgagattctttctggccaagagctgtgcaggggtaggtg

SEQ ID NO: 13129 - DNA, 201 bp, Homo sapiens
tgccattaccgtattctgagttggtggtataaatggcatttttctaggtgatcgttatatatgtgtatcatgtatattaccaggtatagtcctgtaatagytccacctttctgcataaaagtcttcacaaagctaaactgagagttatagtaactgtaattatggaaggtaatcacaacaggaaatatgttatatgaaata

SEQ ID NO: 13130 - DNA, 201 bp, Homo sapiens
ccagaattatatgagataatgcatatccaaagtttagggcagaaactgaaacctagccaacattttaaaaatgtgaattattgtcattaacttatcctttyggtgcttcacctctccatacattttaagatactctggtcattatgagtacttgccacaagtatataggagataaaagatttattttcccacccattatta

SEQ ID NO: 13131 - DNA, 201 bp, Homo sapiens
cccatttacctgttgtcctttggctgtattgccctggttatatattactgggttttgctaaatgtttcctatcttttctttcaagttaaatctttatgtckctgttagattatcacatataaatgtgtaaaaacatagatattcctgcaaagcttacaaggaaacaataaaacagaaaagacttgatctaactcctcccca

SEQ ID NO: 13132 - DNA, 201 bp, Homo sapiens
agatagaaagcttgtgtttagtccaccatacttagtgagaagttgccataacatttttgaagattgaatgtacagtatggaatatgttcattatctcagtmccatgtttgggctcataaaaataaaaatagcagacatgagtgtggcctttattcatttgttcaacaggcttttactgcttgcctatcatgggaatggcaa

SEQ ID NO: 13133 - DNA, 201 bp, Homo sapiens
tgcttgcctatcatgggaatggcaagaaacatcatttcagttaactgaaaggacaaatacaatattcttagtgatctccttccttcagttccccacaggaratttgaggttgataaaacagcagcaaaagcatatttttagaagataaagagatggttcgtatgatgtacagaagtctacttgctactcaaagtgtgatca

SEQ ID NO: 13134 - DNA, 201 bp, Homo sapiens
acataaaaagcactcaataaatgttagctattattactgttttcagtcactccaggcgagctatattgtaaaaaaccatacttccattgcttcttcactasagcctagcaaatcattgttttctactggtctactatttgtggatatttctaccccaagatcctttcccaagaggacaatgcaatatagttgaaagattct

SEQ ID NO: 13135 - DNA, 201 bp, Homo sapiens
cacgttggggtttgtataagtaataaacgctgagatatatgccttaaactttagactgtctgagatcagtttaaggcaaagatagaatattatgactaaasagcgtaaaatgaactgctgagcatgcaagtaccataaaaaggcccttccttcagaattgagctgatccatattttttctcttgatttcattttctactta

SEQ ID NO: 13136 - DNA, 201 bp, Homo sapiens
agaaaaaaatgtgtatcagagtatgttgaatatggctgtttgtcagatcaagtttacgctgtgtatgggccttcgtccaatttagatgcagatggtataarggactttgaatatgctatattattattcagctgacttctccagtaaataatagtgttcttcaggaacagaaaaccaaacgccacatgttctcactcataa

SEQ ID NO: 13137 - DNA, 201 bp, Homo sapiens
taacagtattctattaataccctgggaggctgaagtagaggatgaggcacggagaaagaggtgagtagtccatcgttgaacttgttatatgtggcagtctyaatggtatgtttgcttattaaatcctgataaatattggtggcatttttagtaggttttaactagaagcaggggctcctggagggtgctcaggctgaatag

SEQ ID NO: 13138 - DNA, 201 bp, Homo sapiens
catttagatgtataattataggcatctttcactacgcctttctaaagagggtaattttcatatattttatgcattgtagaaattttggttcatgtgaaacmtagtttgaagggaaatcaagttactgtttcatttacctctttgaataaatagaaagatgttcaggtaaaaccaagtgattatgatacagatctcaccccc

SEQ ID NO: 13139 - DNA, 201 bp, Homo sapiens
tcattacctgggaaattcaactgaggagtgttaggtaatttattaacattctctacttagatccagcagtgatagtttaagcagcctcaagagaatcaaasgatttttttttgtgatcaatatttattacttaaactataaaagagggaaaaatacatgtaatacatacaactaatatgtacccagttgcagatcataact

SEQ ID NO: 13140 - DNA, 201 bp, Homo sapiens
ccagaaaaagtcatccctagactacatcatcaagaacagttttgtatatttcaaccttcagcttgtgtctgcatcttgcattacttatcaattcacttttwtgcctgggctacttattaggtttgtttctcctctctctttgccttgatttcccgctgagtgtaaacatcacttttcctctgtagaatgagttgacctttt

SEQ ID NO: 13141 - DNA, 201 bp, Homo sapiens
gtaaacatcacttttcctctgtagaatgagttgaccttttgacttgattaaggataaatgccattgactctccacttctggaggccaagggttttacaaartcccactgggacttatttatttattgtttgaaaatgaatatcaaatactattccatatcattttaatgagatggatgtgaatctttttttttctacttta

SEQ ID NO: 13142 - DNA, 201 bp, Homo sapiens
gggaggagtgtagctagtgacagttacataataaagctttcaaaattacttagataaaatatattgactctaattgatggttaccatagaaacagacttayatagacattgattattcaagcactcattaaagctcctactatgtacttggccctgtgctcagtatatgttggagccaagtatatggttttccaaactatt

SEQ ID NO: 13143 - DNA, 201 bp, Homo sapiens
atctggatcctgcaaaggataagtcacacatctgttgctcactcctctgggcttgtctctgaagggtgatgggattcacagccgcttctgaaaagcagccrctagatggcgacctcaccctgatctctcctgacagtgagttcgtttcattttccctggaaaataaatgctccaaaagtatagtcataaagaactacagag

SEQ ID NO: 13144 - DNA, 201 bp, Homo sapiens
ctctctcagtcattattcttttatgaaaactttggaataaagctatttgtaaattgcactttcttttaccactaataattaaaaagcagggccaagtcacraaatgccattatccagtaatttgattttttgaaattaatgaaacgctttcattttcagacgtgtccccccaaccccccgaacttcactgctgatggaaga

SEQ ID NO: 13145 - DNA, 201 bp, Homo sapiens
tcccaacccctcaatcctggagatcaattcatccagaatttctctgaaagttctcaacttgactttaaaattgtttcttcagattccttttggaacctcartcttcaccagagattccccattctgacttcttagttctcatcttagattttttctttgtaaaataagaattagcatgactagcagcatcatcatagttca

SEQ ID NO: 13146 - DNA, 201 bp, Homo sapiens
ccagatactgaagtttaagagacctaagaaaatacaatcctccctttttttgtcactgtaattctgagccaatagagaaaatattgcaatgaggatggaargcaaatatcattttaattagtaataacacacaataatattgcttacacccactgaacttcagaattagacagaactgcccacttgaatagtagttcagaa

SEQ ID NO: 13147 - DNA, 201 bp, Homo sapiens
gactctcattcattcaatagttattacatactgtacttgggcttgggaataccaaagagttcttgtcagcatctggtgagtctgaaatcaaaggacacacrgccaattaaataccaccaccccacccaccctaagaaaaaaatgtaaataaaaacagtttcaagtaagagattacttatgtgagctcttattggtaaattc

SEQ ID NO: 13148 - DNA, 201 bp, Homo sapiens
ataaacaactattatctttcaatttaaaagaaattaatttaattacagtccacgtaattgttattagttaagtaaataggaagacatgatgaagagtaaawgttctgctaatgggggcttccttaagtaggatagtttggagaaagctcattttgagctgaaactcaaagaataaaaatgaaacagtcatttgaatctgga

SEQ ID NO: 13149 - DNA, 201 bp, Homo sapiens
tgggcatctataacctgtgtctccacttctttctcatgttattttcttgatgtgaccatagtaaagatgagcacacacttgaaatttctgaataaccgtgrcaaagagatttgttgaaaatccctgactctgtgggtcctgctaaccttctgactttctaaatgcagcctttgttttataatccagactcatttgacctct

SEQ ID NO: 13150 - DNA, 201 bp, Homo sapiens
gggtcttatatggaagagcacagaggtcatcagcaattgctttggtaacatgcctgccacaagtggcctgcctttgacctaaataacagaaatgggtcacwgcattaaaagtcgagtgccatcaaggaaacctggcttttacctaattaattcctgcaaagagagtgttctatagaatgttgcatatagctcaaacaaatt

SEQ ID NO: 13151 - DNA, 201 bp, Homo sapiens
tggtatagcagtaatttttaaggatatcatagtatagtacatccatgtttttggttatgtgttcattccccgccattgttttcagactctacctgcccagygaataggccatatgtaagaagttcacttgtaaaacaattgtttgttgcttagaatgcactttatcatgtattgattcattcactcaccaaacatttctta

SEQ ID NO: 13152 - DNA, 201 bp, Homo sapiens
atataatcatgaataagagagttttgttctcaaagaccttctagtctaatggggaaagacacatatgaaggtgcttcagtagaaacatgaacagtgtatarcgaggagtcataaggtggagtaatggcagctgtccccagggttgagactctatgaagagcagctgcttttaggatggttttcattgaagatgagccttga

SEQ ID NO: 13153 - DNA, 201 bp, Homo sapiens
cactgctgaaaatgtggaaaacacataaaagtatgaggcagtaggaaaaaaacatgcttaatttcatcaactattaatatgaccttgtttcagaatatgcrtgatgtcaggcacataacagatactcaaaatatatttgttggttgaatgactgagtcttgcatattttcagcatctgagttgtgcaaagatcttagcttt

SEQ ID NO: 13154 - DNA, 201 bp, Homo sapiens
aagaacactaacagttttactaggactaggtgttttcttgccagaagaaatgcttttaggcatatgggaattataataagtatcccaatatgaaatttccytcttcagataaaaaatgaaaatgtcaagatggttccatttcttttcaatcttgcccttctcctttctcaaagaaagccttgctgtttctgaacagtcatt

SEQ ID NO: 13155 - DNA, 201 bp, Homo sapiens
ttattccacctaaattctcgatatttggggtatgattttatttctgtaaaaaaggatttaggcagggaggtgtcatctggattttatctgcccttaagagkaagtgttctttctcctctccctatctaaaatttccatgtgattccctcacactggcactaaagtgtgtcatctggttagagctcacatcagtgccctgct

SEQ ID NO: 13156 - DNA, 201 bp, Homo sapiens
ctttggtcagttaaatccatactcatgccttatcccaaatcccactgcatttatattcagtgctgagagacactctggcttggcatctaaagggaattagygtggacctgagagtaaaaggtcagttcaagttctggcttcttttctttctaatttttgtggcatttgtcaattaatagaaggtgatcttactatggaagt

SEQ ID NO: 13157 - DNA, 201 bp, Homo sapiens
ttaactaaaatctggacatgctgcattgagagagcatctcttggaagtctcctttagtgaaggatgcttttttcctaatgttttaaattcctggagtcagrccttgattctacaatcattcttcagtgatgtttcttcttttaaggtcacgtattttttatatgctgtcgccccgtcctcatcattagcatttattgacct

SEQ ID NO: 13158 - DNA, 201 bp, Homo sapiens
gctgtcactttcttcttgaaatcagaaaaacatcgtagtttttacatggtagtttttccttgttggaggacagttgcattttactccacactgttaaatgsattaggccatgtaagagaaatataattctgtaattattcagaactcagttggttgtttatatggtattcagcaagatacttcccccccacctccaacttc

SEQ ID NO: 13159 - DNA, 201 bp, Homo sapiens
gatgagaatctgatggacgatatgtaccacgtgctttgaaatagccataaggatgtctgcacaagaatatccatgcattcgttcttagaatttcagggccrgttgtagctcagtcattttgccattgacttaattgaaatccaaatcaatgcagacacttgctcaaggtcacatagcttgttctctcccagctcccctgac

SEQ ID NO: 13160 - DNA, 201 bp, Homo sapiens
tgtgtggcaggcggggaggcaggagaggaaaatgaggtagatgtccttcccataccttaactagtttttgagagaaatggaaaatggcagatcagatgccrttggccgtttgcccaattaagccatagcagtgttagctaagatgtgatcaatatggaagacttggtctgcagagccttttttagctgtgctcctgtacta

SEQ ID NO: 13161 - DNA, 201 bp, Homo sapiens
agaagaatagatgtgagtaggcaaccatacaatagtgtttgttttgaggacaattatgagtaggttttttagatacattgtatgtcacttgcaagtgtatragcagagtttgctatttttttgagatattttttgagtaactgtcatttctttgtgagatttaattctagaccctaattctctcactgcacagagagggag

SEQ ID NO: 13162 - DNA, 201 bp, Homo sapiens
aagcatttccccatgtttccttccacccccaaattcttaccccatttcaggcagagctgagcaaacataagccttctctgaagtattgagggaaagtctgmtaaacggctaaactacttaaggagctaacagaaaaggttgtatcagagaaacagtggagaaacacaggtttctaattatatctggcactggagagaatgt

SEQ ID NO: 13163 - DNA, 201 bp, Homo sapiens
tgaaaagtgatgcacactgccccaacacgcacacatacacatacaccccgcctaaaaacctgagacataaacaatgtctagaattgtgggcaatcatgcaragcccttcaaacaatattaaaatccagccacttgtaaagagtgagtaataaaataagtttagggttatataaattgagtctaataaaataattcagattc

SEQ ID NO: 13164 - DNA, 201 bp, Homo sapiens
taaagctatgtgtttcagaatgaaaggaccaatcacaagaaactctcaagccttaaaatacatttagcttttggatataatacatcacatctgtatttgtyagtaacatattaaacaaaatgatagataaaatgtagattatataagaacctatgtaattgacatgatttagatactcattcaaagatgagtcatgaaaaa

SEQ ID NO: 13165 - DNA, 201 bp, Homo sapiens
ctttttggctagtataatatttccagaatccctgaggcttgcttttaaatcagcataagctggttttgtgtctcacttttgtgttgtacaattacagaaarcagcaaatacttatcttggcatgtcctgtcatgacatgagccaaaagctgtcatcctcatagattccctgtctaagggaatagttgccctatcagcattt

SEQ ID NO: 13166 - DNA, 201 bp, Homo sapiens
atgggcaaatctcccaaagattccattgtgagtcacacaaacgttcatctataaaaagtggaaatttatcagaaatgatgaccttgatattttgaatgtartaactgagaaattcaagtagaatctcatctagtatgtgttgaaaatgctcattttttgtttaattttgtttagtttttttttcttgtccagaggaatgaa

SEQ ID NO: 13167 - DNA, 201 bp, Homo sapiens
taatccactaaatagtgttcccattgttttcaaatataattcacaggggtaaagatagaaaatgtattttttagggctttttctaacaattatattttccrtggaatgctgaagtcccacaaggaattctgaggcccaggtaaggaagaagaattagggaagacacaccagtgggaggttgcctagggcacaccaaaccat

SEQ ID NO: 13168 - DNA, 201 bp, Homo sapiens
tctgacaaatgctcagtaaacatgagtagtgggaaatcttgattatatgctcattaaaaatatatctatgtatttaaagtagtaagtctggtgttcaaaakgtaaaaccttcaaaattctaacacagttcttgtttggattaactctagtctataatcacaactcttctgtttccttgtctgcactgtgctcacataatgg

SEQ ID NO: 13169 - DNA, 201 bp, Homo sapiens
cattttcattctaataagctattttttatttctaataagctatttcttatttctaataaactattttttatttctaataagctcgtgtcttgagcagaaayactaatacccaggaaattttctgaggactggctcacttaaaatgaagggaagtcactccacgctctgagttgtcttctctcatcttcttcatgtgaaatc

SEQ ID NO: 13170 - DNA, 201 bp, Homo sapiens
cactcacttctgctacacttcccagctgtctcttttggctttgcacattcctgtctcatgactctacagggaaatccatgatgtagattttcctgtattcragcaggcaaagatacgggtcaaacatttaaggccgttaacaagaagttaaatcagcaacaacatttatatagaggcattaattcagggtgaacgcaaaat

SEQ ID NO: 13171 - DNA, 201 bp, Homo sapiens
cacttcccagctgtctcttttggctttgcacattcctgtctcatgactctacagggaaatccatgatgtagattttcctgtattcaagcaggcaaagataygggtcaaacatttaaggccgttaacaagaagttaaatcagcaacaacatttatatagaggcattaattcagggtgaacgcaaaatgtgttgcagcatcga

SEQ ID NO: 13172 - DNA, 201 bp, Homo sapiens
ttggaattgggtgatattggacattcttcaaaaaatcttctaaagggaaagaatgtttcatctactcatttgttcagatttccctataatttttagccagsagtcctttatggatcagatattgcatcaaaaaagaaggggaaaatattcttgtcatggagacattttcagattaagttgaaaaggtccataatccttacg

SEQ ID NO: 13173 - DNA, 201 bp, Homo sapiens
ccctataatttttagccagcagtcctttatggatcagatattgcatcaaaaaagaaggggaaaatattcttgtcatggagacattttcagattaagttgaraaggtccataatccttacggaaattttttttttaatcatcatcaggctattcttgacagtcagtaaaatatcaggtctttctcatttaactgacagattt

SEQ ID NO: 13174 - DNA, 201 bp, Homo sapiens
taatcatcatcaggctattcttgacagtcagtaaaatatcaggtctttctcatttaactgacagatttcttctttttgctttctttcttccctctctgtayctatatctactctctttccagggctcacggcatatagtaagtattgaaaaaatgaatttaagtctaacttatacatacttgtgaaacctcattccttatg

SEQ ID NO: 13175 - DNA, 201 bp, Homo sapiens
tcattgctggcatttggctatgttcagttgccccggtgtgctactgaaggcaagtgtccaaacgccaataatgtttggtttctctcgatattccgaggttrtatatcaaaagaagccgtgtgtatggcttccagttacccatccagagaattcctgaaaaaagcaaattattcttaagatcccctggaattatgaatctct

SEQ ID NO: 13176 - DNA, 201 bp, Homo sapiens
cttccaactctgaaagtctgtgactaattttgttaaacccctactgtgtgcaaagtttgtcactgggacgaataaggttgacactctcagagaagcaataygtaaaaagacatgtacaattctcttaatttttttttttttttttttttttgagacagagtctcgctctgtcacccaagctggagtgcagtggcatgatct

SEQ ID NO: 13177 - DNA, 201 bp, Homo sapiens
aagaaatcaggtggatggagaagatacactagaggaatgagatctcctacatgagtaaagtgttttctaatgtgtttttcttgaatgatagcatcttgaawttcctacaaagtatggaatagtttacctctgactagcgctgccctacagaacaatgtcaatttattctaagactgcaatgttcagaatgcagatatgatc

SEQ ID NO: 13178 - DNA, 201 bp, Homo sapiens
ccttcattttcctgcctgagtgataacgaatgatgtctcttgtcctgtacccctggcttcctctcctcagagcattcaagccagaccccatgacaagatgmtcccagtgaagggagaaaactgggaatgacaaatgtgagtctgggaacccaggcatcaaggggtggacttcctgatctctaccacttgccatcatctatc

SEQ ID NO: 13179 - DNA, 201 bp, Homo sapiens
ttactgtatctgtaatttctttttttttttaattccatgatttactggaaatctcaaaggatgtttgaatgaactctaattatccgttgtctttgttgtcsctgactccactgtcaaaaacccaagccaggcatccgcttggtttggtgaccttaaccacaatttgaaggctgctgactgatcagggcagtggttgcggaa

SEQ ID NO: 13180 - DNA, 201 bp, Homo sapiens
atgtttgaatgaactctaattatccgttgtctttgttgtcgctgactccactgtcaaaaacccaagccaggcatccgcttggtttggtgaccttaaccacratttgaaggctgctgactgatcagggcagtggttgcggaaggttggggtggcaaacaacaaagatgtttcccgcaaggaatttgagtcttcctttcatga

SEQ ID NO: 13181 - DNA, 201 bp, Homo sapiens
tttctacttcccttcttgtctctctatttttaccttattcatttcctctcgtgcctttccattttttatatcaggaattaaataccctctagagtgaaacratgaataaaatctactagtcctgtgagaaggacaaaattaaatgtgttgggttgtgtttgtgattgtgctgatgacagcaaaagaagccacactgaggat

SEQ ID NO: 13182 - DNA, 201 bp, Homo sapiens
gaaatcctgaactagagtttgagagagtctgctaagctaaagttgtggatttgcacgttagcctcctgaagaggatggttgaattcataaatatggatgayactctacagaaaagaagtttgcttagaggatttggcatatccatgatgagagtataccggggaagcaaggaaacactgaagagagaaggggtggtcagaa

SEQ ID NO: 13183 - DNA, 201 bp, Homo sapiens
caggagagtcaaggtcacattgcaaaagagcgtgttggatggaagatgttacatctgattttgaaaaatatacttctctacaatattgtttggtcatcttrtaaaagtaaaaaatagtgtacctttataatatttcattgagaagtgtattaggcactttatcttgctaatgtaagatggttcactttaaagtgctctgtg

SEQ ID NO: 13184 - DNA, 201 bp, Homo sapiens
actttataggtcatataactgaagtgagtttataattatggcaatgggtctacattggaatgtagtttatagttactagctcaaatatctctgcctttcaygttatgttggaaaactgcatgctatctttatttcttagtttcacatctgtaaactgagattaagatctgcttttctgtttaaagactattgcctacatca

SEQ ID NO: 13185 - DNA, 201 bp, Homo sapiens
atgatgttaccatatgttggttctgaattcctattttattttattctcaggtggaaaaaagaaagaaaaaaggattcatcagcaatagggcaacttagagmggacacataggtactatggcagtgataagagatgagatagatcatcactatgcccttttcaattcttgggaactgtcttcgttaaacagttttagatgca

SEQ ID NO: 13186 - DNA, 201 bp, Homo sapiens
aagcctcagggtaaacaggcattgcctcccattttgatttcagctccatttaatgactttttatacccaatgtggacacatactcatttttagttttccartgcagatttcagctatattttggctttattcctcttttttcatcctttttttctttttttttttttttttttgagacagagtcttgctcttttgctcagt

SEQ ID NO: 13187 - DNA, 201 bp, Homo sapiens
ctttgcgctgccagcaacaagcctgtgctgtgtagatctagtgcagccacagaaccttgggactagctgaagggccgctagacctaatggcaggggtaacyatttttgcaattgtgaatattcagcatgcacaggcttcctatcagctctcccaggagctctctgagagatggaccctgtgaggaaacatctttaaatgaa

SEQ ID NO: 13188 - DNA, 201 bp, Homo sapiens
actgtcctgccttttacccttttcttagcatacaagagttactgagaatgcttcagaagctattatgaaccactgtagcatcagctatatttatttaaggyacctattttgtatgttaaaatattctagagtatcttataactcttggttaatgaaactaaggactttctcactccttaggtaaaaaagtagtgtttattt

SEQ ID NO: 13189 - DNA, 201 bp, Homo sapiens
aactacggtgtttcgcttaggaacatcaccaaacaaagctacttgttcttcaaggacccagtaatcatccttatccttgcacaattatcctggctctatcstttgatgattttctttctgcaactaatgatttgggtagaaagaaaacctgccgatagtcatctttgatattgactggtcagtcccaagatctaggcattg

SEQ ID NO: 13190 - DNA, 201 bp, Homo sapiens
caaaatccgcttttatgtaggatggcttttttaaataaataagcagaaggatgaattatgtggctataaataaatctactgacatgtaataaagcaaagtygaactgttttatggtgtcactgaaacccttagatatatttatagccatgttaacagtccccagtattttttcaggacttttatttcatttcacattatga

SEQ ID NO: 13191 - DNA, 201 bp, Homo sapiens
accttgtcagagggccatttcctggggggctgtggatcctggaccacccttacaaatgagagccagggcagttagggtgactgtgtgcatcatttactacsggcagcttgaagcttttggaggacaccaatttcagaaccagaataccagttcactgccataaattctgaaatggacttgatgtatgaccttgaaggcaaa

SEQ ID NO: 13192 - DNA, 201 bp, Homo sapiens
tgagagccagggcagttagggtgactgtgtgcatcatttactacgggcagcttgaagcttttggaggacaccaatttcagaaccagaataccagttcactrccataaattctgaaatggacttgatgtatgaccttgaaggcaaatcacctgtaggtttggtctttttgttagagagacataatgctgtttcctcaacacc

SEQ ID NO: 13193 - DNA, 201 bp, Homo sapiens
tgtggggagaatttggtctcatgaataatttgggcagagagaggatcctgtgatttggatagccaaagttttattgtttattttttccaggagccaattaytatatatcttttttcattgaatcaatatctctgcataatggaatggtcacctttgaatgttctcttttcttaaaacaaacttcttagataagttaaacac

SEQ ID NO: 13194 - DNA, 201 bp, Homo sapiens
tccttattcatgggttttattactactatcctaatttcctcatatggaaatgagcctcaaaaacattaaataagttactctaggtcccatatcaataaatygacagagctggaattggaatcaacttaagtctgacttcagagcttaaggttttaaccatcatattctaccaccttcataatacctttagttactttatta

SEQ ID NO: 13195 - DNA, 201 bp, Homo sapiens
tttcattatagtactaagaatgctggaacaaatattttttctacttacatacttgagttcagttgaattattttatcaggtatttgcaagatgacctggartatcttggaagttattatatgtaaattatacatacacatatatgtgtatagttcctggcattgggcaactagtataaggaatgctgcaaaaaaaatcctt

SEQ ID NO: 13196 - DNA, 201 bp, Homo sapiens
tgtggttttctgaccctggagttctgatgggaaagataatgagaagtgtttacttagcatctaggccagcaagctaagaaaaacattgtgccatgctagtwttgacaaggtgacagagagcccacacttgcctcacatgttggccactcccgatgctacatcccactttactcttgctggaggactgacattaatgcttac

SEQ ID NO: 13197 - DNA, 201 bp, Homo sapiens
ctttcttcaaaaggaaaaaataaaaaataaaaaaaagctactcttgctggaaaggtagagagaagggtctgcgggtgccctctaccattgtggtttcaatrtctaaatcttctggagaggattgctgcagtgatgagataaaagcagctgcctttccaagtactgtctatttgcattgatatttacattctttgccaaagt

SEQ ID NO: 13198 - DNA, 201 bp, Homo sapiens
aatgtccttgcagtcagaatggcaaacaaatggcatggcctgtcagtatctgaagttaatttgggctggctgtcctttctttttggatatttaggtttcartaatgatttcccgaaggccacaataataaacatgtgttatgttataaaaagcgggtgctgcatacattggaagcaaggccccctaattgaatcacctgtg

SEQ ID NO: 13199 - DNA, 201 bp, Homo sapiens
tgagtaaagaaaccctagaggtcaaagattgtagtgtaaataaaagtattttcctttatatatgatataatttatatgtgttatataatatgaagtctcarttagaatagggaaaatgaaattcaataattattagagtattatttgcgaagtgttctgctaatatttttcctcctattaatcaaaattagttttgtattt

SEQ ID NO: 13200 - DNA, 201 bp, Homo sapiens
tacctttagaaggattcagaaaagaagaaatggccgtttcaccccaatatgtcactatagatatgaatgccactcatagaattgacacgtcatgtttttarcttctgtgctttaggattttcctgtttgaattgtttatgtgcatgtgattttggtggaatttcttcccctttcctctgttccttgctccttcttttgctc

SEQ ID NO: 13201 - DNA, 201 bp, Homo sapiens
cataaggtaattttgtccaagtggttactgtgtgggtcctgttcacaatcttgatcatgattgtattccaacttctatgtcagagtttgcaagcatgtggyttataaactcaagatggctggtacaatgttgttcaatatttaatggaggggtattaccaagatctagttttctaggttttcttgagaaattagaaaatct

SEQ ID NO: 13202 - DNA, 201 bp, Homo sapiens
atatcttcaccaaaaaataaggaggcataagaggggagataccagatcttacaaaataagtaggttttatttacaaatacttatggattagtgggggcccyttcactaggctacaaagaatttgaggctctatctatgcttagttttaaagaatgctatggtcaaagaagctatgtttgtcataggcactagaggaaggga

SEQ ID NO: 13203 - DNA, 201 bp, Homo sapiens
tcaaaatttagagacatacagtatttcattttaccatcagcgtatttctatgtttatgcaatagggattgaaaaagttcaatccccatgctcaaaaacacrtacttccagctctctgagatgatatgccagacagggcttttgattagaagccttatttttttgcctagttctagcttctgtatgagtggagactttatta

SEQ ID NO: 13204 - DNA, 201 bp, Homo sapiens
tgggcaatactgctttgttatcagacttcaccatgtagatctcacatccttctcttttctgatcttgctcttatcatttcaaagttacatgtagagtgagratgcaggtttcatagggtttttgtttttatctgagacagagtcttgctttgtcacccaggctggaatgcagtagtgtgagcatggctcactgtagcctcg

SEQ ID NO: 13205 - DNA, 201 bp, Homo sapiens
actgctttaatgtgaattgcattagaaagctcccctccacttttccttccccagtgtttgtctactgaatagcagggtgaaagcgtcggttgctctcatcrcctcacaatcaggccaattgggcataactgctttctggtagaattcatctcataataaattgcattcatggaagatgcctagtatgtggtaaacatggca

SEQ ID NO: 13206 - DNA, 201 bp, Homo sapiens
cagaagatgtgtgtcttgggtgcctgaataatgcttcttttgctattcactttcatcttaatttagagtcatatatttcttgttaccttttggttttcccyggcacctaacaatgtaatcttcacaaagcagtgctacattctaaatttatagtgcagtaaatgaaagaggttggatccattgtgcttcataattcagagg

SEQ ID NO: 13207 - DNA, 201 bp, Homo sapiens
gagggactgaggtttggtgcaagttgtccgcagccaggacttccaacatctggaggatgagcaccctaatcttgaaggctgaattcagtagcacatccackgcaactgaatatctgattcaaggccaaaaattgtggagctcagagccacaacgggcttctgatcttccacaggctgctgaatgcccctggcagtccactg

SEQ ID NO: 13208 - DNA, 201 bp, Homo sapiens
attaaatctcaagggaatgtgaaataaaaactggaatttgagttcagagtacctgaaagagcatttttggaaaagactttgtttatgccatttgtgcataygtagatggaatcaaaatgtataagataataagagaaaggtgccattgagcctccaagtagaagcccgatgacttcacttatgcccggctgatcacccaag

SEQ ID NO: 13209 - DNA, 201 bp, Homo sapiens
accacggtgccatgcagttacagatttgatggcctgcatcccagtgacattgctccaagaccagagacaagaccattttttgtttgcatggagctaagtaktattttcagaaaatcaaaaccaaaaggtatgttttgcttcctagctcagggtctctggagacctgacctgccaggtatcatttgctcattttatttaaag

SEQ ID NO: 13210 - DNA, 201 bp, Homo sapiens
catggttggcaactgggaaagacactcagcaaatattacagataccagaaggaacctggagaaactctgattctttttcattttgttcttaaaaagcaggygtctgaaatgtgcccaacttcagctaaagaaaaaaacactattgttgggtctagacacaaagcctgatttgctgattttatttttcttcatttagttatt

SEQ ID NO: 13211 - DNA, 201 bp, Homo sapiens
tcctctggtgtcctgaatgaggaatctttggggcaagaagggtcctgtcctatttattatccttaagaaattccttgctatttttagttctcaacatcagytacttctcattactaagtaaaagccagattacttaacttgcactcaccctaattcatcttatccactggcagcaaattccttccttagaatacttcccca

SEQ ID NO: 13212 - DNA, 201 bp, Homo sapiens
tgtcgcgctccccttggataagtttaatatgattttgtacacattaattaattatcttaataacagacaaaatagaaggaagccactaccgtcctttccartgcatcagatgaatcaaaatgaatcaaagggctgggcatggtggcccacacttgcaatcccattactttgggaggctgacaccagtaaatcacttgaggc

SEQ ID NO: 13213 - DNA, 201 bp, Homo sapiens
catgtatacatattctctttctctctctccctctctccacacatactcactccctctctctctctaagtgccctagagtaattcttacttcccaaacagcrtccttaagtgacagagtgcaaatgattgaattaacatttatctactcaggtatatgtagaatctaaaacagttgaactcctagaagtacatagtagaata

SEQ ID NO: 13214 - DNA, 201 bp, Homo sapiens
ataagaccaggaccaggtgtagaaagtgccttattccagggcctgatgacctggaaggcaattttcaaatgtagggattatgcagtcacctctcacaaggwccagggtgaagaacaagtaagaaactttctattttctggggaataggcacactttcaaaggaggaagaggtattgagatgagacagagaaattgagatgg

SEQ ID NO: 13215 - DNA, 201 bp, Homo sapiens
ttatactttttcctagaaatgatccattccttctgactttcaaatatattgctttaaagttgtacaaagtatgattttatatttgtaatcttttctattgygatggttatataatttctaatgttctatttttctcctttagtttttatttctgtttttttagaggtttatatattttctttgacattttaaagagcaaac

SEQ ID NO: 13216 - DNA, 201 bp, Homo sapiens
agttgtttaatctccttgagcatcaattttcttttttattaaaatagtaaccaaaatatttgccattaatatttcagtgagtgttgagggaagaggcatcrgatgagacactccaaaagaaagcaatttgaaaatcatttaattctatggcaatataaggcccagctgttataaaatagtgaacattattcactcctaaaa

SEQ ID NO: 13217 - DNA, 201 bp, Homo sapiens
tcaatatcaccatcagctccatcacagtaagtagttagccaattatgaaaacaataagccaggcccattatttgcaggttgtgagttaaaaaaaaaagagycatccttgttgactatttgaagatgagatgtatcctcttaatctttgttagtggtgactgtgtagagatttcattcctggaatactgtgttggttaaaac

SEQ ID NO: 13218 - DNA, 201 bp, Homo sapiens
atagcatgcctcagaaatgaaaatctttgatgaattaagaggaggttcttatagttcccaggattttcccaagaagttgatttgtaatccacattttaaartaacacaattaacttttttatttgaatatgtaaaacaaaataattctatgtttcctgtaggactctaggcattttatattaaaattaacacgaagtatgt

SEQ ID NO: 13219 - DNA, 201 bp, Homo sapiens
aagggtgcagtgagccgaggttgcgccactgcactccagcctgggcaacagagagagactccatctcagaaagaaaaaaaaactcctagaaatcatttttrttaccatgtttatagcaacacaatagtgaaataggcaaatgcatttagtcacataacttggttttcttgggccactgctttctttcctgtgggagtggga

SEQ ID NO: 13220 - DNA, 201 bp, Homo sapiens
tttctttgtatgagcaaaattaccagacattttatatcaaaatgtaaagagccccctgggatactgtagacacttgggtgatacagccgattgcttaaacsttctgtgaaagcccagtagattttcctccaaatcttagattaggaaatgatgtcacctgaccctttcagaaaaaaggaaaaaaggatcctatgctgtggg

SEQ ID NO: 13221 - DNA, 201 bp, Homo sapiens
gaattggatttgagtcaagaactgtatttggggaactttccagtggagtacagaagaatgttggtgtttttgagactggtaacgcaaataaaaaaggaacraacaagaaaacaacagaggtatccaacagatgcaatttcgtttcccatggagtgctgtgcactgcaggttgactccgtatttccttccatcgctatttgt

SEQ ID NO: 13222 - DNA, 201 bp, Homo sapiens
ctttaagctctagtccaggtcattctgcattttgtcaatatagtaaattgagtaacagcctctgagggccctgcaaagagccaaggcccaatttaactccytagtgccagggtctccaaatgtttttggttgtctatacatactagaaaaaaattaactctgcaccaattaaaaatatgtatatatgtatgtagaatacac

SEQ ID NO: 13223 - DNA, 201 bp, Homo sapiens
ggttattaatgggccttcatacctgggaggacagattacaggagagatgtgataattagagatacttcactgatcataagcaggcccccgagcaccaaggrctagcagctgtgttacacatatgaggcaagctccatgctccagagacaaaagtgaagtagaatttgctgcagtgaccttacctaaaagaggtcatctcaa

SEQ ID NO: 13224 - DNA, 201 bp, Homo sapiens
tcttatcagcttctccattcacatgtcttaaatgatttctacctttactaacaagagaaaaatccaggtacattctggggaaaccattagtgcttagttgktaaaatcttgagacttttatcttactagtagaccctcaacatttttccaaagaggcactaatgtaccctgtaaagaaatgacatttttcgtctcaaaaaa

SEQ ID NO: 13225 - DNA, 201 bp, Homo sapiens
ttctgctgtatactgaatgacaaaggctgtcacagtagcgaccaatttgttccaatttgcttacttctccagatctctctgtcagactttaagttccttgmatatagggtcctagtcttcttgcccatccttgtatacatggtaggtgttccatcaatgtttcttgaatgaatgtataaaaagtgtattttaattgaaatc

SEQ ID NO: 13226 - DNA, 201 bp, Homo sapiens
tcctctgtgggttgcagtgaggtcaatcagatgcagtcaaatggcagagaagatattaaaagtacatatatcctagaactaaatatacaccatctgtgaayttcagttacaaagggaaacttctcttaatatgaccttaggtaaagccattggcagttttattgtatctgtcagcaatcaccaatagctttgattaacaac

SEQ ID NO: 13227 - DNA, 201 bp, Homo sapiens
ccgagatccatgtgaggtattctgtgatgaagatcttgttctgtttttattattaagcgtacatcttccccttttctgatattaccactatgcatcatcarttaagctgtcaccaacctgacctctgaggcattggaatcattcacttgatgaagcttactttggcataagctaagggttaggaaaaccaacagatttcta

SEQ ID NO: 13228 - DNA, 201 bp, Homo sapiens
cactcaacagtgcacacatttcttctataaaatttgatagttacttatctatctctgatttttccctctgtgttttattatatctagtttaatttttcccytttgttgatttctgttttgtatatcttgttgcgggatatacatggaagggagacgagtttccaaagataatatagatcccagtttgcctgtaaattgata

SEQ ID NO: 13229 - DNA, 201 bp, Homo sapiens
tcaaccttaacccacacaatcatctttagaattggatccagaacaagatgggaccatcttaaacctggtacattctcataaggttcattctcataagaccstaaagccttcattatatggcatttttgaaactcctttgtcattttaaatttttgtctttcctagctcccttttcctctactattctatctaacttaggca

SEQ ID NO: 13230 - DNA, 201 bp, Homo sapiens
tagccttgttttcatttctcctcctcccgccttcctgtcttcctcttcctctcccttccttttcttctttttcttcttattttgattttgttttactttayggaattaaacctccataattctgtagtgtgccaagtatgagggggaaaaagtctctttcccccattaatagataatgacaccttgacagataagtgagca

SEQ ID NO: 13231 - DNA, 201 bp, Homo sapiens
cgcaaaggcaagcagggtaccagagttagagcaaatggcaataagccacttgaattagaaggcccccagcttgcagcagagttaatgctgcctgttttccrggtgacctcaatcactgcctggggcagacactggactcagatgctctccagtcacaagagagtttgtaaatatgatttaaaaattgtcactggctgctca

SEQ ID NO: 13232 - DNA, 201 bp, Homo sapiens
gaccttggcagtggacttgctttgtgtttgcaatggaagaaggaactagaggggggataacctcatggttgtcttttcttctaaatttctaagacaaccartgaagcttgaggccttttctccagaactatacaatctttgcctccagcaagctctgtttttactaataaccagattgtcaggtggaaaactttttctaag

SEQ ID NO: 13233 - DNA, 201 bp, Homo sapiens
gatcccaaaatgatgaggagattgtggatggaaagtggtctcttaagcagaagaaaaagcatggaagaaatactagggtcagggaagataaaaaatattaygctgttatgaacaatcaattatatagggaaagtaaataatgttagaaaggtagtttaaaattttccttttttgcttatcatgttagaaagaatttaaaat

SEQ ID NO: 13234 - DNA, 201 bp, Homo sapiens
tctagtcccatttactgcaattgtatttaaataccagcttaattagctgtactcatcctccttcccaatcctctttgaagtaggaaagtcccattgcttcygtttagctaatgctatgctcataccctagtttttaagctttgtagaaagtacagatatgactgccccatgtgatctctaagaagtctagatatttgatcc

SEQ ID NO: 13235 - DNA, 201 bp, Homo sapiens
acatagctcacctcccctctttctcttatattgctacccataaggactagagaaaagatggataacataatcctgagtctatgagttgctagaaattcctyattataattgtgtgtcttctggcaaaaataaataaataactttctcttttaaagccacttataggagacaatgcacattctgtgttttttctctgtggct

SEQ ID NO: 13236 - DNA, 201 bp, Homo sapiens
ttgcaacagaggagagggttagcacctttcatgacatattccagcatcctgttaaattgatcagaagaccaattgcacacagtgtcttctaccattgagaytggaaacacagccaagggtggagatggtcagtgaggcttcccagtgtcttgcaagttccaggtcagttgtttatgcttagagtcccctgacagagagatg

SEQ ID NO: 13237 - DNA, 201 bp, Homo sapiens
ttatgcaattttgggccatagattcctttattctgaagtggagaaaatactttccttatacaattgttatgtttacataaaataaggtgccagatacatartagaaataaaataaatgatgttactacttcctaaaatcctaaaagtttcatttcagattgctgagtaaacccagttaaagaaaccagcctctgtgttttg

SEQ ID NO: 13238 - DNA, 201 bp, Homo sapiens
ccgttgttggtgtaaagagcaagatcttttatgggtatcagttttaaggggcttatgggaataatcaatatgctatggaagtaatgaagatatttaacgtyctgaaaattctagtctaagctttgagaatgtgaccataaaattgacagggattaactttaatatttgactagttaacggtaggattttttccgttacagt

SEQ ID NO: 13239 - DNA, 201 bp, Homo sapiens
ctttgctgacacctatttggttgaattttacaaaatggaaggatgaataatacctcaaaggcaatctggtagattctttgagggaaagagatgtgtctatktacagggaataaagctaagcacattgactgttcttaggttaatggaaaagaataaggctagtgtaggagccagcaaattatgtttcctccataattagag

SEQ ID NO: 13240 - DNA, 201 bp, Homo sapiens
tgcatttttttttcttaagtctcaccctgtcttggtgatacacagattaatactaacctcctaccaaacaatccctgttgccactctactgaaaatacatycttgccttccacaagcagaaggctgagtgtctttgtggcttaggagagaacaaaaacacatctatgtattcattgccttgttcacttgcacaaacggaga

SEQ ID NO: 13241 - DNA, 201 bp, Homo sapiens
ttgctggttatagtcctccaccaaaactcttcagttcttggcctctaattcaagctttcttccaagtttctctccactctcactgtgtcatttctaggagrcctcagagttttccacgctagaacacagtcggtactctcatgtgtgttttcattttagcctctttgttgatgtctgctgcctgtcaatccacctgggttt

SEQ ID NO: 13242 - DNA, 201 bp, Homo sapiens
agatgatttttggggcaagtattcagtctatgacaatcctcatttaaactcatcagggaccattgataaaatgctattcattcttccctatgctggtgtgkaaatttgccacccaatggatgcctgcaatatatgccagagactttaggtacgctgtggcatggcttagtgactatgagaagactgacatattagcttgga

SEQ ID NO: 13243 - DNA, 201 bp, Homo sapiens
atcttttctctatagcacaaaagattatgttttttttttttttttcataactcagcatctttgtgagctatgaaacttgccctgatagccttttcttgccyagggtaggatatattctgaggaagggctgggactgcccatgcattcctgcagagcattcacgggtgctatttacagtcctaattaaatggaggattatta

SEQ ID NO: 13244 - DNA, 201 bp, Homo sapiens
ttattttccccttactttaaattctgaaaacgctaatgactgagcttttcatttagtactaactggatggttagttttctttgtgtatgtgatcgtttacrtggtcgttttgtttctcaccaacacattgtaaactcttttagaattgttatctaatagaaatataagtaacataaacctgtattatatttttggagcatc

SEQ ID NO: 13245 - DNA, 201 bp, Homo sapiens
cagaaaatgaccatgcagtcactgtaagcaattcctctaaaattattaaaaactgtttatgtttggagaaaggcagcccctcttgcagtgataatgactgstatatgagaggattaagctgattacatctttggaatactgagattgtgcaaaatagagggaacgatgaactctccacataagctaaggaattcagcaaaa

SEQ ID NO: 13246 - DNA, 201 bp, Homo sapiens
tttgttccttagctggaggattagagggaagaaatgacataggtgattagggatgggggagagctgggatgaatatggagaaaggttagagaatgcaggcrgaagttgatggcagcaatttgacttagaaccttatgggacttgggacacacgcactgtaaccttgagacctagataacagtgttttatacagattcggag

SEQ ID NO: 13247 - DNA, 201 bp, Homo sapiens
caacctggatatggtggagagcattcacattccttttcagtagtagcctcttaacgatgaggtatggatgaacagcaaattgctgctgacttattaattascatgcccacaccactgatttccctatgtcttacctgtgcacacacattggctttacagcatacgaacgccaagtttgtggcgtagcatatggtgctccct

SEQ ID NO: 13248 - DNA, 201 bp, Homo sapiens
ctttattttcattttgtttggtttttgaaatgctcattgtagaatgttgaatatggtcagatgttgggtgtgaagtttattagaaattaaccctgaaaaastatggtatagtcattcagttgccttttccagtggagtctgatttggcctggcgggtgtagtgaaacattaactacacccgcctcagccacccaaagtgct

SEQ ID NO: 13249 - DNA, 201 bp, Homo sapiens
caagatttttgtgacaatttcattcattcctactttctttacaccagtagtagctattcatattcattcttctattttctttgcatgattaactggcatayactagttcttcacattattagcctaataatagtagttacaggctataataggctattaattcattatcatctcctgactcaagtgaatctgctggtaact

SEQ ID NO: 13250 - DNA, 201 bp, Homo sapiens
tgccatgatttgcctctgctggacgcttccttcaagggctgtcaacacctctcttaattgtctggcttaaacatcaggcgagcaatgtgttaaagttagayggcaaatatacttaagacaaatatgtaaatttttactctttcaaatatgcattcaactggtgtgtatagatttcagaacaaaagccagagagagagcaag

SEQ ID NO: 13251 - DNA, 201 bp, Homo sapiens
tagtcattctcaaatatgattataggctatttcagattcatttcaggaaaatgtcatgtgtcaaggtgtcaattctgagcaatttttacattttgccaatwctattatagaagtggctctcacccataagtagcttgaaggagtcagtatgtaatgtgccagtctcattttcactttatgtgggcacaatgtctctctaat

SEQ ID NO: 13252 - DNA, 201 bp, Homo sapiens
gacgaataatgtacttcagtgccctgagatagtttttgtctactgtaataaaatatttccagtcttctctgtttttgcattcttcaattattaccttgaarttttaatgttttttaaaataatgaattggcctaattgtagcctcagcacaactactaagttacacattcaataaaaagactttttctttgtaatgttata

SEQ ID NO: 13253 - DNA, 201 bp, Homo sapiens
tgttactaatagctgtggaagctccgctatccacaaagcagagattatgaaacagtctatactttggctagaagcctaagcagaatctcttctacttccckcaaaatctatttcttagcaccagcaagactgggtctgtccagtgggttgtgggtttggggagaagcagaggaaagattgacatcatgtggaatctggaag

SEQ ID NO: 13254 - DNA, 201 bp, Homo sapiens
ctgaatagtctctgaatggaagaaagtgtttttcatccctaaagcccacatgtatacttcagatgcacaaggttcaaggtcagggcctgaaggagaaagtrtcacagcacaagtaacaatgttaaacttcaaaggaagataaaacctcaaaataagatattaaggtcaaatactagaatctgcagggacactgtcctggtt

SEQ ID NO: 13255 - DNA, 201 bp, Homo sapiens
ttctgcacatgttctttatcctaggaagcaaaatatttattccttttcctgcattctttaatacctagtttatgcatgtctcattgcacttattctaatcrgagcttgttcttgtcattttttttcatatttttttccttttgtgggggagtttaggacccaagtctttgtcctcttttggtttaactagtaccttgcaca

SEQ ID NO: 13256 - DNA, 201 bp, Homo sapiens
atttgttgaatagtagcgagtcctttccccattgcttgtgaccatgagattttatgtgatgttgaaacccaaaactacccaaaggaattaactactgctgkttaattgtacctatattaaacactttctttatagtattttccttatttgggggccatctcaaagtcctaacaatcagaatttgtgtcttctcatatgatt

SEQ ID NO: 13257 - DNA, 201 bp, Homo sapiens
tacaggttcataattcttgtcctcgaagatctcccaatctactgataaagcaagtaccatatgcatgaaaagataaatgtctttataaagtttcttaatcwtgagtgcccatttgagtggtctgtgggtttttagaagttattcacagaaacgaggctccttagttctgacatggggaccatttgtttttattttcaaaaa

SEQ ID NO: 13258 - DNA, 201 bp, Homo sapiens
aggctaggcctacttgcatctggagttggctccagaagtctttacaaagttagcttggcattggctgggtttcaaagaataaatagaaggggataaaccargaagaaatgtggatatatatggggcacgattgaataatttccagaaagaaatcagatagtacaaggagtgtccagagaatgatgtatatggctgaaatgg

SEQ ID NO: 13259 - DNA, 201 bp, Homo sapiens
tggccacactttgtcttactctatgttttctaggaacacattttggggtggaaatgcctttattccatttatatttagtcaattatctggtttagcttccrttcttacaacctaattaaattcagcccatcaactcagtttaaggcatagcagctgtagacacttcgtttatctacttggagagaaaaaagataagttggt

SEQ ID NO: 13260 - DNA, 201 bp, Homo sapiens
aaaaaaaaaatcttaggctgtccctacaacttttgctatcctcacgaaagagtgttactccagtgagacaaaagtccatcacaagaaatgatttttctacrgaaacagctgtgattggagcaagatacaaggtaaaacatgttgtggtcaagttcaaggagaaaacagggtggctagccctagcaatcctactggtggact

SEQ ID NO: 13261 - DNA, 201 bp, Homo sapiens
aaattatctcttttgatgaaggaagtcctttttgttttttgataccatgttgcttttgggaaaacatgcctgaaagtaggcaagtttctctaaagcaagamctgtaaaactcacagaaacataaagttgacttgatcatgcccattttataaataaaggaatggagactcaaagcggttaagggacatgtctgcagtattt

SEQ ID NO: 13262 - DNA, 201 bp, Homo sapiens
gccacttgtcccccatgcccctcctttctagcctgtggtttataacatgctgtaagtctggaaaccaaataatcatgtttattagacttgtatgtaaatckaacctaatgctcctttcctttgttgttgttttccttgataatgtggtcttttaaaagagtaaaatttgaactaggatttatgaaatctaggtttaagttt

SEQ ID NO: 13263 - DNA, 201 bp, Homo sapiens
cccaggttctttctgtttgataacaccgttttcaaatgttgagaatgactaaagaaagatatagaaatttgtaatgattaggtatttatacattctcaatratgaattttggtataaaaacatatttttttatctaactatatttttcatgcagtcatttcagtcagtatcaccatctaggtttcctctagggaccacata

SEQ ID NO: 13264 - DNA, 201 bp, Homo sapiens
tttaggccaattttctattttttccttctatagactgaattttatttttataccaatagtttcaatcttctaaacttctcccattcctctttactttctcmactgcatccacttaaatacatcttattgtttcagtcagccttggctgctataacagaatggcatagattgggtgacttaaaaacaacaaatatttattgc

SEQ ID NO: 13265 - DNA, 201 bp, Homo sapiens
ccaaagtatcgtttacactcttgagggctaaagaatgccagatgtatttatctaacttctgatgtgcctcccaaaatgccctatacagaggataggatcartacacacttgatttcaaaatttctatgacttgattctacttacacatcttattgatttggagaaataaaggtacttcttgggggaaaacatgactacatg

SEQ ID NO: 13266 - DNA, 201 bp, Homo sapiens
gactcaggattccactgactgttctgccactgtttaaggacgatattacagttggattatagatgacctccagtggacacagaggtgcttagattctactragccaccattactttgcctaaaagaaaataagagggtcaaagggactaacttttgtgtaagttttaaggttttattcaaacacaaacacacacaatcaca

SEQ ID NO: 13267 - DNA, 201 bp, Homo sapiens
aaatatcacctggatgaaagacctaactgcagcactatctccaggacacacacacacacaccagagtccccacgtgcagacaggcactgctgatatattayagtctgttggccattttgtttatgataactaggaaaggaaaaatgagcccttatttcagtgtgttcatcccaagatgatgacacagtagattccccttgc

SEQ ID NO: 13268 - DNA, 201 bp, Homo sapiens
atggattataatgccaccgtggtcccatgacaaatgacaaggaggttgcagtaatgaaattttattactgcaaatagagaccacatctgagatctagcacsgccacatttaccattgtgggaaacaaaatgaaacacctgggaaaggatctccactgactttagcagtgagctaacaggattaagaagatctcccagaaac

SEQ ID NO: 13269 - DNA, 201 bp, Homo sapiens
aaacagaatgaaaatagttctatagcaatcggaatcttatatcactaaattctgggaggtagaactgaaaagcaacttctttctttgaacctgaaaatagraaagctaagaaacaggagagggaaataaaagaagaatcagcccagagctatcatccaggcactgacaaatgttccttataaagtctctgattgttgtccc

SEQ ID NO: 13270 - DNA, 201 bp, Homo sapiens
ccctgtcacttgccagcttgcccacaaccttgagaaggttcccgctgtcgagaagtttctctatgctttgatctccatgatcatatatatgcattttctcrcattaaaaccaagtgaatgctcagattgacattactataggacacttcacaaaaaaagaaagtactggctagaggtatgtttcctaaacacacatggcaa

SEQ ID NO: 13271 - DNA, 201 bp, Homo sapiens
taaaaattagaaagcacatcatatttatttagccatatgttaaatgttataaatattatagtttagggactcagtaaaatgaataattaaaaatttgaggrtcacttctaggtacaatgtaaccagggatgtaagataaagaatttcttgatttccaaccataatgcatctattttaattaaataatatctttcaagatta

SEQ ID NO: 13272 - DNA, 201 bp, Homo sapiens
tggttagtgaattacaagttttgttttccctattgtcacatggaagctctagtttaagtagttaatacaaattctggcctgcagaagttgtctctaattaygaaaacttagaattattatcccagccataaaatacaattaccctgtaccgtttttcctctgccccagagctgcctgaacaccaagtgtcctaccacccat

SEQ ID NO: 13273 - DNA, 201 bp, Homo sapiens
tgattcaggtctcaagctgtggttggaaatcagtgactttcactaagggattgtcctttcttttctttaggacatggctttttgaaattaatcttgattcyttctgccatatcccaagccttacatttttttcctttttttctctatgtctgatcattttgctttaagtcaaattgattttttaaaaattaaatgcccatt

SEQ ID NO: 13274 - DNA, 201 bp, Homo sapiens
ataagaggaaaggcacctggggaaatcttgaagggatcatatgtcaaacggctgaagagcaaacattaaagctttattttgaaaaggatatttgaaaatakttgacaccaaaaattctgtagggaagtaattcttgtggagtttgccttctttttagtttaactcttctgaatcaggtacttgttataacaaatcatatat

SEQ ID NO: 13275 - DNA, 201 bp, Homo sapiens
aatcattttagtacataatacctcagcagaaatggatttttgatttgtttaggatatgaaagagaagtctaatattaacatgtatgcacaaaacatgtatrttcaaccagcaacagacagcaaggaataggggcatgaacattcggatagctggacgtaatacaccagggttacatctccggcatggttccattcccattc

SEQ ID NO: 13276 - DNA, 201 bp, Homo sapiens
atagttggacatgataactacatgtctacaggctcatcagagagagagcacaggcagaggctagagctcaatgcaaatatcgagactgaaaaaggttttgraaggctctcaaggcaaggatttaccctgactcccatccccctgctgttcaaggctccttactgggagaaagaactttcttttctaagccttaggtgagtg

SEQ ID NO: 13277 - DNA, 201 bp, Homo sapiens
gaagtaatttaagaatggtttatttgaagatctctttgtataatttatagatttctcagtgtgattaagaaatgaagttattacatttttttctctaattrgtaatgcacgtatgcctccttttaatgatattatgatgtttactactcatagggccattctttcttgagtatagccatcactttctgttgaagaattgat

SEQ ID NO: 13278 - DNA, 201 bp, Homo sapiens
tttctatgaaaacgtctaaaaagtttactcaactttattttgaatgaatagaatgttgtaccaagatctaccaaggtagaccattataatgatctctaatygatagctatattctttcgccatgggctattgaaacaccaagaaattaacttgcctgtctctttttcctctttgcctgccctctccatttttttctatgag

SEQ ID NO: 13279 - DNA, 201 bp, Homo sapiens
tattttacacttcggttgtgtgcatacacttgtgtatttgatgttttatgcaacaaaagtgtaagaagttaacataatgagttggaaaagaaaaggttcaygaaaggcaaaacagcagtctctgatttgctggagacaacaaccactgttaataaaagagggcagcggttataactgatgttagaattttcctgtatagct

SEQ ID NO: 13280 - DNA, 201 bp, Homo sapiens
taactttctgccaagggttttggaaatcttttttgttcttgaccactagtcatcagaactctgccctgtgctccattaaaaacttaaaagcctcatcttcragcctagtctggtcttaaacacattctgttgatcacatcaaacctatgttaggactggggacccaacaactattggattctattcaaagtttaggacaat

SEQ ID NO: 13281 - DNA, 201 bp, Homo sapiens
acagttacaacacatagactattctattaggttgaagtgtatgaaaccactatttttgtagatcaaaatggttaaatattagcaatatcacatggttctaygatgacacacagatttacagcatgttgttatcaatggcacttcgaggcccagactagaacctcagatattctccaggtcttcaaataatcaaactgcctt

SEQ ID NO: 13282 - DNA, 201 bp, Homo sapiens
ggtctagtcgatgaaagggtcctgagggcagacgaagtgtgaaagctcccaggagaattcatagagatgcccttccaattaggatgtaatatttacaggayggaatttccaccagaactactaataaagtgctggctcttatttctaggcatctgaacagctgggagggaagtggggtcagttcttggctacccacgggtg

SEQ ID NO: 13283 - DNA, 201 bp, Homo sapiens
gcttttgaaagggctactttaaaaaaaaataataaaaatctatttatgtgttgtataaaccacagtgtctgattctctcctgtttctcattcaaagaaagsgtgactgctaaatgatttctggctctgtcatttaagaagactgcacagcagtggtcttagttgggaagttgggaccacaataagagtgctattgtaacac

SEQ ID NO: 13284 - DNA, 201 bp, Homo sapiens
cctgccaaaatctctctcctcccaggagatagctcccttttctccctgattgcttcctctcatgaggagaaggtcattggcgctcaccacttccagggcarccctttatgcaagcagtgggtgcctttgaaaggcaaaccgcagcaggaagactttgaaggcaagaagagactttttcatctttgcaggccccagccagaa

SEQ ID NO: 13285 - DNA, 201 bp, Homo sapiens
gcatatccagtctctccatggactggccttcacatatgctttgctatctggtagaaatatctgcccaaaagattattttttatggaaataatagtgcacakgcagattctagatattattttctatttatcaactgcattcaggcagtgctaagtagatgactgatgctgaaattttactagatgatctttgctctctatt

SEQ ID NO: 13286 - DNA, 201 bp, Homo sapiens
ctgttcagtctatacgaattttcaggctgtatagtttaaaaaaaacattgttcaatttcttatacgtttttactagtgatattactttagaaatgggcctygaaagactcaggttacttttagatttgttcagggtttaaagcttcttttaggcacttcttgggcttcttctacctttcactgtaatatagtggtgaagag

SEQ ID NO: 13287 - DNA, 201 bp, Homo sapiens
cacagctgatactcagtctcctatatttcttgtaatagattccctgggactggggagtttctgcgagactcagaatttaaaaggtgcctcaagtcgaactrctattattgcagtcagaactgtttttgctctcttcaggaacagccttacctgtgttcagggactattgtgtggtatcatgctactggtctacattaccaa

SEQ ID NO: 13288 - DNA, 201 bp, Homo sapiens
cattagagagccaacacttcaactttgacctaaattcattcttttcccattccagagaacacgacatacataatagctttagttctgagaatagagtctgmatttgagacaaacgtagaaggaagtgcccagttaattatccaaatgttggactctacctgtgattatccaggcgatttgatgctttacttggaaggattt

SEQ ID NO: 13289 - DNA, 201 bp, Homo sapiens
ctccatgtctacagaagaagttatgaggaacaaaggtatatgcagggctcgttttgtaatgctgacaacagcaatcctcacatccagacttccatgtccaygtacagggttctctactttcgttctaagtcaaactgtgattcagaaatgagccatccattctcccagaattcctccattcaccccacagacacaaaaatc

SEQ ID NO: 13290 - DNA, 201 bp, Homo sapiens
aaaagaataacaaaaaataaattcttactacctaattccagacacagatcattactaccagtagtatgttaatcatgcttgccattccttctccttcgatrtcattatgctttaggatagaaaaggtgggtggtatgtgagcctccttggataaacaaaacgttggagtgcacaggcttctcaagaggtacaatgttattt

SEQ ID NO: 13291 - DNA, 201 bp, Homo sapiens
gctaatctgattcatatctctacctagaagcacttaaagaagctgtcagatgattcccacagtgacaaatttgagtcccaaggagatgatggagtgaaatyagacacattttgggaagaaattcctactatcttttcaaaggataaactcccacagtatttgtgccaatctcttttacagcattcctatctcaaaaaccag

SEQ ID NO: 13292 - DNA, 201 bp, Homo sapiens
tatggatgtgataacatggagcggagaggtgccataatgatttcctttcaaatggctgcctcaccatttatctttgcacactgtcaaagactgatattgtygggagttagcagtggcatggaataattaatctcgtacgggggaagtaagttcttcatttgtctcctgagaaattagcactgcattgacagcaaaagtaga

SEQ ID NO: 13293 - DNA, 201 bp, Homo sapiens
ttgcattctggggaattggattcaatttaaaaagttgaagctgcttgctggcttccttcctggtagttttgaatgtgtaatctcacaaagatcttcttagytctggcaaagctgagcctgtctaaaacatttatgttagaatttacatgagttcatttgtgctggcgtcaaacatttcttgagtatttaccatgttattgg

SEQ ID NO: 13294 - DNA, 201 bp, Homo sapiens
aaaaaaaaaaaaaaggagaatccagtaggaattcattgagtaagccaaggttacaatctgctggacttcagaggtagagttctagatgcccattttaccamcctaggtcagaagtggggagcagagagacagaaggctataagtgaggagacagtactgagacactaagtagacattctagccaactctgtagaggattct

SEQ ID NO: 13295 - DNA, 201 bp, Homo sapiens
agtacatttgggaattggaagatcaacaagtcagtaaatattggtcacatgaagaaggggaaataaatgagcattattgaactataatatattgagtcttsttatgcacatagtaggccaaaagttttgttttttgcataagatctgtagattcattcattcaatatttattgtgcatgcaatatgtaccaaatacagaaa

SEQ ID NO: 13296 - DNA, 201 bp, Homo sapiens
cataaactggaaaatgtgtatagttgaaaatgtttgcataccctctgtcctagagcagtgcttccatcttagctttgaagcacagagacctcctcttactraaagatcatgaaaactggcaatactgtattgcccagtgttaaaatttgtcagattaattacccagagccaaagttagcaaactttttttctgtaagggct

SEQ ID NO: 13297 - DNA, 201 bp, Homo sapiens
aatatctccagagaggcaagtgttgaaacttcatgcttgtttttttgttctttttttttttttttccaaagataacccactgcattcactatcacccacarcattctcacagttcagaagaattctattaaattttttatacactgtcttttttgatggcagtgagccccttttgctggatatcagccctagaggcatgaa

SEQ ID NO: 13298 - DNA, 201 bp, Homo sapiens
gtaggaacaaccaacctactctacaaggttttactcttcccttgaaattacacttcaaaaaaacatgcactgactccccccaggcatagaagcaggatccrtgttttaattctaaccttaattaaatctttacacaaactcactatttggctgtccaatgaagaagggcaagtagaaggaaggaagtgaagagcatttgct

SEQ ID NO: 13299 - DNA, 201 bp, Homo sapiens
ggaaagtggtcattttcagttctgaaggtgagagttttgaggtttggatgactatgaaataacccagtgagaatacccatttatcagtgggaaatcctgarctagagtttgagagagtctgctaagctaaagttgtggatttgcacgttagcctcctgaagaggatggttgaattcataaatatggatgatactctacaga

SEQ ID NO: 13300 - DNA, 201 bp, Homo sapiens
ggatgccattgtctttttttaagcaaatacttgtagaagtgatgtctaaaagaataaagcttctcttctatatctccaaatagaaaatataatcaaaatcygcttttatgtaggatggcttttttaaataaataagcagaaggatgaattatgtggctataaataaatctactgacatgtaataaagcaaagtcgaactgt

SEQ ID NO: 13301 - DNA, 201 bp, Homo sapiens
gtttttttttaatttggagaaatttttaaaaattaaataaaaactagaaataatacttaatgtcttgacaaagtattaacttgatctagtttcagaaagakctcattaaactgcctgataaagtgattattcagtgccactttcatagagttttcagtaattatctgaaatgatttttagaatgaggcaacgttttccttt

SEQ ID NO: 13302 - DNA, 201 bp, Homo sapiens
gtgtaaccagtttctgagctaaaggaaaattcacttaacaggtagagaagaatagatgtgagtaggcaaccatacaatagtgtttgttttgaggacaattwtgagtaggttttttagatacattgtatgtcacttgcaagtgtataagcagagtttgctatttttttgagatattttttgagtaactgtcatttctttgtg

SEQ ID NO: 13303 - DNA, 201 bp, Homo sapiens
aaccagggtagttgggggccattgtgtattgagcactgcccaactcaattcacttagcttgcaatgtgaatggcttctctcttctagaggtgctcaaggtrcaacccacataatcacacctgatagccatgttgtcaatgcccaatcacattttaaacacttggagggcagagactatgacatagagaaagatttgaatag

SEQ ID NO: 13304 - DNA, 201 bp, Homo sapiens
agtacccaagtctcactactgaggcgagtcaggggtaaagagtttagcactgagtggctgaggatacgtatcaagggaaaatgtcatccttgggacttctytttaaataccagaatatgttttgttttgttttgatttgttttcctatcagggatgtgtctttattggcaatccctaatggaaattgctctctaattttcc

SEQ ID NO: 13305 - DNA, 201 bp, Homo sapiens
tattttttatttctaataagctcgtgtcttgagcagaaacactaatacccaggaaattttctgaggactggctcacttaaaatgaagggaagtcactccaygctctgagttgtcttctctcatcttcttcatgtgaaatcctggacacttgcagattcatgacaattcagagattattaatccaattgcttttaataaaga

SEQ ID NO: 13306 - DNA, 201 bp, Homo sapiens
gatagttaaccaaggccatgggcttcgttcacctagaaccagcctaaaattaaggatgctggccagagtacccaagtgtgatgcttgtagcatttaagcayacagataaattctttttgaaaaatttcaaacaagtgtaccatgagcggagtcagagcccctcttgaaagcaggttggtaaatttccagaaccacttagca

SEQ ID NO: 13307 - DNA, 201 bp, Homo sapiens
caactctccctgatcacagagcttccctacttggccataggatagcctcatgtgcacttagctcaatgttactctgagtttctttctactccgtctttctygatataatcctaaaagttagggattcccaggaattatcatggaacaactggcttatgtcttagtttcctatcactgctgtaataaatcacggcaaccttt

SEQ ID NO: 13308 - DNA, 201 bp, Homo sapiens
ctttttaaaaaataatcactgcgatactgttcatcacacagaaacacacataaattgtttttaaaggaagaaaaaagggaaagaggaaggagtacaggcgygtgtttggtaaggtgtcaagggtcataggtccttagattctactcaggtttttcttcataaagatgccatttctattggaaagtgatggctctgcctctg

SEQ ID NO: 13309 - DNA, 201 bp, Homo sapiens
gaggaaggggaaaagggtttagaagagctggagaagggagcatattggggaaaagttgaaggattgctaagtagctgaggttgagagtgacagaaccataytgtagttgcatttgttggcatagatggggttttggtttctagtgcctatctgttgctcaggagcaggggaagtggttgcttagattcctcaagatagaga

SEQ ID NO: 13310 - DNA, 201 bp, Homo sapiens
tgtggccgggtctagcaaaaccattcattctttaatctatcacctccccttatggttactgctcacatgtctatctctcctcacccactaaaccctggctsggatctttgggactccaggaacttacagggtgcctagcaagtagcaggtgtttttttggtgtgtgtgtgtgtgtgtgttggtgtgtgtgtgtgtgtgtgt

SEQ ID NO: 13311 - DNA, 201 bp, Homo sapiens
aaccagtgaccattcatcacagacacattttctacttcataaccaccataggtggacgaatcagagctagggagtacaggagggtgcagggaatataggawtgtcatttgggaaggtgtggtgggaagaggagatgtctaggatatccactgggaaaagggaggaaatgtttggaaatatttgcagtagatttagaggaac

SEQ ID NO: 13312 - DNA, 201 bp, Homo sapiens
agttgacaaaccaggtaagattgatctaggggtggtggcattttcccctgtgccagcacacttcttcagctacctcctgctgttttattttctcatactgrtgggcctgtagttttccagagcgccactgcatttaaatctgtattctattttctctcctagaaaataggtcagactcaaggcagagttcaccaggtgggg

SEQ ID NO: 13313 - DNA, 201 bp, Homo sapiens
tggctcagcaacagggatctgaaactgctgatgctctattgagacctgaagcacgggtgatggggaaaagcaggcatcttctgatgcatgattctcccagsaaccagaaggccctacaacctctggctgatctctgactacagtcttgactgcggctcttgcccatcctagggtcactggaatcagatgtccatcttccca

SEQ ID NO: 13314 - DNA, 201 bp, Homo sapiens
ttcaatttagctatttctatgaaggggtgaaaatccctaacctcttgatatgaatttagcattcaaaggcacctgagatgaggaaggcagaaagtgttcastataatttgggtctgcttcctgatttttctcaggtttggtcaagaggctgaaaagcaaatagaatgcaatggcaggcacacacacataaggagcttattg

SEQ ID NO: 13315 - DNA, 201 bp, Homo sapiens
gtcattcatatttcagagtgctgctgatttctgtgtgagtaaatgagataacagatgctaaagtgggatatgaatgcatagtatgattatgctgcaattgmctctcattcttttaatcatacattttgactgtatcgttttaatttacggaggcaccctaaggcctaataacatataatgcagcatgcaggaaatcaaaca

SEQ ID NO: 13316 - DNA, 201 bp, Homo sapiens
cagccaatggcttccagataaaagtgagaaggccaatatagagctggggttaaacatgtcaagaattcaaagctatagtgcccctgggtattcaaaaagcrtaaagatttgactaaattcacagccaaatggcatttaccccaggtctaccccataccagtcactggcttctctctaatagttgttatcccttttaattct

SEQ ID NO: 13317 - DNA, 201 bp, Homo sapiens
cagactccctatgctcattatcaaaaagcccatatgctatcttcagttcacattttgctcacctctttctcttcattgcattagtcaagttcagaaactaractgtcagctgccagacaggctgctgtttctctcagagataggtgaaaaccatttaggaattcattatcaaagtgtacagcccaagaaggtgtttttgcc

SEQ ID NO: 13318 - DNA, 201 bp, Homo sapiens
cctttgcaccatataatctgttttctctatgggtaaaaatcacattttaatgatggggtggaacttcctttattccaaaactcatttgtagtcggggttgrgcacatatctaggtctgataaatcagaatagcctattcttctgtccacagctatttatttttaatgttttcaagctgattttacctttctgctagagtca

SEQ ID NO: 13319 - DNA, 201 bp, Homo sapiens
tacctgaatgatgcagctttttgaaaaagtctatttgtaggtcattaacaaattgagattcaggaaatcattgtatggtttaaataggataaaatttttcrctagaatgcttgatctctggggattcccagaagcccattcatgaaagtggttcattcatgcaacaaatattttaacaaatgccaagtatgttgtagaatt

SEQ ID NO: 13320 - DNA, 201 bp, Homo sapiens
atgtttatttggctctccctggccaaccccagtaatggttgggtacaaagaggaattggggtagataatgttggccataaaggatatgtaatctggttatrttggtagttctgctgtcttgccatagaaaagggagccaaagggttttaactagagctctgtcaccttgggagaaccctcgggaaagaaccactgtccagg

SEQ ID NO: 13321 - DNA, 201 bp, Homo sapiens
aataagcttcaaaaatggtagctggcatcatcactatcatcacccccatttcaagggctctgggagtttcctggtatgaaacagtgataatgatgcttacwgtttaaggttatagaattgaggagactatttgtaaagggcctcttgcgatgacaggcacgtaatagagaaaaaataagtattggctcctttctctctcct

SEQ ID NO: 13322 - DNA, 201 bp, Homo sapiens
aaacttttcccctttgaagggtactggatgattaatttaagcttctctttataggcactactttccttgctcatttttctcagttcagtgggcacacaagrtataacttaaatgtttatagaagacacccattaatataccacttgcggtgccaaggacatgcacagtagttggctttgtggacatccatgtctgtagaaa

SEQ ID NO: 13323 - DNA, 201 bp, Homo sapiens
gagtaaaaacatcccagtatttatagactattaggggagagggggttggagaggcaggtgacttttcagccctacactgatgacttttatgtcttccaggycacattaaaatgttttgcttgaattagaataaaagtagtcctttttgtccactctaaattcagtgtcttggttgaaagtatccacagaaaacattcctca

SEQ ID NO: 13324 - DNA, 201 bp, Homo sapiens
actctctggccaaatttgaaggggatagtactgtagctgattaaatatataatctaagaactgtggaataaagataggattaaaggttttttaaatctcaratcagtggggttgatgctctttgtgtttctgttctttttgttattgttttctcttgttattttgaaatttctctaaaaactacttaaaagtatagttagt

SEQ ID NO: 13325 - DNA, 201 bp, Homo sapiens
aaagacctactcagtgacagatactgaacccaatgactggtttgattcctaggaatgtgagtgatattctcttcctgtgttttctaaaattatttgcctartgaatatttaaacaaattcacatgttgaacatcatagtgtttcaaaacagcccctggacttggtatcagatatattgagtcaaatccagagatgctgtgt

SEQ ID NO: 13326 - DNA, 201 bp, Homo sapiens
tacagaactcacccaaggttatatggtctctcagtgacaaagtgaccataatacctcaggcctttaccaagttagtattctctctaagacactgcatgacrgagtccatagtgatttcaagttagcccaggggttaaaactaaccatagtacatttgaatacggattaacatttggtgtgtcctttgaacaaaaggttaaa

SEQ ID NO: 13327 - DNA, 201 bp, Homo sapiens
tggcatatatgaattgttttttttttctttctcccaaaggcataggttaggcatatttactgtctttgccaggccttttctcactttttaagacatccgawtgtgtagatttccttccttttcaacatttacattggaagatgaacatatttagaatgagccaaaagaaaaaatgctgcataaagcagtgttgaaggaagt

SEQ ID NO: 13328 - DNA, 201 bp, Homo sapiens
cttcccttttgtgaagaaaattcaatttttatgaattagatttttaagatggcttgtaatgtacccatacagccaggtataagaaattacctggtagcttsactgatgcagatgacagatacctgtggggacttacagtctagttgggagagtaatcacacacatacacacacacacacacacacacaccccagatttggc

SEQ ID NO: 13329 - DNA, 201 bp, Homo sapiens
taacatttccttaaaaaaccacttccctaaaataatccttgaggaaacatatttgtcagaaatgttcacatcatattccttttgttctggtttatctcatyctccttgacttctccacatctctaagtaggaagttatttattgctgctgaagttgtaaccctggtgatttcgctatcaacttacaaatcacttcctttcc

SEQ ID NO: 13330 - DNA, 201 bp, Homo sapiens
attaacattctctacttagatccagcagtgatagtttaagcagcctcaagagaatcaaaggatttttttttgtgatcaatatttattacttaaactataaragagggaaaaatacatgtaatacatacaactaatatgtacccagttgcagatcataactttcctagttattaaaaatgcaggaaagttaatggttttgag

SEQ ID NO: 13331 - DNA, 201 bp, Homo sapiens
caatgttcccaaactactatgtttgtgttagtcattttccgcttatcttgtccccaatcataaaaattaagcgatgtacaaaaattgcctaaagaacagaygccaccttatagaagatgttttaaatagcccgtacttgtagcagttctgccttcatagctaatattctccacgtctttcttcacttttttctttcttatt

SEQ ID NO: 13332 - DNA, 201 bp, Homo sapiens
taactacatatttatgggtctctctccttaggcgtagagtatgtgtctggagaacagatgtagggttctacagatccttttattattcaatcattcaaaartcacatgtcaatcatcctcccatatgccagttccttccatcagtgagtgaatcactctctagtagaagagatgggcaaaccagaaattcagaacattaca

SEQ ID NO: 13333 - DNA, 201 bp, Homo sapiens
cccccctagtgtgtccaatttcagctagtttatagaaatgatgtaaagaataggtctggctcacaagaaatcaaaagcaaggatagaaatattcctcaacyttgtgtttatcatttattgtaatgtgattgtgttcttggaaaagcattaagttcgggtgacagttaataataattgattgatctatgtttctattattaa

SEQ ID NO: 13334 - DNA, 201 bp, Homo sapiens
ctccatgctcatccactatatgctattgcttcataggaataggaagctacagcttgaacctggccagaattttccataactatatgtccttcgtcactctragagctggtttgtagactgcttgttggccatcagtgcaatatggaagtgaatgtgtgacaaggaggcaaggcaacaatgctgctttagggagggtgctgg

SEQ ID NO: 13335 - DNA, 201 bp, Homo sapiens
gttaaccaacatctttttttcttatactaagagagtgatttgtcactagttgtcaaaacactgcatagaagctcataacatgtaaatctaatttttgtgcktatagggaatataagaaattttatttttatttttttagagacagcatctcgctgtgttacctaggctggagtgcagcctcaaactcctgggctccagtga

SEQ ID NO: 13336 - DNA, 201 bp, Homo sapiens
ctggtcaacaaagattatctaatgtggttgatcagcttttcactgtcccgttcattcttatgacaatttgccctaactatgcacaaactgagaactctttytaagggtaaataaatgttctcattcatcctcacaattgatttaaaatattgtaacattttctaaatatgtacaaacagaaagctatctcatagttcttgt

SEQ ID NO: 13337 - DNA, 201 bp, Homo sapiens
gtttatagtaaaaaaacacgaatgtggataagcttgtgaaagagtaataaaaaagaaataaagaataagaaacctgaaatgatagaggaagaccaacatamcttaccattatgagattttatactaagtcctgaggcaatgatcaaagagaactagagcaggagactgacatcttgtttctcatcctagtttatctatcat

SEQ ID NO: 13338 - DNA, 201 bp, Homo sapiens
aaaccaggaagaacatattccaaagtgtttaaaatagttatatctgagcgtcggaattatactattttaaatacacttttaccaagtttcctataatgagyatgcgttctatgagaaaagggctaaaaatagatgaaagttaaacattagtcactaattcatctcataaacctacttactcctgggaactattaacttctg

SEQ ID NO: 13339 - DNA, 201 bp, Homo sapiens
ttatcatagcatgctggttctcagaccttttctgcacactgctaacatccttctcacctttctttgcttggctttttttttcactgcaagctctcccatgytcatttctcatttgccatcagatttagagtaactggcttatggcatcaaagaatgaatcagatgggagcagctaagtaaactgaatgaagctgcttcctt

SEQ ID NO: 13340 - DNA, 201 bp, Homo sapiens
attttaaagttgaatttctggctattactaggataattttttctcctggacattttatgtatttatgtatctactttggtcagggtgacaaatggtatgtkgtatgcagagcttaactactactcctagcccccaggccccataatcttttagtggattcagccaagcagaaatgtatgttgaataaaaccatgtccaggg

SEQ ID NO: 13341 - DNA, 201 bp, Homo sapiens
tctaagagtatcccagagattggttctatgaatctagtgaaacacagaataccctactcttcacagatgggtgtttatttgcatgagtccataggcatgtragcttttgttccttagctggaggattagagggaagaaatgacataggtgattagggatgggggagagctgggatgaatatggagaaaggttagagaatgc

SEQ ID NO: 13342 - DNA, 201 bp, Homo sapiens
ggtttccatttctacatggtaggcattctctagtttacttttcctcttctttctgtagaaattaactatttttgcttcacagtcatttcatgatagacccratttcttacactgaaattcattttaatgtttggattgagcaatggtttgctttggtcttaacttttatttattgaggtataacttacatacaatgaaaat

SEQ ID NO: 13343 - DNA, 201 bp, Homo sapiens
tagtacattctgaaatatgtagcaattatttctctatggcttcataaagaaaatgtcaatccaaggctgaggatttatttatgaaaatctaaagacagccrgttttcctgatggttcatgccgtgggggaacgggtctctttcccaatatataagaggacaaatcttgggatgggttttttttttttttggtcttttatga

SEQ ID NO: 13344 - DNA, 201 bp, Homo sapiens
tatatttttcatgcagtcatttcagtcagtatcaccatctaggtttcctctagggaccacatatcaatgactcttaaaatcactgttgtgcaaggtgagtkggaaaggaacaggatggtagagtttggattggggaacagactttgagcactgaacagcaggcagcattgctgttggcagagtaacggagaaggcgctgag

SEQ ID NO: 13345 - DNA, 201 bp, Homo sapiens
agtaatttgcccaaggtcagtcaggtctgacaccaaagccaatgcttttgttccctcacatcttctcttttctagacacatgagccagcggagttgatttkcatggcagctgtgcatgatagtttcaagcctgggcaactctatgggtattcgccacaaggcttccgtgacttctaatgaactgaaacaaagcagttagcc

SEQ ID NO: 13346 - DNA, 201 bp, Homo sapiens
ggagaacattttctattccacaaacattgggtgtctcataagtgcaagactttggagaaataaagaatgaaatagaaatttttctgctttagaggaacacrcagtctggtactgttcttaaatattttcagactacaagcggactcacttgcagcccagttttttacaaaaactttagcatgctgattggctagtacagtt

SEQ ID NO: 13347 - DNA, 201 bp, Homo sapiens
gcagccaggcccccactacaggcccacccagcttgatggcctcaccctgcatcttgtcctgtctctgaactgctaaatctcaaaactttaaagccctaatrtcttgctgattaaccataatttccaaatcttatgcttaagtccaggcagtttttaatttttttttattttttggcttcagcaaatttttcatttgtctat

SEQ ID NO: 13348 - DNA, 201 bp, Homo sapiens
ccttaaaagaataacaaaaaataaattcttactacctaattccagacacagatcattactaccagtagtatgttaatcatgcttgccattccttctccttygatatcattatgctttaggatagaaaaggtgggtggtatgtgagcctccttggataaacaaaacgttggagtgcacaggcttctcaagaggtacaatgtt

SEQ ID NO: 13349 - DNA, 201 bp, Homo sapiens
ggttttcatgcctccttcccctttgttttctcctttgccaagtctccattctcactcttttgtggatgtgtgtgttatggagacgaatgaaatttcagacrcagcaatgaattgccacctaaaaggatacaccccagggtcttctgtgttcctttgcagctgtgtgataaattgccatctccaaaattaattgttaccttt

SEQ ID NO: 13350 - DNA, 201 bp, Homo sapiens
ccttattcccaggagttttgtttttatttgttcttgtccttggagggaacaaaagacagctggtagctgttccctgtttggttttgcatgtattcaaaagrcatcatcttctactgctctcttactcctttactttgtggtcatttgttttgcagctatttagacagttacttcttaaagaacccctaaaactatttagac

SEQ ID NO: 13351 - DNA, 201 bp, Homo sapiens
gtatttaatcattcggagcaataattgcattgtaaatattagctcagctgataaggagtagagaaccaagagaatgagggagccgttacattgttttatcktgtttgatgcctttactcagtgctctagcatgggggccatgtctagggagggaatccactgcagctacatttaaggtcacctaataaaccgtgctgtttt

SEQ ID NO: 13352 - DNA, 201 bp, Homo sapiens
tgaagtagaaaggctatgtttgaagattctgtctgattttgggcatcttggttctagatctatcataggtgcagattaaattgtttccaggctgtacttgrtagttggtaaggatcaaacaataccctcacataacttgtcctagaactggttgtgctatggcatcattgtagtcccacatcctagcatggagcctaaaaa

SEQ ID NO: 13353 - DNA, 201 bp, Homo sapiens
aaaattcagtgtttttcactgagcaaaatagcttgtctggtccaaagccagtaaaataagaattttgtgggtggggtatctactccattagtatagcaaaygttgagatatataaattattttaatatatttattttattgacaatataaaaaaaaatttaacaggctccacaccaaggtcaatagaattcagaagcacat

SEQ ID NO: 13354 - DNA, 201 bp, Homo sapiens
ctttatcctgctctagtatatgcattgtggaaaagaagaaaaagaatatgctggctattgaggatgggtagaggttttagggagtgggtgatacgatttgyttgaattcctatgtagtctgctgtctttagtgacaatgaataattactgttgggtgacgcttatgagcccaacactaattttaagattttatagctaatg

SEQ ID NO: 13355 - DNA, 201 bp, Homo sapiens
ctatccaactccattacccaagattttttagtaggttggagagcgaggcaggggaatccataaaatcaatgtatgagtgtatatacttctatctgaaagtytgataaatctcttctatatgtaacacttttgagtaactattacatgtaggcactagaataggtgctgggaaaacaaaagtattttgcttcagaaatatcg

SEQ ID NO: 13356 - DNA, 201 bp, Homo sapiens
gctctatttggtatcttaaaattgtttccagccagtgggaggcctgtaccctagaagaaaatgagttgagttagctccaagtagtaccagtggtatttgcmtctttttaaaattccttaaaaagcatttaggaaattagttcttttccttcagcaaaggggaaataaggtactctcaagtgactatggtagagtttggtta

SEQ ID NO: 13357 - DNA, 201 bp, Homo sapiens
aagcacaatcctgccaaaaaggggtatgtatgcctgattttaaaatgctaactttaaagaatatagatagcttttatcccaaactaaagaaaaattctggrgatagcataggaaattaggattttgatggattacaggttttgtattactctgctcataaccctttatgactttgggttatttgcttccatgaatactttt

SEQ ID NO: 13358 - DNA, 201 bp, Homo sapiens
tctgctcccatcctgagatacacatggccccaacacagagtgtttggcagagacatcatttgattagagaaggcatagctttctgtattgtgaggagtcaratatgaacagtgggaattctggagggcacagagggaagaattcgaaagaggcattgggaggcagttggctacccagggccagagagcagctgctggagca

SEQ ID NO: 13359 - DNA, 201 bp, Homo sapiens
aattatagagtggtgtatgcattaaaggagacatatgtgtaacagtggtctctatgggtttattggtctctcttcacatatggcagagaaaagaccctgtraagttcaggagtgtgattaaggtactccaagaagtcacacacaggaggtccagggcttttactggactcactgttcttggactggctctcctagcctggg

SEQ ID NO: 13360 - DNA, 201 bp, Homo sapiens
gcaaacagtacgggggtcatataattcctcgattcattttttcttcagcacagttaaaccattccttattttttcaattcagttttatcttactgaattayttttaacaagatcaattctgctccatatgtattctatagtgaagatttgattcatcaatcagttatttttcgtgtgcctatcaaattttaccgacacggc

SEQ ID NO: 13361 - DNA, 201 bp, Homo sapiens
ccactgcatttaaatctgtattctattttctctcctagaaaataggtcagactcaaggcagagttcaccaggtggggtcccagaaggtttgactgggactygcctacaggaggctggctgtgcagcctgtcccatgctccccagagctcttccagaggcatgggggagttgaagtagcaagtcaggagaatcttggactca

SEQ ID NO: 13362 - DNA, 201 bp, Homo sapiens
ctaatcctcttatcttgctgtcatttatcttcctaaaagtgaaaataaagcaaaattaaaattaaatcgggtcatgtagctcatctgttccaaagttttgsgtagattcttcttgtataattgtcaaggtgccttccctgctttattttcagtgggcataccccctctgcccacctatcacccctgccagctcccccatct

SEQ ID NO: 13363 - DNA, 201 bp, Homo sapiens
gtgcagttgagtagttgtgttaaagactgtatagaccacaaagcctaatctgctttgctgcctcctgatctagaagatttagactaggaattcaagtagayagaaaaccggtgttacaaggtttagaccttacttcttggcacaccccactcattccaagtgggattttagctgttcgctccaactttttgcatctcgcct

SEQ ID NO: 13364 - DNA, 201 bp, Homo sapiens
ggcaggtaggaaaactgtactgctgcagtctttgtagattagctcaattcagagacacctgtggtcttgtgaaatgccaaactttactccagtggcatttrggtcaatgtgaactaggatgggcctagcaattctattaggtgaatgacaagtgctttgtaatgaaacagaaggactttatttaaacagatataaggactg

SEQ ID NO: 13365 - DNA, 201 bp, Homo sapiens
ccaagttctagtgtctttgggcagcaagtccctcaacagactgtgagctccatgatgggaaagaccaactattgttcactgtgatagttgaaaaaatgaaygcatccaaatgcttttggattccagtttctctagagatgtcttttatgtgtcatttttgtagtttggtctcttctcaatggaataatagatactaaatat

SEQ ID NO: 13366 - DNA, 201 bp, Homo sapiens
ttctacctctgccagattaattagctctgtgtgatcttgcacaacttctctaagccttaattgtgagaattaatattgtatttattaggagtatggcacaygataggtacttattagatgttagctatcatcatcatcttcatcataatttgattttgcttttcttattccctttgatcttgcctcctagtctaacaggag

SEQ ID NO: 13367 - DNA, 201 bp, Homo sapiens
tggctgcccaatctataacgaatattctatctacagggcaataagcagaaaaggtgatgcagagcagccagccagatactatcatcctcatttctttaacmtgtatttctagatccttttttgctcagaacattgttatggcattcctcagaacgcttttagtctctctctttctcttttatacttaaaattctaaaccag

SEQ ID NO: 13368 - DNA, 201 bp, Homo sapiens
cacgcaacaagcggcatgttccaggttgttccagggccagagagagtgacatgaggcaatgtctgtggcaagcgaaaaatgtgtgctgagccttgggaggygccgattggctggcagtgaggtaatgcaatgcagtccaaatgtggaagcagcagtaccagcatcgagggcgtgcctcctcggcaagcctgagtctcctgc

SEQ ID NO: 13369 - DNA, 201 bp, Homo sapiens
caaactgtctctgtttgatattaaaatttgtaatggggaaacactcactggtttctaaaaccctatgtagatttaagtagttgatgattctgtgaaaaaamcaaataccttctagagaaaacatacaggttgggcagagcccaggtattgatgtccttgatgaaactggtttttgtattctgaatgttggagattgagaga

SEQ ID NO: 13370 - DNA, 201 bp, Homo sapiens
tggcagggatgagccaccggtcctcattttcttaattcctggacaaggtttttgtgtattctaaccaagtattcttgcttttctttgttctgattcattcrtctacaaagtgtggtcagaaaccttgaccaactgctgatatatacaaatatcacaacttctctaagtctgggatctcctaccacagttgagatatccaaa

SEQ ID NO: 13371 - DNA, 201 bp, Homo sapiens
ttgcccagtgaagtgtaaacctcactatatccaggaactatatcaacatctaggctgaaccagttccaggcaacccctgaaaaagtagttcaaatgtattyctaaaagattatgcaatctcttaaaaatacaggttgaatccttctatccttctcagtaaaattatgcaatggttccccataacttatagaagttcaaatt

SEQ ID NO: 13372 - DNA, 201 bp, Homo sapiens
tgttctcagcctgtaggacaaaataagaggagcacccaaagagtgctattatctctctgcaggatgttacctaggcttctgctggcttcagagatttcatygtcatttctgatggaattatggtaggcatagagcccttcctcactgggatttactcctatttggatagaataaaggtatagactatgcactgtctagtga

SEQ ID NO: 13373 - DNA, 201 bp, Homo sapiens
atcagaaactgggacagaagcagctattatgcctcctgtccctgtcaggactgggtcaggaatgagggcattagggcttttgtgtgtctctcagattaaaytctgctcacttgaggttaaaacaaggcagaagctggcctgagataatcaaagcctctttcaaatctatttgcttataaaggcaaggtgtttttggtgtct

SEQ ID NO: 13374 - DNA, 201 bp, Homo sapiens
caatcgatgcatgcccatttaaaggattgtttttgaacactggaatctgtcagttcttaatgcaaatgtagcatagcaaggccacatcttcttctggagcrggagttagaatccacgtgcagatgttctggacaaatggctttgcttccagatttgcaaaatgttcttgaaaacccttatccctataggcacagataccat

SEQ ID NO: 13375 - DNA, 201 bp, Homo sapiens
atccgctgacctggtgttttttattgaagttgtcctctatgcagatagtttaaaaacaagagaaaagaaagaccaggtggtaaacctcctattccttgtcwggagaaatagtgccaagaagccatctgggcactccagggcacatgcccacatcccctcattctttctagttcccttgctggagtgcatagggatggggca

SEQ ID NO: 13376 - DNA, 201 bp, Homo sapiens
cctagaactataccagagacagaataggtcttccatacacatttattaaatgattaaataaggaataatgtttcagttaaaatgtgtcacagggaatgctsaaaatattcactggcagggctggtagtgaatgcccaatctagagagtaccagtgcatggagagagagacagaagaggaagttccatcttttgggggttgg

SEQ ID NO: 13377 - DNA, 201 bp, Homo sapiens
gaaaagatacactagatgttaggtcactgagatttttctgggtcttcctaagggccagcttgacttagctggcagagattggaaccaaacggcctacattrtcttttccattgtcttgtaacatctaattctcttgcttacattgttctctcctggccagccaatggctgggctcagcactcacctgttaggtttcttaca

SEQ ID NO: 13378 - DNA, 201 bp, Homo sapiens
ctgcagtgagcgaagatcacactgctgcactccagcctaggcaacagagtgagactgtctcaaaaaaataaaaaataaaaataagtcagttttcctctttycctatttgaataaaagtaaaatgagtttttcaagggtgtcattagctttatgttattgttctaactctgcctctatcagatattctttgaatgggccaaa

SEQ ID NO: 13379 - DNA, 201 bp, Homo sapiens
tccatgccgaatctcctgttggttgaagaaggtgaaagtcaattggtaaagtcactgtgatttataatgttcaaactggggagggattgagtcgtgaagascagaagtactgataatcatttagcttatttgctggaaggctccactagaccctaatgaaacaatctcatttatcttccccacatcctaatggaattgcag

SEQ ID NO: 13380 - DNA, 201 bp, Homo sapiens
attaagtccatagaagttaaacttccggagagctcccaagctaattggtaccccttgttcaggactggggactattaactgagagaattcattgggtgttktaatatctagccttttaaaatctattttaaacaaggactttgaaggatgactgaaatgtggttaaatttccacagagaacttacaactccagcaatggga

SEQ ID NO: 13381 - DNA, 201 bp, Homo sapiens
tgaatagctgggtcacttgtctttctcacacctccctgggagacttctctgtagaagacttcaagaaaaatccctgcaccttccacacctgttgtaggagrtatggcagctattcctgagccttaagtactccagtaagaatgaaatgaactatttgaggtgttctgccaaacgggctctaaaaataattatgatttaaaa

SEQ ID NO: 13382 - DNA, 201 bp, Homo sapiens
tttttattcattggccatcacattccaaagttttacagtcaaatggacagttaaatatttgtgtttgaatctgaccactgtgaatatctcaaggataccayaagagctgatggacctccaaacgttagcatcactggactgagagaaagctcgttttatatctctataggtactgtcataccaatgaagcaatgttcccaa

SEQ ID NO: 13383 - DNA, 201 bp, Homo sapiens
atgagattacctgtttcctcaaataatgaaccaattaagcagatcagataggactctggtatttgaaaacaggaccaaaatatataatgagattctaattytgatgggtgagattacaatttgtcaatcagaagagagaattacccatttgggctggagaaatcaggagtggtttataaacgtagatcttcagactgaatt

SEQ ID NO: 13384 - DNA, 201 bp, Homo sapiens
aagaactacagagctgagggtactataatgtgtctctctcagtcattattcttttatgaaaactttggaataaagctatttgtaaattgcactttcttttrccactaataattaaaaagcagggccaagtcacgaaatgccattatccagtaatttgattttttgaaattaatgaaacgctttcattttcagacgtgtccc

SEQ ID NO: 13385 - DNA, 201 bp, Homo sapiens
tttctcaacaagatgaataactcacttcttctttggtcaacataattctacctaatattctctgtaaactagctctggaaatacatgcggaccagtgcttsagatttttagtaaatgtaaaaggtatctgaatggttgtataatgctgctttaaaagagttttaagggttggaacatggtcactgagaaatacacaagaaa

SEQ ID NO: 13386 - DNA, 201 bp, Homo sapiens
tagaaatcatttttgttaccatgtttatagcaacacaatagtgaaataggcaaatgcatttagtcacataacttggttttcttgggccactgctttctttyctgtgggagtgggagaaggtacaagcaggagagacatgatgcctttggactgctctgttaccttcagttttgtaaggctcctggctccactgaccagatt

SEQ ID NO: 13387 - DNA, 201 bp, Homo sapiens
aaaacaaattgctacgtaaaccatcttgctactagctttaagctctagtccaggtcattctgcattttgtcaatatagtaaattgagtaacagcctctgasggccctgcaaagagccaaggcccaatttaactccctagtgccagggtctccaaatgtttttggttgtctatacatactagaaaaaaattaactctgcacc

SEQ ID NO: 13388 - DNA, 201 bp, Homo sapiens
atcagataatttacttcctactttctgtcctcttctaactatttttagttgtattacttctgtattgtcagggtttattccattttcattctggtcttcarcatattattcccattaggttagacatagttcttctttaaaaactatactctgtgcttaccttcaatttcattgtcatagttattctaattatgttttggt

SEQ ID NO: 13389 - DNA, 201 bp, Homo sapiens
ctagagctatttttgaggtctcttttattccttcattcctgatctgaaattcattaaggctaagagtgccccttaaattacgttctgctgtatcctggagraacacctgaagaagttaataataaaccctagagattaggcaagtggaaagaattatgaaataaaacaaagcaaagaaattgtgtaaacaaattaattaat

SEQ ID NO: 13390 - DNA, 201 bp, Homo sapiens
tttaaattagtttgcataagaaaatgtaatgccagggacaaatttctctctttatcccttcttatactacaaaacagacaaagagggttaggtggttgctktttagtatgcgagtaatcacttgggattcacagaaatattagatgcagtgttattagtgaaaccttagttccctttatagatatgtcttatgtcccattt

SEQ ID NO: 13391 - DNA, 201 bp, Homo sapiens
tttgaattaaaaagtgctcaccctactctttcttctcggctacaagttttgccatagtgcacagtgtttcttcatcttactttctttaaagaacctttccyatctcttcagttatttctacctgttccaacctccctcctgatagcaccccagtagtgggatggaatgtgctggaggggtttggccagttcttgggggagt

SEQ ID NO: 13392 - DNA, 201 bp, Homo sapiens
tgttgagtagaagtttggagaataaacaaattgatagattgatatttgaatccccggcagagtaagaggaataataagattttgaatcaagaagaggaatyctgccacatgcaactaggaagaaaaaagcaaattaactgtgataacactcattagggattatcattatatctttaatgaggaggtaataaagactgatta

SEQ ID NO: 13393 - DNA, 201 bp, Homo sapiens
ttgaatccccggcagagtaagaggaataataagattttgaatcaagaagaggaattctgccacatgcaactaggaagaaaaaagcaaattaactgtgatarcactcattagggattatcattatatctttaatgaggaggtaataaagactgattatttactaggcatcccttattgatccctatttatcactacgtagag

SEQ ID NO: 13394 - DNA, 201 bp, Homo sapiens
aatttctgaatcagccttaaactataatgcttaaactgtttaaatgtgaagggataaaatttggggcatttatgccactattttatgttatcgttgttacrgtgagtacaatttttaattggtatgtgtgtaagatttgctcagatctcaatcaatggttctaagaggaaaaagcttaattccaagctgcctctctcctgt

SEQ ID NO: 13395 - DNA, 201 bp, Homo sapiens
ctttctatagctttttcttgagatgaatttgtggaccagttgaatagtgatagaaatacaggacttgctaaaaattacaaagtgtttatggcagttctggyaaatatcctctagatcaccagataatgccaagtcagcaatattatcaataatgagttgcctactaagaaccaggggaatgggggcatggactgaaacttt

SEQ ID NO: 13396 - DNA, 201 bp, Homo sapiens
agatctggtagtttggtgagcagagttggcgtggctcatcagcagtcaccctttggcaatggaaccagaaaagcatcatgctgtctgttaaagaatgtgtytatgcttgtagctagtttcctaagatgtttgcctctaggtatttgcctgcagaaagttttttgaagtcaatacaaagtagagtggcaagcgatgcatcca

SEQ ID NO: 13397 - DNA, 201 bp, Homo sapiens
ctctgttagtcaaagtcaaaattgatcaatcaggtaagctgtaactcatctttttgtattttacagatgcatttataaagcatagtgagatgttttgcctragatttattgcacgaaatttgaatatggtagcaataatttattttatcctataatactgaaatcatatttggtctcttatggtacaaaaaagattcttct

SEQ ID NO: 13398 - DNA, 201 bp, Homo sapiens
ttcccagagccagatggctgaatcaagcacaacgggagaaaaggttgccttccttaaaagagatcattcaaataatccctcagctttccctcttgcctctsacttctcccaggaaaagtcctgaatgctgatcgtaaaagtgccaggaatggaagggacaacccttcagcaaagggccattgttccacaattgcactgtca

SEQ ID NO: 13399 - DNA, 201 bp, Homo sapiens
tagatattttttattctccatttcaaataaaaacagagacccaaggaggtgctatgcccttcctaaggtcacatagcaagtgaaggaagacctaggacaakatttttctgtttccaattgggcagttttcactattgctcccccagagaattgggggatgttctgaaaaatgcatagctagaaatgagtatttttcttctt

SEQ ID NO: 13400 - DNA, 201 bp, Homo sapiens
tagttctatagcaatcggaatcttatatcactaaattctgggaggtagaactgaaaagcaacttctttctttgaacctgaaaatagaaaagctaagaaacrggagagggaaataaaagaagaatcagcccagagctatcatccaggcactgacaaatgttccttataaagtctctgattgttgtccctatacaatgcggtg

SEQ ID NO: 13401 - DNA, 201 bp, Homo sapiens
ctaaccttcccttcaaaaggaataaaatataccaaagacttgtaaagacaatgaatataaaggataaagatagatggatgattagacagatgcatttggamgtatttggaatgcctctttggagttatttctgtcactggggtggagagctgggtcatagcattcccaagtctcttttctggctctgtctactattgacta

SEQ ID NO: 13402 - DNA, 201 bp, Homo sapiens
tgggcaccactgggtttgctgctcttggatctttgctctaggaataaggagtcccagagatatctccttgtctctggtatgtaagattatttttgttagcytccagtcttgttgctcagccaaaagcaagggctaattctagcacgtatagttttcaaatcacttttggaaatgtaatatcacccacctttccctttccag

SEQ ID NO: 13403 - DNA, 201 bp, Homo sapiens
aaactgaggtaagaattgttttttttttttctgaaaatatatgatgttctatttatatataataggaaaacgacttcaagcagcaatcgtcacttgccagrcatcaaggcggatatttccattatgtctatgacaaggtggtgggaggggtgggatgtggtttcatacctttctggtgcatgtttgaatgattgtaaaaat

SEQ ID NO: 13404 - DNA, 201 bp, Homo sapiens
aaaaagaatgccgaattaatgttggatggatgtacatatacaagaacttgctatcagtacacaattccaataggaattatatatacacacactgaaaataraatttgattaaataattacactaggtacaagctacattttacttccattgaaggagagctaagtggaaactagtgtgagacaatcatgaatagaaaagtg

SEQ ID NO: 13405 - DNA, 201 bp, Homo sapiens
ttccatgaatcctaagaattgcacagtaaaaaataaaatctgcctaccatttaacagcccgcaatacaaaaatcttactgtgtcaaatgtaatatgcatamctggcttcccaatttggttttcttaaggaggagtaatttagttgtcattaaactctttgggaaaccgttttaataatgttctttggttatcaggggtatc

SEQ ID NO: 13406 - DNA, 201 bp, Homo sapiens
tgatacagagactaatgatcatttacccaaataaaacagataccattcaaagttagacactgagcctctggtaatccctgttcttctccttcatcttgagygagggatactgaaaaagactgggctggctactgtttaatcagggaatgatgaatacttttcattagcccaagaaaagttagtttctattccagaaatatt

SEQ ID NO: 13407 - DNA, 201 bp, Homo sapiens
tgagtgtaatgattcagcaaaacttcattataatctcttcagggcacctcctggaaacctgagaaataaaactgttttattactggtacttgcctttctcraaaactgatagtaaacgtcctgacaagttagtcttaggtatctttccttcagttcaatagcaaatgctgtttaaaagcaaatacacagcatttatagaat

SEQ ID NO: 13408 - DNA, 201 bp, Homo sapiens
tttacagtctttacaaacagaagccagaagtgctatatttgaacatctacatttgttgggatttctttaaaaaaaataaaacaaaaagaagaatcacattktatacgtgttaaatggtgtagtagtaaaccatgtttaaaaaagcttcagttttcattggtgtacaaagctgctacatgtaaatattggaaccacttttta

SEQ ID NO: 13409 - DNA, 201 bp, Homo sapiens
cgagattacgcactgcactccagtcttggtgacagagcaagactccgtctcaaaaaaaaaaaaaaaaaagaggctaagatcttggccacgttttcacagcrgctaacaagcagaatcaggatttgaacctaggccgtggagcaccagagcccattctaaatctgaatgcactctcaaagtgtcttgcagggaggtgagccc

SEQ ID NO: 13410 - DNA, 201 bp, Homo sapiens
tgagcaaacatagacccagccctctgacaccttgctcacagtcaatgggagtttgaaaatagctttcagatgtaacaaccacctttcctcaagtaaaaagycttaaatgcattgtttttaatgtatttttatatatgcagtttttaaattaatttttttattttaaagggaaattgttaggtaatcatttagtcagatcac

SEQ ID NO: 13411 - DNA, 201 bp, Homo sapiens
cttctttttctttattggttgatttattttttaaaaaattaccgtttatttttaataaatacatgtattttccccactcaatccaaaattgtgtttatccrtgtaataatcagtaggcaggctctagattgcttaactttcattaagaaggattaaccttgtgagacacccaggcagtgtggtttttcactgtgtgtaaat

SEQ ID NO: 13412 - DNA, 201 bp, Homo sapiens
cacatgagtcacccacagtcccagcacaatcctgccctgcaggccccatcaccttcttccctgaggaatggccaagatgcaggcatcagctgatgatgatratgattactgttattgcagctattatttttataaatactcccttccttgagatgcaaaaaaaaaaaaatgtaatttgcaaagatgctttgttgggagata

SEQ ID NO: 13413 - DNA, 201 bp, Homo sapiens
agtagaccctcaacatttttccaaagaggcactaatgtaccctgtaaagaaatgacatttttcgtctcaaaaaaaagcaaaaacaaaaaagaaatggctayttttcaccctaaaataaaaaagtgtgtgtgtgtgtgtgagagaaagagagagagagagagagaatgaatctatctccaaatgccaatgagcatgatggac

SEQ ID NO: 13414 - DNA, 201 bp, Homo sapiens
tacatttcctctgccagccccgccccccagccaccgtgacaggaagccccagtagcgccaagatagttgtgactggtcccaccctttcaggaggggcctargttttcaggcagaaggggaattaggttgggccttagaaggtccttcaagtgtacatccacgatcccagcagcagacactggcatctggctctgcccctac

SEQ ID NO: 13415 - DNA, 201 bp, Homo sapiens
tgacaggaagccccagtagcgccaagatagttgtgactggtcccaccctttcaggaggggcctaggttttcaggcagaaggggaattaggttgggccttakaaggtccttcaagtgtacatccacgatcccagcagcagacactggcatctggctctgcccctaccgtatagatgaggtgacaagctggaaggtcccaggg

SEQ ID NO: 13416 - DNA, 201 bp, Homo sapiens
aggggcattcaattttatcctgagagcagtggaaattttaagacagtttttttggtttattggtttggctttgttttctatgtatttttgtttttgtttaraagagtttttaaatagaagagggttggctgggcatggtggctcagcctataatcccagcacttggggacgctgaggcaggcagatcacctgaggtcagaa

SEQ ID NO: 13417 - DNA, 201 bp, Homo sapiens
gtgtggatagggctgtagggcccagtccatggggcatggctgggaccatggttccagggttccagggttccaggactctttcccagggttcagacaggggyttcgttccagggaaggaatgctcctttgagcagctggagcacgttcgggagatgcaggagaagctagcccggctgcacttcagcctggatgtgtgtgggg

SEQ ID NO: 13418 - DNA, 201 bp, Homo sapiens
cgttcgggagatgcaggagaagctagcccggctgcacttcagcctggatgtgtgtggggaggaggaggacgatgaagaggaagaggatggggtcactgagrggctgccagaggagcagaagaagacaatggctgaccgtaacctggaccagctgcttagcaatgtgggttcatgtctgggtgctttggttcctgggggcat

SEQ ID NO: 13419 - DNA, 201 bp, Homo sapiens
atcacttgaacctggaaggcagaggttgcagtgaaccgagattgtgccactgcactccagcctgtgtgacagtgagactctgtctcaaacaaaaaaaaaawtttttttttaattaaaaaaaaagaagagggctaggggcagtggctcaggcctgtaatcctagcactgtggaaggccaagacaggcagatgacctgaggtc

SEQ ID NO: 13420 - DNA, 201 bp, Homo sapiens
acgttcgggagatgcaggagaagctagcccggctgcacttcagcctggatgtgtgtggggaggaggaggacgatgaagaggaagaggatggggtcactgargggctgccagaggagcagaagaagacaatggctgaccgtaacctggaccagctgcttagcaatgtgggttcatgtctgggtgctttggttcctgggggca

SEQ ID NO: 13421 - DNA, 201 bp, Homo sapiens; identical to SEQ ID NO: 1382

SEQ ID NO: 13422 - DNA, 201 bp, Homo sapiens
gaaccataaagttacccatttatgctagtaagtagatgggcagatgagttagtgcagatagacagataaactggtgcataggcagatggcacaaaagatcrggaggtgcctgactgccccctaccctgtgatcatggtcatgtccaccccacccagagtaggcaaagagaagtgccgcccagtcctggctggaggtggaag

SEQ ID NO: 13423 - DNA, 201 bp, Homo sapiens
cactacatttcctctgccagccccgccccccagccaccgtgacaggaagccccagtagcgccaagatagttgtgactggtcccaccctttcaggaggggcmtaggttttcaggcagaaggggaattaggttgggccttagaaggtccttcaagtgtacatccacgatcccagcagcagacactggcatctggctctgcccc

SEQ ID NO: 13424 - DNA, 201 bp, Homo sapiens
cctaggcctgaggcccagccagcgcccaatggatgacaaaaagaagaaacggagtcccaagccctgcctggcccagccagcccaggccccaggcacactayggagggtccctgtgcctaccagccacagcggctccttggccctaggacttcctcatctgccatcccccaagcagcgggccaagttcaagaggtgggtaca

SEQ ID NO: 13425 - DNA, 201 bp, Homo sapiens
tcattcagggtcataaaacaaatgagtgaggcactcagacaggaacccagggaccccctttcaggcactgctctggctgtgttattagcagaaaagacttmtttttgacctcttcacgcctcctcaccccttcccagtgcccaaggggaaccataaagttacccatttatgctagtaagtagatgggcagatgagttagtg

SEQ ID NO: 13426 - DNA, 201 bp, Homo sapiens; identical to SEQ ID NO: 1383

SEQ ID NO: 13427 - DNA, 201 bp, Homo sapiens
agtggtcttagcaaaaggcacaccaggagattatatcccacgcctggctcgagggtcccccacccacggaccctcgctcattgctagcacagcagtctgasatcaaactgcaaggctgcagcaagtcttggggaggggcatccaccattgctgaggcttgagtaggtaaacaaagcagctgcgaagctcaaactgggtgga

SEQ ID NO: 13428 - DNA, 201 bp, Homo sapiens
cccattttatttccttttattatttcaatacatgcctatctccccacactctcatcattagattttagctcctttaaggtcacacagattgggtattcatyttttttcgcacataagttttataaatatttaaagtaaaatatatttaaactataatgcattagaaaaatgcttgctaagtagcatttggcagactgaata

SEQ ID NO: 13429 - DNA, 201 bp, Homo sapiens
gaagggtttaaggataatttctgctcagaagttgccaacaggaagagcaaacaaattggattacacaaataatttcccaaataactacagactggagcaaygggccatgctggtaaaataacttaaaggagacaattgaaactatgtcctctatttaggtccttctctctcaacctcctcaaaaggactaagtacagaatt

SEQ ID NO: 13430 - DNA, 201 bp, Homo sapiens
atatttacatataaatattatatattatttatttcaaattttagacactttttagaccatgcatggaagaattatagttctacaaaaggttgtactctatytactccatttatctttcatgccatgcccttttatttttattagcttttttatgaaagttattgcatgcacctgataaaagatctaaatcagtaagacatg

SEQ ID NO: 13431 - DNA, 201 bp, Homo sapiens
tatctcattcaatctttgtaaaacctcattatgtaggtgggaatcatttcccattttacagatgaggaactgaagcccaaagaaggtaagtgatgactccycggaatggcagataggactctctatctcaaactacttgactgttgacattttatctttgtcaaaatcatggaggtgcttgggtttttatttccctggatc

SEQ ID NO: 13432 - DNA, 201 bp, Homo sapiens
acttccaacaacccactggtctctaaaagtaatagagcccacctccttcatctctcacactgaccccttaccttcatcctcacctctgctgccttggttcragccctcatctcttttacagggatccgccacagcatcccaactgatctggccttaggtcttcttctccaatccattcttcaaaaggctgccactgtgatc

SEQ ID NO: 13433 - DNA, 201 bp, Homo sapiens
tcattggcattaatgcttgtatatgtttgaattcgatactgtaattttagggggtggggggagtgagaactcaagaaagactcacatagcagggatcctgwatgcatgcatcccagtacccaccttctaactcccaaccaaggttaaaagagtataatgttggagaaccagcagaaaaaggccacaaaacagaaaattaat

SEQ ID NO: 13434 - DNA, 201 bp, Homo sapiens
gaagtgagaagagagatttaaaaaggaacaagtgagccttagaaatcaagagtatggccaaaaaaaaaaaaaaaaaaaaaaaagccatgtattgccatgtwttttctttaagaaaggtgtagaaaccaatgacaagagggaaatttataaacaagaaatgaaagaggagcagagcacaaatttgaagtgtgggagagattt

SEQ ID NO: 13435 - DNA, 201 bp, Homo sapiens
gtttcaccatgttggccaggctggtctagaactcctgacctcaaatgatccacctgcctcggcctcccaaagtgctgggattacaggcatgagccactgckcctggccaatagtcatcatttttaaggcaattcatactaaaaaaaagaaatcactactgcatcttccaggaagtatgcaggggctaaaaaataataactt

SEQ ID NO: 13436 - DNA, 201 bp, Homo sapiens
tcttttttaacttttacttcaagggggttcaccaatgccttacagctaaacttttatgatttttttctatttcacaaggacaatcaattctttaacttttytacttcaatcccccctttggtgctctgtataaatgatgtttaataaagagcaccacaatttttttttttttttgagtggctacacattttttttgaggca

SEQ ID NO: 13437 - DNA, 201 bp, Homo sapiens
atggtgcatatttaaatggaaaaatgactttttatttcagagaaatcaccaggattcctggaattccagaacacaagagttaagtctctacttctaaatasacttttgctgcattgaaaaatatcctggcaaatgttcatctgggcagtaagtatcatcatagttaagaaatagctttttgtccattatttgcttatttga

SEQ ID NO: 13438 - DNA, 201 bp, Homo sapiens
tttaacatatccttctgggcatgactctgtatattcctattgtatatatacctggaagtagaactgatgtgtcacaccatatgcatgtgtttagctttacsagataactgccaacaagttttccaaagtcgtttgggccaatatacaatcccagtagtagtgtatgtaagtttagttgctcagtatcttccccagtacttg

SEQ ID NO: 13439 - DNA, 201 bp, Homo sapiens
tgatgtgcaggatggactgtagagaggaaggattgcagagaagatggactacagagcagtgaggacactggtcagaaagagttatagggttaccatatggrgctgtagcaatagaaacagagaagagaaaactaaatgcaagctatagacttgacgattaatatggcgagaattgaaaaaagcggtcaacagtgacaatga

SEQ ID NO: 13440 - DNA, 201 bp, Homo sapiens
ggtctttgagacatagataaacatttagttatatgtcatgtcctatattttgtaccagtaatttaagtctattgttcttttctgaactaaatagctatctmcttcagacattgttatcaccttttatatttcttctgtatcctaaatagcaaattgttgtcagtgagtgaaacagcatgcccagtgaggaaatatttgttt

SEQ ID NO: 13441 - DNA, 201 bp, Homo sapiens
tcacagaaagcaaataattgtttactggtcagttctcacaaatataaattatgtttttaagtctgtgaaattcacatgatggaagatctcatgtgggatcmccattaacaaatagacaaatgaattcaacttagacatttaaacttataggaatattgaataggattaagcaaagcaattgcaaactatccaactttcgtt

SEQ ID NO: 13442 - DNA, 201 bp, Homo sapiens
atcttgatcaatattgaccttcattgaccaatcctgattaacacatttttaaacctgcattcagaatgctactaggtacatttacccaaaatctagatgaytcgtttgtgaataaacatcaaggaatctaccaaagaaagatctggccttcaagagcaggtttttatatgattcaaggcagcttatgaagtataacaataa

SEQ ID NO: 13443 - DNA, 201 bp, Homo sapiens
ttttgggaaaatatgagataaaacagggaaacaaagccattcataaatggtacaaatagtctatatattttatcataatactgcattgctcttcctgatcyatttctttttctcttttctacttttcctgtatcctttctttctaagatgattttacaaaagccttatgtcctaggcaatgtgctatatactttacatcat

SEQ ID NO: 13444 - DNA, 201 bp, Homo sapiens
gggtacatgcttccgtttcttgtgggtaaatacccagaagcagcattgttgggtcatatgataaattcatgtttgagctgtatgtctatccttaataaacwtaccaccacattatatttattattgtagctttatcctaagcctgaaattcaggtagtgagagccttccaatgtcttttccctttcaagattgttttggat

SEQ ID NO: 13445 - DNA, 201 bp, Homo sapiens
cacattatatttattattgtagctttatcctaagcctgaaattcaggtagtgagagccttccaatgtcttttccctttcaagattgttttggatataggascattgaatttccatatacattttagaaatgctttgttgatttctacaaaaagttgtgaatttataaaaagcccactctatcatgtatttctttatagacc

SEQ ID NO: 13446 - DNA, 201 bp, Homo sapiens
aatgctttatatatgttcgttgttgttattataagtagccatgaccttgagaagttcttctaggccactctgttctagttaaaaaacgtcagataaggaaygacacagacacatacatcatgcacactcagtggtctgcaatttctgcttgccttctataacttcaatacagctccacatgatttctaattggctctacct

SEQ ID NO: 13447 - DNA, 201 bp, Homo sapiens
gctccacatgatttctaattggctctacctaagtcctaaaaactaaaaaggctaaaaactaaggttttcttaacttccattttgttaattttactgacacwtatattcattatatctatatatcttgtttttcctcaaaattaacctatattcagtgacaaactgattttttttaaaaaaactccctttctttgattaata

SEQ ID NO: 13448 - DNA, 201 bp, Homo sapiens
tagatgagacttccacctctactctagacagatccaaaccagtgcacatttaaagttctcatgcctgatgttattattattgtccattatcctgtgctatmagctgattattatcactgatacacttatgttactcagtggtctaataagtaaaaaagagagcacagtatacaatttttagaaaagcatcctccctgcata

SEQ ID NO: 13449 - DNA, 201 bp, Homo sapiens
aattgaattgttttttatttatgacacactctcaaaaaaggaatggcttatattccttatcatgtgcaaattttgaaagtttcttgtagttaatcttactmcttctaattgcaggccccaaccctcacctccaaatcctgattttcatgccgccagactctcctgaatcttttcttctcctacaacaaaaaacctgtccag

SEQ ID NO: 13450 - DNA, 201 bp, Homo sapiens
ttcggttcatgaatttatactttaaagtcattacatcagtagctaacatttattgagtgatatgatacttgccaggcacagagttaagtgctctacgtggwtgatttcataaatgcctcaatacaaccctattaggtaatactatttgtccccattttacagatgagaaaacggaggcaaagcttatttacaaaataggcc

SEQ ID NO: 13451 - DNA, 201 bp, Homo sapiens
atgaaaatagtctttcctttgaaccgctttttctgaaagactcctgggagtatggaccaggcagagggttaaatgtggggagcgggtatagcagggaagaragaatggctggcaactcaaactttggagcaaaaggtcatgaaaaagacagtatccaaaagtgaaatggtaaacaaaaactcaaacaaatcatcccaacca

SEQ ID NO: 13452 - DNA, 201 bp, Homo sapiens
caaccaaaggtttgccatggtccccaagcagaacaaaaaagacactaaaaacacagatttctcactaggtatttttataggggataaaagtaaacaatcartgaaagtgtctcatggagaaggaaatacaaatagataattttagtgccagttttatctgtcagtaaaatctgcagcaataagctctgttaataccacaag

SEQ ID NO: 13453 - DNA, 201 bp, Homo sapiens
gtctcattcatacacttagaagaagttgttcagtcaaactgctcccctctaagaaaatgctagaatgccacaaagcactttttatgagtaaagcaggctgsggggaggagaaaggaggactgaaaaaggcagcgaggggaaacaggggaagtctaaggtggtgaaaatctgatagaagaatgtgaaaccaaaactagctta

SEQ ID NO: 13454 - DNA, 201 bp, Homo sapiens
gtcaaactgctcccctctaagaaaatgctagaatgccacaaagcactttttatgagtaaagcaggctgcggggaggagaaaggaggactgaaaaaggcagygaggggaaacaggggaagtctaaggtggtgaaaatctgatagaagaatgtgaaaccaaaactagcttatttaaaaatctccctaaaagatgactgccaat

SEQ ID NO: 13455 - DNA, 201 bp, Homo sapiens
acacttttctgaaagaatgaaatccaaactaaatcacatcgtgtgtagctcagaaagggacatgaagatactcttcttaatgtaaggcaagataggtgatmtatctcctaatggtaaaagctgcaagataagaaagaggtcttgcctgagaaccagctactcagagttgctgcaatcaacccaagaaacactacattgaga

SEQ ID NO: 13456 - DNA, 201 bp, Homo sapiens
ggttacagtttgctgtggttccaacgtccctataaaacccatgttgaaactgaattactattgtgatggtattagaagctgaggccattaagaagtgaagygattcatccttgagggctctgccctcatgaatggatttatgtctttattgtttgagttggttcattatcacaagagtggcttgttataaaaagcaagttt

SEQ ID NO: 13457 - DNA, 201 bp, Homo sapiens
gaaccagaagacaaataaagttctgttcattataaattactcagtctgtgatattctgttacagcagcataaaaggactaagacatggttgttttagttayctgggtcttgccacttaccatgtctctgtgctgctttctggcaacagcagcaaatcccaaattccacttacctggcttctctccagattacctataacaa

SEQ ID NO: 13458 - DNA, 201 bp, Homo sapiens
tcaatctcataattttggcactgtctataaattccttcccaacatcattctgtagtgggggagacagaaaataacaaagcaaataaatgtatgtttagaaytgttaatgtactataagaaaaacaatgtaacaaaagagagttgcagggaaggcccatttacatagtggttggggaaagaatcttcaaggagtgacattta

SEQ ID NO: 13459 - DNA, 201 bp, Homo sapiens
agattgctgccatagtccacaaatgtttgtcattcgtaagctgtggcaataatgtgaatacagaggagggaaactgcaactgaactacaccttgtaaaaaytcctttcatttgctttgtaataacccctgaagaaatgttaagaattattttgaaatcacatatgtttgtaatttccattttttcttgctacatctaagag

SEQ ID NO: 13460 - DNA, 201 bp, Homo sapiens
accatgtgttacaattgtctatagtattcagtgcagtaatgtgctgtacagttatagcctaggagcaataggctataccatacagcctaggtgtgtggtargctatgccatctaggcttgtgtaagtacactctatggcattcacacaacaaaaaactgcctaacaatacatttctcagaatgtatccttgttgttaagag

SEQ ID NO: 13461 - DNA, 201 bp, Homo sapiens
ttgtctatagtattcagtgcagtaatgtgctgtacagttatagcctaggagcaataggctataccatacagcctaggtgtgtggtaggctatgccatctargcttgtgtaagtacactctatggcattcacacaacaaaaaactgcctaacaatacatttctcagaatgtatccttgttgttaagagatgcattactgagc

SEQ ID NO: 13462 - DNA, 201 bp, Homo sapiens
aatgtcacgttctcaaggaagccagccctgaccaccctatgtaacactgtaacctgctccccaactctaccctgccctatgcacagcagtaccagttttcyttaaccatactttttacttttatagatagcactaattatatttaactttcttactcactatgcttacttttcattgtttatctctatccactagaatgta

SEQ ID NO: 13463 - DNA, 201 bp, Homo sapiens
aaatatttgtgcttttgatgaatattacatatcattacatatgacactgtgtcactttacttagctattagacttctcaacttaaagcaaatcatcaggtmatttttattgtcttcaaacaccactagattgataattctgaccaaaacagaagccactgttactgctgttcttgttggtgttgtttttaattgagctggt

SEQ ID NO: 13464 - DNA, 201 bp, Homo sapiens
tttattgtcttcaaacaccactagattgataattctgaccaaaacagaagccactgttactgctgttcttgttggtgttgtttttaattgagctggttgcraatttgactaaattgacttcaatcctgtccaaatgattacatcagctgtgtccacagatacaaactgcctgagccttcctttgatttttaagtacacatt

SEQ ID NO: 13465 - DNA, 201 bp, Homo sapiens
gaagccactgttactgctgttcttgttggtgttgtttttaattgagctggttgcgaatttgactaaattgacttcaatcctgtccaaatgattacatcagytgtgtccacagatacaaactgcctgagccttcctttgatttttaagtacacattttaaaatatttctttataagcaaaaagaaagtgagagaaactttaa

SEQ ID NO: 13466 - DNA, 201 bp, Homo sapiens
ttaatactcatccagaaggttgatttataatatcttgatcactgaagtttaattgattaatatttataaaatattcaaaatgcaaattctcatttatgatkcaaatatgaaaatatttatatcaagattagcatttgctattttgagttcaatccacaattcactaagaatcaatacaagcacacaccaatagaataatag

SEQ ID NO: 13467 - DNA, 201 bp, Homo sapiens
gattcctcaagggtgaggagtatctttaaaacaggcagatttagtatttctaaaagagatataaaaatatttctcaaatttcactaatttccccaatgacmgtccagttctaatgttctctctattaattataaatgctgaaggggtgggaagtgggggggaatcttgccaccaataagagaatccttgtagtagtggcct

SEQ ID NO: 13468 - DNA, 201 bp, Homo sapiens
ttcccacccaactctcatcttgtagctcccataattcccatatgctgtggaagggacccagtgggagactgttgaatcatgagggctagtctttcccatgytattctcctgatggtgagtgggtctcatgaggtctgatggttttaaaaatgggagtttccctgcacaagctctctctctttgcctgctgccatccatgta

SEQ ID NO: 13469 - DNA, 201 bp, Homo sapiens
ataactgtacagaaagaatcaaagaacatatatatatattaagtttcattccaacctacaaagagcctgcacttaaaagtcttaaaggtttcctgaatcatggaatctcaacttacctgccaattaatccagttctctctttttaaatgcagactccaaccttaaacagaaggcatattctagctgacttctaagtgtgtc

SEQ ID NO: 13470 - DNA, 201 bp, Homo sapiens
ctgagtggtaggaaatttttagtgcttagacatttctatagccaagtaaaatgtgtacttcctagtcaaatataaatgccttttgaattatcctgtataawtccctcttgctaaaatgctatgtctctttctttccattcttcactgactggcctaaattctatctcctctgaaagtggagtcctaactggtaaagtccaa

SEQ ID NO: 13471 - DNA, 201 bp, Homo sapiens
catgtgagtcagtaaacctgtatgaaaataatagcagtttatggccaattgttatttagaaaatatgcaacctcacataaaaagttaaactgaatattgtycggattgcataaaattaaaggatataaaatggtcaaatgcagagaaagcttttagaatgagcgatttatttcctaatgatttctgtaaggtggcctgaat

SEQ ID NO: 13472 - DNA, 201 bp, Homo sapiens
ttctgtatgtgagtagtagcattatctagatcctttgatcaggagatcaggggaggcaatccacctctcccttctgctgctgcccctactgcattccatgyggctttcatgcaatctgtcaatccacaatctcatgagcagtgtaagaaaaggtccatctgcacagcatggagggtttctgttaaagcaaacaacctaggc

SEQ ID NO: 13473 - DNA, 201 bp, Homo sapiens
tacaattcaagatgagatttggttggggacacaaagcctaaccatatatacccagtaaacttttcatataaatattatatttttcagttctaaaagctgtktttggttattttatatgtgttccatttctctcctaagtatgttcatgttttcatttaaatccttgatttatttttccatcaagtctatcacctttaccat

SEQ ID NO: 13474 - DNA, 201 bp, Homo sapiens
ccatgcctgactactttttgtatttttagtagagacagggtttcaccatgttggccaggctgatcttaaactccttgcttcaagtgatcctccagctttgkcctcccaaagtgctgggagtacaggcatgagccactgtgtggccccaatgcttcttttgtaaaggaatgcctaacaccaggtgtctaccaacttcagaaa

SEQ ID NO: 13475 - DNA, 201 bp, Homo sapiens
ttaatggttggcaaaaaccttcttttattttaatttgaataacatgtcatctattaagataaaagcaataagatatgacttaataaatcattaactctaawgcagcaatttctgtgtatagacttcctggaggtagtttaaatcattattttgttgtatataatttttaagttttaaaataaatgttcatatcaagcaatt

SEQ ID NO: 13476 - DNA, 201 bp, Homo sapiens
tcctagtcactgttgtatcccaagagactacaacagtgtctggtacaccgtacatgctcagtatacattgttgaatcaataaatgaacgaataagtcacarcgtgagctgttttatctcacaaagtattaagggaattagttaatcattattgttattatttttgagatagagtcttgatgcatcacccaggctggagtgc

SEQ ID NO: 13477 - DNA, 201 bp, Homo sapiens
tacgatgactttgggagactactcacactaaagcagcacacttccccagtgtggaacctccaggtctctgagggcctaattctcatttttggtgccactgtgggaatttccttccttgccttatcagagtatcttgaccttacccctctagaaaactttagttaagcagggaaaactgaatgcgcttattcctaatatcaa

SEQ ID NO: 13478 - DNA, 201 bp, Homo sapiens
ttccattacatatatgtaacccctctgtaattaaggagagggaataagcttttgcacaacaggacttcattctgctgttatcttagacctactacactatytcttctcccactcttcagatagccagttcataccatgttatatgctagtctgtagccccattcttcaaaaaagcatgaaagaagtagggaaaaaaggagg

SEQ ID NO: 13479 - DNA, 201 bp, Homo sapiens
gacttcttgaatataattgaaacaacacgtttgccatttctggccagacagaactcattcccctttcttttgcaaatggtgtctatgcctactctattgcstttatttttctcctttatttctacatatcctttctcctccccagcccagagcaagccatcataatgtttcatgtgtatcttttgtttgtatgagtatgca

SEQ ID NO: 13480 - DNA, 201 bp, Homo sapiens
tatgccttgatgtctagtatattctacttacccactttttcaatgatgtacacctagatctctactaacttgctgcccaaacaatgtggcaacggatagcstgatgcatgcctccttacgtacctgtgtgagaatttttttgagaacatacgtatgcaaaagggctgagttacagtattcatttatcttaattaaatagtg

SEQ ID NO: 13481 - DNA, 201 bp, Homo sapiens
ctgtgtctgctttttaagacaggtggtcatttcatctgcaaataattagaggcttatctctcccattctgatccttccatttttttcttttttaaaagtgytttcccatatctattacttttttcttgtttcatagctttaaaaacatgtactaaatttctccataaaatataagcatttctctaggtttcttgtacctca

SEQ ID NO: 13482 - DNA, 201 bp, Homo sapiens
taagacaggtggtcatttcatctgcaaataattagaggcttatctctcccattctgatccttccatttttttcttttttaaaagtgctttcccatatctaytacttttttcttgtttcatagctttaaaaacatgtactaaatttctccataaaatataagcatttctctaggtttcttgtacctcacattttctaaatta

SEQ ID NO: 13483 - DNA, 201 bp, Homo sapiens
attgtactatgggttaaatgaatcaatcatgtgtgaatggttcttaataaatatcagtagcattaacacatcatattgctagtaatgggagcagctctatrccctgaaggaaaaaataactgaagtctgttagctattatcaccattctcagagtctaacacagtgcctggccatgcagagaaacatcatgctaaacccaa

SEQ ID NO: 13484 - DNA, 201 bp, Homo sapiens
atggcagttttcaatagctcttttatttttccttttaatacacagcattccattcagccaactctaaattcccttttactcatattggagaaattgttctrcattctaatttgcatagtcacttctttatgccaataaaaaaccacacacatttcaatcctgcttgtaccactggttcattaaaacagcgtctggattttg

SEQ ID NO: 13485 - DNA, 201 bp, Homo sapiens
tgcattttttcatatcattcaactaaattcccacagcaactatacaatttataagtcattatcttcatttaaagaggaggaaactatgctttggggaaatgaagtaccttattcatggtcacacaatctaatatgaagaggataacggctcacatttacttcattccaaagcttcaaacagttaggagatactaagaaagt

SEQ ID NO: 13486 - DNA, 201 bp, Homo sapiens
catggccaggtgcccctctgagacgaagcttccagaggaacaatcaggcagcaacattggctgttctgcaatactcgctcttctgcagcctccgttggtgrtacccaggcaaacggggtctggagtggacctccagcaaactccaacagacctgcagctgagggtcctgactgtcagaaggaaaactaacaaacagaaagg

SEQ ID NO: 13487 - DNA, 201 bp, Homo sapiens
cattggctgttctgcaatactcgctcttctgcagcctccgttggtggtacccaggcaaacggggtctggagtggacctccagcaaactccaacagacctgyagctgagggtcctgactgtcagaaggaaaactaacaaacagaaaggacatccacaccaaaaccccatcagtacgtcatcataatcaaagaccaaaggtag

SEQ ID NO: 13488 - DNA, 201 bp, Homo sapiens
aagttgcctgtggtctgagggttcacggttcagcgttcagggatcagctggcatggcaactgtctcaattcctacggctacaagaaaaaacacacctttgmtaaattctctaacaataggcgttatcaaacaaattatcagattgcttcctaactctgatttacaacccaggccactataactctgattgaaaagagaact

SEQ ID NO: 13489 - DNA, 201 bp, Homo sapiens
tgagaaatccactattactctgatggggattcccttacagatgacttgacacttttctattgctgtttttagaattctctctttgtctgtgacttttgacmgattaactataatgtgccttggagaagaccttttggaattgaatcagtttggagatttttgaccttccttatctgagtatctatatctcttgcaagactt

SEQ ID NO: 13490 - DNA, 201 bp, Homo sapiens
caggctggtctcgaactcctagcctcaagtgattcgcccgccttggcctcccaacctgctagagttacaggagtgagccaccgtgcctcacaaccaatttyttaacataagacaacaatgatgtttgctgcatcggttgactcttcatgaaagatttctctgtagcatgtgatgctttttgatggcattttacccacagta

SEQ ID NO: 13491 - DNA, 201 bp, Homo sapiens
actaacagtttaagcttattttagatggttttcttgcttttcatgctttgatttctaaattccaaaagacccttttccccctttatagggagtattctacraaaagcatatctcaaacaaagctttactattattattgtttgtaggatggagtccttctttggtgtaatgtttagacaaactctaaaatgtaatccctca

SEQ ID NO: 13492 - DNA, 201 bp, Homo sapiens
ttttttaactcagaatttctaacagtaagacagattctcattttgatgatgatagctgatttggggaaaatgtttatttccattttaaagtcttcaaaaaygcacatataatatctttccatagtaacagtattataaggggggaagacacgatgccgttttggatttagtttgcacaattcttataaaaggcttcctact

SEQ ID NO: 13493 - DNA, 201 bp, Homo sapiens
tagattccaggttgagggctttgccagtattccatgtgactctactagccccctaccaggtgtatgaccttagatgattagtagactgctctatacttcartttctccatctgtaaagtgggagtgataatcacattacttgcttaatgaaacgttttgaggattacttgtaacatgattaagatagtccttggcacacaa

SEQ ID NO: 13494 - DNA, 201 bp, Homo sapiens
cctcataagcatgtccatttgtctgtccatttgctgtcttcaagaccaattcatatccataatctgatttcatctacctaatacttgtattagtttcctaytgctgctacagcaataggactgtaaactccgtggcttaaaataacacatatttatcacagagtccaggaagtcagaagtccaaaatgggtctcagtgagc

SEQ ID NO: 13495 - DNA, 201 bp, Homo sapiens
ttcatatccataatctgatttcatctacctaatacttgtattagtttcctattgctgctacagcaataggactgtaaactccgtggcttaaaataacacayatttatcacagagtccaggaagtcagaagtccaaaatgggtctcagtgagctaaaatcaaactgtcagcagtctgcatttcttctggagtttcctggaaa

SEQ ID NO: 13496 - DNA, 201 bp, Homo sapiens
acctcttatgcctgcatgtgctccaactgcagtctgcacagctgactttgatgcactttttcaaaggtatatgcaaaaccctctccactcagcttaggctsggatcccaggctggctgcttgccctgtctccatgattccctgctgcctccattgctggcaccgacacaaatacagctttgtatctactcactacaaaaac

SEQ ID NO: 13497 - DNA, 201 bp, Homo sapiens
tccagccaggactctgcagagacctgaactgtataaacaacaaaaaagttagggatcaaattagttttgccactgctacctctgtacctctgggtaaacaytgggctgttcattagcaaaatggaatttgaatttcaaagatgaatgaatattcatttactttgggtaattacatactaaggtattcaaaatatatttgtt

SEQ ID NO: 13498 - DNA, 201 bp, Homo sapiens
tgtgagtgatcaggggcccattggcacataaatatatgtaaccttttaataatgccttctcccaactaagccaagcacaaggatgtgtgacaaactgacayattttgacttttgaaaagatttcaaaaaagatccagatttcttcagtgaaaggtcccctatctctctgaagacgaccctctgaaaagctgtgaacattag

SEQ ID NO: 13499 - DNA, 201 bp, Homo sapiens
ggcagaagagtcacttgaaccagggagttggaggttgcagtgagccgagatcttgccactgcaatccagcctgggcaacagagcgagaccaagagcctccrtctcagtaaataaataaataaataacagcttagttgtgtcaatagctcattaaaactcttcttagaagctttttatcagtagttttgggaaatcagtaca

SEQ ID NO: 13500 - DNA, 201 bp, Homo sapiens
gctactcaggagactgaggcagaagagtcacttgaaccagggagttggaggttgcagtgagccgagatcttgccactgcaatccagcctgggcaacagagygagaccaagagcctccatctcagtaaataaataaataaataacagcttagttgtgtcaatagctcattaaaactcttcttagaagctttttatcagtagt

SEQ ID NO: 13501 - DNA, 201 bp, Homo sapiens
gtgagaaatggtcagtgatgttggaaaaaggatataaaatttaagttaggaggaataagttcaagatatctattgtataatgaggtgactatagataataatattatattgtatttttgaaagtcactaagataatagaaaaatttaagtgtacttaccacaaaaaaaaggtaagtaagtgaggtatgcatatgttaacta

SEQ ID NO: 13502 - DNA, 201 bp, Homo sapiens
cctctcaatacatgaaggattttttatcacatacttctttgagattccacactttccaaatgtttttcctacaaacagttcttcaacatattaatttcctycattttagcacccatgtatgtacatccaaccattccttctttcatttccaaacacatcaatgtactgagtgtaacaccttgcttgacaagcatgcaggag

SEQ ID NO: 13503 - DNA, 201 bp, Homo sapiens
atgctgatgaatacgtcacacagttcattgccttggtattaattgtagtgactccactttggcataaattaagatttactaactttcatcaagccttatgycctctcaatacatgaaggattttttatcacatacttctttgagattccacactttccaaatgtttttcctacaaacagttcttcaacatattaatttcct

SEQ ID NO: 13504 - DNA, 201 bp, Homo sapiens
ccaaaagcataattaaataacagatataaaattgcacatacttctgaaataatatcaagaacagtgaagtgtacacagactatgatatttgtaacaggggycagctaataaaatagatgatttctgctgagtttgatcttgatttttgttgtttctacacaatgagcttcaaattaatattaacttagtaataaacttgtg

SEQ ID NO: 13505 - DNA, 201 bp, Homo sapiens
tgagagttctgttgattttttcattcctccttcatcaactacatcaaaatggttattatgtttgttcacttttacttctaaaatatttttgacctctctgyctcattttcagctcttctgtcatagcccgagaataggcccacgcctcttctgcctggactacagtgccagctctctaatgaggctcccttctcttgatag

SEQ ID NO: 13506 - DNA, 201 bp, Homo sapiens
tattacctctcacacaggagtggggattttccagcacagagctctttgacaacagaaaaatatgaaaacccttgagaaatggagttcatataggaacgcamatgtttccaggctctataattcaggcagtagagagtagggtgtttgctgagtttcaggttgtttggtggtattcagattctctattccttgagctaactg

SEQ ID NO: 13507 - DNA, 201 bp, Homo sapiens
ttcgtttttactctttttaatctttttgatgatgtgctttttaaaccataagtattttaaatgaaatttctaatgcagaggggaagaaaaggtttctttgyatgttcatttgtttctagctactcttgatgtaataagagaccttcttttaaataattacccttaggcaggaagaccatcataacatagtatttctccact

SEQ ID NO: 13508 - DNA, 201 bp, Homo sapiens
aatgtagtccatgttcttcctctttttattttggcctacaatatttgcttttctttgaaagattgccatggcagggggtgactggcgagaggtgggtatcwtcttctcaaaaaaggaagatcaccatcattgcccactttctcctttcctcattcttaatgattctccttcaatatggttaacttatggctccacagtcat

SEQ ID NO: 13509 - DNA, 201 bp, Homo sapiens
aattgattgtaagatgtgaaaacacgcggaggaggagaaccaggagcactcagtgtcacaggtaaagaaagaggaaagcctttggaaagggatgaattgartggcctaagaaaacacttctatattttttaccatctggttagttacagacgcttgtaaaagggagcgaaggagcagaatccagcttactgcaaatgagaa

SEQ ID NO: 13510 - DNA, 201 bp, Homo sapiens
cttataatgatctctaaactatacatccttctaaagaacttggaatcactgtttcacagggcctttcttgcccataccataaaactattagattatgacgmtattttattcattcactcacagaacaaacagtagtaagctttaactatacacaaagcccggtgaacaacaacaaaaaagttagtcttgcattttaaagag

SEQ ID NO: 13511 - DNA, 201 bp, Homo sapiens
atgggttcaaggagattctgtgagccagctaagaaatttaactttagttgtttaactttttttgtatgagaaaactagttctgagttcatacaactcactwacataagtcactgaaagcagaaagtaaactgtcttgcttaagatcaacaattatttcattaaacaaataaatgaacagatacatcaacaaatgaataaat

SEQ ID NO: 13512 - DNA, 201 bp, Homo sapiens
aagtaattatggaagaagtattagagtctattgtatgatatgaatttcaattggtctactctttaacactttctttaatttagaaattttgtttatatgtmcatcatttaaatatgtcttacaatatgggcaggataaaactaatattcaagataaagcatttactaattttgttataaaacatgctgaacgtttgaatac

SEQ ID NO: 13513 - DNA, 201 bp, Homo sapiens
ataaaactaatattcaagataaagcatttactaattttgttataaaacatgctgaacgtttgaatacacacaatggttcacacagtattgaattaaatgamagatatctgaacatcatatttgtatggaaaaaatgcatcataacatgggtcatatctcatgataaacttggagcctgaaaaccaacagcccaagaagaaa

SEQ ID NO: 13514 - DNA, 201 bp, Homo sapiens
attcaagataaagcatttactaattttgttataaaacatgctgaacgtttgaatacacacaatggttcacacagtattgaattaaatgacagatatctgamcatcatatttgtatggaaaaaatgcatcataacatgggtcatatctcatgataaacttggagcctgaaaaccaacagcccaagaagaaaacactttaatt

SEQ ID NO: 13515 - DNA, 201 bp, Homo sapiens
catttactaattttgttataaaacatgctgaacgtttgaatacacacaatggttcacacagtattgaattaaatgacagatatctgaacatcatatttgtwtggaaaaaatgcatcataacatgggtcatatctcatgataaacttggagcctgaaaaccaacagcccaagaagaaaacactttaattgctttcactttgc

SEQ ID NO: 13516 - DNA, 201 bp, Homo sapiens
taaattcatgtcattaattcactcattctgtttggaattctgtaattagaaaggcaggagtacagtaactcaacaaaaggtctcgtttgtgcccaaatggsccccaacagtgaaccacactgcataatggggagggaagtactatcagaggggaaactagaagtgtctgaagggaatggaataagtaaaaatgaaaaaatt

SEQ ID NO: 13517 - DNA, 201 bp, Homo sapiens
aaggcaaaattatcagattgtgatgcactaaaggcatttcctatgctttgcattattcctaaagttgtgtgtgtgtgtgtgtgtgtgtgtgtgtgtgtgtktgtgtcaccaaatgtcaaggcttcccatctggtcttaattcctgagaataccgactaaccatgtgactctgaagctgagcagaaacaactcagcaggtga

SEQ ID NO: 13518 - DNA, 201 bp, Homo sapiens
aaacggcagtttaagggggtagagcctgggaacttccatttttaactagctcctctaattaactgctggcatgctaaagttaaaaaatgcctgctatagakctatagctaggccatgacaggttgtttaaaataagccattatcaaagaggctctttggcaaaattactagaaatctcctgccttacaaatattcttgctt

SEQ ID NO: 13519 - DNA, 201 bp, Homo sapiens
ggttgtttaaaataagccattatcaaagaggctctttggcaaaattactagaaatctcctgccttacaaatattcttgctttgagtaatagctagtttttwcattttccatttttaagctccacacccctgcgacctacttcttaactcacagactgagtcttgcttgcaattttctggggtttttagcactgtctgggat

SEQ ID NO: 13520 - DNA, 201 bp, Homo sapiens
gttgtttaaaataagccattatcaaagaggctctttggcaaaattactagaaatctcctgccttacaaatattcttgctttgagtaatagctagtttttayattttccatttttaagctccacacccctgcgacctacttcttaactcacagactgagtcttgcttgcaattttctggggtttttagcactgtctgggatt

SEQ ID NO: 13521 - DNA, 201 bp, Homo sapiens
ttatcaaagaggctctttggcaaaattactagaaatctcctgccttacaaatattcttgctttgagtaatagctagtttttacattttccatttttaagckccacacccctgcgacctacttcttaactcacagactgagtcttgcttgcaattttctggggtttttagcactgtctgggattcacccttatgacatacca

SEQ ID NO: 13522 - DNA, 201 bp, Homo sapiens
tcttaactcacagactgagtcttgcttgcaattttctggggtttttagcactgtctgggattcacccttatgacataccacacactggaaacatgagggawatcttgatctatttcttgttcttgtttctaaaaatacaatgaaaggagggccatactggtaaatgataaggtgcaattttccttagttgtacctggtcat

SEQ ID NO: 13523 - DNA, 201 bp, Homo sapiens
ccttatgacataccacacactggaaacatgagggatatcttgatctatttcttgttcttgtttctaaaaatacaatgaaaggagggccatactggtaaatrataaggtgcaattttccttagttgtacctggtcatctaaaattatgtttaagtgatactgagctgcccttccatagataaagtaaatttaaagcgaatat

SEQ ID NO: 13524 - DNA, 201 bp, Homo sapiens
cttatgacataccacacactggaaacatgagggatatcttgatctatttcttgttcttgtttctaaaaatacaatgaaaggagggccatactggtaaatgwtaaggtgcaattttccttagttgtacctggtcatctaaaattatgtttaagtgatactgagctgcccttccatagataaagtaaatttaaagcgaatatt

SEQ ID NO: 13525 - DNA, 201 bp, Homo sapiens
cgccaccatgcctggctaatttttgtatttttcgtggaaacggggtttcaccatgttagccaggctggtcacaaactcctgacctcaagtgatttgctggyctcggcctcccaaagtgctgggattacaggcatgagccaccacacctggccaataatgacttttttgataaatactaataatatggatgtgattctcaga

SEQ ID NO: 13526 - DNA, 201 bp, Homo sapiens
actagggcaggaatatgaagtctttgtcctttgaaactgagggaaagagttcacaaacaactgtaataagatttatttattagttatattatttataaatkaacatattcaaatatactcaaaagtaaagtgaacgctataaagacatccatgtatctgccaatctggatgcatccattttgccaatctggatgcatctac

SEQ ID NO: 13527 - DNA, 201 bp, Homo sapiens
cactgcaacctccacctcccaggctcaaggaattctttcacttcagcctcccaagtagctgggactacaggcaagcaccaccacgcccagctatttctttmttttttttttttttttgtacttttagtagagacagggtttcactatgttacccaggctggtctcgaactcctggcctcaagtgatctgtctgcctcagcc

SEQ ID NO: 13528 - DNA, 201 bp, Homo sapiens
tacattccaaatattactagggtgctttgccatggggagaaaaatactttcttccatggggagaacaataatgggaaaatttgaaatactgtgttggtatraagtgaatgaccccattgaattggaaatcaattcttttgcaacttactttctaattcgtgctttcaacaataataaagaaggatttaatggatttataaa

SEQ ID NO: 13529 - DNA, 201 bp, Homo sapiens
caaggaatgttgcaaaatgtactgttgttaaagaaaagcctattcatgtatttaaaagaatagttaataaagggtatcgaatgtctataatatttatattmtaatgggtacatttaaaggagtgatatgacagctttattgtcaaataccaatattttccatccactagaaaaattaaaacaatttttgacaaaatagtgc

SEQ ID NO: 13530 - DNA, 201 bp, Homo sapiens
ctaatgggtacatttaaaggagtgatatgacagctttattgtcaaataccaatattttccatccactagaaaaattaaaacaatttttgacaaaatagtgytagataccaacttaaaaatacacaaggaggtacaaagcttcagaattctttttgagttcaaatgaagaaaaatgtttgaagatcactcttttaaaataat

SEQ ID NO: 13531 - DNA, 201 bp, Homo sapiens
cacttccctgcttccagctccctttcctggttggggtagcgagccactctcgccacttccagtttcctagttggggtggtgagccactctcgccacctccrgttttcttttccgagctgacttagcgagccactctcgtgtcctgtctctgttggggtgtgagtttcattcaaatcaatgagccactcttgttgtccccag

SEQ ID NO: 13532 - DNA, 201 bp, Homo sapiens
ttcctggttggggtagcgagccactctcgccacttccagtttcctagttggggtggtgagccactctcgccacctccggttttcttttccgagctgacttrgcgagccactctcgtgtcctgtctctgttggggtgtgagtttcattcaaatcaatgagccactcttgttgtccccagcccctctgggtcagattagttgt

SEQ ID NO: 13533 - DNA, 201 bp, Homo sapiens
cttaccacggttcagatgtctgtgcagtgctcctgatgccatccaggaatcccctttactggttccgttgcactgtctggaagggcaccgggacatgggarggcctatccccttcagggctgaagctctcccattggcaccaagtttcccaggtctcctctgtcccggggcctcagtcccacaggcaaaggagacagaaat

SEQ ID NO: 13534 - DNA, 201 bp, Homo sapiens
aagtttcccaggtctcctctgtcccggggcctcagtcccacaggcaaaggagacagaaatctgccatctccagtcccgggtttcagcaccagaaatgttgyagtgaattaagggaccagagagactgaatggggggggcaggagagtttatttaaggtgtacactggcttagtggacatgtatcctgaaagactgagcact

SEQ ID NO: 13535 - DNA, 201 bp, Homo sapiens
tctataaagaagaaagtattatttctgattaatgtatctcataattaattcggttcatgaatttatactttaaagtcattacatcagtagctaacatttaytgagtgatatgatacttgccaggcacagagttaagtgctctacgtggatgatttcataaatgcctcaatacaaccctattaggtaatactatttgtcccc

SEQ ID NO: 13536 - DNA, 201 bp, Homo sapiens
tggaattttattttattccttttgtacctaggtatcacactttgtatatgcagccttctttctctcaagtcagttttttttattaccgaggtaacctccayagtaacacttcctatctttaagctccctgcgaagttggaaatacaagctatatacacacttgaagaatagtatgtaagaaaagcaattataagaacaaga

SEQ ID NO: 13537 - DNA, 201 bp, Homo sapiens
caggaggatcatttgaggccaggagttcaagaccagcctggccaacatggtgaaaccccgtgtctactaaaaatacaaaaattagacaggtgtggtggtgygtgcctgtaaccccaactactcgcgaggcttaggcaggagaattgcttgagcccaggaggcagaggttgcagtgagccaaaatcgtgccaccgcactcca

SEQ ID NO: 13538 - DNA, 201 bp, Homo sapiens
accagcctggccaacatggtgaaaccccgtgtctactaaaaatacaaaaattagacaggtgtggtggtgtgtgcctgtaaccccaactactcgcgaggctkaggcaggagaattgcttgagcccaggaggcagaggttgcagtgagccaaaatcgtgccaccgcactccagcctgggccagagagcaagacgcagtctcaa

SEQ ID NO: 13539 - DNA, 201 bp, Homo sapiens
ttttttgtttgttttttcagaaccaccatgaatggtgacagcctctgtccaattcagtagcaaaaaccaaaaacacaggtgaaatatttggttagataccwgttttccttcctcccatccacctcctgcctcatgcatgcacgcatgcactatgtcactattgcaggccaccttctatgcctctgccttcttcatcttcat

SEQ ID NO: 13540 - DNA, 201 bp, Homo sapiens
tatcttcaacaattttataaatctttccctggacagctataatgtgaccaactttaagttgtgacatccctctattttttcaatcaccttgaaaaacagtycagtccttcatccctttccttctagctccacacttggtcccttcatgataagacccctggcaccaatcctccctatttaaaataaaattactatatggta

SEQ ID NO: 13541 - DNA, 201 bp, Homo sapiens
agtggtgacagatactgtgttataccatggagaatccatttcttaaatgtttacagcaatttgtgaaagctttcaaagtaataacatatataatctcttaytaaaatacaaggtgatctggatttgctgagtgctaaagtaatcgtggaagttacattaacttttatattgcctcactattttcaagtaaaccaaaatgaa

SEQ ID NO: 13542 - DNA, 201 bp, Homo sapiens
acttttacttcaaggggttcaccaatgcctattacagctaaactttttattattttttctatttcataaggacaatcaattctttaatttttctacttcartagtacattatagaatcctagcccataatactcaatgtcaaacatgtagcgctgtgtgtgtctgtgtgtacacgctcatgtgcttctgaaacaacgtggt

SEQ ID NO: 13543 - DNA, 201 bp, Homo sapiens
attttttctatttcataaggacaatcaattctttaatttttctacttcaatagtacattatagaatcctagcccataatactcaatgtcaaacatgtagcrctgtgtgtgtctgtgtgtacacgctcatgtgcttctgaaacaacgtggtaagaccaaagactagattttaatgcaacttaattacaaaagagaaagagac

SEQ ID NO: 13544 - DNA, 201 bp, Homo sapiens
taaactttcaaagaaaattcatgccaagaacatgtgaaaaatgacatcacaaatagccaccatttaaataaaatacttttaaactataaaacacagaataytgctaagcaaaattaaaaaaaatacctttactatgggaaaccttatttcctttttctagaaaatgtgactttttatgctatgttcatgtggcgagaatca

SEQ ID NO: 13545 - DNA, 201 bp, Homo sapiens
gccaagaacatgtgaaaaatgacatcacaaatagccaccatttaaataaaatacttttaaactataaaacacagaatactgctaagcaaaattaaaaaaawtacctttactatgggaaaccttatttcctttttctagaaaatgtgactttttatgctatgttcatgtggcgagaatcagtatggttaggaaaaatgattt

SEQ ID NO: 13546 - DNA, 201 bp, Homo sapiens
tcaaattaatattaacttagtaataaacttgtggatggcaaacatgagcatctctcacatgcaaaaaaaaaaaaaatagttcaatgaatgaggtgatgctrggaaagaatggcaaccacacttctcccagggaacccagacctcctaacttcaaaggctctcatttacagcacgcagttcattcatataaaagtaaacgtg

SEQ ID NO: 13547 - DNA, 201 bp, Homo sapiens
ctcaccatgtaaagatcatgaaagggtctttgactgttatcaaaactccatggatgcttttctattgtaaagtagaacaaacactggccataatttacttyagactgtgtctgaaatatctgaaccaaaaccaaaaccaaaaaccctgactaaaattacatcaccacactctctaatatggaagaagcacagacatgacag

SEQ ID NO: 13548 - DNA, 201 bp, Homo sapiens
cttttctattgtaaagtagaacaaacactggccataatttactttagactgtgtctgaaatatctgaaccaaaaccaaaaccaaaaaccctgactaaaatyacatcaccacactctctaatatggaagaagcacagacatgacagctgatcttttacctacctccattaatggtcacttcgccaaggcagttgtttggtac

SEQ ID NO: 13549 - DNA, 201 bp, Homo sapiens
tcaccacactctctaatatggaagaagcacagacatgacagctgatcttttacctacctccattaatggtcacttcgccaaggcagttgtttggtactttyggtgcacaacgtttatggcagttgaatctgcaatctaatcccagtgattttcaaacaaaacaaaatgagaatttgtcataaagaaaagtggtaaccagaa

SEQ ID NO: 13550 - DNA, 201 bp, Homo sapiens
aaggcagttgtttggtactttcggtgcacaacgtttatggcagttgaatctgcaatctaatcccagtgattttcaaacaaaacaaaatgagaatttgtcakaaagaaaagtggtaaccagaaaatacttatgtcagatgaatgagggtgatcaaagttcgacaggtgacaaaatcatccttacctttgcactgcaagccct

SEQ ID NO: 13551 - DNA, 200 bp, Homo sapiens
cctgtagccaagggtggctcaaggtcttatccacactgtagcgctttctcatttttacttgcagcaaattgttgataagatcaatggctgaaaaaaattacagtaaaaatagatgacaaatctgtaacatatgcataattcatttatagtttatttcacatctgctatttcacacagttaaatgcagcatagtgacaagg

SEQ ID NO: 13552 - DNA, 201 bp, Homo sapiens
ccttctccttcttccttttcctcttcctcctcctcttcttcttcttctccttctccttcttcttctgcttcttcttcttctccctcttctttttcttcttkctctttctcttcctcttcctcttcatgtccttctcctttcttcttcttctcttgcattccatgtcaagctgaagctggctagatttctcctcctccttct

SEQ ID NO: 13553 - DNA, 201 bp, Homo sapiens
aatggtttcaaaaattacctttatcacataatacattttattatcaaattctggtttgaaaaagggactgttattaataagagaagttaagtgacaatgcycgatgtcaaatgaaaggcttacagtgagagacaaagaggacattaataaaatcaacatgatctgcttctcagacatagctcactcccgtgactgatatgc

SEQ ID NO: 13554 - DNA, 201 bp, Homo sapiens
gaaaagcaatacagtaacagaaatcagtcaattgtcaacttaactttgaaacgtgaatcaagttgttctctcttacgtacgtacacaacctcattcctcawctattaagaaaatctcagggtacaggattccaatgttcctgaatgggtcagttcttcagggaaaacttagttaaggacttacgaagtataagatagttat

SEQ ID NO: 13555 - DNA, 201 bp, Homo sapiens
gaaacgtgaatcaagttgttctctcttacgtacgtacacaacctcattcctcaactattaagaaaatctcagggtacaggattccaatgttcctgaatggktcagttcttcagggaaaacttagttaaggacttacgaagtataagatagttatcactgttttattctctgcctagaatgcagtgtttcctataaaattct

SEQ ID NO: 13556 - DNA, 201 bp, Homo sapiens
aacactgtcattaacaccctggctgcattctccctcctagcgccctgtcttggattgacattgctatcacatcaccccacagatttctcatgtaaatgggraagtgggtaaacaggaagccataccagaaggggctcatcaggggcacttgtagagagttcagcagatgatgtgcggatggtgctgaccccagtgagggaa

SEQ ID NO: 13557 - DNA, 201 bp, Homo sapiens
taacatctgcaactgggttcatttaaagccaaattcaaaatgcctaaacccaatctctttatctttcttgctatcctgtaaccacagtaagcagtgagctraagattttctaaacgtttcaaccacccataaaaacaaatgtatgcggccgggtgcagtggctcacacctgtaatcccagcactttgggaggccgaggggg

SEQ ID NO: 13558 - DNA, 201 bp, Homo sapiens
agttatacataaatgcattcagttataatctttatacacaattgtagttttatatatatgaatgcttacatttataaaaaactaaatacatacatacagatagacagaagtaaagactataaagtgactgggaaacggaaaatgatcaatatttaaactaatatagacatgccaatcactgtgctaagcagtttccagaac

SEQ ID NO: 13559 - DNA, 201 bp, Homo sapiens
caatgccttacagctaaacttttatgatttttttctatttcacaaggacaatcaattctttaacttttctacttcaatcccccctttggtgctctgtataaatgatgtttaataaagagcaccacaatttttttttttttttgagtggctacacattttttttgaggcaaggcctggtacttggttaaggccatgatttga

SEQ ID NO: 13560 - DNA, 201 bp, Homo sapiens
acaaggacaatcaattctttaacttttctacttcaatcccccctttggtgctctgtataaatgatgtttaataaagagcaccacaatttttttttttttttgagtggctacacattttttttgaggcaaggcctggtacttggttaaggccatgatttgagtagtagtatgctttgttaccattgcctctacagttgactg

SEQ ID NO: 13561 - DNA, 201 bp, Homo sapiens
gacaggtgagaaattccttgtctccaggtcattccaggggcactctggtgcaggaaggaggattcctgcaccaggaatgcgctggtccagggtccgtaggrgagagaggggaagaaaactgggaagtctcaaggacaaggaggggcgcggcgaggaaagggcaagatacctggaaatgtcatgagaaggatggaaatgggt

SEQ ID NO: 13562 - DNA, 201 bp, Homo sapiens
cccccaccacttcaacgtcctactatcagcatcccgggaatgaaaaataggaaggtcgcaactttcaggttttgtcgttggaaaatgtgtttccatgctcmtacagaagtggaactaaaagatgacaaggccttgggtacctgcactcctggtcagttgttttgacaactggccgagtcaatcacactctcttaaaagctt

SEQ ID NO: 13563 - DNA, 201 bp, Homo sapiens
aaaattgtacagaattacctttgctttttgagaaattttgttttacattgtatacgtgcttatgaagcattgctgtttcattaactggtctgcatccaaayggagaggattgtatacaaggctttcacagtgcctaggagtgctcctgctgacccacaatagacattccacaatactgatgtggaaaaggagcatgatatg

SEQ ID NO: 13564 - DNA, 201 bp, Homo sapiens
atagtatatataatttttattagtaaattataccttaataatgctggggagggagaaagaatcttgtaggatcacctgcagtgttacaaagggaactcaaygtgagacaggtaattcaaacagtcagaactatgaaaatatcaaatagtaatttacaaaaatgtaaaagaaaaacacttattatgaccccaatgacaccaa

SEQ ID NO: 13565 - DNA, 201 bp, Homo sapiens
ctccttttttagctaaccgtattttctccagtgaaaagaacacaataaagtacaacttgaaactatgatacacagtgtcacccttctgcatctaagtccaygtattttgcctttgtcatgactgtgaagagcactttacgctacagcttcaaagcaggcttttctgtttaactacttgaattaataaaggtattatgtacc

SEQ ID NO: 13566 - DNA, 201 bp, Homo sapiens
aatcttgccaggaaaggaaactgaccagccttgtaataagtatctcagaagcaagacagcttaaaaacagtgctagaaacatggctgaaaatcactactgytccacctcccatgaatgattgacgtgcaccaagggctgggagaagccctcctcaaggttgactgcagaagttacacccacttcaggcttacagcacgcaa

SEQ ID NO: 13567 - DNA, 201 bp, Homo sapiens
cgttataatgccctatattcctgccctttgggccccaaatttggctctcagctctagggcagtcaacacaagatggaaaaacgttaataacacacttcacrctgtcaataagattaaaaacataggaatggctcaagagacgaacaactattcttgggattaaaatttaacagagaattttcccccaggttcctcaaaaga

SEQ ID NO: 13568 - DNA, 201 bp, Homo sapiens
acagttgttaattgtgtagctgatgttataatttcctttagaaggtatttttgaggatgcatcattcactattttttggttttttattcgcccacagaggygggaataaacatttctttcctacatggctgctccaagattgagatattattctgaaagtgctcagtatggagccttgcttaataaacattcatttaatca

SEQ ID NO: 13569 - DNA, 201 bp, Homo sapiens
ctgtggagaaaaaggaacgcttatacactgttggtgggaaatgcaaactaattcagccactgtggaaagcaatttggagatttctcgaagaacttaaaaarctaccatttgacccagcaatcctcctactgggtatatgcccaaaagaaaataattcattctatcaaaaagacaaacgcacttacttgttcactgcagtgc

SEQ ID NO: 13570 - DNA, 201 bp, Homo sapiens
aaaatatctatgatcctactagccagataaaaccacttacaattttagataataagagtatctttctagatttctatgtatctatacaaatttttaattgrctcattttataagtctattttataagcttattttactcaaccatatatcgtggacatctttcatgtaaataaaaatatatttccacatccacattttaat

SEQ ID NO: 13571 - DNA, 201 bp, Homo sapiens
actttgttctagatgcaaggggaagtataccatcctcagttggaagccagaagccaaaggagttccagggttgtattctgtatcctcttggagtacagagyaaagaaaggcagataatggatggggacatatggagaatattctagtggatatcattgaaatgttttacactgcagcatgatttaatgagacctacatttg

SEQ ID NO: 13572 - DNA, 201 bp, Homo sapiens
ggcaattactgaaaactgcctgtgaggctatatttaatttctgaatgcattcaccaggcagctagtgagtgctctgtatgtaccaaccactgcttctgagrcttagatttaaaagaaatacctgcatatctttgacctcatggaacccagaatctatgagagaagagaatcactatgcaaacatgttgcatgaatatttat

SEQ ID NO: 13573 - DNA, 201 bp, Homo sapiens
catgaacacagggaggggaacaccacacatcagagcctgccggatgtgtggacaaggagagggatagtgttaggagaaatacctaatgtaaatgatgagtkgaagggtgcagcaaaccaacatggcacatgtatacctatgtaacaaacctgcacgttgtgcatgtgtaccctagaacttaaagtataataataatttaaa

SEQ ID NO: 13574 - DNA, 201 bp, Homo sapiens
tccatcaataatagactggatgaagaaaatgtggcatatatacaccatggaatactaagcagccacaaaaaaggatgagttcatgtcctttgcaggcacayggatgaagctggaaaccatcattctcagcaaaatatcacagggacagaaaaccaaacactgcatgttctcactcataagtgggagctgaacaacgagaac

SEQ ID NO: 13575 - DNA, 201 bp, Homo sapiens
gaagccatgagtgactgtccatcaataatagactggatgaagaaaatgtggcatatatacaccatggaatactaagcagccacaaaaaaggatgagttcaygtcctttgcaggcacatggatgaagctggaaaccatcattctcagcaaaatatcacagggacagaaaaccaaacactgcatgttctcactcataagtggg

SEQ ID NO: 13576 - DNA, 201 bp, Homo sapiens
agtcctctggaaaggaacttgtgcacatctcaatggcacatctggtagctgcaaatggtgtggattagcataatttttccagcaatgatgcaccaaaagtwtaatgcaaaataagacttatgcctgctgtcaattgtttgttcttgcaaatgttaatataaaactttctagtggtggctataatgcttactatcagctcaa

SEQ ID NO: 13577 - DNA, 201 bp, Homo sapiens
tgtactcagccatgcaatgaaaaaacttattctatcaccatctgctgatatcctttcagccaattctcttaataaaacatacaagcaaagaaatgcaaggyagacggcaggatgtcaccacacccactataaacatatactgaataagataatcttcaatagattccatagttattttggaactgaccaaaaggtagactg

SEQ ID NO: 13578 - DNA, 201 bp, Homo sapiens
cctttagaatatttctacctggtggttgctgtggaacaaatcaatctacaaaaggagtcaaaacagaaacatattcaagaaaattcaggctattgacatayacatctgtatttagaagctgttatttacttgagatcaaagagccatttgtcagtttccctttgacacttgattacattttacatatttgtgtttttcttg

SEQ ID NO: 13579 - DNA, 201 bp, Homo sapiens
aacagtttccaggatcttattctcataatctatttatatgcctggaactgagctatataatcacctctgctaaactgttagattgacagaacccattgagraagaagtttatgtgttctgactttgacaaactgaatttgaggttgtttcaggagaggaaattcaagctattcacgcaattaaaaaacagaagcatacaat

SEQ ID NO: 13580 - DNA, 201 bp, Homo sapiens
cttcaatatggttaacttatggctccacagtcatcaactccagctgattttcacttattattattaccgaggtggggcaaataaaagcaatcaggtgaaasccttggttcagatttcctccatatttcatgaaatccatcaaacaaatgcccagattatatttcactgtaagatgagcaaaagcacacctcttcagctgca

SEQ ID NO: 13581 - DNA, 201 bp, Homo sapiens
tgcaaaagatgtctcttctgaaatcagtctgaattgttttaaaaaggagtgtcaataaaattaaacccaacctatacactgatttcaagaacaataaaaawaaatagtagccttatgctgtaaagaagtctgtatgaagcgtatggaggtacatacacttggagagatttggcactgaatcttaccttcactgcatttttt

SEQ ID NO: 13582 - DNA, 201 bp, Homo sapiens
tcctctctgatgcaaaagatgtctcttctgaaatcagtctgaattgttttaaaaaggagtgtcaataaaattaaacccaacctatacactgatttcaagamcaataaaaataaatagtagccttatgctgtaaagaagtctgtatgaagcgtatggaggtacatacacttggagagatttggcactgaatcttaccttcac

SEQ ID NO: 13583 - DNA, 201 bp, Homo sapiens
aggaaggtttctgacactctgcttagtgcagagcctggcatataggaaatgtcccaaaagtagatgatggagttaatgaataaatgagccaacaacccagraatttggaagaggcagttacaaattagttttagaatacttagtctgtgttttaaactataaagaatctatgaaggaaacagggtgggattagtcatagac

SEQ ID NO: 13584 - DNA, 201 bp, Homo sapiens
agagagagagagagaaagagaggcataaagagtattttaagaaataatggatgaaaacttcccaaatttgataaagatggaattttgtgacatcaaaaacygaaaggattgggaacaaagctgtaaaaggggtatagtttttgtatgttactgaagttaatctgacataaaatcaaattagattttgaaaagaaaatgaaa

SEQ ID NO: 13585 - DNA, 201 bp, Homo sapiens
ctttataagttacccagtctaaagtatttctttatagcagtgcaagagtggagtaatacacctctatgcacacaaactagaaaatccagataaattcctcraaacagacaccttcctaagattgaatcaggaagaaactgaaactctgaacagaacatgagttaaaaaactgaatcagtgaagtaaaacaacaacaacaac

SEQ ID NO: 13586 - DNA, 201 bp, Homo sapiens
agaagcttataccaagttgttaatggcccagtctccctctagttactcattctgccaccatggtccaatatggctgtggagctttgtccatcagatatccrttctggtcagaaagatggaggaaaagagaaagaagaaaggcacccctttgctgttaagataattttccataatgaccatataacatttctggctacaaca

SEQ ID NO: 13587 - DNA, 201 bp, Homo sapiens
aggccacaggtgagtgagctagacaaggttacgattaagtgtagccggaaagaagttaaagaaagaaatggcaggccacatgattccatgaagtactcatmaaattcataataaaatcacaatcacaggatggttaccttacattctggcttagtttctgatgagtatagttaaaataattccatatacttccttacccag

SEQ ID NO: 13588 - DNA, 201 bp, Homo sapiens
ggcagaattgaacagcctttcctttcccatcaagtaggaaacatttcagtataagaatatttataatatagtattctactttacaattgactccatatccrttttctgagtgatctcaaaataactttactttggttgacttatcttcctatacaatgaaattgctatttgttgaattcaaccaatttcaatttcatatat

SEQ ID NO: 13589 - DNA, 201 bp, Homo sapiens
attaccgaggtaacctccatagtaacacttcctatctttaagctccctgcgaagttggaaatacaagctatatacacacttgaagaatagtatgtaagaaragcaattataagaacaagattaatttttgctacaacttattaactataaaatatttctttaaaaatatatctcaaaaggttagggtaaaaaacaatctaa

SEQ ID NO: 13590 - DNA, 201 bp, Homo sapiens
agttaagttagcagctgaatgagatctaaagccagttctctcactcacagtccagtagttattagaatgtttggtttttttttttttttttggttggttgkttgttttttgagatggagtcttgttctgtcatccaggctggagtgcaatggcccaatctcggttcaccgcaacctccatctcccaggttcaagcgattct

SEQ ID NO: 13591 - DNA, 201 bp, Homo sapiens
acaaatttcaaaattcctgcggatttgaacttttacctggatggccttactagtggaagatgaccaaaattaaagtctcagactgacaaagattaggggayctaataggagatcaccctggtagaagaaaatatagattctttttggaatcccaacataaactcaggtacaagtgaaatagaatgaattggcggcccatta

SEQ ID NO: 13592 - DNA, 201 bp, Homo sapiens
tgacaaatttcaaaattcctgcggatttgaacttttacctggatggccttactagtggaagatgaccaaaattaaagtctcagactgacaaagattagggratctaataggagatcaccctggtagaagaaaatatagattctttttggaatcccaacataaactcaggtacaagtgaaatagaatgaattggcggcccat

SEQ ID NO: 13593 - DNA, 201 bp, Homo sapiens
cttatcctagagatagactcagtcaaaatctctgcaagggtcccaagcattactttggggagaattttggttttaacgtacatgcttggtaaagaaccatkgaagaactgccaattttcagtaatgatgaactaaattttcagaacaatctttctccactggaaaaaaaaatctaaaaagtactatttaaaaaaaaataaa

SEQ ID NO: 13594 - DNA, 201 bp, Homo sapiens
ggagaattttaaaagcatacgggtcttatcctagagatagactcagtcaaaatctctgcaagggtcccaagcattactttggggagaattttggttttaaygtacatgcttggtaaagaaccatggaagaactgccaattttcagtaatgatgaactaaattttcagaacaatctttctccactggaaaaaaaaatctaaa

SEQ ID NO: 13595 - DNA, 201 bp, Homo sapiens
ttcctttattcctaagatacatttttcattaacagttatcaaacctgtgagtcacaggccaagtcaacaaagccaagagacaaaccctggcgacacagagygccggaaaaaaaacaaacttacccctggttgatacggctttgtgtaccaagatagtccctcaagagacatttttcagctggtttctgtcacttgtaatca

SEQ ID NO: 13596 - DNA, 201 bp, Homo sapiens
atgtagccttctattcctttattcctaagatacatttttcattaacagttatcaaacctgtgagtcacaggccaagtcaacaaagccaagagacaaacccyggcgacacagagtgccggaaaaaaaacaaacttacccctggttgatacggctttgtgtaccaagatagtccctcaagagacatttttcagctggtttctg

SEQ ID NO: 13597 - DNA, 201 bp, Homo sapiens
agtttcttcctctataaattagcttttcatattcattgcttattttaagacattacaaataactccatccatttaatcacatgcttattagtgttgtccaygctgtcctttgatgagcagaaattctataagtgatgtcatcaaattcatcaattatgtattttataattttgcttacaaagtttgtttaatatggccttc

SEQ ID NO: 13598 - DNA, 201 bp, Homo sapiens
gggcattaaaagtttcttcctctataaattagcttttcatattcattgcttattttaagacattacaaataactccatccatttaatcacatgcttattartgttgtccacgctgtcctttgatgagcagaaattctataagtgatgtcatcaaattcatcaattatgtattttataattttgcttacaaagtttgtttaa

SEQ ID NO: 13599 - DNA, 201 bp, Homo sapiens
atcagatagttgtaggtatgcggcattatttctgagggctctgttctggcaaagacttggaaccaacccaaatgtccaacaatgatagactggattaagamaatgtggcacatatacaccatggaatactatgcagccataaaaaatgatgagttcatgtcctttgtagggacatggatgaaattggaaatcatcattctc

SEQ ID NO: 13600 - DNA, 201 bp, Homo sapiens
tccatccttctttcatgactgtgctgcttttcctcttcgtgtgtttgacagactgcactaccctcatgagtgggatattgttgcttgttgatggacttgaraagtcaaaatattgtagggaaaaaatgttttcaggtacattttatgtattttcatgcataaaaccttatgtcagctaatccaagtgaaactttacaaaat

SEQ ID NO: 13601 - DNA, 201 bp, Homo sapiens
gcagttgtttggtactttcggtgcacaacgtttatggcagttgaatctgcaatctaatcccagtgattttcaaacaaaacaaaatgagaatttgtcataamgaaaagtggtaaccagaaaatacttatgtcagatgaatgagggtgatcaaagttcgacaggtgacaaaatcatccttacctttgcactgcaagccctgcc

SEQ ID NO: 13602 - DNA, 201 bp, Homo sapiens
taaacgactctgatggtgatttttgctacattttggaaaacaataaaggaagcaagatgtaagaggctatttgatttatatatttatatattttaagataycggtttactcttgtatttagtactttgatgtttaataatatgaaatcatactgtatttctgttaattaatataatttacttgccttccccatttctattt

SEQ ID NO: 13603 - DNA, 201 bp, Homo sapiens
acattttggaaaacaataaaggaagcaagatgtaagaggctatttgatttatatatttatatattttaagataccggtttactcttgtatttagtactttsatgtttaataatatgaaatcatactgtatttctgttaattaatataatttacttgccttccccatttctatttgagttaccttgcttgtataatcttaaa

SEQ ID NO: 13604 - DNA, 201 bp, Homo sapiens
gtacagcttccattttccttgagagtatttggaaattcacattttcttttgaacattctctgaattttttttccaatttgttaatgggttttgaattctgwtcttattgcacaagctcaggaactatgctaggtatcatttttaaaaatgttctgtgatataacagtcttaggcttgaagggatatagaaattaactcaaa

SEQ ID NO: 13605 - DNA, 201 bp, Homo sapiens
cacagtgttttgacagattataggagatggaactcagaggatgctgacacgctcaccgagggctttcatttctgtttcttcagtctcaggagtgtcactgyggctagcacttggattgatcaggtgtgtggggtactgcagcccctgctcgcctgcatacttctcccacctcaggtcatcactttcatgggtgatgtagcg

SEQ ID NO: 13606 - DNA, 201 bp, Homo sapiens
ggccgctttcaccagctgaaggatgttttcagaggtagggtcatggcgaaaaagcaggatcttatcatacattccgtagaaaccacattcagggaactgcraatacaaataccatgagagtgtaaatgtcaaaatccttccaaatattttgttttaaatatttcagggcacaaatacaagctaattagaaaagttcaaagt

SEQ ID NO: 13607 - DNA, 201 bp, Homo sapiens
ttttgaaatctggtcctctgaggtctgttatgatccttggtttatttatttatttttggttttgccttttggttttgggctgtgtgtgtgtgtgtatatgygtgcgtgtatctcttctatcaaattatcctggtagagaaaaatgtttagaaacactaaattgttattaaatcctatgaagttgcatgcatttgagcaaat

SEQ ID NO: 13608 - DNA, 201 bp, Homo sapiens
tgaataaaaatggatagaaaacacttgaaacaaataaaggttttaagggaaaaatggaaggtgacaagatgctacatggaagctagcaatgcttccaactrgctttttgctgagagaggcttttatacttgcctgaggaaaaggatcagctgaggctagcaacacattttctggtttgaggtcacagtgaacgatattttt

SEQ ID NO: 13609 - DNA, 201 bp, Homo sapiens
cgcaaagccacgagtatctgtaaagaagaatcaccaaaatttcattccagtttattaatttcaaaatgtcttctaccagttaaaaggccaagaaaaaaaamtgacaatggacattcaaatttctttatgttaaagacactgaaatgagctagattaacataggtttctaaagaaatttcaatgaaaaaattaccatatgat

SEQ ID NO: 13610 - DNA, 201 bp, Homo sapiens
ctctacattacagaattgattatagaaaaattactaatctatataatttaatatttctaaaatatcacagaaaaaatatccaaattctattttgctttccraaatttactaaaaaattaaaatgaattaaaaaaactattttatgatgcttttattttccagtaatcacattagcaagttttatattagtaggtacatact

SEQ ID NO: 13611 - DNA, 201 bp, Homo sapiens
tgtacatttatcaggattacacatacagatgcttttgaaatctggtcctctgaggtctgttatgatccttggtttatttatttatttttggttttgccttktggttttgggctgtgtgtgtgtgtgtatatgcgtgcgtgtatctcttctatcaaattatcctggtagagaaaaatgtttagaaacactaaattgttatta

SEQ ID NO: 13612 - DNA, 201 bp, Homo sapiens
acttcgttatgtgctctggcaacctgcccttttcacttgacaagatcatttccagcatgtctccatggagtttttccataacaacaaacactctttcaggmgtctcaaacatacactccaaatttacaacaccagggtgatgaaggttctattaaagataaataaagcacttgaagaaaatgagttttttgatactgtttg

SEQ ID NO: 13613 - DNA, 201 bp, Homo sapiens
ggtctcaattttggtggccaaggattgttgggaactctgttaaatctcatattctttgctgcaagtttgggtcttatcagtccatttatttccctagaggygtaaaaaatgtaaatttccacattataacaaatacaaatcccatggaacccagaaatcaatgcaaaaaaatagcagtgtaaactatgaaaaataagttgc

SEQ ID NO: 13614 - DNA, 201 bp, Homo sapiens
aagtactttgtgttctaaaggctatcaggtctcaattttggtggccaaggattgttgggaactctgttaaatctcatattctttgctgcaagtttgggtcwtatcagtccatttatttccctagaggcgtaaaaaatgtaaatttccacattataacaaatacaaatcccatggaacccagaaatcaatgcaaaaaaatag

SEQ ID NO: 13615 - DNA, 201 bp, Homo sapiens
ccccattcttacattctcatctggctaaatcctagtcatccttcagttttcagcttaaacttcattggacttctcttaacttcccttttctcttccgtgtrgataaatatctcccccatgtgcttgtctttaccgtggtaatgtatgataactggtgaatcatttagttttgacttgaacaactgcagggctgtgctgagc

SEQ ID NO: 13616 - DNA, 201 bp, Homo sapiens
tcagtacctaaaactcctacttttcaaatcggcttacttttctccaactctgcttctgtgaataaagccaccatcatctcttacctaaatttctgcttcartgtctctttcccctgcttcactcttcttccttttccaatatattctcaatgctatagcaaaacttgaaccaatgctcgcatggataacggcatgaccctt

SEQ ID NO: 13617 - DNA, 201 bp, Homo sapiens
atttcaattttgtcatattcctacacccaaaacatgggtgtcatccttgcttctttccacttttctgtctccaaatattcagtacctaaaactcctacttytcaaatcggcttacttttctccaactctgcttctgtgaataaagccaccatcatctcttacctaaatttctgcttcaatgtctctttcccctgcttcact

SEQ ID NO: 13618 - DNA, 201 bp, Homo sapiens
acacacactggggcctgtcaccgggttgtaggagggagagtatcaggaagaaaagctaatgcatgttgggctttatacctaagtgacaggttgatctatayagcaaatcaccatggcacgtgtttacctatgtaacaaacctgcacatgctgcacatgtatcccggaacttaaaagttgaaggaaaaaacaaaaagaagaa

SEQ ID NO: 13619 - DNA, 201 bp, Homo sapiens
ctgcactcctggtcagttgttttgacaactggccgagtcaatcacactctcttaaaagcttatctgacaggtgagaaattccttgtctccaggtcattccrggggcactctggtgcaggaaggaggattcctgcaccaggaatgcgctggtccagggtccgtaggggagagaggggaagaaaactgggaagtctcaaggac

SEQ ID NO: 13620 - DNA, 201 bp, Homo sapiens
tattgatcattatactagttatttggtatagtttgagagcttattcaatgattccagtctaatacacacacacacacacacacacacacacacacacacamaaagtttcatataattatccattacactcttctttaaaagatttataaataattaaagattgtggttttctaaaggttttataatggggcatggacttcc

SEQ ID NO: 13621 - DNA, 201 bp, Homo sapiens
gtagttcgttatttaaattcaatttttaaaagtgttactgagtttttctaattacttttattatgtatatcataagaaatttagaaaaggaaaaataaaawaaaatcatctatctcacttcaagctagacataacgactgttagaattttcgagaatttgtttatattttaactaaaaagggaaaaagaaatataagggtg

SEQ ID NO: 13622 - DNA, 201 bp, Homo sapiens
aaaaacaacgcatcctaaaaattacaaattgtttaatttcacaaatttagaaattttttgaatttagaagtttgaacttggaagttttgaatttagaagawtttttatactgtttttgctttcgaagtcagtggtatatccctcttttcaattccagattttgcagttctacatttatgtgtatttttgcacattaagaca

SEQ ID NO: 13623 - DNA, 201 bp, Homo sapiens
agagcttaaatccagatttactgactcttaacttcagaaaatctgttttccattaacgtttcccaattataaggtttttaaggtttctacaggcatgtgtrtgtacacacacacacacacacacacccatcaagactattagcttaaatgaaggtttatttttcctttgaacaggtaatatttgcttaggtgataggagag

SEQ ID NO: 13624 - DNA, 201 bp, Homo sapiens
accagcctggccagcatctctactaaaataccaaaaattatctgggcatggtggcggacacctgtaatctcagctactcaagaagctgaggcaggagactcgcttgaacccgggaggcagaggttgcagtgagccaagatcatgccactgcaccccagcctgggcgacagagtgagactccatctcaaaaacaaacaaaca

SEQ ID NO: 13625 - DNA, 201 bp, Homo sapiens
taaagaatggatgaggagacttgtagtatagcaaaactgacaacgtctatctaggaccatggggttaacagtggagatggagagaaataaacagattttagatatattttgaaaacacaatggacaaaacttggattacatggtggagagaggatggagagacagtagtattgagaatggtttctcagtttctgaaacaag

SEQ ID NO: 13626 - DNA, 201 bp, Homo sapiens
gagaccatcctggaaaacatagggagagcccatccctactttaaaaaataaaaataattaggcaggcatgttggcatgtgtctatagtcccagcaacttgraggctaaggtgggaggatcacttaagcccaggagtgatcctatgattttgccactgcactccagcctgggtgacagagcgagaagaaagaaagagagaaa

SEQ ID NO: 13627 - DNA, 201 bp, Homo sapiens
aacttagcataacatcctcaagattcatcaatagtctatcatgtatcatgtattacttcttttttaaggttgaacaatattccactgtgtgtgtgtgtgtgcacgtgtataccacgttttgtttagccattcgtccatcaatggaacttgggttgcttcgaccctttggctactgtattacgttgttctagcattgctata

SEQ ID NO: 13628 - DNA, 201 bp, Homo sapiens
aaacttagcataacatcctcaagattcatcaatagtctatcatgtatcatgtattacttcttttttaaggttgaacaatattccactgtgtgtgtgtgtgtgcacgtgtataccacgttttgtttagccattcgtccatcaatggaacttgggttgcttcgaccctttggctactgtattacgttgttctagcattgctat

SEQ ID NO: 13629 - DNA, 201 bp, Homo sapiens
tcaatttcagctcaaaatagattgaaacacccaacagattgctgccatagtccacaaatgtttgtcattcgtaagctgtggcaataatgtgaatacagaggagggaaactgcaactgaactacaccttgtaaaaattcctttcatttgctttgtaataacccctgaagaaatgttaagaattattttgaaatcacatatgt

SEQ ID NO: 13630 - DNA, 201 bp, Homo sapiens
attccaatctttccccatgttttaatcagataattagattttttttcctatagagttgtgtaagctccttatatattctggttattaatcctttgtcagaygggtcatttgcaaatattttctcctattctgtgggttgtctcttcactttattttttcctttgctgtgcagaagctttttaacttgatgtgatcccattt

SEQ ID NO: 13631 - DNA, 201 bp, Homo sapiens
caactctcatcttgtagctcccataattcccatatgctgtggaagggacccagtgggagactgttgaatcatgagggctagtctttcccatgctattctcmtgatggtgagtgggtctcatgaggtctgatggttttaaaaatgggagtttccctgcacaagctctctctctttgcctgctgccatccatgtaagacgtga

SEQ ID NO: 13632 - DNA, 201 bp, Homo sapiens
aaaaatcagtagcatttctatacaaaataacattcaagctgagagccaaatcaagaaagcaaccccattcaaaacacacacacacacacacacacacacayatacacacacacacacagtacctaggaatacatctaaccaaggagttgaaagatctctaggaggataactacaaaacattgctgaaagaaatcacagata

SEQ ID NO: 13633 - DNA, 201 bp, Homo sapiens
gacaccttcctaagattgaatcaggaagaaactgaaactctgaacagaacatgagttaaaaaactgaatcagtgaagtaaaacaacaacaacaacaacaacaaaaaaaaaactaccaatcagaaaacgccctaaacagatggattaacagccaaattctatcagacacacaaagaagagctggtaccaatcccaccgaaac

SEQ ID NO: 13634 - DNA, 201 bp, Homo sapiens
agacaccttcctaagattgaatcaggaagaaactgaaactctgaacagaacatgagttaaaaaactgaatcagtgaagtaaaacaacaacaacaacaacamcaaaaaaaaaactaccaatcagaaaacgccctaaacagatggattaacagccaaattctatcagacacacaaagaagagctggtaccaatcccaccgaaa

SEQ ID NO: 13635 - DNA, 201 bp, Homo sapiens
caaaagaatcagtagtttacaaatgaataatccttttaagaagggatgagacaatgttgaagataaagcccacaatgtcaaaccattcacatcaataaacraaaaaaaaaattcctcgtttatgccctaattgaagaagactgatgattaacagcagacataacaccacagacatttcaagtggttcaacttgcacaattc

SEQ ID NO: 13636 - DNA, 201 bp, Homo sapiens
tgccacattactcaatccacattattcactgtaaaattgaaaacatggtttattatctaattattgggtacagggatctatatataagaggatatatatawaaatgcaagatataattcatggaaaatgcatattattaagaaactatgcataaatttcaaaatttttgcaccaaactaaactcatactaacttgctataa

SEQ ID NO: 13637 - DNA, 201 bp, Homo sapiens
tgtgtgtatgcttggaagaagtcactaccatgaagcaggagaaattcactctagtaaaagtggcacacatttcagtggggtcgaagatgtaaagtagataacttgccacttcatcaaagatgatttacaagtttataccaaggtatgaacctaatccacaaagggatcgttatttaaaaaaatgtaaagaggatagtgaca

SEQ ID NO: 13638 - DNA, 201 bp, Homo sapiens
tatggtgatggcttctttctttaaaccttatgaaacaaactctgttagctttcaacttttcttctgtagcttcctcacctctctcagcattcacagaattraagagagttaggaccttactctggattaggatttggcttaagggtatgttgtggctgctttgatcttctatccagaccactaaaactttctccctatcag

SEQ ID NO: 13639 - DNA, 201 bp, Homo sapiens
aaccgtggcttaaaatattcagaaaccatgctgcaaacagatgtgctgtcacacaggttttattccatttatggagcacagacagaacagatttagcatamatcttaaaggccccaggattttcagaatggtcaatgagcactggcttcaacttaaagttaccagctgctttagcccctaacaagggagtcagcctctgct

SEQ ID NO: 13640 - DNA, 201 bp, Homo sapiens
gtccaggctggtctcacacttcttgagctcaagtgatccaccacctcagccttccaaagtgctgggattacagacataagccaccataccagcccaatttmttttcttttcttttttttcttttccttttttttttgagacagagtcttgctctatctcccaggctggaatgctgtggcatgatcttcggctcactgaaac

SEQ ID NO: 13641 - DNA, 201 bp, Homo sapiens
ctttgccagtggagaatctagtctcaatattgatggctgttgattgatcacagtggtgattgctgaaggctgaggtggctgtagcaatttcctcttttttwaaaaaaaaaaaaattgagacagggtcacactccatggcccaggctggagtgcagtggcaatttcttggctcactgcaacctctgcctcccaggctcaggt

SEQ ID NO: 13642 - DNA, 201 bp, Homo sapiens
attttcaggtttctcaatgcatataaaagctatgcttacactacactgtagtcaattaagtctgcaatagcattatgtcttaaaaaatgcacatgcctcawtgaaaaaaaaaatactttattgctaaaaaatgctgacaatcgtctccagtggtctcttgacaggggatgatttcagggtgaaactgttccacctcagatc

SEQ ID NO: 13643 - DNA, 201 bp, Homo sapiens
cattagactctcaacaagtaattcaccagtagtacaagaagcccaaatatgcctccttgtgctactttacccatacacaatccaactaaaaaaaaaaaaaatgcatcctaatgtttaaaatagagttaccacagtaacaaagtgaacagttaaaaagcaatgaacttaatcaatgcaagtcattgttagaaagatcatccc

SEQ ID NO: 13644 - DNA, 201 bp, Homo sapiens
gaattgcttgaactcagaaggcgaaggttgcaatgagccgagatcaggccattatactccagtatgggcaacaagagcgaaactaaaaaaaaaaaaaaaaatgtatgcaaaaggcaagagaacaatctaacaacattgttatacaagattcccaagagtaaactgttcaaaaagcaatgttctccagctagtaaatctagc

SEQ ID NO: 13645 - DNA, 201 bp, Homo sapiens
tgcccaggctggagtgcaatggcacaatctcggctcatcgcaacctccgcctcccaggttcaagcgtttctcctgcctcagcatccccagtagctgggatyacaggcatgcgccaacacacctggctaattttgtatttttagtagagacggggtttctccatgttggtcaggctggtctcaaactcctgacctcaggtga

SEQ ID NO: 13646 - DNA, 201 bp, Homo sapiens
tagttttgctttttgaataaagaaagagttgatccctcttattgatataagcattaatcaattgactgagtttaacaatccctggaattagccagccccaygggattttttaatttggcttaacctatctacaacatcatgatttcccaatgtctatgctagtttttaatctcattgctcatatttctgtaaagttttctt

SEQ ID NO: 13647 - DNA, 201 bp, Homo sapiens
acccctcagaaataataccacacatctacaaccatctgatctttgacaaacctgacaaaaacaagaaatggggaaaggattccctgtttaataaatggtgytgagaaaactggctagccatatgtagaaagctgaaactggatcccttccttacaccttttacaaaaattaattcaagatggattaaagacttaaatatta

SEQ ID NO: 13648 - DNA, 201 bp, Homo sapiens
agccccaaatctccttaagctgataagcaacttcagcaaagtctcaggatacaaaatcaatgtgcaaaaatcacaagcattcctatacaccaataacggayaaacagagagccaaatcatgagtgaactcccattcacaattgcttcaaagagaataaaatacctaggaatccaacttacaagggatgtgaaggacctctt

SEQ ID NO: 13649 - DNA, 201 bp, Homo sapiens
ctcagccccaaatctccttaagctgataagcaacttcagcaaagtctcaggatacaaaatcaatgtgcaaaaatcacaagcattcctatacaccaataacrgataaacagagagccaaatcatgagtgaactcccattcacaattgcttcaaagagaataaaatacctaggaatccaacttacaagggatgtgaaggacct

SEQ ID NO: 13650 - DNA, 201 bp, Homo sapiens
cggagcagaaatgaaggagatacagacacaaaaaacccttcaaaaaatcaatgaatccaggagctggttttttgaaaagatcaaaaaaaattgatagaccrctagcaagattaacaaagaagaaaagagagaagattcaaatagacacaataaaaaatgataacagggttatcaccactgatcccacagaaatacaaacta

SEQ ID NO: 13651 - DNA, 201 bp, Homo sapiens
atcacaaagaagctaaaaaccttgaaaaaagattacacgaatggctaactagaataagtagtgtagagaagtccttaaatgacctgatggagctgaaaacmatggcacaagaactacgggacgcatgcacaagcttcagtacccgattcaatcaactggaagaaagggtatcagtgattgaagatcaaattaatgaaatga

SEQ ID NO: 13652 - DNA, 201 bp, Homo sapiens
cttgaacttgggaggtagaggttgcagtgagctgagattgtgccaatgcactccagcatggatgacagagcgaggctctgtctcaaaaaaaaaaaaaaaaaggagtaaaaacaatgcaaaaaccattatattatgtaggtatacacatatgactctacatgatccatgaattaccctcaaatttatttttctgatgagctg

SEQ ID NO: 13653 - DNA, 201 bp, Homo sapiens
caatggacctaaattttgaaatatctttttaaaatgtatttggaaaaatgtggctaccaaatatgatccaattcataggttcttcagattttgagataacrctttagaatgcaaaaaatgagatattcataatgtggagcattaattcagaatttaagattatagctatttgggggacagaggaacaaaacaaaaactttt

SEQ ID NO: 13654 - DNA, 201 bp, Homo sapiens
aagtttcatgagactagtgagccttgagactatcttttcccttgagtacacaatatcatattggttcttactatacaatgcctttcaagaaaccctctccwttgcccactgttcatcatagtcttaatctggctattgtcctgacttttgattctccttgatagctttctcaaccagcaaatccatgacacaatgcatgct

SEQ ID NO: 13655 - DNA, 201 bp, Homo sapiens
tttttaaagaataggaaaggagttgggagagattataactgaaaagggaaacaggagagctggcaatattccttttctagacctgggggtgactgcatggktttgcatgttataacaatttattaaaccatactttcagctttgtagactttcctgggtatatgttatatttcacagtgaaaacaatattagaagaagaaa

SEQ ID NO: 13656 - DNA, 201 bp, Homo sapiens
ttttctgccaaaattatagtttcctaacggagtaaataaaaaaactctccctaccaagagagggagattaaagcatggaagagagaaagaaaaaaaaaaaagctacttcaatgagtggagtgtgcattgtggaagaaaaagagggaagtggtaaccacagaaggtggagagagaataattatcagcagcaagactgagcca

SEQ ID NO: 13657 - DNA, 201 bp, Homo sapiens
aagaacccatgagggcatcaccaacttaatatgatgaggtcaaaggccaaaaagtgatgcaattaacacagcgatttaatttcacttttctgtttgtgtgmaatcatcaaagagcagcctacggtacataaaaaaagtaaaaagaatatgtttagaaacgaacttttctgatttcctgttttttcataacctttactttct

SEQ ID NO: 13658 - DNA, 201 bp, Homo sapiens
acaagtaagatatatatctacccagtttttccagttcaggatcacgaatggccagagcctattccagcagctcaaggccaaggcaggaaccagccttggamaggacatcatcctatcccaggatgcatgaacgcgcgcacacacacacacacacacactcacactcactcagactggggccatgtagacatgctaattcac

SEQ ID NO: 13659 - DNA, 201 bp, Homo sapiens
tatgaatttttaaaaaatactaagtctgccagagctccaaattatatacagtaactcctcattcaatgtcattggtaggttcttgggaactgcaactttaygtaaaataatgtataacaaaaccaattttaccataagctagttgatataaacaaaacttaagttcctacagcatatttctggttacaaaaacatcaccaa

SEQ ID NO: 13660 - DNA, 201 bp, Homo sapiens
cattcttccacataaaagtccactggtacacactgtcatctgattcaggtttctgtctaaatatccttctattatttatctcattgtgtgtgtacatatayacacacacacacacacacacacataatccctctactcattaacatgtgagctcacttggggagcgactgtgtgtgtgctttggttcattactgtatcccc

SEQ ID NO: 13661 - DNA, 201 bp, Homo sapiens
aaaatagcaagttacacttgaccccatgaaaggctgaaataaaaaatgagatattgaggaaaaaatctatagatgttcatgttctttgctttaggataccrtaaaaaatgagtatcaaggtaaaatgttatactgtgactatgcataaaataatcgctttcatttttcatgcatataatcgatcaatatatatctatgcta

SEQ ID NO: 13662 - DNA, 201 bp, Homo sapiens
acagtaaaaaatagcaagttacacttgaccccatgaaaggctgaaataaaaaatgagatattgaggaaaaaatctatagatgttcatgttctttgctttasgataccgtaaaaaatgagtatcaaggtaaaatgttatactgtgactatgcataaaataatcgctttcatttttcatgcatataatcgatcaatatatatc

SEQ ID NO: 13663 - DNA, 201 bp, Homo sapiens
gcttctttctttctttccttccttccttccttccttctttctttctctctctctttctttctctctgtctctctctctttcttttttctttttttttttttggagacagagtctcactctgttgcccaagctggagtgcagtgatgccgcaatcttggctcagtgcaacttccacttcccaggttgaagtgagtgattctt

SEQ ID NO: 13664 - DNA, 201 bp, Homo sapiens
cagtccggcctgggcgacagagcgagactccgtctcaaaaaaaaaaaaaaaaaaaaaaaaaaaaaaaaaatactctgccagtttacttttgctaaaaggtraggattcaataaaagtcctgaaattaaattattctggtcaataatggaatacatcaggcagttgaatattgcaaccttctcattaaatatgattctcaag

SEQ ID NO: 13665 - DNA, 201 bp, Homo sapiens
aaagggtgcttttccatagttgggccaatcacaaaaggcaagcaatactagaaacaaattaatccatgactcagtcaagtggaacaaaacggaaagagagwcatggcccaattaggaaatgaaaatactcggccgggcgcggtggctcacgcctgtaatcccagcactttgggaggccgaggcgggtggatcatgaggtca

SEQ ID NO: 13666 - DNA, 201 bp, Homo sapiens
ttactttttttccttttctatattatttgatattatttgttgatacttctttttatcttctctcctggtttatttgtataattatcctatttcacacacamtgaccttaaagctgtatatttccatttctcctcttcctgcctttatgctatttttctatgtcttttacatacacaaatgttagaaaaaccaaaatagaat

SEQ ID NO: 13667 - DNA, 201 bp, Homo sapiens
tctttaaatccctgtgtctttataaagttgttgtacacacgtatatatgactccctcatctttttgtgcagtctgacaatctctactttttttttttttttattttttttgagaccgaatctcactctggcgcccaggctggattgcaatggtacgatcttggcttatggcaacctccaactcctgggttcaagtgattct

SEQ ID NO: 13668 - DNA, 201 bp, Homo sapiens
agaaatggtcagtgatgttggaaaaaggatataaaatttaagttaggaggaataagttcaagatatctattgtataatgaggtgactatagataataatattatattgtatttttgaaagtcactaagataatagaaaaatttaagtgtacttaccacaaaaaaaaggtaagtaagtgaggtatgcatatgttaactacct

SEQ ID NO: 13669 - DNA, 201 bp, Homo sapiens
gagaaatggtcagtgatgttggaaaaaggatataaaatttaagttaggaggaataagttcaagatatctattgtataatgaggtgactatagataataatattatattgtatttttgaaagtcactaagataatagaaaaatttaagtgtacttaccacaaaaaaaaggtaagtaagtgaggtatgcatatgttaactacc

SEQ ID NO: 13670 - DNA, 201 bp, Homo sapiens
aaaaacaaactcaaaacagattacagacataaagataagacctaaaactataaaattactagaagatgtggagacaactccatgacattggtatgggcaaygatttttttatatgaccccaaaagcacaaacaaaaaaaagcaaatatagacaaacgttaagacatcaaactaaaaagcctctgcacagcaaaggaaacaa

SEQ ID NO: 13671 - DNA, 201 bp, Homo sapiens
attatatttattattgtagctttatcctaagcctgaaattcaggtagtgagagccttccaatgtcttttccctttcaagattgttttggatataggaccaytgaatttccatatacattttagaaatgctttgttgatttctacaaaaagttgtgaatttataaaaagcccactctatcatgtatttctttatagaccatg

SEQ ID NO: 13672 - DNA, 201 bp, Homo sapiens
ttgagctgtatgtctatccttaataaacataccaccacattatatttattattgtagctttatcctaagcctgaaattcaggtagtgagagccttccaatrtcttttccctttcaagattgttttggatataggaccattgaatttccatatacattttagaaatgctttgttgatttctacaaaaagttgtgaatttata

SEQ ID NO: 13673 - DNA, 201 bp, Homo sapiens
ccctttgtcagatgagtaggttgcgaaaatcttctcccattttgtgggttgcctgttcactctgatggtagtttcttttgctgtgcagaagctctttagttaattagatcccatttgtcaattttggcttttgttgccattgcttttggtgttttagacatgaagtccttgcccgtgcctatgtcctgaatggtaatgcct

SEQ ID NO: 13674 - DNA, 201 bp, Homo sapiens
gtgtaatgatatctcattgtggttttgatttgcatttctctgatggccagtgatggtgagcattttttcatgtgtcttttggctgcataaatgtcttcttwtgagaagcatctgttcatgtcctttgcccactttttgatggggttgtttttttcttgtaaatttgtttgagttcattgtatattccggatattagccctt

SEQ ID NO: 13675 - DNA, 201 bp, Homo sapiens
gtgggagaggagctgggagagtactgctgtcgatggttataggtaagcgcaggagatctaaacataattgagtgtgcgtgtgtgtgtgtgtgtgtgtgtgkaattgatatactaactgaacaatttaaagggtcaatgactttgggaaaatggcactatgtcgttcaaaactagaattaaactgttagagaatagctcctt

SEQ ID NO: 13676 - DNA, 201 bp, Homo sapiens
caaattagccagaagcagcttggttagttttcactcccaaagcagttaaaagatgatgaaaagtctgagcagaaaatgatataagcaaagaaaaaaaaaaatcttgatgttgtctgaagaaataaaattaaccttgaaatttttccctattttttctctcatttttactgcagtcctgtgtcagaaaatgttcctgctggt

SEQ ID NO: 13677 - DNA, 201 bp, Homo sapiens
aagattcaacatttatctttcaaacttttaaaactgtgactttatttgaggaattcttgtagtccttttctagtctctatttaactacctacaagatacayacacatatagacataaacacacacatatatacactgataattattagagatcaagccaaaaccaaccaaacaaacagtgttttgagtcatgtaaatgtag

SEQ ID NO: 13678 - DNA, 201 bp, Homo sapiens
tttccctgagctctcacaggcacttctgctactgccatgtgaagaaggtccttgcttccccttcaccttctgccatgattgcaagtctcctgagccctcccaaccatgtggaactgtgagtcaattaagcatcttttctttataaattacccagtctcatgtagtatctttatagcagtgtgaaaatggactaatacacag

SEQ ID NO: 13679 - DNA, 201 bp, Homo sapiens
tcctgttgtgccatcaaggccctaacatggcacttacataaattagaccagaccgttaaacttccattctaagaagcaaatataaggaatttttagcttcwcagtaaccagagcatagagacaaaagtcccctttgtgtggttttcattgccctcgtgttcttttcctgttttcatgggtgacagttataatactgtcttc

SEQ ID NO: 13680 - DNA, 201 bp, Homo sapiens
gaacagaaaatcaaacaccgcatgttctcactcataagtgggagttgaacagtgagaacacatgcacacagggaggggaacaatcacacaccggggcccgytgggggatggagggctaggggagggataacattaggagaaatacctaatgtagatgacgggttgaggggtgcggcaatccaccatggcacatgtatacct

SEQ ID NO: 13681 - DNA, 201 bp, Homo sapiens
acctagcataatatgatctgaggctgatattctatatttctggtctcagacttaaatcctcttaacatctcagaatcacaagagcccaaaattgggatacygaagatattctttcacatttcccctttcagatcagtttatcaaatgaaataaattcctttgaaatttattaggattgtaataaattaatgattaatctgg

SEQ ID NO: 13682 - DNA, 201 bp, Homo sapiens
ttattctatggccttgacatttcctaaacgattgctcagtaatacaatgcgtgatgtattttaaaatctgctacttggtaaagaatttgggcattttttttgatgcaaatgagaaacatctattatttacttagaaacaacttctgcaaagtatttgaactcaacaagcagtgcaattctggtattcttactaactggtta

SEQ ID NO: 13683 - DNA, 201 bp, Homo sapiens
aatttatgagttaccccccttataaaagtgggtcattttagaaatgtaaaaatctctttaaatggagttcagaaaaaacttcctgttcattttttttttttaaatatagaggtcctttagttcaagtgcacctgttggatgattccattggagactttagtccaagtgcacctgttggatgattccattcctgccattaaa

SEQ ID NO: 13684 - DNA, 201 bp, Homo sapiens
gatctttggtttaatattttagaaagatgagcaattataactcaaagaatgagcaaaagatgtatctttatcctcatctgtgtgtgtgtgtgtgtgtgtgkacagtcttttctatgcaatactggaccagctaactataactcaagttcagatgtttatgcttaggaaaaaaacatttctattttggactgtataagctct

SEQ ID NO: 13685 - DNA, 201 bp, Homo sapiens
tgagaatatgtggtgagttgaaaagctcaagaagcaaaaggaaaaaaaaaataggagaagttagattactggaaaatttattttgcttctgagtaatcacagttttattacatttatgtgtttccataactgagatgaataatattgtcacatgggatgaagggaagaatgaataagctgtctgtgtcactgttataaaga

SEQ ID NO: 13686 - DNA, 201 bp, Homo sapiens
gtttaatgctaacagacaaaatagaaaaagctattcaattatatttttgtttttatcttttctagaaaaatagaccatctttaaactaaaagaaaaaaaaataggaagaagtaacatatcaagaagaaaacaaagtctaggatggatgagaaaggggctttaaagaaattattttcaataggcccaaatgaattatagatg

SEQ ID NO: 13687 - DNA, 201 bp, Homo sapiens
acactaggtaatacagaatctgaactgaggcagtcctgacaccagaaccatataaactctctcagccaccattactcaacttgtatttttttgactatttaaacactatggattataagctgcacctttattttatgtatcactgaaaaatattttttaaagagtacaattaaatacatataacacacaaccccttgtaac

SEQ ID NO: 13688 - DNA, 201 bp, Homo sapiens
tacactaggtaatacagaatctgaactgaggcagtcctgacaccagaaccatataaactctctcagccaccattactcaacttgtatttttttgactatttaaacactatggattataagctgcacctttattttatgtatcactgaaaaatattttttaaagagtacaattaaatacatataacacacaaccccttgtaa

SEQ ID NO: 13689 - DNA, 201 bp, Homo sapiens
ctacactaggtaatacagaatctgaactgaggcagtcctgacaccagaaccatataaactctctcagccaccattactcaacttgtatttttttgactatttaaacactatggattataagctgcacctttattttatgtatcactgaaaaatattttttaaagagtacaattaaatacatataacacacaaccccttgta

SEQ ID NO: 13690 - DNA, 201 bp, Homo sapiens
gctacactaggtaatacagaatctgaactgaggcagtcctgacaccagaaccatataaactctctcagccaccattactcaacttgtatttttttgactatttaaacactatggattataagctgcacctttattttatgtatcactgaaaaatattttttaaagagtacaattaaatacatataacacacaaccccttgt

SEQ ID NO: 13691 - DNA, 201 bp, Homo sapiens
agacatttttggaattaatcagaaggaatataaataattaaactaaagattttcagtgacactcctccaatttatgctaggtaaatttgttttttttttttctttcattttttgaagaggattaacattcataagcagttagcacccttgacttatgtttaaatgccatatttctaaagttcaattttaatattctcctgt

SEQ ID NO: 13692 - DNA, 201 bp, Homo sapiens
cttttgaataactatttttttttttaaaaaagcagtataacctatttggattctaataatgttatctactaactcattcagtaaataatttttatttttaytttatttattattattttttgagacagagtctcattctatcacccaggctggagtgcagtggcatgatcttggcccaatgcaacctctgcctctcgggtt

SEQ ID NO: 13693 - DNA, 201 bp, Homo sapiens
ttatctttaatctggccatgttgatttattttcaacatgtctctatatggttaagtctctatacagtaagagaatgaatgaaaatatgtcttctccatgtkaaaaaaatcaatatgggaaaagacataaaaaacatacagatcacagattaatagaggataacagtcataatacataaagactataagcaaccaataagca

SEQ ID NO: 13694 - DNA, 201 bp, Homo sapiens
ctctgtagagcctcttaacttcaaagctaaattagtagatacctccttaaagtcacttaaaaacatttaagataactttagtaaagttatttaattttttwaaaaaaatccataatgtaaaaaatgctgtgtcatcaattatatcctatggtcacacaggtcatccaatatcttaaattctgcttcattttccaccttgac

SEQ ID NO: 13695 - DNA, 201 bp, Homo sapiens
tttttttcctgggtagccacattcatgaggacatataaactgttgaagtgaacataagtaacctttttttcatattttttatttattatttatgtatttayttttgagaccgagttttgttcttgttgtgcagtctagagtgcaatggctgtgatctctgctcactgcaacctccacctcccaggttcaagtgatactcct

SEQ ID NO: 13696 - DNA, 201 bp, Homo sapiens
tttgaaaagacacaaatattttagaggctgaattttctctagtttctagaagtctaatttatagtaccaattccaatcttctactctcctctctccttctcattattatttcttctatagaaatctttcttttttttttttcctgggtagccacattcatgaggacatataaactgttgaagtgaacataagtaacctttt

SEQ ID NO: 13697 - DNA, 201 bp, Homo sapiens
atttgaaaagacacaaatattttagaggctgaattttctctagtttctagaagtctaatttatagtaccaattccaatcttctactctcctctctccttctcattattatttcttctatagaaatctttcttttttttttttcctgggtagccacattcatgaggacatataaactgttgaagtgaacataagtaaccttt

SEQ ID NO: 13698 - DNA, 201 bp, Homo sapiens
atatttgaaaagacacaaatattttagaggctgaattttctctagtttctagaagtctaatttatagtaccaattccaatcttctactctcctctctccttctcattattatttcttctatagaaatctttcttttttttttttcctgggtagccacattcatgaggacatataaactgttgaagtgaacataagtaacct

SEQ ID NO: 13699 - DNA, 201 bp, Homo sapiens
tattattaaaatggcaacatcatcactctttttgagaaggcaagaaggaattcatctgattagattaaatcaagtatcagaataccatgtctaaggggttsagtaaaataatgtatctaaatatttgaaaagacacaaatattttagaggctgaattttctctagtttctagaagtctaatttatagtaccaattccaatc

SEQ ID NO: 13700 - DNA, 201 bp, Homo sapiens
ggtaacattcttgagattcagcttacatcttgggaaaaacatgtcctgtaacttacgcttatctattttgtgaccttgcagctgcacagcaagaagaaaarcagaaacttagagaccttacaatatatgtgggaaacagataaggtgtcttacagtttctacagaaaagcagttaatattcttttctaacttttacttcaa

SEQ ID NO: 13701 - DNA, 201 bp, Homo sapiens
agtttatttaaggtgtacactggcttagtggacatgtatcctgaaagactgagcactagacaaagaagttgccttttaagcagtttttggcaggaactacktgatgcaggaatcaggcttacagaagcaagaactaaagcagttaatcattaggtaacattcttgagattcagcttacatcttgggaaaaacatgtcctgt

SEQ ID NO: 13702 - DNA, 201 bp, Homo sapiens
ttcagcaccagaaatgttgcagtgaattaagggaccagagagactgaatggggggggcaggagagtttatttaaggtgtacactggcttagtggacatgtrtcctgaaagactgagcactagacaaagaagttgccttttaagcagtttttggcaggaactacttgatgcaggaatcaggcttacagaagcaagaactaaa

SEQ ID NO: 13703 - DNA, 201 bp, Homo sapiens
accagtttttcctgtggctttccttttgtctctgtgtttgctgatgaagtttttatttgtggtttggtttttgttacaagtttttctaattttttttttttaattttgtgtttactggtgaagtttttactttgtgtttgtagttgctagtgtagttgatttttttttggctcgagctgcgagagtttgtaataagctgtt

SEQ ID NO: 13704 - DNA, 201 bp, Homo sapiens
aatgccttacagctaaacttttatgatttttttctatttcacaaggacaatcaattctttaacttttctacttcaatcccccctttggtgctctgtataaatgatgtttaataaagagcaccacaatttttttttttttttgagtggctacacattttttttgaggcaaggcctggtacttggttaaggccatgatttgag

SEQ ID NO: 13705 - DNA, 201 bp, Homo sapiens
atgtcttacagtttctacagaaaggcagttaacattcttttttaacttttacttcaagggggttcaccaatgccttacagctaaacttttatgatttttttctatttcacaaggacaatcaattctttaacttttctacttcaatcccccctttggtgctctgtataaatgatgtttaataaagagcaccacaattttttt

SEQ ID NO: 13706 - DNA, 201 bp, Homo sapiens
gagctaactgtcaaatatcctaaatatatagcataaataaaatctaatcaacaccttttcacaacagtgaaacggtggctacagggcaagcaaaaaaaaaatatgtgcccactgcttagtggtgacagatactgtgttataccatggagaatccatttcttaaatgtttacagcaatttgtgaaagctttcaaagtaataa

SEQ ID NO: 13707 - DNA, 201 bp, Homo sapiens
taaatggtgtttaaattaattttcactcttagtctctattccaatttggccccatgtatttggtgaacctgaaaaatctgcagaatgatttttttttttttaatgagaagaggagggaaagttgaaatgctttggaaagtctgttttgttctgcttcattaatatgttcagagaaaaaaatggctcaaaacttaaagagca

SEQ ID NO: 13708 - DNA, 201 bp, Homo sapiens
gcgggtggatcacgaggtcaggagttcaagaccagcctggccaagatggtgaaaccccgtctctactaaaagtacaaaaaaaatcagctgggcatgttggygggcacctgtaatcccagctacttgggaagctgaggcagagaattgcttgaactcgggaggcagaggttgcaatgagccaagattgtaccactgcactcc

SEQ ID NO: 13709 - DNA, 201 bp, Homo sapiens
tagggaggtagtttatacttcaggtgtatttttctcccttccttccttccttccttccttccttctttccttccttctgtttttattatttttttttttttaggaatctcactctgttgcccaggctggagggcaatggcacgatcttggctcactgcaacctcgcctcccaggttcaagtgattctcctacctcagcctt

SEQ ID NO: 13710 - DNA, 201 bp, Homo sapiens
ggtccacggcctggggactgaggacctctgttttagaagaggaatagggaggtagtttatacttcaggtgtatttttctcccttccttccttccttccttycttccttctttccttccttctgtttttattatttttttttttttaggaatctcactctgttgcccaggctggagggcaatggcacgatcttggctcactg

SEQ ID NO: 13711 - DNA, 201 bp, Homo sapiens
aggtgggaattgaacaatgagaacacatggacacaggaaggggaacatcacactctggggactgttgtgggatggggggaggggggagggatagcattagkagatatacctaatgctaaatgatgagttaatgggtgcagcacaccagcatggcacatgtatacatatgtaactaacctgcacattatgcacgtgtaccct

SEQ ID NO: 13712 - DNA, 201 bp, Homo sapiens
actgcatgctctcactcataggtgggaattgaacaatgagaacacatggacacaggaaggggaacatcacactctggggactgttgtgggatggggggagkggggagggatagcattaggagatatacctaatgctaaatgatgagttaatgggtgcagcacaccagcatggcacatgtatacatatgtaactaacctgca

SEQ ID NO: 13713 - DNA, 201 bp, Homo sapiens
acaaaaaaaaaaacaaacactgcatgctctcactcataggtgggaattgaacaatgagaacacatggacacaggaaggggaacatcacactctggggactrttgtgggatggggggaggggggagggatagcattaggagatatacctaatgctaaatgatgagttaatgggtgcagcacaccagcatggcacatgtatac

SEQ ID NO: 13714 - DNA, 201 bp, Homo sapiens
actatcgcaaggacaaaaaaaaaaacaaacactgcatgctctcactcataggtgggaattgaacaatgagaacacatggacacaggaaggggaacatcacwctctggggactgttgtgggatggggggaggggggagggatagcattaggagatatacctaatgctaaatgatgagttaatgggtgcagcacaccagcatg

SEQ ID NO: 13715 - DNA, 201 bp, Homo sapiens
aaaaattaattcaagatggattaaagacttaaacgttagacctaaaaccataaaaaccctagaagaaaacctaggcattaccattcaggacataggcatgrgcaaggacttcatatctaaaacaccaaaaagcaatggcaacaaaagccaaaattgacaaatgggatataattaaactcaagagcttctgcacagcaaaag

SEQ ID NO: 13716 - DNA, 201 bp, Homo sapiens
tcaaactatactacaaggctacagtaaccaaaacagcatggtactggtaccaaaacagagatatagatcaatggaacagaacagagccctcagaaatgacrccgcatatctacaactgtctgatctttgacaaacctgagaaaaacaagcaatggggaaaggattccctatttaataaatggtgctgggaaaactggctag

SEQ ID NO: 13717 - DNA, 201 bp, Homo sapiens
gccaaaagaacaaagctggaggcatcacactacctgacttcaaactatactacaaggctacagtaaccaaaacagcatggtactggtaccaaaacagagayatagatcaatggaacagaacagagccctcagaaatgacgccgcatatctacaactgtctgatctttgacaaacctgagaaaaacaagcaatggggaaagg

SEQ ID NO: 13718 - DNA, 201 bp, Homo sapiens
atttggggaggctgaggtgggaggatgacttaagttcagaagttcaaggccagtctgggtaacatagagaggctccatctctaccaaaaataaaaaaaaaagttagccaagcttggtggggcatgcctgtagttccagctcatcaagaggctgaggtgggaggattgcttgaacctgggtcaaggctgcagcgagctgtga

SEQ ID NO: 13719 - DNA, 201 bp, Homo sapiens
ctcttgtgaacaggtgtcactggttgactgttacatcaacgaggtcatgatcaaatataactcactggactccgaggattcagaaattctcagatcactcmtattaagaactgtttgctcataccatccactggaactagagtataattatacttttgttgtgccactaattagcagagatttatcctggtttaatatagt

SEQ ID NO: 13720 - DNA, 201 bp, Homo sapiens
taatgactttttttttcttttccttttttttggagacagattctcactctcttgcccaggctggactgcagtggtgcagtctcagttcactacagcctccmcctctcgggttcaagagattattctgcctcagtctcccaagtagctgggattacaggtgcccgccaccatgcctggctaatttttgtatttttcgtggaa

SEQ ID NO: 13721 - DNA, 201 bp, Homo sapiens
tttttttttttttgttttgacggagtttcactcttattgcccaggttggagtgcaatggcaaatctcggctcaccacaacctctgcctcccaggtccaagmgattctcctgcctcagcctcccgggtagctgggattacaggcatgcaccaccatgcctggctaattttgtatgttttgtagagatggggtttctccatgt

SEQ ID NO: 13722 - DNA, 201 bp, Homo sapiens
gaaagttggagaagaggggagagacgcaatgactggggagtcctcctacctaaattatctgaatgatatgaatccttatgtgcctctacctgtattcctctttttttttttttttttgttttgacggagtttcactcttattgcccaggttggagtgcaatggcaaatctcggctcaccacaacctctgcctcccaggtcc

SEQ ID NO: 13723 - DNA, 201 bp, Homo sapiens
tatacataaatgcattcagttataatctttatacacaattgtagttttatatatatgaatgcttacatttataaaaaactaaatacatacatacagatagacagaagtaaagactataaagtgactgggaaacggaaaatgatcaatatttaaactaatatagacatgccaatcactgtgctaagcagtttccagaacaat

SEQ ID NO: 13724 - DNA, 201 bp, Homo sapiens
ttatacataaatgcattcagttataatctttatacacaattgtagttttatatatatgaatgcttacatttataaaaaactaaatacatacatacagatagacagaagtaaagactataaagtgactgggaaacggaaaatgatcaatatttaaactaatatagacatgccaatcactgtgctaagcagtttccagaacaa

SEQ ID NO: 13725 - DNA, 201 bp, Homo sapiens
gttatacataaatgcattcagttataatctttatacacaattgtagttttatatatatgaatgcttacatttataaaaaactaaatacatacatacagatagacagaagtaaagactataaagtgactgggaaacggaaaatgatcaatatttaaactaatatagacatgccaatcactgtgctaagcagtttccagaaca

SEQ ID NO: 13726 - DNA, 201 bp, Homo sapiens
aaaggcaaaattatcagattgtgatgcactaaaggcatttcctatgctttgcattattcctaaagttgtgtgtgtgtgtgtgtgtgtgtgtgtgtgtgtgtttgtgtcaccaaatgtcaaggcttcccatctggtcttaattcctgagaataccgactaaccatgtgactctgaagctgagcagaaacaactcagcaggtg

SEQ ID NO: 13727 - DNA, 201 bp, Homo sapiens
taaaggcaaaattatcagattgtgatgcactaaaggcatttcctatgctttgcattattcctaaagttgtgtgtgtgtgtgtgtgtgtgtgtgtgtgtgtgtttgtgtcaccaaatgtcaaggcttcccatctggtcttaattcctgagaataccgactaaccatgtgactctgaagctgagcagaaacaactcagcaggt

SEQ ID NO: 13728 - DNA, 201 bp, Homo sapiens
ctaaaggcaaaattatcagattgtgatgcactaaaggcatttcctatgctttgcattattcctaaagttgtgtgtgtgtgtgtgtgtgtgtgtgtgtgtgtgtttgtgtcaccaaatgtcaaggcttcccatctggtcttaattcctgagaataccgactaaccatgtgactctgaagctgagcagaaacaactcagcagg

SEQ ID NO: 13729 - DNA, 201 bp, Homo sapiens
actaaaggcaaaattatcagattgtgatgcactaaaggcatttcctatgctttgcattattcctaaagttgtgtgtgtgtgtgtgtgtgtgtgtgtgtgtgtgtttgtgtcaccaaatgtcaaggcttcccatctggtcttaattcctgagaataccgactaaccatgtgactctgaagctgagcagaaacaactcagcag

SEQ ID NO: 13730 - DNA, 201 bp, Homo sapiens
cagtgcactaaaggcaaaattatcagattgtgatgcactaaaggcatttcctatgctttgcattattcctaaagttgtgtgtgtgtgtgtgtgtgtgtgtrtgtgtgtgtttgtgtcaccaaatgtcaaggcttcccatctggtcttaattcctgagaataccgactaaccatgtgactctgaagctgagcagaaacaact

SEQ ID NO: 13731 - DNA, 201 bp, Homo sapiens
ttcagtgcactaaaggcaaaattatcagattgtgatgcactaaaggcatttcctatgctttgcattattcctaaagttgtgtgtgtgtgtgtgtgtgtgtrtgtgtgtgtgtttgtgtcaccaaatgtcaaggcttcccatctggtcttaattcctgagaataccgactaaccatgtgactctgaagctgagcagaaacaa

SEQ ID NO: 13732 - DNA, 201 bp, Homo sapiens
cttcagtgcactaaaggcaaaattatcagattgtgatgcactaaaggcatttcctatgctttgcattattcctaaagttgtgtgtgtgtgtgtgtgtgtgrgtgtgtgtgtgtttgtgtcaccaaatgtcaaggcttcccatctggtcttaattcctgagaataccgactaaccatgtgactctgaagctgagcagaaaca

SEQ ID NO: 13733 - DNA, 201 bp, Homo sapiens
tttctggacattatattttcagtatacgtcattaatagttcattatttattaaagtcattccctcacacttctcattcttgtaataacttccatgtttctytttttgaattttagcattttcttcccaaaaagagcttagtgaaatctgccaacctaataggaagcatttatatttcaaagagttaatttttgcccttaac

SEQ ID NO: 13734 - DNA, 201 bp, Homo sapiens
tctgtaacatatgcataattcatttatagtttatttcacatctgctatttcacacagttaaatgcagcatagtgacaaggcactagaaccaaaaaaaaaaatcctcttaagaatactgaaactttggccttcattttattttggatactaaaaaaaaaaaaaaaaaaaaaaaaaaaagaagaagttggaagtaattatgga

SEQ ID NO: 13735 - DNA, 201 bp, Homo sapiens
accctggaaagggaaaataaaaattatttttattgaaccataaattaaaaagtgattccaatattagtgtaaagtagaaatttaaaaaatagtacagcttycattttccttgagagtatttggaaattcacattttcttttgaacattctctgaattttttttccaatttgttaatgggttttgaattctgatcttattgc

SEQ ID NO: 13736 - DNA, 201 bp, Homo sapiens
cacaaagctcatattatcaaccctcttactttacttttcctgattacttgcaaataagagcagatagccagatggctttgagtattatgggagggccagakgctaaggaggcgactaatatgacgacatacacttgtttgataggcactatggaacatgtgatagtattgttcatacttgaacttgtgtcccaggctgtct

SEQ ID NO: 13737 - DNA, 201 bp, Homo sapiens
atctaatatcagctgtgaccaccctgtgccagatacgattaatagttgtgctggtgtgtttgtcaggtcctacaagcttaaaattaaaactatttggtctyaactccattaaaacttctaatgatggaattatttcttctcaataagataatgggatagaacctgggccagtaactacttttgtgacaccttaactgatat

SEQ ID NO: 13738 - DNA, 201 bp, Homo sapiens
ctttgattctgatgccttgggtcaaatcatacagcataatggagtcatggaattgcaagtttattatgaatgtgatctgagcagacgcctacacatctacmcaatagcctttaacctctaaagggctagagtcattgttcttcaaaccgttgcactgttaactggtcaagtctggcaacttcgaatagacctcacctccca

SEQ ID NO: 13739 - DNA, 201 bp, Homo sapiens
aattttgttttacattgtatacgtgcttatgaagcattgctgtttcattaactggtctgcatccaaatggagaggattgtatacaaggctttcacagtgcmtaggagtgctcctgctgacccacaatagacattccacaatactgatgtggaaaaggagcatgatatgacttacatcagcattagacaaaacgtgtcattt

SEQ ID NO: 13740 - DNA, 201 bp, Homo sapiens
acaggagacttggaggggacaaaacatccaaaccatatcaatattctattctccttgactaacacaaggccttgttagtccttggatctttagaggaaaamgagattctctgtctctgaatgtacacattcataaagaaattcaacagataaaagaataatactgatctcaagtgtttaaaatgcatacatacatgtactt

SEQ ID NO: 13741 - DNA, 201 bp, Homo sapiens
gtaaactagttcaaccactgtggaagtcagtgtggcgattcctcagggatctagaagtagaaataccatttgacccagccatcccattactgggtgtatamccaaaggactataaatcatgctgctataaagacacatgcacatgtatgtttattgcggcactattcacaatagcaaagacttggaaccaacccaaatgtc

SEQ ID NO: 13742 - DNA, 201 bp, Homo sapiens
ctcacccaatttcatccctataattctcttacctaataataaatgtaaatcacatttacatattagtgtttgtccatttgcatcgctataaaggaataccwgagcttgagtaatttataaagaaaataggttaattttggctcatggttctgcaggctgtataggaagtctgatgccagtatctgtttctggtaagggcct

SEQ ID NO: 13743 - DNA, 201 bp, Homo sapiens
tcccgaatagctgggtttacaggcatgtgccaccaagcccagctaatttttgtatttttagtagagacggggtttcaccatgttgaccaggatggtctccrtctcctgacctcgtgatctgcccgcctcggcctcccaaagtgctgggattataggcatcagccacagcgcccggccaagttcagtttttaacctgtttag

SEQ ID NO: 13744 - DNA, 201 bp, Homo sapiens
aaatcacaatccttaaacgccttattaaagggaaacagactatacttacctgatagagaataaaaagtcatcttgcagagaacagacaattataaaagtayttgttaaagataatacccaaattgatatgataagatctcctaaattccacaatcttatattcaattgtctttggggtatgttcatttaaatggaagaggt

SEQ ID NO: 13745 - DNA, 201 bp, Homo sapiens
atcacagcacgagctttaaggattacatgagttcggctagagttctgattctcctaggacaagtccactatgatatgtgcaaagtacacgttcctctttgmgcatcttcattgattcttttatttttctatttaatataactgtaagcacttaagcagtgttctggggagtctggcttccttaaatggctaagctttgcag

SEQ ID NO: 13746 - DNA, 201 bp, Homo sapiens
tatacacttaaatatcttcaaataaaataataaactgagaaagttacattgtcatagttacattgtcctgtgtaaaaaccaagctcactctcatggatcayagctttaattctgctcttttgattccaatatgcaatttatatttcagaattcacatacttaatggtaaaatgcttttaaaaggattagtacaagccaata

SEQ ID NO: 13747 - DNA, 201 bp, Homo sapiens
gataacaagatcaacaggatgctggctagattaacaacaaccacaacaacagaagttccaaataagcataaacagaaatgacaaagatgtaacattacaaycaatcccagagaaatacaaaagatcctcagagactattatgaacacctcttgatatggtttgcatttgtgtccccaccaaaatctcatgtcaaattataa

SEQ ID NO: 13748 - DNA, 201 bp, Homo sapiens
agtaatagagcccacctccttcatctctcacactgaccccttaccttcatcctcacctctgctgccttggttcgagccctcatctcttttacagggatccrccacagcatcccaactgatctggccttaggtcttcttctccaatccattcttcaaaaggctgccactgtgatcttcccaaaggtgattctgatgctacca

SEQ ID NO: 13749 - DNA, 201 bp, Homo sapiens
tctatgtcttcctctcacccaatttcatccctataattctcttacctaataataaatgtaaatcacatttacatattagtgtttgtccatttgcatcgctrtaaaggaatacctgagcttgagtaatttataaagaaaataggttaattttggctcatggttctgcaggctgtataggaagtctgatgccagtatctgttt

SEQ ID NO: 13750 - DNA, 201 bp, Homo sapiens
acacttgctaccttctgccaaagtctacaaggatcaaacttagtggtagccaactaagctaaataatgcttgtccaagtttctaaaacaagtattcatcaytttccatttatgaaaattagaggtaagaactatactttatcattttgaaccaccacatgatttaaaaagtaaacttaacttttaactttcccatccccct

SEQ ID NO: 13751 - DNA, 201 bp, Homo sapiens
gcatcctagaaagctcacttctgctccttcccagttgatatcccaccttagttttatttttaagtatcttgccataaattggttttgcttgatttgaactycatatactggattcataagtatgtaccctttgtctgacttatttctttaaatatcattttgtgagattcaacaatgttgcagagtgaatcaatagttaat

SEQ ID NO: 13752 - DNA, 201 bp, Homo sapiens
gggtttcaccatgatggccaggctggtctcaaactcccgacctcaggtgatccgccctcctccgcctaccaaaatgctaggattacaggcgtgagccatckcggccggccttattttatttttctacctctcgagtcagtagctgatactgtgttgacagacttggggaaagccaattaaaaggcctagacacagaaaatt

SEQ ID NO: 13753 - DNA, 201 bp, Homo sapiens
gaaaaatgaagactataataagattaagaggaaggaggagatttatttttatttaacaaatacataccatttgctatattatagacacagttttaagtatstttaagtattgactcaataaatcctcgtgacctctaactttatggttagatatcattatgtaatctccattttacagacgagaatatagaggacagagag

SEQ ID NO: 13754 - DNA, 201 bp, Homo sapiens
gctaatcatttcaagcttacatttttccatctactctgtaggactatcataagaaattttgtaaaaaccaatccaaattcaccaaacacataaagttcccwgcatttccagtcaagttaactatttaacaagagatgtcaagttaatacagcatgatttgttcttgcatttttggaagctaattcatcctctattaatcac

SEQ ID NO: 13755 - DNA, 201 bp, Homo sapiens
ctagaaagctcacttctgctccttcccagttgatatcccaccttagttttatttttaagtatcttgccataaattggttttgcttgatttgaacttcatawactggattcataagtatgtaccctttgtctgacttatttctttaaatatcattttgtgagattcaacaatgttgcagagtgaatcaatagttaattaatt

SEQ ID NO: 13756 - DNA, 201 bp, Homo sapiens
gacgcctacacatctacccaatagcctttaacctctaaagggctagagtcattgttcttcaaaccgttgcactgttaactggtcaagtctggcaacttcgratagacctcacctcccacgttgctctctcctggtcagagctgaagcacatggagatagttggggttcacaaagctcatattatcaaccctcttactttac

SEQ ID NO: 13757 - DNA, 201 bp, Homo sapiens
atgttggtcaggctggtctcaaactccctacctcacatgatctgcccaccctggcctcccaaagtgctgggattacaggtgtgagccaccgtgcccagccmactttactcttaattagactcattgacccttaagtcagatcagtcctgagggttgactataagataacgtagataaagcagagagtgcttgtgccacagt

SEQ ID NO: 13758 - DNA, 201 bp, Homo sapiens
ggcactcaccaccatgcccagctaattttttgtatttttagtagagacggggtttcaccgtgttagccaggatggtctcgatttcctgacctcgtgatccrcccgccttggcctcccaaagtgctgggattacaggcgtgagccaccatgcccggcctggctggggcttttatctgcaccctgaagcacctttgagatttt

SEQ ID NO: 13759 - DNA, 201 bp, Homo sapiens
tcaattagttctaacagctgccatgtgaacatgtgaacccattgttgatggatcttttagtttttcaaaagaagcagggaatctaggtgtgtgataaaatwacttgatctagatgtcagcaactgaaaaaaaaaaaatttaaaaactttgtgccagtcaatttatctggggactaaatctagttgaaatggagacctttga

SEQ ID NO: 13760 - DNA, 201 bp, Homo sapiens
cagaatgatttttttttttttaatgagaagaggagggaaagttgaaatgctttggaaagtctgttttgttctgcttcattaatatgttcagagaaaaaaayggctcaaaacttaaagagcacatttaaaatttcgttttttataactatgggcaacacatataagagaatgcattttttaaaattttatatttttatatta

SEQ ID NO: 13761 - DNA, 201 bp, Homo sapiens
gtagactatagagaagaaaaaaaaaatagttcctggaggaagcacaaaaatagccacgtttgttggatgtatttcctatttcttatactctacattcccaygaaaaagcaataagaggtatgaaactacaaagaaagagcccactcttaccttgtagtacctgcttcctgtgtcattctgaaagagggtaatacatttgct

SEQ ID NO: 13762 - DNA, 201 bp, Homo sapiens
taattcataggtttcattatgagtaactattatgaaatttaaaaataaatgacttttttatagaaatattcctctaaaatttcttctttaaaatttatccycaatactgaatctaggttgcattttagcaaatgtatctcattctactaatgaacagagaattcttcctgggataaagtgatcaagaattaccaattacca

SEQ ID NO: 13763 - DNA, 201 bp, Homo sapiens
cattttcttgaatctggcaatttgatactgaaatactcacagagatatctcctggaaatgcatgtaaaacaatatgcacacaaaaagtcagtaagagatgyaatagcaaaacaagtaagtacatgcttacaaatcatcctgcaaaagtggttttaactaaatcatagcaattaggtttttctaagaaaatgtcattagaat

SEQ ID NO: 13764 - DNA, 201 bp, Homo sapiens
gagacaaagaggacattaataaaatcaacatgatctgcttctcagacatagctcactcccgtgactgatatgctgacagttacatacccaattcatgttaytatcacagcataaaggcatgtttatgaaggcaaggtcatttgtaatataaaataaaatggtctcagcatgtccactatgagcaaatgctgaaatattacc

SEQ ID NO: 13765 - DNA, 201 bp, Homo sapiens
aaatgaaatgttccgttttgcgaaaaaaaattgtccgttaaaactgggaattaaaaattatgacatgcttgcatgagaagtaaaaaattatggcaggtatrtaaaaatcggaatttatcaatgatctcaactgagtagactagatagccatgatgactacatttagcaaataactgctctatttccctttggtctgcaaaa

SEQ ID NO: 13766 - DNA, 201 bp, Homo sapiens
tgcagtaaaatatagaaagatgtaaccatgttaaccatgaagctctcttctccaatcctataatgaagaataaatatctcctgtacgcatgctaactctgkattccttccctgcaaaagtatcttccttcaggagaccacagtgcgtggagactggaagtgcaagggccaggttaggaaagatgtcatttactagagtttc

SEQ ID NO: 13767 - DNA, 201 bp, Homo sapiens
ggccggccttattttatttttctacctctcgagtcagtagctgatactgtgttgacagacttggggaaagccaattaaaaggcctagacacagaaaattaraaccccaatatctagtcagttttctgcaattgcagtaaaatatagaaagatgtaaccatgttaaccatgaagctctcttctccaatcctataatgaagaa

SEQ ID NO: 13768 - DNA, 201 bp, Homo sapiens
actttgaagtcttctatcagctcaggtgctttttcccaagaacagaaacaaatcaaaatttgatctgaggacctagcagagctgactgaggaggattttgmcccattggcatttcaacccacatggtcccctctggagaatgaggaggaggaagggggagggcaaaacttgttaggccctactagggcaccagcttctata

SEQ ID NO: 13769 - DNA, 201 bp, Homo sapiens
atctctcctcactgcaacctctgcctcctggagggttcaagtgactctcctgcctcagcttcctgagtagctgggactacagatgtgcaccaccacacccrgctaatttttgtatttttagtagacatggggtttcaccgtgttggccaggctgttctctaactcctgacctcaggtgatccggctgcctcagccacacaa

SEQ ID NO: 13770 - DNA, 201 bp, Homo sapiens
tgatctctcctcactgcaacctctgcctcctggagggttcaagtgactctcctgcctcagcttcctgagtagctgggactacagatgtgcaccaccacacmcagctaatttttgtatttttagtagacatggggtttcaccgtgttggccaggctgttctctaactcctgacctcaggtgatccggctgcctcagccacac

SEQ ID NO: 13771 - DNA, 201 bp, Homo sapiens
cacatgttctttatccagtctaccatttttcaccatttaggttgattctgtatctttcctattgtgagttgtgagttacctctaggcttgtctctaacttytagcctcaactgatccttccactttgagagggattataggtgtgagctgggattataggtgtgagctactgtgcccagccattgttctgtttttaaatga

SEQ ID NO: 13772 - DNA, 201 bp, Homo sapiens
tgtaatttttgacaaatcctattactgtagtacagcttctatatttagatgtcagcacaccaaaaagcataacattccatgatatgctaaataatgtgtgyagacacataatccttcggatgtattatataccagataatggtaactaaagtgagcatgtagggtctactggacaaggttagatgacagaatatcatgtgc

SEQ ID NO: 13773 - DNA, 201 bp, Homo sapiens
ttcaagtatgacccccttcccttcacaccattattgggtttgtgtttaggagaaagagaatattaaaagtgtgaattattaccaaaaaaaaaaaaaaaaamaaacgctggaatctacatgaagctgtttaatggtttataaaaattgaaaaatggagcaaatatctggatttttcttctacttggcatcaaatgtctggaa

SEQ ID NO: 13774 - DNA, 201 bp, Homo sapiens
cccaaatatccaccctttttgccaccctaaaaccatttttataacaagccacactctctcctttctatgttttcatacatactacccttcagcctgaccaygaacgtttatcgggtgtgaatattcagctgtcaggtaacttttattgactctcccagtctgtcttggatgtctctctactctcagagtctttgctataat

SEQ ID NO: 13775 - DNA, 201 bp, Homo sapiens
gtgtgcaaaaagagttttgcccaacttctcaggctttccacagaaatgcagataaatttcatggcagagcaagctactacaggactctctggccatctgtytgttgcatttaagcaatttaattttcaggaaatgaaacatttggccaagtacaggaaaaaatagtgtccattcacacataacagattgatgacatattca

SEQ ID NO: 13776 - DNA, 201 bp, Homo sapiens
acaacatgacctgaggtgcccctgtacagagggtagaactttaatacatgtttatttccagaattggggtattcacagaatgttctaaatcaaaagtaagkgacagattaatgacagtgttcattgtcaactattttgtgccatgttcaccgtcagctctgaagagctctacaaatgttctctaatagcatcttgatgtaa

SEQ ID NO: 13777 - DNA, 201 bp, Homo sapiens
taacaaatgaataaaaatggatagaaaacacttgaaacaaataaaggttttaagggaaaaatggaaggtgacaagatgctacatggaagctagcaatgctkccaactggctttttgctgagagaggcttttatacttgcctgaggaaaaggatcagctgaggctagcaacacattttctggtttgaggtcacagtgaacga

SEQ ID NO: 13778 - DNA, 201 bp, Homo sapiens
ggagccaggtaagcgggggtacccaccactgacctccggaaagacttctctccaatgatccgggcaaaaccaaaatcacaaagtttcacctgttgatgaawggatttgcagaaatactccgttcacaattgtgtgtctgtgtgtcttagttcagattcaccagatacaaccataatattttaaatactttacctttacatt

SEQ ID NO: 13779 - DNA, 201 bp, Homo sapiens
accacatgtctagagagcgattgtagcccttgttccttaggacctcaggagccaggtaagcgggggtacccaccactgacctccggaaagacttctctccratgatccgggcaaaaccaaaatcacaaagtttcacctgttgatgaaaggatttgcagaaatactccgttcacaattgtgtgtctgtgtgtcttagttcag

SEQ ID NO: 13780 - DNA, 201 bp, Homo sapiens
aaagcagagatggggcatcatttgttccactactcctagaaaaaggatttaaagacatgaaggttgtttccccacacccaattcctgtgtaacaggaaagygtttgattggcttcagtggtattacggatttgcattctgataacaggatcaagttattttactggatttctagatgagcaatatcaagcataatggttag

SEQ ID NO: 13781 - DNA, 201 bp, Homo sapiens
gagccataaggaggtactgagtcatttggaaaagtgagggttctatctcccatctgagctggtctccatatcacttcatctgagtggtaggaaatttttartgcttagacatttctatagccaagtaaaatgtgtacttcctagtcaaatataaatgccttttgaattatcctgtataattccctcttgctaaaatgctat

SEQ ID NO: 13782 - DNA, 201 bp, Homo sapiens
atgagtaaaatatttctataggttcctaaatatcaagccataagaaataagcacccttttggtatacaacaatgtatagtgtaaagaatggagacaaattrtaaatgatttccagtctaagcccttgatttcaagatcatgaaacctctctgggttctctctaatgcagagacgaaagcaaatcacttaccagaggattgc

SEQ ID NO: 13783 - DNA, 201 bp, Homo sapiens
aacgaattcacatatgagtgtttagaatagtgcctggctacagggcaaatactgtaaaagtgtgagctattcatatttgttcatattttttctttcaacakttaattaattttactatctccattttactggaaacaccatttgctaagttttcttcaaattttctcttatttttcaaatcataccttattttgcacacaa

SEQ ID NO: 13784 - DNA, 201 bp, Homo sapiens
ggctggagtgcagaggcacttgcaccctctgcctcctgggttcaagcaattctcctgcctcagcctatcgagtagctgggactacaggtgtgcaccactaygcctggctaatttctgttattttcagtagagacggggtttcatgttggccaggctggtcttgaactcctgacctcaggtgatccgcccaccttggcctcc

SEQ ID NO: 13785 - DNA, 201 bp, Homo sapiens
ttttaaatccacagtaaactcagtatgatcgtatttcttatccccaaatcaaatattattttatgttgtgctaacagaaatgtgtactttgtaatgagggwagtagtcgtttcactttactctctcctttttttgtttgtttttttgagacggagttttgctcttgttgcccaggctggagtgcaatggcgtgatcttggc

SEQ ID NO: 13786 - DNA, 201 bp, Homo sapiens
tctcttttacatacatatgaaaaatagttaagagatcttaaactgaagattctgatttggtagttctgaggtggggcctgatagtctgtattttaatggcwgctaggcaatccaatattgctggactttaaaccacattttgagtagcaaggagctagaggtatgagaacattgatagtggttaaaaactggcttaatatt

SEQ ID NO: 13787 - DNA, 201 bp, Homo sapiens
tctatatgacagttctttacatctttggagacagtgattcattccccttaatctcacctctatagttccttcagatctttcagcctgcttagtcctcctgyacacctcgattttaatagtcactagctctactcaatgtccctgttaaaattcagtgatcatcactgaccaacattttcctcactaactgccaatttgaat

SEQ ID NO: 13788 - DNA, 201 bp, Homo sapiens
atttatgaagaaaaagtaatactcatcgttatctagtctgaaaatcatcctagttacccacagtatcatgtgatggagttctcactctccttttctggacrttatattttcagtatacgtcattaatagttcattatttattaaagtcattccctcacacttctcattcttgtaataacttccatgtttctctttttgaat

SEQ ID NO: 13789 - DNA, 201 bp, Homo sapiens
tgataaacttggagcctgaaaaccaacagcccaagaagaaaacactttaattgctttcactttgcttttgctttcaaaaataaccaatgtattggaattayatcagccttcatagactttctagaggaagacaggaaagaagtctatttaacaagaaatgttctctgaggggttagaaccacaatccctctggcctagtac

SEQ ID NO: 13790 - DNA, 201 bp, Homo sapiens
aaaaaaagaagaagttggaagtaattatggaagaagtattagagtctattgtatgatatgaatttcaattggtctactctttaacactttctttaatttaraaattttgtttatatgtacatcatttaaatatgtcttacaatatgggcaggataaaactaatattcaagataaagcatttactaattttgttataaaaca

SEQ ID NO: 13791 - DNA, 201 bp, Homo sapiens
tgattgtagattttaaatgttctcaccacacacacaagaaaagataagtctgtgagatgatggacatgttaattagcttgatttaatcactgcacaatgtwtacatgtaccaaaacattatatatcatagtatatataatttttattagtaaattataccttaataatgctggggagggagaaagaatcttgtaggatcac

SEQ ID NO: 13792 - DNA, 201 bp, Homo sapiens
aattcttacagacaggtcatcatgaagttgctctttggagctctcacctgtgatgctcatggaatttctaaagaggactactccgcttgtaaaaagcaacmtccaagatctctttccactgttattcctgagtgatctagcgtggccatttcttctggctctagccacaggaaggtcagagctttgctgtcatgttctttt

SEQ ID NO: 13793 - DNA, 201 bp, Homo sapiens
gactaacagatatctagtaaattcagacctctagtacagctggagatgtctgctgccttttcattagcaagatactaccagtaactcgtgaaaagagaagkctctatgtaagttgtccattgtactaaagttcaaaagttccaaatacatcaaagaaaagcacctttctagtacattagggaaaactactttactgtatgc

SEQ ID NO: 13794 - DNA, 201 bp, Homo sapiens
tattttctccagtgaaaagaacacaataaagtacaacttgaaactatgatacacagtgtcacccttctgcatctaagtccatgtattttgcctttgtcatkactgtgaagagcactttacgctacagcttcaaagcaggcttttctgtttaactacttgaattaataaaggtattatgtacctccagaatcaatttagtat

SEQ ID NO: 13795 - DNA, 201 bp, Homo sapiens
taatgcctggagtacagttctctttgttgtcagttaaatagagaaccacatgccataacatataagagaactgtaaaaggtagtcttccagaaccaagcayctaaacacatgatatcccctgacagggagagtactattccaacatcctgatgttctccaaaagccattctgaagactcaaaaccctggattaaaaataaa

SEQ ID NO: 13796 - DNA, 201 bp, Homo sapiens
agttgagacattcaagataagcaagagtgagccaagtgaagtggatgggaggtggaggaaaagtggttcagtcaggaataatgagagtatacaccaaggakgtgggaggaggcgggggagtataaggaactgaaaggcaactgtcaaagccagggatggcgaaagaagtgagatgggtagatcagcaaaatcacgcagagc

SEQ ID NO: 13797 - DNA, 201 bp, Homo sapiens
ctgcatatctttgacctcatggaacccagaatctatgagagaagagaatcactatgcaaacatgttgcatgaatatttatacatagtcacaccacctgctrcaaaagaaaaattcagtgagaaatgggagtatataattagggaaggtttctctgaggaagtgatgttaaagttgagacattcaagataagcaagagtgag

SEQ ID NO: 13798 - DNA, 201 bp, Homo sapiens
cttatgaatgtcggtttctaggtttcaggtcagaacacacagactcctgggctccagtgctagttctaattttcagttctaagtgtgctcctagatatgaytctacactaacacattacaatctcctcggcaattactgaaaactgcctgtgaggctatatttaatttctgaatgcattcaccaggcagctagtgagtgct

SEQ ID NO: 13799 - DNA, 201 bp, Homo sapiens
agccttatgaatgtcggtttctaggtttcaggtcagaacacacagactcctgggctccagtgctagttctaattttcagttctaagtgtgctcctagataygactctacactaacacattacaatctcctcggcaattactgaaaactgcctgtgaggctatatttaatttctgaatgcattcaccaggcagctagtgagt

SEQ ID NO: 13800 - DNA, 201 bp, Homo sapiens
ttatttataatagaaagaggtttttttttggttttcaaatctttttagtggcatgtggcattctttttgtcttcactcacatatttgggccaaagctcttyctaccttatttccacttgttaaacgtatggaatcttgctcttaattaaagtcagaaaaaataagtaaatcataccagtcacaaaagttataataagcata

SEQ ID NO: 13801 - DNA, 201 bp, Homo sapiens
gtggaagggtgcagcaaaccaacatggcacatgtatacctatgtaacaaacctgcacgttgtgcatgtgtaccctagaacttaaagtataataataatttwaaaaattactcaaatatcctttcattcatccaacaagaatttatagagcacctattctacggcagacacttaactaggctctgaggatacagaagggagt

SEQ ID NO: 13802 - DNA, 201 bp, Homo sapiens
ggaacaccacacatcagagcctgccggatgtgtggacaaggagagggatagtgttaggagaaatacctaatgtaaatgatgagtggaagggtgcagcaaaycaacatggcacatgtatacctatgtaacaaacctgcacgttgtgcatgtgtaccctagaacttaaagtataataataatttaaaaaattactcaaatatc

SEQ ID NO: 13803 - DNA, 201 bp, Homo sapiens
aaaagcatttttttaaaacaatgaatgcaatttgtatacaatttttactggcaaggttttcaatcagttaaatttttaatgtaaaatatatataacaatayctcaaattgaaaattgggctaaaacatgaaaagaaaagttagttgcactttaccaaacatacaaatgtatactaatgtattaatatttcatgtctaatat

SEQ ID NO: 13804 - DNA, 201 bp, Homo sapiens
aatatcaagagtcatttcctgttattggggttaaaagcatttttttaaaacaatgaatgcaatttgtatacaatttttactggcaaggttttcaatcagtwaaatttttaatgtaaaatatatataacaatacctcaaattgaaaattgggctaaaacatgaaaagaaaagttagttgcactttaccaaacatacaaatgt

SEQ ID NO: 13805 - DNA, 201 bp, Homo sapiens
tttgtacataaatacattttcaaaggtctgcaaggctacagatgaaaatatcaagagtcatttcctgttattggggttaaaagcatttttttaaaacaatraatgcaatttgtatacaatttttactggcaaggttttcaatcagttaaatttttaatgtaaaatatatataacaatacctcaaattgaaaattgggctaa

SEQ ID NO: 13806 - DNA, 201 bp, Homo sapiens
gttatacttgatggacatatcaccaaatactttatctcatgtttgaatttgtaaatgaccattagtctttaggagatgtacctgagatttgccacctaaaytcatagtccagagacccccaagattggaaacaaagacaagtaaaaatgagtaaaacgagaacacaagtcacaattatgaaaacttctgcaatctgtcttt

SEQ ID NO: 13807 - DNA, 201 bp, Homo sapiens
tttccctccccacccaaagaagttattacttcttccataaagtgttcctcataccagaaatcctaaactcccaaaactttctatctcttctcatggagcaygtcttacttatcccttccatagttttatagttttttagcataattttctatttctgtgttattctcccatttccaaatgcaattgatttcagactcctta

SEQ ID NO: 13808 - DNA, 201 bp, Homo sapiens
ggtctctcccgtgctattcttgtgatagtgaatacgtctcacgaaatctggtgggtttatcaggggcttccacgtttgcttcttcctcgttttctcttgcygccaccacgtaagaagtacctttcgcctcccgccatgattctgaggcttccctagacatgtggaactgtaagtccaattaaacctctttttcttcccagt

SEQ ID NO: 13809 - DNA, 201 bp, Homo sapiens
accaaggacatcacccagcaccttgcaccaaatccttctctattatgctcactgacttctgcctcattcctaaaacaccctgtgatatggtttgactatgyccccacccaaatctcaacttgaattgtatttcccagaattcccacatgtgggagggaccgcggtggggcgcgggtaatttaatcctgggggccggtctct

SEQ ID NO: 13810 - DNA, 201 bp, Homo sapiens
gcacacagttgcatcttgttttgagtttttgtttgcaaactgtcagtaagatcagaataaattgcatgatatgcagtccaatatgtatattcttgagcacrtctcaatgtacccaccaaaaaatattcatagctgcaggtgtagaaaaaaaaaggcagaattatggcttgatttgccttgataagcatggtaattttctgt

SEQ ID NO: 13811 - DNA, 201 bp, Homo sapiens
tccaaactaaatcacatcgtgtgtagctcagaaagggacatgaagatactcttcttaatgtaaggcaagataggtgatatatctcctaatggtaaaagctrcaagataagaaagaggtcttgcctgagaaccagctactcagagttgctgcaatcaacccaagaaacactacattgagatatcacgttaattcaaacttga

SEQ ID NO: 13812 - DNA, 201 bp, Homo sapiens
attgcagcaagcaaatggctacacttttctgaaagaatgaaatccaaactaaatcacatcgtgtgtagctcagaaagggacatgaagatactcttcttaawgtaaggcaagataggtgatatatctcctaatggtaaaagctgcaagataagaaagaggtcttgcctgagaaccagctactcagagttgctgcaatcaacc

SEQ ID NO: 13813 - DNA, 201 bp, Homo sapiens
accatgctaatgaaatgagtagttcgtgtgagtaggcagtgggaactacaactgctgagaaactgcagaaccacagtctcaggagcaaaagtttgccaacrcctcctcctcatgctcagtcaaaggcaatgagaaaagcagcctcccctagagagggttctgagaggaagaccagtcacatgagaaggtccaaatttcagg

SEQ ID NO: 13814 - DNA, 201 bp, Homo sapiens
gagttttatcaaactgtctctgctctagacagaagctgttagccattcattgttttagtagaagaataagttcatccaggttgtgatctgggcaaaaatayagctgtaccattgatctactttgtttgtatttttgacatactgttgtggaacttccattttttctcatttgtttgaaacagaggcctgatttttaactga

SEQ ID NO: 13815 - DNA, 201 bp, Homo sapiens
attcacaagctgttatttttaatatttgttattcgcagagcctatgttttccgagaataatgcaaaagaaaaacccattcaaatgcaaatgttaaagtatrtatttaattaataaatataaacaagctcacaattttaaaatatcctgggtcctgaccccattgaattgatagctctaaatgacagaatcattgaatgaat

SEQ ID NO: 13816 - DNA, 201 bp, Homo sapiens
aagtcacattttgaattaaacaggccccaactctaacatttacaggctaagtgaccttagacacgttgtttgattttgcttggactccacctggaaataaytgaatatactatgtgtgaatcaactaagcccagcactgagtacccataggcactcactttctccttggctttccatttgatactgtaaataacaacatca

SEQ ID NO: 13817 - DNA, 201 bp, Homo sapiens
atgagaaggtgaggcatatccgccctaaacacaatggatacagaatcataaggacaccccatattacccctggaaataaggttcattcataccaccaatcyagaggcaatactttctggctactacccgggtggtctgactcagtgaatatttatttaatgcctactatgtgcaggcaccaggctatgtgctaggaaaaga

SEQ ID NO: 13818 - DNA, 201 bp, Homo sapiens
ctactcaggagactgaggcagaagagtcacttgaaccagggagttggaggttgcagtgagccgagatcttgccactgcaatccagcctgggcaacagagcragaccaagagcctccatctcagtaaataaataaataaataacagcttagttgtgtcaatagctcattaaaactcttcttagaagctttttatcagtagtt

SEQ ID NO: 13819 - DNA, 201 bp, Homo sapiens
atggcaacaacactgggtcagcatttgccaggtgtggcaaattactgcatcttcctctttccaagtttcagcctggagtctaacaaaaagcacttaagaamctcccaaggcaggagcgcagtgctggctgactatcaatgtcttcttgctagtggtgccctagttctgttccaacagtctcaagttcttatggattcttag

SEQ ID NO: 13820 - DNA, 201 bp, Homo sapiens
cataggttcttcagattttgagataacgctttagaatgcaaaaaatgagatattcataatgtggagcattaattcagaatttaagattatagctatttggsggacagaggaacaaaacaaaaacttttgttataatatttattcaaattgttgcatattctctggaggcactctggtgtcactcactgcattggatttaga

SEQ ID NO: 13821 - DNA, 201 bp, Homo sapiens
ttatatacagtaactcctcattcaatgtcattggtaggttcttgggaactgcaactttatgtaaaataatgtataacaaaaccaattttaccataagctakttgatataaacaaaacttaagttcctacagcatatttctggttacaaaaacatcaccaaacttctaagtaaagataaaaacactcctaatactaaacatt

SEQ ID NO: 13822 - DNA, 201 bp, Homo sapiens
agccaaaataatccctctttgaaagatactgtaattgcctaaaacatttttcatagtattgtcagattctataactcatccatttcattatatcctatgtrtcaagctttcatttttgacatggattgtgatatttttgaaaataaaccccaaataatccagagtcaaatttagtaaataagccacatgcgttttagaagc

SEQ ID NO: 13823 - DNA, 201 bp, Homo sapiens
gagccaaaataatccctctttgaaagatactgtaattgcctaaaacatttttcatagtattgtcagattctataactcatccatttcattatatcctatgygtcaagctttcatttttgacatggattgtgatatttttgaaaataaaccccaaataatccagagtcaaatttagtaaataagccacatgcgttttagaag

SEQ ID NO: 13824 - DNA, 201 bp, Homo sapiens
taccaaagaaagatctggccttcaagagcaggtttttatatgattcaaggcagcttatgaagtataacaataaagttatatgactgtttttaaatggataytctagaatttatatacttaactgaatgttgtcttttctaacttagacaacatccattgtcagttactgacatttcattatattttgtatgtttctgtaag

SEQ ID NO: 13825 - DNA, 201 bp, Homo sapiens
tacagagaaagagagaactgaatatggaaataaagtatttgttatgatttttcatcactgcataggaagaaatcaaagggcattccaatatgacctcttartaaaaaagagcatctatccacataaaaccataaaacaatcttgatcaatattgaccttcattgaccaatcctgattaacacatttttaaacctgcattca

SEQ ID NO: 13826 - DNA, 201 bp, Homo sapiens
tgagaaaatgaacagttaagctttcaaaattgctgagtatagatagcaattctcaattacactaccaatgacattttccctagcaaaaatgtacactgcayccaaagataatgaacaagtagaaagtgagaactagaaaaatggccatggatgattgcacataatttgatatcgactgaatcataaagtgtatgtgtctgt

SEQ ID NO: 13827 - DNA, 201 bp, Homo sapiens
tttcaaactcaaatttcaaagagtatgtgtgtgcacatattagggcaaagaggacattccaataacttttcacaatctaaatcataaagtaggtatgtttytaataaaatatatttcaatacttaactaaatttaattgcatctctgataaaaaaatgcattttaacatatatatgcaggtctaaattaataaaccgtgat

SEQ ID NO: 13828 - DNA, 201 bp, Homo sapiens
tatagtattctttccttttcttgtacagtctttttcagcttttgatagtaaaattctggaatgtttgaataatttattagacaagtttttttaaattgtaygcattctgaaacagtttctgcttgtgtttgacagaaacttcacctaagatttcctgaaacaatgctctttgggtgggaggggcaggtgggaactgggtac

SEQ ID NO: 13829 - DNA, 201 bp, Homo sapiens
aaattatagtcaaaatgaagcgtttttgacctttaagtgaaagattagattttcttcacaataattcatattctcaatgggaaaagaaagaaaaaggtcaycaaagtaatcaaatgatacaaagttgttatctgcttgcaagcaagaataagctaatgaataatcagtagcagtcagtggtttccaaacctagaaagtcca

SEQ ID NO: 13830 - DNA, 201 bp, Homo sapiens
ggactgtgaaaagttaaacataacaggacaaaagcaaggaaaacctgagggctttctgtgggtcaatgtgttgaattttgagctaaactctgacctgattrttctcataaagtcagtacagacaattgtctgatgtcagcgtaatatgctggtttgaaaaagacagtgaagcaaatttctagcgccaggtagcattagtac

SEQ ID NO: 13831 - DNA, 201 bp, Homo sapiens
gatagcaattcgaatcataatgctgacagaaataattggaactgtttgcatgaaatgtattatacaaagtaaagagatttcattatatatcaagtttatawgttataacaactttgtatgtttattatacataaataaaactcaaattcttcattaacttactacattttcttggcttacttgtatatttaattacaatgt

SEQ ID NO: 13832 - DNA, 201 bp, Homo sapiens
aaattcagaaattaatagttttaaaggaaatgatacttttaaaaaactcactgatctttgcattttaagataatttcaagaggaaactagatagcaattcraatcataatgctgacagaaataattggaactgtttgcatgaaatgtattatacaaagtaaagagatttcattatatatcaagtttataagttataacaac

SEQ ID NO: 13833 - DNA, 201 bp, Homo sapiens
aattattatgtgaagttttatgtgaaggcatgtacaacataaagcataattacagtatgtttttgtttgatatatcaagctacagagcaggcaaaaattcmgaaattaatagttttaaaggaaatgatacttttaaaaaactcactgatctttgcattttaagataatttcaagaggaaactagatagcaattcgaatcat

SEQ ID NO: 13834 - DNA, 201 bp, Homo sapiens
ctcttccttcttcttcttttaggtacagtatatatttcttctagagaagaaagttctagagcaaagatagtcattcttcagcttcttagcaacaaaaataytcaactgaaagtatctgtgatcttttacagccattttcctttccagaggaattggaaaactggtatcaggctaaaggtataaagaccactatctgcagaa

SEQ ID NO: 13835 - DNA, 201 bp, Homo sapiens
cacatgccacagaaagtgggacgatcgccaagctttcaattttggcagctaattcatgaatctccaagccagaaacaagtgtgacaatgttttcctggagmgctcttccttcttcttcttttaggtacagtatatatttcttctagagaagaaagttctagagcaaagatagtcattcttcagcttcttagcaacaaaaat

SEQ ID NO: 13836 - DNA, 201 bp, Homo sapiens
caaagtaatcaacaacatcaaaaactgttctgtatccccttagttatagttatccagtacacactgacattccctgagcctgaacaaagtcaacaccacaygccacagaaagtgggacgatcgccaagctttcaattttggcagctaattcatgaatctccaagccagaaacaagtgtgacaatgttttcctggagagctc

SEQ ID NO: 13837 - DNA, 201 bp, Homo sapiens
gtgtgatcatagctcactgcagccttgaattcccaggctcaagtgatcctcctgcctcagccacccaagtagctgagactacaggtgcacactaccaaccracttaattttttattaaacaatacagatttattaccttacagtctggggattagaaaacaaacacgggtcttactggactaaaagcaaagggttggcagg

SEQ ID NO: 13838 - DNA, 201 bp, Homo sapiens
gttaataagtaaaaggctatgtttacttctaagacgtgagtgacctggatacagtacatacacaacattttccaaattttcttgatgaaaaaatgtgtttycacctcttctgtgaaggggttcaaaagactagcgttctttgaaaaatatgctgggaaataatgatttttaaaatgctttatataggagttaatttagtcc

SEQ ID NO: 13839 - DNA, 201 bp, Homo sapiens
ataccagataatggtaactaaagtgagcatgtagggtctactggacaaggttagatgacagaatatcatgtgcaaaaagtcaaatggtaataccttacatmtgtataaggttctgtggcaaaatgagtttaactaacatattcttaaaattaaacaagttttcaattatgggatttctcagaattgttaataagtaaaagg

SEQ ID NO: 13840 - DNA, 201 bp, Homo sapiens
acttttctcccctttttcttgttgccaaccctaaggtattttcaggatactatataacttacttatgaagatgttttactataataacataattatttgcyatcatggggtaccttgctgtgttttcagacctcagtgatgacagaggtgcttctactctaaggtcaattaagggaaaggctgtgtgttatatcacatgaa

SEQ ID NO: 13841 - DNA, 201 bp, Homo sapiens
ttacttttctcccctttttcttgttgccaaccctaaggtattttcaggatactatataacttacttatgaagatgttttactataataacataattatttsctatcatggggtaccttgctgtgttttcagacctcagtgatgacagaggtgcttctactctaaggtcaattaagggaaaggctgtgtgttatatcacatg

SEQ ID NO: 13842 - DNA, 201 bp, Homo sapiens
caattgtctttggggtatgttcatttaaatggaagaggtccaacaatgacatcagcgtctctccacccaaacttattcttctagtatttcttcgcttggcraatggcgaatcacctaggtcagaaaccttgagctcatcctaaatgctaacttctctttcacttccaacaacccactggtctctaaaagtaatagagccca

SEQ ID NO: 13843 - DNA, 201 bp, Homo sapiens
caacctatctttgcaataggtctttaggagcagtgcagtcttaatatggggacctctgactaattttctgtcaaagaacaaactgatttagttcataatgrgatagaaaaactaaatataaaagtgatgagcctaggatctaaattctaaatggtatgcagatcagaaggaagaatattccatcacacaatggaatgggtg

SEQ ID NO: 13844 - DNA, 201 bp, Homo sapiens
aaagtaacagaattattaataattttaaaatggcaagaagactgcaacatcaatcatggcatagtagtgtgcaaaaagagttttgcccaacttctcaggcwttccacagaaatgcagataaatttcatggcagagcaagctactacaggactctctggccatctgtctgttgcatttaagcaatttaattttcaggaaatg

SEQ ID NO: 13845 - DNA, 201 bp, Homo sapiens
tatatggttgagacaaggccatcatagatacttacttaggaactgtattttttcttgcattgaaacaaatggccaaacttgtttttatatttgatagtaasaaaagaaaacaaaacagactacatagatcatgccttatttagtcaaacttcttatactgcactgataagaatatgccgttagcctagagaatatattaga

SEQ ID NO: 13846 - DNA, 201 bp, Homo sapiens
gttctgtcctctacttttgtattacctactgtgtatgtatattgtgatttcccaacaagtgtttcctgagcctttgctatctagtcctccggtgtctattrctagtgataattaaaagttcataatttataactattcatttctggcatgaataggttttgtcttaataggctatagttacatagcaagtcaaattttcat

SEQ ID NO: 13847 - DNA, 201 bp, Homo sapiens
cctgaacttggaggccctggttttccacctaggtaacaattaaaggaaatatattatcattttatccaacatcacataactcgtctccccaactaacattmaagttctttgaagcacatctgatgttctgtcctctacttttgtattacctactgtgtatgtatattgtgatttcccaacaagtgtttcctgagcctttgc

SEQ ID NO: 13848 - DNA, 201 bp, Homo sapiens
tctccttttgtgcaactgtttgtaaatatataattcatgctggaatgtttcatttgtaggcatgcatttttatatagttatgtatgcataactatatatawgatgtatgtatgtactctgttacatattgcttataatgtattttataacaatttattacttaactattgtaagttatacataaatgcattcagttataat

SEQ ID NO: 13849 - DNA, 201 bp, Homo sapiens
agagagccaacaatgagggaaaaaagagcccaactggggtctggagtccagttccaaaactaacatcaaaattcagaatttagatctagagtgaatgtggyaggacatgcctttggaactgcaggagagtagtggagagggacaatgtgggagacatacaaaattgggccattctatgaattcctctcaaaaacaaagtaa

SEQ ID NO: 13850 - DNA, 201 bp, Homo sapiens
tgtttcatatgatgtcagtttctgcaatctatgagttacccttctccttccactctaacagcgctgaatctttcatcacgcatcctcaagtgacagtgtckgcaccaaagccatcctatttgtctaacctttgcaaatacatactgtttataagatagcatggatcaaagagtgggcaattaatgtttgcagtcaagcaat

SEQ ID NO: 13851 - DNA, 201 bp, Homo sapiens
cttcaatcaattattcatacaggctctctctcacggatactactgaggaacaaccatcagcataatgcctggagtacagttctctttgttgtcagttaaayagagaaccacatgccataacatataagagaactgtaaaaggtagtcttccagaaccaagcacctaaacacatgatatcccctgacagggagagtactatt

SEQ ID NO: 13852 - DNA, 201 bp, Homo sapiens
aagattcttctttgccatatagatatccaattggtcacagagatgtttgctgaaaagaccattcttttctcacagcagtttttcccttgtcataaatcagytggtctgtgtatgcacatagtttccggactctatttcatcggttaatttttctgtctttgtgtaacagcacattgccttaatactttatacttaactttg

SEQ ID NO: 13853 - DNA, 201 bp, Homo sapiens
caaaatataaaacaatacttcacatctggaggctatacaaggataaggaagctcttaaaaatatatttaaaaaatagttaaacataatctactacatatawattccacatctgtaatacataatatacagttccaaaatataatcctgttacattattaaacttgaaaagaaatttaaattttaaaagtacaggcagggca

SEQ ID NO: 13854 - DNA, 201 bp, Homo sapiens
gcctatttaatttagtgtattagagcaactcctctccattaatccatcctcactctatgtttacttttgctccttatccttctcaaagaattgaaaaaaargcaaagatcatgcaagatgtagtttttcattcttcaaaaatgtatggaagccactgggtttatgtaaatattgttaagatctacatcctagttgacattc

SEQ ID NO: 13855 - DNA, 201 bp, Homo sapiens
ttagaacagagtttgacacatacaaactcaatatacatctatataggacaataacttgagtcttctatttgtaaaccagtattctcttgccacactatcayaccactctcacagggctctaagcatgtcttggagcaaaatgcatgggaattatgatttatcaattttctagccaggcatggtgacacacacctggaatcc

SEQ ID NO: 13856 - DNA, 201 bp, Homo sapiens
ttataggcatgacccactgcacccagcagaaacttattttctaaaataagtctataaagaagaaagtattatttctgattaatgtatctcataattaattyggttcatgaatttatactttaaagtcattacatcagtagctaacatttattgagtgatatgatacttgccaggcacagagttaagtgctctacgtggatg

SEQ ID NO: 13857 - DNA, 201 bp, Homo sapiens
tcaaaagagacaaagaaggtcattacataatggtaaagggatcaattcaacaagaagagctaactatcctaaatatatatgaacccaatacgggagcaccyagattcataaagcaagtccttagagacctacaaagagacttagactcccacacagtaataatgggagactttaccaccccactgtcaatattagacagat

SEQ ID NO: 13858 - DNA, 201 bp, Homo sapiens
gtatgcctcccatttgcttcagagggagaaacatactatatcttccaaggctattcactattcaaacattctcaaaatgatagtctggaacaaaaacagtsagtgtccctgcttgtaaaacatgcagcaatgcgagacccatggagaattatctcactatatgtggttccatttatatgtcatttttggaaaggcaaaacc

SEQ ID NO: 13859 - DNA, 201 bp, Homo sapiens
gtgtcaggagttcaagaccagcctggctaacatggtgaaacccgtctctactaaaaatacaaaaattagctgggtgtggtggtgctcgcctgtaatcccarctactcggtatgctgaagcaggagaattgcttgaacctgggagacagaggttgtggtgagccaatatcgtgccactgcactacagcctgggtaacaagag

SEQ ID NO: 13860 - DNA, 201 bp, Homo sapiens
aaataagcgataatttttgtaacagtgaggtagaatcacaacacttttgaaatgcatttaggcagacatggctatttttaaattttaacctattctttaargcactcaatacatgttaatgtaataacatagccaagtgaatagtttaagtgaggacaactagagattggttttaaaatggtctttttttttttttttcca

SEQ ID NO: 13861 - DNA, 201 bp, Homo sapiens
agacattccaagtggagatgttgagttagaggaagctggatatgagagtctggagctaaggagagacatttttaaactggaaagagttttgagttcatctytagggaaatatcagaaaagaggaagagtgccagccaaggcaaactggaaagtgctattgcagattttaaaaaggagaaagaacgagagaaaatgatagat

SEQ ID NO: 13862 - DNA, 201 bp, Homo sapiens
ctggctaatttttgtattttttgtagagacagggtttccccatgttgcccaggctggactagaactcttggctcaagtcctccacctaccttggcctcccwaagagctgggtttagaggtgtgagccactgagcccggccagattacttcttcttttataaccaatagctctagaggtctgtaattgcctaatacatagtg

SEQ ID NO: 13863 - DNA, 201 bp, Homo sapiens
acagtccacacatactcttctaacacagatctgtctaagaatatcctgtggtctgaaaattttccatccccaagtttgctttcatgatgatttttctccarttttctaaaaggaaggcatggatgtcatacattccaaatattactagggtgctttgccatggggagaaaaatactttcttccatggggagaacaataatg

SEQ ID NO: 13864 - DNA, 201 bp, Homo sapiens
ctattaagaactgtttgctcataccatccactggaactagagtataattatacttttgttgtgccactaattagcagagatttatcctggtttaatatagwtcaaaattttgtagaaacaatagtaagttgaagcatctccattaactgctaatgacaacagatatattgtgccctcatatcaagaaagggagtcaacctt

SEQ ID NO: 13865 - DNA, 201 bp, Homo sapiens
tttgcaggcacatggatgaagctggaaaccatcattctcagcaaaatatcacagggacagaaaaccaaacactgcatgttctcactcataagtgggagctsaacaacgagaacacatgaacacagggaggggaacaccacacatcagagcctgccggatgtgtggacaaggagagggatagtgttaggagaaatacctaat

SEQ ID NO: 13866 - DNA, 201 bp, Homo sapiens
aatggtctctcatctttgtactagtagccactcatcctttatacctggctatgtggataacagcatttggtatcgagtccgactaatctctttatcattcytgccaaagtaaaacactaatttacaacacattactatcctactttgaatgacaagaaatttattttctgattggagaactacactctaaggaatccttca

SEQ ID NO: 13867 - DNA, 201 bp, Homo sapiens
gcttgcttctccttcaccttccagtattactgtaagtttcctgaggcctccgcagccatgcagaactgtgagtcaattaaacctttttcctttataaattrcccagtcttgggtatttatagcagtgtgaaaatggactaatatgtaagtgttccatagatgttactgactcccataacaatcctaaatgtctactgcaca

SEQ ID NO: 13868 - DNA, 201 bp, Homo sapiens
ccccactcactccataccagcctggcagcctcgctgctgtcctgcaagcactttaggacttttgcactgactgttctttctgcctaaggcacactctccamcgacatgtccacacggctgctccttcacctcatttgagtctttactcaaatgtcacgttctcaaggaagccagccctgaccaccctatgtaacactgtaa

SEQ ID NO: 13869 - DNA, 201 bp, Homo sapiens
caaataaacacatgcgaaagtgcttcacttgattaataatcagggaaatacaaaataaaactacaattaatgaacacacccacctgaatactttagtatcragcctgagaacaagacatgctgttgagaactgaaaaacagtcactctcctacccttctggtacaaatataaatgggtaaaaaccatttcagaaacatttg

SEQ ID NO: 13870 - DNA, 201 bp, Homo sapiens
ctctccatgtaacacgccccttggtagcttctgagacacctggaattcaccctccatttaaaatcccactaccaaacctcttgaactaggcatcagtctcyccattctgaactccaggaggaagtggggggcggggtggagggagaattcaagctggtcaaaacaaagtctatcaatattactttgacccaatttgaatat

SEQ ID NO: 13871 - DNA, 201 bp, Homo sapiens
tggagctgtgagaagaaggccaccatcctccagaccccagaatggtaaatccattgacagcttgcactgtgcacctggaaaagccacacacactcaatgtyggcccatgaaaacagccaggagggaagctgtaccctgcaaagccatagggacggagctgcccaagaccatgggaacccatatcttatatcagcatgacct

SEQ ID NO: 13872 - DNA, 201 bp, Homo sapiens
caaactgggtggaggccaccaaagctcaaggaggcctccctgcctctgtagactccatctctgggggcagggcatagctgaataaaaggcagcagaacctsctgcaaacttaaatgtccctgtctaacagctttgaagagagtagtagttctcccagcatggagtttgagatctgagaacagccagaccgcctcctcaagt

SEQ ID NO: 13873 - DNA, 201 bp, Homo sapiens
atgctcccttaagtgtgttcctccctaaattctaaccatgatctcctaacactctgaaaaggacatagccactttttgtaatgataagaactccctggtcyaacccaagaggccctaccagaacacaagcctaccaccatttctgaacaatgtgaggagttagaagggagggggggaaatgttcatgtttaattgataaaa

SEQ ID NO: 13874 - DNA, 201 bp, Homo sapiens
tcctccagggctgaaaaattcagcacctttagagacctctgtctccactcctgaaacgctggctgtttacactaagaagactggcgccatggccccctctscctcacgtctgtatcacccccttccatgcaacatccatctggatggctccagaggcaacctgaaaatccaagttgcaactgtaaacagtggtgggtgggc

SEQ ID NO: 13875 - DNA, 201 bp, Homo sapiens
gaaattgtgtattttccattactagaacaatttggtaatattctagataattactcagtggattggcacttgggagccgtacaggggttagataagatttytaacatcctgtattttgaagtattattctttgttgttatggaagaaagcaaacttacagaatatttttgttgatcctctattcagacatctccacacata

SEQ ID NO: 13876 - DNA, 201 bp, Homo sapiens
ctctttctcatttgtgtatctgcaataccagtgagttgtatactttcatatgttttcatgtggtagatatcatccttttgcttccagatataggactaccktagtatttcttgcagagctggtctaacggtgatgaattccctcagtttttgcttgtctgaaaaataatttatttctcctatatttttgaaggagagtttt

SEQ ID NO: 13877 - DNA, 201 bp, Homo sapiens
gtcagaggttgatagcattttacaataaatgtaaaatggaaatttttggaatatcagaggttgagagcatttaggcgaaaaaatactaattagctgatccrtttgagccagataaaatcactttttcttaggagtgagtgagtcttacattagtcttcttttgcaatttctgaaagataaagcaataactagcatataaag

SEQ ID NO: 13878 - DNA, 201 bp, Homo sapiens
tgtctttctagctgagacccaaggcatcatggaatagagattaaaaagcaccctgtggcttgtcttaattcctgatctccaaaaatccatgagcaaaattwaaaaataagttgtttaatgtcactaagttttagggtgatttgttacatagcagtagatactggaataaggtccacaattaaaagaaataaaatccattat

SEQ ID NO: 13879 - DNA, 201 bp, Homo sapiens
taaaagcatatttgaatttggatgagcatatttgcttacagaaaaaaataagatatccaccaaaatattaactatatttaactctgagtagtatgatccaytttggggcttatctgaatttctcaccttttctgcaatgagtgtgacatattagtttcttactgttcctgtaacaatttaccataaacttagtggctttac

SEQ ID NO: 13880 - DNA, 201 bp, Homo sapiens
ggccatagatacagcaggtaaaatagacaaaagggtctgggtcacaggaggaggtagaaaaggccttattactttttggctacttgccatagggataaaayataacaaataaagcaaacatttgacagactgtaaaatatttcataatatgtctgatctacaattttcaaaaactgagctgcaaggatggagttacgtggc

SEQ ID NO: 13881 - DNA, 201 bp, Homo sapiens
tcaactcctcaactaagagtggaggaaaataagaggcaaagcctcttggaaatggggcatcaccttcaggagagtcaggatgcaaggaagacataaagacygggaaaaagaaaggaacatcaggcatttgatcacaatagactcagggcctaaaaaggctaagggaaaagagataagagatatgggtaagaaacagggttg

SEQ ID NO: 13882 - DNA, 201 bp, Homo sapiens
cttaaggaggcggaacacagaagataatgctttctggcccaccgcacacctcctgttgttcggcccagttcctaacaggccacgtacaggtacaggtccayggcctggggactgaggacctctgttttagaagaggaatagggaggtagtttatacttcaggtgtatttttctcccttccttccttccttccttccttcct

SEQ ID NO: 13883 - DNA, 201 bp, Homo sapiens
gacattaagttggtagtcatcagtctataaatcatatttaatgtcatgagactgaatgagatccccaacaataactgcaaatagataagcagactaagtgytcatctttcagggattccaaaattaaaaggtctgaaaaatgtggaggaacaagtgagtcacaggcctctaggaagatacatgtctctaatgctctggata

SEQ ID NO: 13884 - DNA, 201 bp, Homo sapiens
tcctgcggatttgaacttttacctggatggccttactagtggaagatgaccaaaattaaagtctcagactgacaaagattaggggatctaataggagatcmccctggtagaagaaaatatagattctttttggaatcccaacataaactcaggtacaagtgaaatagaatgaattggcggcccattactaaaacccccaaa

SEQ ID NO: 13885 - DNA, 201 bp, Homo sapiens
gttgttgggaagagtataaggaaatggaaactctcatacactattttcagtagagttaaaaatgtaaacttttacacttttgaataactattttttttttwaaaaaagcagtataacctatttggattctaataatgttatctactaactcattcagtaaataatttttatttttactttatttattattattttttgaga

SEQ ID NO: 13886 - DNA, 201 bp, Homo sapiens
gagagaagaaactactagaataaatacaaaaggaaaggattccccttataaatcagtcaccaatcagggctgatgattttccctttccagtatttctcccrgtctctcccccaagtcttgactcatgttccaactagctcatgactgaacttcggtgctctttctgccataacatttttggcattctaaaacctccataca

SEQ ID NO: 13887 - DNA, 201 bp, Homo sapiens
cccaactctttcctgcttttgacaatggtgaaaaagctacggctgtttggtcaagtggtcataacctctagtgttactgttctgaggatctaacagcactraccaatctctaaataactgcgactcttggtcacccatgttcttacttgcagatttccatattagagacacagaccaagccttccaaggatgctaaatgca

SEQ ID NO: 13888 - DNA, 201 bp, Homo sapiens
tcatcggttaatttttctgtctttgtgtaacagcacattgccttaatactttatacttaactttgtataatactaccttgcctttactgcgcctttataakatgtttggcaagtctctggtttgttctacatcaggggtgctcaacctcagcactattgacattttgggttggatacttcttcattgtaggaggctgccct

SEQ ID NO: 13889 - DNA, 201 bp, Homo sapiens
agagctaaagaaagatcactatctatacaaaatgctttgtacataacagatattcaacatgcatttgtgaactcaataaatagctttcagtgcaaaaggtyctttgtatacattaaacaaatatttaaagtgtctaaatatgtaagatgcattttagttatttttttcatcagtagtttacacaagttggggggcacccat

SEQ ID NO: 13890 - DNA, 201 bp, Homo sapiens
cagaatgtgactgtatttggaggcagggcccttaaagaggcaattaaggtaaatgggtaagccctaatccaatatgaatggtgtctttataataagaagakgttatgccacagaagcacacaaaggaaagaccatgtgaagatacagagagaagatggctatctacaaaccaaagagagaggtcctcagaagaaaccaacc

SEQ ID NO: 13891 - DNA, 201 bp, Homo sapiens
aatcacaatgctaagcaatagagtgggagaggagctgggagagtactgctgtcgatggttataggtaagcgcaggagatctaaacataattgagtgtgcgygtgtgtgtgtgtgtgtgtgtgtaattgatatactaactgaacaatttaaagggtcaatgactttgggaaaatggcactatgtcgttcaaaactagaatta

SEQ ID NO: 13892 - DNA, 201 bp, Homo sapiens
cgggaaagacctgaccccatgattcaatcacttcctaccaggtccctcccacaacacgtgggaattcaagatgacatttgggtggggacacagccaaaccrtatcaggggtagtgctgaccaagaccacaggaacccacctcttgcatcagcatgacctggatgtgagacatggagtcaaagaggatcattttggagcttt

SEQ ID NO: 13893 - DNA, 201 bp, Homo sapiens
caagtgaattcacaagctgttatttttaatatttgttattcgcagagcctatgttttccgagaataatgcaaaagaaaaacccattcaaatgcaaatgttraagtatatatttaattaataaatataaacaagctcacaattttaaaatatcctgggtcctgaccccattgaattgatagctctaaatgacagaatcattg

SEQ ID NO: 13894 - DNA, 201 bp, Homo sapiens
tcaccttgttcagtaaatctcagtaaccaaaaatgaacaggaatctcataaataaggtcatacagaaaagaatacatagtactttttgtaaagctgttagwtataaagaatttgacaccacaagagaattagataaaagtataaatatatttaaaaatcaaacagcaaatatttcttggggactttactgtgtgccaagca

SEQ ID NO: 13895 - DNA, 201 bp, Homo sapiens
gggcaaggacttcatatctaaaacaccaaaaagcaatggcaacaaaagccaaaattgacaaatgggatataattaaactcaagagcttctgcacagcaaamgaaactaccatcagagtgaacaggcaacctacaaaatgggagaaaattttcgcaacctattcatctgacaaagggctaatatccagaatctacaatgaac

SEQ ID NO: 13896 - DNA, 201 bp, Homo sapiens
gagatcacactgcactccagtctgggggacagagcaacactccatctctaaataaataaataagaaaagcaaacactgaatggcacttttcttttcttttyttttttttgagacggagtcttgctctgtcgcccaggctggagtgcagtggcgtgatctcggctaactgcaagctccgcctcccgggttcacgccatccag

SEQ ID NO: 13897 - DNA, 201 bp, Homo sapiens
tcagttatgctcaaacaggtatcaaagcaactacaatcctctgaaatatcagctagcccgtttaagattcatgcttccattgcctttcacaaaggcctcaytaaattcagattcctatgctatgttcttgaaggggcaggaagtgtctctaagatattgtagccaatccatagatcttgaactccactttctatttaaagc

SEQ ID NO: 13898 - DNA, 201 bp, Homo sapiens
tcttctcagttaaaggcaactattttttcatttaaaaaagatttgtcttccaaacacaaatgacaaaaacagcagggaaggaaatgctattttcaagtttytaggaggttatcataaacaatgaagagagaaaaacaaattaaagttgtaaaaaaaaatggcatttgacagtatttcttctaccttgctgcctatgacaat

SEQ ID NO: 13899 - DNA, 201 bp, Homo sapiens
gaagaataaatatctcctgtacgcatgctaactctgtattccttccctgcaaaagtatcttccttcaggagaccacagtgcgtggagactggaagtgcaarggccaggttaggaaagatgtcatttactagagtttcagatgtcatctgcacctcaatgttgccagttgtttgtaactgattagcagatactaagacatga

SEQ ID NO: 13900 - DNA, 201 bp, Homo sapiens
aaaatgtatggaagccactgggtttatgtaaatattgttaagatctacatcctagttgacattccacattagtagatgaaattaacatctgtcacaaaggytgctctgaagttaatcagttatttctgagtactcgtaatttggtaaaggaaagctaggcatgcgtgattcgctttaccactcaagcaacaactgacgccc

SEQ ID NO: 13901 - DNA, 201 bp, Homo sapiens
aaagaaatttctttaggaatttatctcatgattgacagcacaagaatttatctaaccttcactatgaagtttaactagttctctcaaattcatatttggcygtttactttatgccactttaatgtagttttcagaaatataataaggatgaatagagtttcatgaagttaattttcttaaacaaatttttagaaagtgtaa

SEQ ID NO: 13902 - DNA, 201 bp, Homo sapiens
gttccaaatacatcaaagaaaagcacctttctagtacattagggaaaactactttactgtatgctatgcagtactcattcagggcaggaaccgttagaatygaactgaattgtgaatgtgctttaggtcaagtcatctctctttatatatagacacacttacatctacatttttgtaaagtttgaggaaagtacaattagt

SEQ ID NO: 13903 - DNA, 201 bp, Homo sapiens
caaatatttattcaggccctaccataaaatgttctcagaaaggaaggctttcactatctttaaatctttgacccagttagttgagaggactatcaaatccycagaagcgacccaaatctccggggcttctgtttgtttcctccagcaacgtccaatattctccctagctacatcttatctcacaaaatccttttaaaaatt

SEQ ID NO: 13904 - DNA, 201 bp, Homo sapiens
gcagggggatcaagaggtcaggagattgagaccatcctggctaacacggtgaaaccccgtctctattaaaaaatacaaaaaattagccgggcgtggtggcrggcgccagtagtcccagctactccggaggctgaggcaggagaacggcgtgaacccggaaggcggagcttgcagtgagccaagatcgcgccactgcactcc

SEQ ID NO: 13905 - DNA, 201 bp, Homo sapiens
ctttctgccataacatttttggcattctaaaacctccatacagcaaatccatctttcagatgtccttggtatgatgtcgctatgaaaagattactgaggcktctagcaatttgagtttaattcaaggccttttcataactgtacttcccttaaatacccaggccaccacctgcaggcctgctgcattccataggtgcttgc

SEQ ID NO: 13906 - DNA, 201 bp, Homo sapiens
cataatctattttgtacaatacaccttatacattgggaggttgttcatataaagtaagaatttggccaggcacggtggctcacacctgtaatctcagcacyttcagaggccgaggtgcacagatcacttaaggcccggagttcaagaacagcctggtcaacatggtaaaaccccatctctactaaaaatacaaaaattggc

SEQ ID NO: 13907 - DNA, 201 bp, Homo sapiens
atacatactggtgtggagaggtgcaaagggccatggtgcgtaatatcctcagacagttcaggaattaaaaaaagtctgagacagaaagagagagagcacayaaataataaagcaaatgggggccgggcgcggtggctcatgcctgtaatcccagcactttgggaggccgaggcaggcggatcacgaggtcaggagatcgag

SEQ ID NO: 13908 - DNA, 201 bp, Homo sapiens
tagaatagtgcctggctacagggcaaatactgtaaaagtgtgagctattcatatttgttcatattttttctttcaacagttaattaattttactatctccrttttactggaaacaccatttgctaagttttcttcaaattttctcttatttttcaaatcataccttattttgcacacaaaacatctatttttataaaggac

SEQ ID NO: 13909 - DNA, 201 bp, Homo sapiens
tttaaggattcattctttcactcaataaatagatattgattgcatgtgatataccagatcctaaagtttcaaatattaaaataaatcgttcctatttcaaraaatgtgtagtgcagtggggtggaggtggggtaagaggattgagtactttacatttggcaaccatcttgtgaaatgctttatatttattctcatgaattc

SEQ ID NO: 13910 - DNA, 201 bp, Homo sapiens
cacatatatatacacatatatatatacatatatatatacacatatatatacatatatacacatatatatacacatatatatacacatatatatatatatayatatatacacacatatatatatatatatatatatatatatatatgatggaatactactcagccataaaaagaaatgaattagtggcattcacagcaactt

SEQ ID NO: 13911 - DNA, 201 bp, Homo sapiens
gcagaggtagagtatgaaaaagagaaagcaaagatgactccaaagctgtagatcgagcaacagaaagcatgaatgggccatttgctgagatgggaagagcstaagagctgcaggtctggaagaaactatgagcagtttggttttgggtattttgcctttgcaaagcttcctagacattccaagtggagatgttgagttaga

SEQ ID NO: 13912 - DNA, 201 bp, Homo sapiens
cccttttctttcttgccctttagaatatttctacctggtggttgctgtggaacaaatcaatctacaaaaggagtcaaaacagaaacatattcaagaaaatkcaggctattgacatatacatctgtatttagaagctgttatttacttgagatcaaagagccatttgtcagtttccctttgacacttgattacattttacat

SEQ ID NO: 13913 - DNA, 201 bp, Homo sapiens
tggctcatgcctgtaattctaacattttgggaggctgaggcaggaggattgcttgaggacaggagttcaagaccagtctaggcacatagtgagacccccayctctacaaaaaattaaaaaattagcccggcgtagtggtgtgcagctatagtcccagctattcgagaggctgaggtgagaggattgattgagtctgggagg

SEQ ID NO: 13914 - DNA, 201 bp, Homo sapiens
gttgagctacagtatatgggaaatgcctcccagaaaagacgatatctaaatggatacttgaaaatactggggtgtggataagctcatgggagaatcaaccrcaaaaacaaacaccttctctgcactgaaagtataaatgtgcagggcaatgacaaaagacaggaagctagtgtggcacctgctggagagaatgagatgcac

SEQ ID NO: 13915 - DNA, 201 bp, Homo sapiens
ttatttgcataataaaataaaataacgacagatcttccaagattttcagtacttttttaaaaaactggtaattttggcaatgggagaagcataaactcttkctggctatgacaagttgagactgatataatgagaggaaatgcttaagcaatctataaggtagttattatgccaaaccccattttacagatgagaaaactg

SEQ ID NO: 13916 - DNA, 201 bp, Homo sapiens
gtttttttgacagggagtctcgctctgttgcccaggctagagtgcagtggtgcgatctcggctcactgccagctctgcctcctgggttcatgccattctcmtacctcagcctcctgagtagctgggactacaggcactcaccaccatgcccagctaattttttgtatttttagtagagacggggtttcaccgtgttagcca

SEQ ID NO: 13917 - DNA, 201 bp, Homo sapiens
gtaaactagttcaaccattgtggaagacagtgtggcgattcttcaaggatctagaactagaaacaccatttgacccagccatcccattactgggtatatamccaaaggattataaatcatgctgctgtaaagacacatgcacacgtacgtttattgtggcactagtcacaatagcaaagacttggaacgaacccaaatgtc

SEQ ID NO: 13918 - DNA, 201 bp, Homo sapiens
tacttttactctttcagattgatctcaattctgaatctaaaggcccaaatgaattcatgtatttatcaaatgagccaatcatccaactcttcccagcccakggactacaaggcttaatggttttaacttcacagtctcacaggatattcttgtgaaaactgtcaaatagtacatacctgttttaaaaaggtttataagtct

SEQ ID NO: 13919 - DNA, 201 bp, Homo sapiens
cttcaaatctaaatttatactttaatcaacttacatttgcatctatatcaacagtaatcaatagtacaacagcaacagcaatagtagaaaatgtcatactytgtcagtcaataatattaccttctttttatcactatgctgggcccttttcaaaaatactcactcaagccgtatttattttgatccttacaacaaactctg

SEQ ID NO: 13920 - DNA, 201 bp, Homo sapiens
aattattgcttaataggtacacaatttctgattggggtgatgaaaaagttctggaattagataatcatgatggtgagaatatatttaatattactaaattktacacttaaaatgattaaaatggtaaatttatactatgtatctctcattacaatagaaaattttaataaaatacatgaaaatttaaaaccacctaaaacc

SEQ ID NO: 13921 - DNA, 201 bp, Homo sapiens
cctttggcacacgaccctttaatataacttggttcaggactatatttttaaaaatctgggagaagggacagaatgtatgttcttcaatcaattattcatasaggctctctctcacggatactactgaggaacaaccatcagcataatgcctggagtacagttctctttgttgtcagttaaatagagaaccacatgccataa

SEQ ID NO: 13922 - DNA, 201 bp, Homo sapiens
tataagggtgaagacaaatgaaaagtgggaacagaatttaaaatccacgttataatgccctatattcctgccctttgggccccaaatttggctctcagctytagggcagtcaacacaagatggaaaaacgttaataacacacttcacgctgtcaataagattaaaaacataggaatggctcaagagacgaacaactattct

SEQ ID NO: 13923 - DNA, 201 bp, Homo sapiens
agtgagccgagattgcaccactgcactccagcctgggcaacagagcgagactccatctcaaaaaaaaaaaaaaagaaaaagtaaagaaaaacagaaaaatrtaaagcagagtttctctttgggattgtgagatatgtgatgaggcctcattttttgcagtctataacacaaaatataaaacaatacttcacatctggaggc

SEQ ID NO: 13924 - DNA, 201 bp, Homo sapiens
tcacggaatttttataaagataaaaggataataaaagataaaaggaaaacaggtaaagtgctgggtacttggtaggtgcctagttattttttaaagctatsatgtagaggtgcatctatgaaagactgacttactcacttggcagaaactggttgcttccatacaatctcatagtattttgaaaacttttcttttcaaaag

SEQ ID NO: 13925 - DNA, 201 bp, Homo sapiens
tatacacatatatatatacatatatatatacacatatatatacatatatacacatatatatacacatatatatacacatatatatatatatatatatatayacacatatatatatatatatatatatatatatatatgatggaatactactcagccataaaaagaaatgaattagtggcattcacagcaacttggatggga

SEQ ID NO: 13926 - DNA, 201 bp, Homo sapiens
ttgggattaaaatttaacagagaattttcccccaggttcctcaaaagaacactgtataacaaataatgtattggccttccctaagacctcagttgcacagragcatactatccaaccagcctcgaaacgggctaatggcatcaccacaaatcattctgcatttcattaatgcaatacctttggcacacgaccctttaatat

SEQ ID NO: 13927 - DNA, 201 bp, Homo sapiens
tgtcataatgagtatccactatctgcaatgcttgccaaacctttaccttaaacttaagtagctgcttattttctccacatttttggtgccccagtccttgsgtggctctatatgtgacagtaactctaggtaagaagtcaacatcatgtacttaggctgttttttcacacagtattcttacatactctgcctatttgggtc

SEQ ID NO: 13928 - DNA, 201 bp, Homo sapiens
ctgagaaaatggtttagtgtggcacaaagaaattaaaaccaggttgatatggttaggcttcgtgtccccacccgaatcttatcttgaattgtaatccccaygtgtcgaggcagggaagtggttaaattatggaggtggtttcccccatgctgttctcgtgatagtgagtgaattctcacaagatctgatggttttatagat

SEQ ID NO: 13929 - DNA, 201 bp, Homo sapiens
gatcaagaggtcaggagattgagaccatcctggctaacacggtgaaaccccgtctctattaaaaaatacaaaaaattagccgggcgtggtggcgggcgccwgtagtcccagctactccggaggctgaggcaggagaacggcgtgaacccggaaggcggagcttgcagtgagccaagatcgcgccactgcactccagcctgt

SEQ ID NO: 13930 - DNA, 201 bp, Homo sapiens
aggtacaaagcttcagaattctttttgagttcaaatgaagaaaaatgtttgaagatcactcttttaaaataatccaaagtttgctgctcagcttttaaaamctgtttatgttgctgaggtggttgctcggcctaatggccctttccactgtttctctggctatgaaaagcttatgaatcttcccaggttttgccaatgccg

SEQ ID NO: 13931 - DNA, 201 bp, Homo sapiens
attagatgaaacaacaaaaatataagccaacatctcaatacacactgaaagagaaagcacccacattttgcacgttttcctctagagaaataattgacttmtttgtgatttaaaaagaagtctccagtttccaaaaattttcattttcttgtgcacacttagcaacattattctctggttttctgtcataattatctcctc

SEQ ID NO: 13932 - DNA, 201 bp, Homo sapiens
gggaagagcctaagagctgcaggtctggaagaaactatgagcagtttggttttgggtattttgcctttgcaaagcttcctagacattccaagtggagatgytgagttagaggaagctggatatgagagtctggagctaaggagagacatttttaaactggaaagagttttgagttcatctctagggaaatatcagaaaaga

SEQ ID NO: 13933 - DNA, 201 bp, Homo sapiens
aggaaagtacaattagtctacgagggaagttacgtgttggcattagccctggacacagacaatgtgaaaggatgcaaggcaattcacaattcaattcaacygctgaagtggaaagaaaacttctacttagctggtgattgatcatgtacaagtgggagtaagtttaccttcaggtggcttcactcataattgacaaaaaat

SEQ ID NO: 13934 - DNA, 201 bp, Homo sapiens
catgtgctggcctcacaaagtcttttataaaactggctggggcttctgtttttttgacagggagtctcgctctgttgcccaggctagagtgcagtggtgcratctcggctcactgccagctctgcctcctgggttcatgccattctcctacctcagcctcctgagtagctgggactacaggcactcaccaccatgcccagc

SEQ ID NO: 13935 - DNA, 201 bp, Homo sapiens
gatttttaaatggccacaaactttttgacactcccttagggagaggtgaggtttgtatcactttccgtgaaatctggacaggcttataattgcttcagccratagaatgcagtggaaatagtggtatgtaaaatttcctagctagtccttaagtgacaatagaactttctcttggattttttggagtgctccctcttggga

SEQ ID NO: 13936 - DNA, 201 bp, Homo sapiens
acttcctttcattcacccataaacacacattattggtggaatgatcactactcacaatcagtttattgcatttgtgaatatctcaaattattagaaagttstttttattgaggccccaatacacttctgtaacttttacttagtaatcataatgctaaaagcaagcctttaaaaataaggcatttttatgcatttaaatga

SEQ ID NO: 13937 - DNA, 201 bp, Homo sapiens
gaaaaggctctgtatttttggtatggccaaaactgacagtttaaaaacttttattaacactttaacctaacagattaatcttaataattaatgaaaagtgytttgattcttaagaaagtttgaaatttacatcaacataaatgtcggtgaataaatttcaagcaaaaattcctagtcaaaagtcaacttaaaccatttaca

SEQ ID NO: 13938 - DNA, 201 bp, Homo sapiens
atttcagtggggtcgaagatgtaaagtagataacttgccacttcatcaaagatgatttacaagtttataccaaggtatgaacctaatccacaaagggatcrttatttaaaaaaatgtaaagaggatagtgacatggtttcaactgcattttagtcctcttagttagaattgaattttaagacctagactgtttatcaactg

SEQ ID NO: 13939 - DNA, 201 bp, Homo sapiens
ctataaagacacatgcacatgtatgtttattgcggcactattcacaatagcaaagacttggaaccaacccaaatgtccaacaatgatagactggattaagraaatgtggcacagatacaccacagccatactatgactagaatactatgcagccataaaaatgatgagttcatgtcctttgtagggacatggatgaaattg

SEQ ID NO: 13940 - DNA, 201 bp, Homo sapiens
ccaagcaaatggaaaacaaaaaaaagcaggggttgcaatcctagcctctgataaaacagactttaaaccaacaaagatcaaaagagacaaagaaggtcatyacataatggtaaagggatcaattcaacaagaagagctaactatcctaaatatatatgaacccaatacgggagcacccagattcataaagcaagtccttag

SEQ ID NO: 13941 - DNA, 201 bp, Homo sapiens
tcatggggtaccttgctgtgttttcagacctcagtgatgacagaggtgcttctactctaaggtcaattaagggaaaggctgtgtgttatatcacatgaaarttctcctgctctaaagtgagaacagagatcatttggttattgcctatgaacatgtccccgtttcatcttcagttggcaaaaagtttgcaattaaaacagg

SEQ ID NO: 13942 - DNA, 201 bp, Homo sapiens
tatttaaagcatacacacacatgcatgcatgcgtgttctctctctctctctccccccccaccaacctttcactctctctaggattggcagaagatggtgcrgcaagaagcataggaattgtctccccatctagacaacaattacactggcagaataggtcttacataattattttggaactctgatgtctattgaaggctt

SEQ ID NO: 13943 - DNA, 201 bp, Homo sapiens
cagctcctacattttaaaaaaaggaataaaattatttctgagccctgtctcacttgagtaataagtaatattcactcaccaatttatgaactaaatttaaktcgatttcattaaataatgtatttccagtaatattttaatttttgttatacaagcataaagatttacagaatatttatcttactgaataatatctatata

SEQ ID NO: 13944 - DNA, 201 bp, Homo sapiens
aacaggtatcgccatccctgtttaacaagattattaagatgcagaaacttcatatccagaagttaggaggctgccaaggattccaaagctctttgactttrtacctccaaagcttagaacagagtttgacacatacaaactcaatatacatctatataggacaataacttgagtcttctatttgtaaaccagtattctctt

SEQ ID NO: 13945 - DNA, 201 bp, Homo sapiens
tatacacacatatatatacatatatacacatatatatatacatatatatacacatatatatacacatatatatatacatatatatatacacatatatatayatatatacacatatatatacacatatatatacacatatatatatatatatatatatacacacatatatatatatatatatatatatatatatatgatgga

SEQ ID NO: 13946 - DNA, 201 bp, Homo sapiens
gtataagcaaagggagcattttgataaacaacttagtcatatcaggccgggcgcggtggctcacacctgtaatcccatcactttgggaggccgaggtgggyggatcacaaagtcaggagatcgagaccatcctggccaacatggtgaaaccccatctctactaaaaatacaaaaattagctgggtgtcgtggcacatgcct

SEQ ID NO: 13947 - DNA, 201 bp, Homo sapiens
agactggcgccatggccccctctgcctcacgtctgtatcacccccttccatgcaacatccatctggatggctccagaggcaacctgaaaatccaagttgcwactgtaaacagtggtgggtgggctgagtctcctctgggggtggcctggccccggataatgacccttctaacctgccttcagtggccgctgtccagagccc

SEQ ID NO: 13948 - DNA, 201 bp, Homo sapiens
tatatatatacatatatatatacacatatatatacatatatacacatatatatacacatatatatacacatatatatatatatatatatatacacacatayatatatatatatatatatatatatatatgatggaatactactcagccataaaaagaaatgaattagtggcattcacagcaacttggatgggattggagac

SEQ ID NO: 13949 - DNA, 201 bp, Homo sapiens
aatgtgagcagaggcaaatgtagccatttctcagggactgagttaactagcgtcacatggcatgacctgaccttctctaactcctgggctctggcttcctycttggtcttggcttacctcatagctactggacttttgaccttagtaagtcaaaggcttcttagccctggtgctatttcttggcttccacacattctgtac

SEQ ID NO: 13950 - DNA, 201 bp, Homo sapiens
aaacctgagggctttctgtgggtcaatgtgttgaattttgagctaaactctgacctgattgttctcataaagtcagtacagacaattgtctgatgtcagcrtaatatgctggtttgaaaaagacagtgaagcaaatttctagcgccaggtagcattagtacctacctcaaagccaggactcacaggagactgaaacatgaa

SEQ ID NO: 13951 - DNA, 201 bp, Homo sapiens
aggcacagtacttgactaacagatatctagtaaattcagacctctagtacagctggagatgtctgctgccttttcattagcaagatactaccagtaactcrtgaaaagagaagtctctatgtaagttgtccattgtactaaagttcaaaagttccaaatacatcaaagaaaagcacctttctagtacattagggaaaacta

SEQ ID NO: 13952 - DNA, 201 bp, Homo sapiens
aaaaaacacactagagaaattagaaggtaaacttgagcaggcagatgaatcagcaaacttgaagatagaacactggaaatatctattctgaggaaaggaawgagaaaagactgaagaaaagtgaacagagccaaagggacctgtggaacaccatcaagtgaactaacaagtgcattgtgggagtaccagaaggaggagaga

SEQ ID NO: 13953 - DNA, 201 bp, Homo sapiens
ttttaaaaaagtaagtcatctacattgctgtaggcatgcatagttcattacgtttttgttttttttttttttttttttgctgagttgtatttcattttgtwaagattccactgctcatccattcaccagctgaattctttcagcggcatcagtttactcattcacctgggaattagggtagacggtcagctaggatttgtg

SEQ ID NO: 13954 - DNA, 201 bp, Homo sapiens
catatctttttcaggtttttatcatatgaaactcaataaatggcagttaaatgaaactataaatgaagaaatgaaatgttccgttttgcgaaaaaaaattrtccgttaaaactgggaattaaaaattatgacatgcttgcatgagaagtaaaaaattatggcaggtatataaaaatcggaatttatcaatgatctcaactg

SEQ ID NO: 13955 - DNA, 201 bp, Homo sapiens
caagggcactgaacattttatatttcaaaactgacatagaagtatcaaataaaaagagcaaataaaagcatatttgaatttggatgagcatatttgcttayagaaaaaaataagatatccaccaaaatattaactatatttaactctgagtagtatgatccactttggggcttatctgaatttctcaccttttctgcaatg

SEQ ID NO: 13956 - DNA, 201 bp, Homo sapiens
tggctccaatattttctcacttaataaatatctgatttgatcataattttacaagcattcttgacaaagtctaattttaaaaatgtgtacttataaaatakattttaagcattttacaaaaaaattttaattcaccatttaatttcaacattttatgtaacgtatcaaataattcaaataatttagtggttatttaatttg

SEQ ID NO: 13957 - DNA, 201 bp, Homo sapiens
cagttagaatggcaatcattaaaaagtcaggaaacaacagctgctggagaggatgtggagaaataggaacactttcacactgttggtgggactgtaaactrgttcaaccactgtggaagtcagtgtggcgattcctcagggatctagaagtagaaataccatttgacccagccatcccattactgggtgtatacccaaagg

SEQ ID NO: 13958 - DNA, 201 bp, Homo sapiens
agaaaaccacatacttcatgttctcacttacaagtgggagctaaacactgggtacacatgaacataaagataggaacaacagacactggagactacaaggygggaaatgatggagagaaacaagggtttaaaaactacctagtgggtactatgttcactgccctagtgacaggttaaatcatgccacaaacctcagcatca

SEQ ID NO: 13959 - DNA, 201 bp, Homo sapiens
aagccactgggtttatgtaaatattgttaagatctacatcctagttgacattccacattagtagatgaaattaacatctgtcacaaaggttgctctgaagytaatcagttatttctgagtactcgtaatttggtaaaggaaagctaggcatgcgtgattcgctttaccactcaagcaacaactgacgccctgtgtccaact

SEQ ID NO: 13960 - DNA, 201 bp, Homo sapiens
tttaaatgacattcctaagggcactggataataagttgactcaaatttaggttatttgactccaggagcaactgacattccactaaaccaactttccagcytttcccagatctttatcttccccaattatgggttaattccgtaattagtttaaaaattccacacttactaaaagaatataccagtccaattttcgaacct

SEQ ID NO: 13961 - DNA, 201 bp, Homo sapiens
tactatattgccacttcttttgtgctacaaatacaaatacaaaacactctttaatggagcactgtcctcattatacaaccgaccactgacataaaaggcawgaaggttaagcccacttttgaaaagctcttaagtaacaggtcagaggacagaaacgttaggatgagaccattataagttgttgatagaagaggaaagata

SEQ ID NO: 13962 - DNA, 201 bp, Homo sapiens
cttgtctgcctgctccttgcccctacttcaacatgaaaatctgtgcagaactcttctgctaccaaactcaaacacttaataggctgttcatattaatgggkggccctcagcatcaaggatgcaatgaggaatggttgagactatagtaatttggagaggacagcgtcactgtaaaacagatagctacagctcaattagttc

SEQ ID NO: 13963 - DNA, 201 bp, Homo sapiens
gtacgttatcttaaaataagtattttttgttgaattaccatcacaatgtttcaagtacaatcgtgtctgctacataattagagaacaactatactctaaaytctaaataataacaataataatttacaggtgagtttctcagggaaacttatgcagccttgtacacctcagttgctcatcccaaaggaaatgtcctgtgat

SEQ ID NO: 13964 - DNA, 201 bp, Homo sapiens
tttctaaaaaatcagtgttacagacattctgttcttcaagtatgacccccttcccttcacaccattattgggtttgtgtttaggagaaagagaatattaaragtgtgaattattaccaaaaaaaaaaaaaaaaacaaacgctggaatctacatgaagctgtttaatggtttataaaaattgaaaaatggagcaaatatctg

SEQ ID NO: 13965 - DNA, 201 bp, Homo sapiens
aggaaagcaggccgggcacagtggctcacgcctgtaatctcagcactttgagaggccaaggcgggttcgagaccagcctggtcaacagagtaaaaccctayctctacaaaaaatacaaaaattagctaggcgtggtggcacatgcctgtaatcccagctactcaggaggctgaggcagaagaattgcttgaaccggcaggt

SEQ ID NO: 13966 - DNA, 201 bp, Homo sapiens
aaaattatggttgggggacctgtccatgttaatacatgtatgtacatccaggtcattatttttaatttctagttatatctatcctactaacataccatatyattatttatttaagttgtttttgctttcctcacaaacaaacaatgctacagtggatatattagcacacatctccttaggcttatctgcagaagtttctga

SEQ ID NO: 13967 - DNA, 201 bp, Homo sapiens
ttttttgacagggagtctcgctctgttgcccaggctagagtgcagtggtgcgatctcggctcactgccagctctgcctcctgggttcatgccattctcctrcctcagcctcctgagtagctgggactacaggcactcaccaccatgcccagctaattttttgtatttttagtagagacggggtttcaccgtgttagccagg

SEQ ID NO: 13968 - DNA, 201 bp, Homo sapiens
aaccatgaagctctcttctccaatcctataatgaagaataaatatctcctgtacgcatgctaactctgtattccttccctgcaaaagtatcttccttcagragaccacagtgcgtggagactggaagtgcaagggccaggttaggaaagatgtcatttactagagtttcagatgtcatctgcacctcaatgttgccagttg

SEQ ID NO: 13969 - DNA, 201 bp, Homo sapiens
agttaccaaaaatgacatggttaatatacatgatttgatgactctttctatgaaatgtaagttttacctttctccttaaatgtacaggttttttggccaaraggtaataaaatgtgtgccctaagtcaggtttttctttctgtttttctttactgtttgtttttgttagtgaatatacaatttaaaagaattccaggacaa

SEQ ID NO: 13970 - DNA, 201 bp, Homo sapiens
tgaaaaaataaaaacagtctccctcctccaaaaaccgagagacaaatatgaagacaagtgtactcagaagtgggtaatattgtatacaaggcaggaaagcrttatgcaaatctgggaagtgatgaccttcactcaagcgcttattatgagaagaagatgaaggataagtacagagatgtgtcatgtcatccacaataatcc

SEQ ID NO: 13971 - DNA, 201 bp, Homo sapiens
taagaagactggcgccatggccccctctgcctcacgtctgtatcacccccttccatgcaacatccatctggatggctccagaggcaacctgaaaatccaarttgcaactgtaaacagtggtgggtgggctgagtctcctctgggggtggcctggccccggataatgacccttctaacctgccttcagtggccgctgtccag

SEQ ID NO: 13972 - DNA, 201 bp, Homo sapiens
ggttcgagaccagcctggtcaacagagtaaaaccctatctctacaaaaaatacaaaaattagctaggcgtggtggcacatgcctgtaatcccagctactcrggaggctgaggcagaagaattgcttgaaccggcaggtggaggttacagtgagctgagatcacactgcactccagtctgggggacagagcaacactccatc

SEQ ID NO: 13973 - DNA, 201 bp, Homo sapiens
gaattaaaaatccaatcaagtgatcaatcaaggaaggaatttgagacttgttaggacaaagaggtaatatataaatggaatccagggatgtgggatacackattccccctttcttgaagtgatagaatcactgatagaaatagggttctgtggagttgatctatacttgtcacaaaaatccaatctttgtcccagctaaaa

SEQ ID NO: 13974 - DNA, 201 bp, Homo sapiens
aattttggacacagtttcacaaagccctagagactgccaacattcaatcacatacttaatatctataagaattaatgtagccttaagagaaagaaagattrtgaaagtgtagtatttcatcaacttcaatagtctttcatgtagataaaaaagagatttgcctatcttaagagctaacggaattaaaaatccaatcaagtg

SEQ ID NO: 13975 - DNA, 201 bp, Homo sapiens
ccagacgcgccgccttaagagctgtgacactcaccgcgaaggtctgcagcttcactcatgaagccagcaagaccacgagcccaccagaaggaataaactcygaacacgtccgaacatcagaaggaacaaactctggacacaccacctttaagaactgtaacactcaacgcgagggtccgtggcttcattgttgaagtcagc

SEQ ID NO: 13976 - DNA, 201 bp, Homo sapiens
ccagtgagaccatgaacctactgggaggaatgaacaactccggatgggaggaacgaacaactccagacgcgccgccttaagagctgtgacactcaccgcgmaggtctgcagcttcactcatgaagccagcaagaccacgagcccaccagaaggaataaactctgaacacgtccgaacatcagaaggaacaaactctggaca

SEQ ID NO: 13977 - DNA, 201 bp, Homo sapiens
tggattaaaaataaatcttaatacttacctttaaaataatctgaggagaaagggataaaggggtgacaactgaggaacaaaaaatgattaatgaaaaaagmctgtctatatttagatgtttattaaggctgggtactgaagatggtataggaagtccatcatttaaagtgaaaataaagcctaagcttgtacagtctagct

SEQ ID NO: 13978 - DNA, 201 bp, Homo sapiens
ccaggttcctcaaaagaacactgtataacaaataatgtattggccttccctaagacctcagttgcacaggagcatactatccaaccagcctcgaaacgggmtaatggcatcaccacaaatcattctgcatttcattaatgcaatacctttggcacacgaccctttaatataacttggttcaggactatatttttaaaaatc

SEQ ID NO: 13979 - DNA, 201 bp, Homo sapiens
atcattcatgatttattgtataaattaatttactggttttcaaaccttgtcaaaaaaacacataatctattttgtacaatacaccttatacattgggaggktgttcatataaagtaagaatttggccaggcacggtggctcacacctgtaatctcagcactttcagaggccgaggtgcacagatcacttaaggcccggagt

SEQ ID NO: 13980 - DNA, 201 bp, Homo sapiens
tatctaataataaaaaatttataattttttcatattttataaaaaatgaaaatatctatgatcctactagccagataaaaccacttacaattttagataawaagagtatctttctagatttctatgtatctatacaaatttttaattgactcattttataagtctattttataagcttattttactcaaccatatatcgtg

SEQ ID NO: 13981 - DNA, 201 bp, Homo sapiens
ttccattttctttaaagaactcaagttttccaaatatattagccaaatggttgaggaagtttctctttgtatcaagaacaatattctgtgcctttttccastaaatgtgaaatcatttcatggccacccatacaaaaaaaaaaaaaaaacagcattacacatcatctctttcagaagtttgttttgcagtttccatgttga

SEQ ID NO: 13982 - DNA, 201 bp, Homo sapiens
cctaaagatgataatgaattaactatatggcacatccctgccgctactgctctcttttcctctggcacaaagatggtcaagtctagaggtgtgacaggtamacaagagggagtcaacacaaagcatgccctctatattgcatgaagattttatctgtattatatgtgtgtgtattcagtgtgtccatattactgatgcaat

SEQ ID NO: 13983 - DNA, 201 bp, Homo sapiens
ataaaataaaaaataaaaaaataaacacttttttctgtaacaatggttgcaatatatttatagaatacctgagctataagaaaatactctccggtatccayacaaagccccttcacgtagcagtgatacgtgtccaggaggaactttagaacaggcattaaatgacggaaggaggaaagagacttgccctccactcagaca

SEQ ID NO: 13984 - DNA, 201 bp, Homo sapiens
aaaaaaaaaaaaatagccaggcgtggtggcacgcacctactcaggaagctgaggcaggagaattgcttgaacctaggaggtggaggttgcagggagctaasatcgtaccaccatgctccagcctgggtgacagcaagactcggtctcaaataaaataaaaaataaaaaaataaacacttttttctgtaacaatggttgcaa

SEQ ID NO: 13985 - DNA, 201 bp, Homo sapiens
agtttgagactagcctggccaacatggtgaaaccccatctttactaaaaaaaaaaaaaaaaaaaaaaaaaatagccaggcgtggtggcacgcacctactcrggaagctgaggcaggagaattgcttgaacctaggaggtggaggttgcagggagctaagatcgtaccaccatgctccagcctgggtgacagcaagactcgg

SEQ ID NO: 13986 - DNA, 201 bp, Homo sapiens
acaattatgaaaacttctgcaatctgtctttacttgctgctctcagatgcatcactgtcagcatctgaccctgttaggtggctgataagaggattttgaargccagcagattttatttttaacctccccatatggttgaccttctaatttcaatgagagcatcatctgcagagatgatcatcaaatggcaactcctaccct

SEQ ID NO: 13987 - DNA, 201 bp, Homo sapiens
ttagcataacatcctcaagattcatcaatagtctatcatgtatcatgtattacttcttttttaaggttgaacaatattccactgtgtgtgtgtgtgtgcaygtgtataccacgttttgtttagccattcgtccatcaatggaacttgggttgcttcgaccctttggctactgtattacgttgttctagcattgctataaag

SEQ ID NO: 13988 - DNA, 201 bp, Homo sapiens
ggggctgaagggaggacaggaatggggaattattgcttaataggtacacaatttctgattggggtgatgaaaaagttctggaattagataatcatgatggkgagaatatatttaatattactaaattgtacacttaaaatgattaaaatggtaaatttatactatgtatctctcattacaatagaaaattttaataaaata

SEQ ID NO: 13989 - DNA, 201 bp, Homo sapiens
agtattattcaaccataaaaaggaatgaagttctgatacatgctacaacatggatgagccttgaaaacattacactaggtgaaataaactagacacaaaasaatgaacattgtatgattccacttatatgaaatatttaagatagccaaattcatggagacagaaagaaggttagaggttgccaggggctgaagggaggac

SEQ ID NO: 13990 - DNA, 201 bp, Homo sapiens
tcttctgtgggaacatggatgtagctggaggccattatccttggcaaactaacctaggaacaaaaaccaaatacttcatgttctcacttataagtgggagytaaatgatgagaacacatggacacaaacagatgaacaacagacactggagcctacttaagggtggagggtggacagagggagaggatcagaaaaaataac

SEQ ID NO: 13991 - DNA, 201 bp, Homo sapiens
agacacatgcaagtgaatgttcactgcagcactatacacaatagcaatgacagggaatcaacctaaatgttcataaatggccgattggatgaggaacatgwggtacatatacaccatggaatattattgcagccataagaagaatgagatcctgtcttctgtgggaacatggatgtagctggaggccattatccttggcaa

SEQ ID NO: 13992 - DNA, 201 bp, Homo sapiens
attctatcataaagacacatgcaagtgaatgttcactgcagcactatacacaatagcaatgacagggaatcaacctaaatgttcataaatggccgattggmtgaggaacatgaggtacatatacaccatggaatattattgcagccataagaagaatgagatcctgtcttctgtgggaacatggatgtagctggaggccat

SEQ ID NO: 13993 - DNA, 201 bp, Homo sapiens
ggaatataaatcattctatcataaagacacatgcaagtgaatgttcactgcagcactatacacaatagcaatgacagggaatcaacctaaatgttcataawtggccgattggatgaggaacatgaggtacatatacaccatggaatattattgcagccataagaagaatgagatcctgtcttctgtgggaacatggatgta

SEQ ID NO: 13994 - DNA, 201 bp, Homo sapiens
aggaatataaatcattctatcataaagacacatgcaagtgaatgttcactgcagcactatacacaatagcaatgacagggaatcaacctaaatgttcataratggccgattggatgaggaacatgaggtacatatacaccatggaatattattgcagccataagaagaatgagatcctgtcttctgtgggaacatggatgt

SEQ ID NO: 13995 - DNA, 201 bp, Homo sapiens
ctaccattcaacccagcaatcccattactgggtatatacccaaaggaatataaatcattctatcataaagacacatgcaagtgaatgttcactgcagcacwatacacaatagcaatgacagggaatcaacctaaatgttcataaatggccgattggatgaggaacatgaggtacatatacaccatggaatattattgcagc

SEQ ID NO: 13996 - DNA, 201 bp, Homo sapiens
ctaaaatgggcttgcaaaaaaaaaagccaatttcatatataaggccaaactctagtatctattttataaaaactccaactctacagcaaaaacaaacaaamaaaaaaaaacaaaaaaaagcacccaatcaaaaaccaggcaaaggacttgaataaatatttctccatagaaaatacacaaatagacaacacatgaaaagat

SEQ ID NO: 13997 - DNA, 201 bp, Homo sapiens
tcataaaacaaaattagctttgactttgataaagacagcaacattctaataatctgaattattttgccactctttatagagaatttcttactgaatggctrtagcatagttcaaggtttcctttcaatcacctcacaagtgggaaatacacatatattaagtaaaactggcagaaaagagtcagtttaggagtcaaaaatt

SEQ ID NO: 13998 - DNA, 201 bp, Homo sapiens
gggagggcttcctgattagactcacccctgatctcagtttggttttcttctaagcacctatcaccatctgacctcataattcattgaccatcttccctacyagaacataaactctatgagggtacaaactggtttttacactactgttgtcctcacctataatagtgtatggcaaattgtacatgctcagtaaatatttgt

SEQ ID NO: 13999 - DNA, 201 bp, Homo sapiens
ccttatcagtaattactctgaatgtaagtagatcaaactctccaatcaaaaataccaagatcagtagaatggatcaaaacatatgatccaactatattccrtctacatgagactcactttagattgaaaaacacaagtaaactgaatgtgaaaggatgaaaaaagatagttcatataaatcataaccaaaaaagagcagaa

SEQ ID NO: 14000 - DNA, 201 bp, Homo sapiens
agattcaagtgtctgattctcaacaaaaaatcacaatccatacaaagaaacagaaaactataatccatccaaacaaaaattaattaacagaaactgtctgyaaaaaacacctgatgacagatctacctgacaaaaacttcaaaacgactgtcttaaagatgctcaaagaactgaaggaagatgtagataaagtcaataaaa

SEQ ID NO: 14001 - DNA, 201 bp, Homo sapiens
tactatacatacatgttatacccaaccagtactgcatttttcaacatctaagtagtgatagttcctgctcatatttattcattcaatatcaaactaaaatmaacatttactgatgttaggcattcttctaggccctgaggatacaggtataaacaagaaaaatccctgatttatggagcttacattttactgtgagaaact

SEQ ID NO: 14002 - DNA, 201 bp, Homo sapiens
ctttgtccatcagatatccgttctggtcagaaagatggaggaaaagagaaagaagaaaggcacccctttgctgttaagataattttccataatgaccatayaacatttctggctacaacataacctcctgtagcacagcaaggaaatacagtctttacatgtgtgcagcatgccaatctaacttgttattattgctgtctt

SEQ ID NO: 14003 - DNA, 201 bp, Homo sapiens
ccatgtgaagatacagagagaagatggctatctacaaaccaaagagagaggtcctcagaagaaaccaaccctgctgacatcttgatcttgtacttctaggytccaggagcatgagaaaataaacttctattgtttaagtcacccattctgtgggacttttttatggcagctccagaaaataaatatggaagataagtgcaa

SEQ ID NO: 14004 - DNA, 201 bp, Homo sapiens
agcataccaagcatgaaaatagtctttcctttgaaccgctttttctgaaagactcctgggagtatggaccaggcagagggttaaatgtggggagcgggtayagcagggaagagagaatggctggcaactcaaactttggagcaaaaggtcatgaaaaagacagtatccaaaagtgaaatggtaaacaaaaactcaaacaaa

SEQ ID NO: 14005 - DNA, 201 bp, Homo sapiens
acgagatctaatggttttaaaaacggaagtttccctgcacaagctctctctttgcccgctgccatccatgtaagatgtgacttgctccttcttgccttccrccatgattatgaggcctccccagccatggggaactataagtccattaaacctctgtttcttcctggtctcgggtatgtctttatcagcagcatgaaaaga

SEQ ID NO: 14006 - DNA, 201 bp, Homo sapiens
ttttaatagtatcctttattatacagagactttactggtggtataaaatttatctaccttttcttatttagctcaataaaatcaaatttatgtaaccataygtttttcatccaaaatgcttataaatggacacccttatttgtaacctcctcagagaaaactgaggagaacacgaattagactagttccctttttgcattg

SEQ ID NO: 14007 - DNA, 201 bp, Homo sapiens
tcatgcatgcatttctccattgacatgtttgcatttctcttattgatttataagacttttctgtttgtctgttatgtatgttgttttccttcagacaaaarttggcctttagtttttttaatagtatcctttattatacagagactttactggtggtataaaatttatctaccttttcttatttagctcaataaaatcaaa

SEQ ID NO: 14008 - DNA, 201 bp, Homo sapiens
cttatttagggaagagtgtcacagcgtgcttttcgtttttactctttttaatctttttgatgatgtgctttttaaaccataagtattttaaatgaaatttytaatgcagaggggaagaaaaggtttctttgtatgttcatttgtttctagctactcttgatgtaataagagaccttcttttaaataattacccttaggcag

SEQ ID NO: 14009 - DNA, 201 bp, Homo sapiens
tatatatgatggaatatatatatacatatatatgatggaatatatatatacatatatatgatggaatatatatatacatatatgatggaatatatatatayatatatatgatggaatatatatacatatatatgatggaatatatgtatacatatatatgatggaatatatgtatacatatatatgatggaatatatatat

SEQ ID NO: 14010 - DNA, 201 bp, Homo sapiens
catatatatgatggaatatatatatacatatatatgatggaatatatatatacatatatatgatggaatatatatatacatatatgatggaatatatatayacatatatatgatggaatatatatacatatatatgatggaatatatgtatacatatatatgatggaatatatgtatacatatatatgatggaatatatat

SEQ ID NO: 14011 - DNA, 201 bp, Homo sapiens
gcacaattcacaactgcaaaaatgtggaaccaacctaaatgcccatcaatcaatgagtggataaagaaactgcgtggtatgtgtgtgtgtgtctctctctmtatatatatatggatgtacatatatacacacacatatatatgatggaatatatatatacatatatatgatggaatatatatatacatatatatgatggaa

SEQ ID NO: 14012 - DNA, 201 bp, Homo sapiens
tttctgttctatctgaataacatactgacttttaagtttgaatagagacagagttcaagttaagttctcattctattcactctctccttacacactgaatmgcaaaattaaacaaaggactttattttaaaaggaagcataatcagggacacactggaatttttatagacattcagggcttataaagcaacataaaggaaa

SEQ ID NO: 14013 - DNA, 201 bp, Homo sapiens
gtaaaatcaactaataacacaagagaatggcaggaagtcaaccaagtaaaggtgttttcattgaataataagcagatcagtatggttgggaacacagcatytcctgggaatatggataatggggaagacaaaccaattagggccagatgctgaatggccttgtataacacgctaaggaaccacaagacaatcctgtggagg

SEQ ID NO: 14014 - DNA, 201 bp, Homo sapiens
gttaaggtactttatcaatgacaaatttattgatattgatcattgcactgtggttatataaaacaatacctgatccttaggaaatacatactggtgtggakaggtgcaaagggccatggtgcgtaatatcctcagacagttcaggaattaaaaaaagtctgagacagaaagagagagagcacacaaataataaagcaaatg

SEQ ID NO: 14015 - DNA, 201 bp, Homo sapiens
aaactgaaatataaatggtaggttaaggtactttatcaatgacaaatttattgatattgatcattgcactgtggttatataaaacaatacctgatccttakgaaatacatactggtgtggagaggtgcaaagggccatggtgcgtaatatcctcagacagttcaggaattaaaaaaagtctgagacagaaagagagagagc

SEQ ID NO: 14016 - DNA, 201 bp, Homo sapiens
ataacactatgcttatcagaatgggctacataatttgcagggccccttgttcataaagcagaggaaaagtgccattaaaggtactaaaatatcaagtgttytcctttcttccgcagcttcccctcaacctgccatggtgttatttgctacttgacatccttcaggcacagggatatctgcacaataaatgcagaccttcca

SEQ ID NO: 14017 - DNA, 201 bp, Homo sapiens
aaagaaatgactttatttgttcatccataagaagccactagtcatccattcaagtttaatcattagattgcagcaattcggtcctactttcaggctctacytttttttttttttttttttttttttttttttttttttttttgagatgggagttttgctcttgtcgcccaggttggagtacaatagtgttgtctcagctca

SEQ ID NO: 14018 - DNA, 201 bp, Homo sapiens
tcaaaagaaatgactttatttgttcatccataagaagccactagtcatccattcaagtttaatcattagattgcagcaattcggtcctactttcaggctcyacttttttttttttttttttttttttttttttttttttttttttgagatgggagttttgctcttgtcgcccaggttggagtacaatagtgttgtctcagc

SEQ ID NO: 14019 - DNA, 201 bp, Homo sapiens
tcaaatcctgccactgctttatcaactaagtttatgtaaaaccctaaatcctttgttgtcatttaaataatgttaacggaatcttcaccaggagtagattytagattctatcaaaagaaatgactttatttgttcatccataagaagccactagtcatccattcaagtttaatcattagattgcagcaattcggtcctact

SEQ ID NO: 14020 - DNA, 201 bp, Homo sapiens
atcgtctccagtggtctcttgacaggggatgatttcagggtgaaactgttccacctcagatcatcaggctcttatgagaatctgatgccgctgatctgacrgaaggcaagaaagcagagctcagacggtaatgctcactggctcactgctcaactcctattgtgtctatggtttgaggtttggggattcttgatgtaagcc

SEQ ID NO: 14021 - DNA, 201 bp, Homo sapiens
gctactggggaggctgaggcaggagaattgcttgaactcagaaggcgaaggttgcaatgagccgagatcaggccattatactccagtatgggcaacaagarcgaaactaaaaaaaaaaaaaaaaatgtatgcaaaaggcaagagaacaatctaacaacattgttatacaagattcccaagagtaaactgttcaaaaagcaa

SEQ ID NO: 14022 - DNA, 201 bp, Homo sapiens
ccaagtcagtgtcactgtatgaatatgattattgcccatgttaatttctctaatttacttcttacatctatttcaggttataaatattcataattgtagtsctctggtagtagccccccaccactagtctacactaaattgtacttgctataatataaatctattttctcccattctaatttatgaaatggctgagaaaaa

SEQ ID NO: 14023 - DNA, 201 bp, Homo sapiens
aagggggagggatagctttaggagatatacctaatgctaaatgatgagttaatgggtgcagcacaccagcatggcacatgtatacgtatgtaactaacctkcacattgtgcacatgtaccctaaaacttaaagtataatcataataaaataaaataaataaataaataaataaataaaagtttggtggggctgtcaaaaaa

SEQ ID NO: 14024 - DNA, 201 bp, Homo sapiens
tcaggtagtgtgatgcctccagctttgttctttttgctcagtactgctttgagtattcagggtcttttgtggttccatatgaattttagaattgatttttytacttctgtgaagaatgtcattggtattttgatagagattgcattgaatctgtagattgcttcatgtagtatggtcattttaataatattaattatttta

SEQ ID NO: 14025 - DNA, 201 bp, Homo sapiens
aggacctcttccaggagaactacaaaccactgctcaacgaaataaaagaggacacaaacaaatggaagaaaattccatgctcatagataggaagaatcaayatcgtgaaaatggccatactgcccaaggtaatttatagattcaatgccatctccatcaagctaccaatgactttcttcacagaattggaaaaaactactt

SEQ ID NO: 14026 - DNA, 201 bp, Homo sapiens
aaaaggcctttgacaaaattcaacagcccttcatgctaaaaactctcaataaattaggtattgatgagacgtatctcaaaatgataagacctatttatgamaaacccacaggcaatatcatactgaatgggcaaaaacgggaagcgttccctttgaaaactggcacaagacagggatgtcctttctcaccactcctattca

SEQ ID NO: 14027 - DNA, 201 bp, Homo sapiens
aaactgaatccagcagcacatcaaaaagcttatccaccatgatcaagtgagattcatccctgggaagcaaggctggctcaacatatgcaaatcaataaacrtaatccagcatataaacagaaccaaagacaaaaaccacatgattatctgaatagatgcagaaaaggcctttgacaaaattcaacagcccttcatgctaaa

SEQ ID NO: 14028 - DNA, 201 bp, Homo sapiens
ctcctcagcaaatgtaaaagaacagaaattataacaaactgtctctcagaccacagtgcaatcaaactagaactcaggattaagaaactcattcaaaaccrctcaactacatggaaactgaacaacctgctcctgaatgactactgggtagataactaaatgaaagcagaaataaagttgttctttgaaaccaatgagaac

SEQ ID NO: 14029 - DNA, 201 bp, Homo sapiens
caagcagacataatagacatctacagaactctccaccccaaatcaacagaatatacattcttctcagcaccacatcacacttattccaaaattgaccacawagttggaagtaaagcactcctcagcaaatgtaaaagaacagaaattataacaaactgtctctcagaccacagtgcaatcaaactagaactcaggattaag

SEQ ID NO: 14030 - DNA, 201 bp, Homo sapiens
ttaaatttaccattcagtaatttataaattcttctactatcccttttggaaaattatctttaatttcttagaacctgttcagttctttgaatctgtaaagmtgaccactgatgcttccaggatccccacatgtgtatctggcctcaaaactgaactacttcattgcctacgagttcacccactatttccaaatattttaag

SEQ ID NO: 14031 - DNA, 201 bp, Homo sapiens
tggaaagctgagttgggggaaacggttgagcccaagaggttgaggctccagtgagctgtgattgtgcccctgcactccaacctgggtgacagagcaagatwctgtctcaaaaaaacaaaaagccaaaaaaagaaaaaagaaggaaggaaggaacgaagcaaggaaggaaggaaggaaggagggaaggaaggaaggaaggag

SEQ ID NO: 14032 - DNA, 201 bp, Homo sapiens
cctgtctctaaaattaaaaaaaaaaaaaaaaaaaaaaaagttaaaaattatccaggcacatctgcagtcccagctacttggaaagctgagttgggggaaayggttgagcccaagaggttgaggctccagtgagctgtgattgtgcccctgcactccaacctgggtgacagagcaagatactgtctcaaaaaaacaaaaagc

SEQ ID NO: 14033 - DNA, 201 bp, Homo sapiens
caccacgcccagataatttttgtatttttagtagagatggggtttcaccatgttgcccaggctgatcttgaactcgtggcctcaagcaatccacccatctyggcctcccaaagggctggaattacaggcatgagccactgcacccagcctatgctaaggtgtttaaaaagtaaataagaagcacaggagttggagacctgg

SEQ ID NO: 14034 - DNA, 201 bp, Homo sapiens
gaggcacaatttcagctcattgcaacctccacctcctgggttccagcaattctagtgcctcagcttcctaagtatttgggattacaggcacatgccaccaygcccagataatttttgtatttttagtagagatggggtttcaccatgttgcccaggctgatcttgaactcgtggcctcaagcaatccacccatctcggcct

SEQ ID NO: 14035 - DNA, 201 bp, Homo sapiens
tctagattgcagactcccactaaggcccttcctatataactccctatgcctgtggtggaaaataaacgtgtgcatacacatatattactatctatactaargtattttattttatctgtgttgcccaggctggagtgcagaggcacaatttcagctcattgcaacctccacctcctgggttccagcaattctagtgcctca

SEQ ID NO: 14036 - DNA, 201 bp, Homo sapiens
atgttccccaggatggccttgaactttgaggctcaaataatcctgctgccttggcctcccacagcacaaggattataggtgtgagccactcactgcacctsgctcttaacagtggggctcttgaaagaagatgggggaagaagaggtgctacaaagtaacttaagccaatttggccaattgcaactgtacaattctttgga

SEQ ID NO: 14037 - DNA, 201 bp, Homo sapiens
tttttagaaaagcatcctccctgcataaagcagaaaaagttcttcctttttaccctttaataggagaagtgggttgctctaacagtgatgttctttctttyttttttttttttttgagacgcaaggtctcaatctgttgctcaggctggactgcggtggcatgatcctagctcactgtcacctcaaactcttgggctcaag

SEQ ID NO: 14038 - DNA, 201 bp, Homo sapiens
acttgactttctttggaacctgtgaacaaccagctttctctttagttctctgcccaatcagcccaggccacacagtcattgatttgcaggtaacatggagwtttacctattatcacacacattcatcacttaattcccatagctactccccaattgtgacactcctgtttcataaacctaatgagaaagaaataggaaaaa

SEQ ID NO: 14039 - DNA, 201 bp, Homo sapiens
ttacagtattcatttatcttaattaaatagtgctagactgttctgtaggatgatggcaacagtttacacttttaccagcagtgcctaaggcttcctaaatwcaaaactctttgccaacattggctattacccaacttttccaactttttgcagcttaactgatgagagatgacatgccataattcctttagtttgcattta

SEQ ID NO: 14040 - DNA, 201 bp, Homo sapiens
acataaataccagtatgcaacataccactttgttcctttttagcttttggaatgtatccaaattgccataggtacataagtccatagcctctacctgctayatcatatgccttgatgtctagtatattctacttacccactttttcaatgatgtacacctagatctctactaacttgctgcccaaacaatgtggcaacgga

SEQ ID NO: 14041 - DNA, 201 bp, Homo sapiens
tacataaataccagtatgcaacataccactttgttcctttttagcttttggaatgtatccaaattgccataggtacataagtccatagcctctacctgctrtatcatatgccttgatgtctagtatattctacttacccactttttcaatgatgtacacctagatctctactaacttgctgcccaaacaatgtggcaacgg

SEQ ID NO: 14042 - DNA, 201 bp, Homo sapiens
cagcagctcaaggccaaggcaggaaccagccttggacaggacatcatcctatcccaggatgcatgaacgcgcgcacacacacacacacacacactcacacwcactcagactggggccatgtagacatgctaattcacctaatgtgcacatctttgggatgtgggaggaaactggagtacctggagaaaattcacatagaca

SEQ ID NO: 14043 - DNA, 201 bp, Homo sapiens
ctattccagcagctcaaggccaaggcaggaaccagccttggacaggacatcatcctatcccaggatgcatgaacgcgcgcacacacacacacacacacacwcacactcactcagactggggccatgtagacatgctaattcacctaatgtgcacatctttgggatgtgggaggaaactggagtacctggagaaaattcaca

SEQ ID NO: 14044 - DNA, 201 bp, Homo sapiens
gaacacctgtacattgctgatagaagagtaaaatagttccaaccattatgaaaaataatttgttggtttctcaaaaagttaaacatatcattaccatatgwcccagcaactccactcctaggtatatactcaaaagaactaaagacaggcacaaaaacaaatactgcacacacatgttcatagcagcactattcacaatag

SEQ ID NO: 14045 - DNA, 201 bp, Homo sapiens
tcaagcaatcctcctgcctcagcctcctgagtagctaggactacaggcacatgccgccatgcccaactaattattattattattattattgtagagacagrgggtctcactatgttgcccaggctggtctcaaacatctggcctcaatgatcctcctgcctcggcctcccaaagcacttggattacaggtgtgagccacct

SEQ ID NO: 14046 - DNA, 201 bp, Homo sapiens
atgctcagtatacattgttgaatcaataaatgaacgaataagtcacaacgtgagctgttttatctcacaaagtattaagggaattagttaatcattattgktattatttttgagatagagtcttgatgcatcacccaggctggagtgcaatggtgcaatcatagctcactgcaaccttgaactcctgggctcaagcaatcc

SEQ ID NO: 14047 - DNA, 201 bp, Homo sapiens
attttacacgtttaggtatacatatatgacatatgtcatgtgtatatacttgcatatatacttatacctgtttgtatgtttattacttcattgactacctsccagaaccactgcagagattagatgaaccaacatatgtaaagtaattactattggcccagactcatagcaaatgctttatatatgttcgttgttgttatt

SEQ ID NO: 14048 - DNA, 201 bp, Homo sapiens
ctttaaatccctgtgtctttataaagttgttgtacacacgtatatatgactccctcatctttttgtgcagtctgacaatctctactttttttttttttttwttttttttgagaccgaatctcactctggcgcccaggctggattgcaatggtacgatcttggcttatggcaacctccaactcctgggttcaagtgattctc

SEQ ID NO: 14049 - DNA, 201 bp, Homo sapiens
aaaataatgtgtattctgctgttgttgggtggcaagttctataaatatccgttagattaagttgactgatagtttttcagattttctatttgcttaataaytttctgtttgttctataaattaatgagaaagaaatattgatgtcttcacatatacttgtggatttttttctctttttcctttcaattctattatttgctt

SEQ ID NO: 14050 - DNA, 201 bp, Homo sapiens
aagccatgttaagcccagattttcctttgctggaggacttaaaacttcatattcaatatctgtatagtatactttagacttcaatttcctcttaagtgacwtttggcagtttgtttattttcagaaaggtatccatttcattcaagttgtcaaatttcttggcataaagttattcatgtgattcccttaccacccttttaa

SEQ ID NO: 14051 - DNA, 201 bp, Homo sapiens
aaagcagaatgctgttctcatgcagcaagggaattctagagggctacatcaggtcaacacgagggaagagcaggtctggctcattaatgctgggataacawgcaaataagcagtcctctcctacataaatacacccacacacaggttgcattcaatctgtctgctactactctaaagtgcttgataacaaaagtaaaatgg

SEQ ID NO: 14052 - DNA, 201 bp, Homo sapiens
tactttacttccagaatgaaaacaagtatagaatgcatgtaatattatcactgtatgatactttcatctagtagaagctttttgtttgattaaaaaacaarcaaaaaaaatcctgaagcccaagccgagcacggtggctcacgcctgtaatcccagcactttgggaggccgagacaggcggatcacaagatcaggagctca

SEQ ID NO: 14053 - DNA, 201 bp, Homo sapiens
gtcaaatcacaaacaatttcataaataatgtaggaggatttagccttatgctattgaagggttttatatagagaaatattgttatccaatccaggctttakaagttactaggattacacaatagaaaagaatgaaatgagagggaacaaaactggaggcaaggaaaccaacaaggaaactattccagtgagaaaggtggga

SEQ ID NO: 14054 - DNA, 201 bp, Homo sapiens
agctgaacattacacatatgaattgctgatgaactgatttatgtctatctccatgaaattatctagtaatagagtcaggcctatatatgtgcatatgtacwaagtttttattttttatttttcaaatcagtatcttagttgaagagataaaatgctatttagtataaaacataaaggatatgcaaagctagaaaaggacag

SEQ ID NO: 14055 - DNA, 201 bp, Homo sapiens
ctgaaagataaagcaataactagcatataaagcattgcattttcagcaaatcgcatgttagagtgactcgggatagtctagtaagttaaaaaacaaaacamagcatgagctgaacattacacatatgaattgctgatgaactgatttatgtctatctccatgaaattatctagtaatagagtcaggcctatatatgtgcat

SEQ ID NO: 14056 - DNA, 201 bp, Homo sapiens
ctggagtaggcagaggctggagtaagcagagaccacgccactgcactccagcctgggtgatagagcgagactccgtctcaaaaaaaaaaaaaaaaaaaaamaaagaaagaaaaaaaagaaaacccgaaagtataaaaaccccagaagaaaatctatgcaataccattcaggatataggcacaggcaaagattttacaatga

SEQ ID NO: 14057 - DNA, 201 bp, Homo sapiens
gaggctggagtaggcagaggctggagtaagcagagaccacgccactgcactccagcctgggtgatagagcgagactccgtctcaaaaaaaaaaaaaaaaamaaaaaaagaaagaaaaaaaagaaaacccgaaagtataaaaaccccagaagaaaatctatgcaataccattcaggatataggcacaggcaaagattttaca

SEQ ID NO: 14058 - DNA, 201 bp, Homo sapiens
gctgaggcaggagaactgtgtgaacccgggaggtggaggctggagtaggcagaggctggagtaagcagagaccacgccactgcactccagcctgggtgatrgagcgagactccgtctcaaaaaaaaaaaaaaaaaaaaaaaaagaaagaaaaaaaagaaaacccgaaagtataaaaaccccagaagaaaatctatgcaata

SEQ ID NO: 14059 - DNA, 201 bp, Homo sapiens
gataacattaggagatatacctaatgtaaatgacgcgttaatgggtgcagcacaccaacatggcatatgtaacaaacctgcacgttgtgcacatgtacccwagaatttaaagtataataaaaaatttttaaaaaagtaagtcatctacattgctgtaggcatgcatagttcattacgtttttgtttttttttttttttttt

SEQ ID NO: 14060 - DNA, 201 bp, Homo sapiens
tcggggcctgtcgtggggtggggggtggggggagggataacattaggagatatacctaatgtaaatgacgcgttaatgggtgcagcacaccaacatggcayatgtaacaaacctgcacgttgtgcacatgtaccctagaatttaaagtataataaaaaatttttaaaaaagtaagtcatctacattgctgtaggcatgcat

SEQ ID NO: 14061 - DNA, 201 bp, Homo sapiens
gaattgaacaatgagaacacttggacacaggaaggggaacatcacacatcggggcctgtcgtggggtggggggtggggggagggataacattaggagatayacctaatgtaaatgacgcgttaatgggtgcagcacaccaacatggcatatgtaacaaacctgcacgttgtgcacatgtaccctagaatttaaagtataat

SEQ ID NO: 14062 - DNA, 201 bp, Homo sapiens
cactcataggtgggaattgaacaatgagaacacttggacacaggaaggggaacatcacacatcggggcctgtcgtggggtggggggtggggggagggatarcattaggagatatacctaatgtaaatgacgcgttaatgggtgcagcacaccaacatggcatatgtaacaaacctgcacgttgtgcacatgtaccctagaa

SEQ ID NO: 14063 - DNA, 201 bp, Homo sapiens
gtagttgagagatcaaagtcaaaatgaggatgacaggcccatgtatatttataataccaaatgcagggatggaacagaagacaaagggtggctaagtctgkctaggtctgtcagggaacacttcatccaagagaggaattgtacagaatcctgaaggttgaagagtattttgaaaagcagagaacaggataaaagagtgaa

SEQ ID NO: 14064 - DNA, 201 bp, Homo sapiens
tgtagttgagagatcaaagtcaaaatgaggatgacaggcccatgtatatttataataccaaatgcagggatggaacagaagacaaagggtggctaagtctktctaggtctgtcagggaacacttcatccaagagaggaattgtacagaatcctgaaggttgaagagtattttgaaaagcagagaacaggataaaagagtga

SEQ ID NO: 14065 - DNA, 201 bp, Homo sapiens
tttctcaaccaaacgagtggatgaagaaaatgtatatatacacacatatatatgtgcgtatatatatgtatatatgtaccacattttctttatccactcawtggttgatgggcacttagcttttacgtatctttgcaattgtgaattctgctgcgataaacacaggagaacagcacacatttaacttgcatgggaagaaaa

SEQ ID NO: 14066 - DNA, 201 bp, Homo sapiens
tccaaaatttggatgaaccaagaagcatttcctaatcttatttgaccaatttttttttttcagaatattttatggggccattatttttaagaaaaactttragaaacacagagacagctctatcttttcatcctgttatcaagttagaatcaccagaaatgtctataaatcaccaaggaaaagagagcgacctgtttcatt

SEQ ID NO: 14067 - DNA, 201 bp, Homo sapiens
taaactctgacctgattgttctcataaagtcagtacagacaattgtctgatgtcagcgtaatatgctggtttgaaaaagacagtgaagcaaatttctagcrccaggtagcattagtacctacctcaaagccaggactcacaggagactgaaacatgaagttgtaagagcaaaaagcaggcaaaggtgcagaatcaaaggag

SEQ ID NO: 14068 - DNA, 201 bp, Homo sapiens
tttaaggtgtacactggcttagtggacatgtatcctgaaagactgagcactagacaaagaagttgccttttaagcagtttttggcaggaactacttgatgmaggaatcaggcttacagaagcaagaactaaagcagttaatcattaggtaacattcttgagattcagcttacatcttgggaaaaacatgtcctgtaactta

SEQ ID NO: 14069 - DNA, 201 bp, Homo sapiens
ttttagccatttattttaatttcttgcagttttgattgttttttcacaggtgatactggaggcgtgtatttatttgagctttactttttagaggcaggtarccttggtaaagggggataaattggattgtaaggaggaggggtctttattccctccagtggttcttgcaaaaccagtttttcctgtggctttccttttgtc

SEQ ID NO: 14070 - DNA, 201 bp, Homo sapiens
tcatgtaacccaaaaatatatatgcctactatgtactcacaaaaattagatagatagatagatagatagatagatagatagataaatttttttcaggacamttcagtcctatcaatctgcaaactgtccagagatttcttttttatatttcgaaactgtctgtctcacttagggatgatgacctaacctgctgttaggaaa

SEQ ID NO: 14071 - DNA, 201 bp, Homo sapiens
caccaaaatccaagacttagaaaataagcgataatttttgtaacagtgaggtagaatcacaacacttttgaaatgcatttaggcagacatggctatttttmaattttaacctattctttaaggcactcaatacatgttaatgtaataacatagccaagtgaatagtttaagtgaggacaactagagattggttttaaaatg

SEQ ID NO: 14072 - DNA, 201 bp, Homo sapiens
tcttctatgtttttcctgtaaatatcgctttttaaaatataactagcaaaaattttaagttcataaaaatactcagtgagataacctacctccataaacamttccaaactgtccagaacccagtacttcatcaggaaaaatctgatatactgtgctgatgtcctagaggtacaagcccaatgaaaaaaaaacatgaagcag

SEQ ID NO: 14073 - DNA, 201 bp, Homo sapiens
gtcttctcttctatgtttttcctgtaaatatcgctttttaaaatataactagcaaaaattttaagttcataaaaatactcagtgagataacctacctccawaaacaattccaaactgtccagaacccagtacttcatcaggaaaaatctgatatactgtgctgatgtcctagaggtacaagcccaatgaaaaaaaaacatg

SEQ ID NO: 14074 - DNA, 201 bp, Homo sapiens
acacagaaatatatacacataggtcttctcttctatgtttttcctgtaaatatcgctttttaaaatataactagcaaaaattttaagttcataaaaatacwcagtgagataacctacctccataaacaattccaaactgtccagaacccagtacttcatcaggaaaaatctgatatactgtgctgatgtcctagaggtaca

SEQ ID NO: 14075 - DNA, 201 bp, Homo sapiens
tatgtgattgaaaattcggtacataaatatgttgcaaatatccaactcagcataactgagcatagctgagtgatataatttaaagacccatgacagcaaasagctgtgtgcctttgtctgtgctgtatctactgaacctagaacagtgtttggctcataatatgtactcaataaatactagtttgatgaatgaggcaaaga

SEQ ID NO: 14076 - DNA, 201 bp, Homo sapiens
tttgacaaacctgagaaaaacaagcaatggggaaaggattccctatttaataaatggtgctgggaaaactggctagccatatgtagaaagctgaaactggrtcccttccttacaccttatacaaaaattaattcaagatggattaaagacttaaacgttagacctaaaaccataaaaaccctagaagaaaacctaggcatt

SEQ ID NO: 14077 - DNA, 201 bp, Homo sapiens
gtgagggcagtacagcaaagtggagatgtcctaaggatggaaatgtgagactgaagtgcctgtggaaggctggacttcaagagctgtattaagcaatggcytaagagatgacaggtgactctctcaaaatggatgacctcgctctggaaatgagcttcaaatgtgcgtaaatcctttagataaatggagggaaacgtttag

SEQ ID NO: 14078 - DNA, 201 bp, Homo sapiens
actacaggcatggggcaccatgcccagctaattttttttttttttttgtatttttagtagagacagggtttcgccatgttgcccaggctggtcttgaactmctgagctcaggcagtctgcccgcctcggcctcccaaagtgcttggattacaggcccgagccactatacccagccaatatacacatatttttattgcaaag

SEQ ID NO: 14079 - DNA, 201 bp, Homo sapiens
aagtaataagtgacaacagttataataataaattagtcatggagaatattttagacatttaaaatgttgccatcaagaaatttaaaaatatacacatatayttttttttttgagacagagtctcactttgtcacccaggctggagtcaactggcacgatctcggctcactgcaacctctgcctccaaggttctcgtgcttc

SEQ ID NO: 14080 - DNA, 201 bp, Homo sapiens
ggaggctgaggcaggagaatggcgtgaactcgggaggtggagcttgcagtgagccaagatcacgccactgcactccagcctgggtgacagagcgagactcygtctcaaaaaaaaaaattcttcatgtaatataatgcaaggaaagaaatatttgaagaaatatagtacatattagatgaaacaacaaaaatataagccaac

SEQ ID NO: 14081 - DNA, 201 bp, Homo sapiens
cgggcttgctggtgggtgcctgtagtcccagctactcgggaggctgaggcaggagaatggcgtgaactcgggaggtggagcttgcagtgagccaagatcaygccactgcactccagcctgggtgacagagcgagactccgtctcaaaaaaaaaaattcttcatgtaatataatgcaaggaaagaaatatttgaagaaatat

SEQ ID NO: 14082 - DNA, 201 bp, Homo sapiens
tcacgcctgtaaacccagcactttgggaggcctaggcgggtggatcacgaggtcaggagatcgagaccatcctggctaacaaggtgaaaccccgtctctaytaaaaatacaaaaaattagccgggcttgctggtgggtgcctgtagtcccagctactcgggaggctgaggcaggagaatggcgtgaactcgggaggtggag

SEQ ID NO: 14083 - DNA, 201 bp, Homo sapiens
taaattaattttctttttcttataatagatagttgttttccctattttagacatatatacataacctatacactttattttggaacatgcaaaagacagtrcgatttccttagagctccaaaacatgtcttgcctatagaaatagtttcataaaaattcatgtagggcgggcacggtggctcacgcctgtaaacccagcac

SEQ ID NO: 14084 - DNA, 201 bp, Homo sapiens
tgacagaatatctatttggaaaattttctaaattaattttctttttcttataatagatagttgttttccctattttagacatatatacataacctatacastttattttggaacatgcaaaagacagtgcgatttccttagagctccaaaacatgtcttgcctatagaaatagtttcataaaaattcatgtagggcgggca

SEQ ID NO: 14085 - DNA, 201 bp, Homo sapiens
gatacagtacatacacaacattttccaaattttcttgatgaaaaaatgtgttttcacctcttctgtgaaggggttcaaaagactagcgttctttgaaaaayatgctgggaaataatgatttttaaaatgctttatataggagttaatttagtccccaaaacactcctatgaaggaaatagaccaagtcagcatgatttcta

SEQ ID NO: 14086 - DNA, 201 bp, Homo sapiens
gcctcagcctcccaaagtgctgaaattacaggcataagccaccatgcccggccaaaaaccatgtatattcaaaaacctatccacacacctcgcagtcattyttcgtttcatacattctagaaatgattcaatctagatttagatccaggattgctgcagacacatgataaatgtaatgagtcctctcttttccctataaaa

SEQ ID NO: 14087 - DNA, 201 bp, Homo sapiens
cattagattgagcacacctgaataatccaaacgactcttcctattttaaggtctgcaactttaattatacctgtaaagttccttttgccacctaaggtaayatatttactggtgtcagagattagggtgcagacatctttaacagggcaggggtatgtgggggggcattctgcctaccacaccatacaaagactccactat

SEQ ID NO: 14088 - DNA, 201 bp, Homo sapiens
tgactttttttttcttttccttttttttggagacagattctcactctcttgcccaggctggactgcagtggtgcagtctcagttcactacagcctcccccwctcgggttcaagagattattctgcctcagtctcccaagtagctgggattacaggtgcccgccaccatgcctggctaatttttgtatttttcgtggaaacg

SEQ ID NO: 14089 - DNA, 201 bp, Homo sapiens
gaatttttatgagaattaaatacactccaatgtatgttaaaggaggaactcctttccgaagtactgaatgagtcactttctctgccctgtcagcccctgcratttcttttaaacaatcttttgtcctttaagaggaaggaaatatttattaagaatataactctaaacaatgcaacactgtcaaggtaatctattctaaag

SEQ ID NO: 14090 - DNA, 201 bp, Homo sapiens
agcataaagacactaagacaagggaaaggggaagccagttgtaaaggaacagccagtctagtaaagctggggaagtcacagcagtcccagaagagagccamcaatgagggaaaaaagagcccaactggggtctggagtccagttccaaaactaacatcaaaattcagaatttagatctagagtgaatgtggtaggacatgc

SEQ ID NO: 14091 - DNA, 201 bp, Homo sapiens
agactgccatgtgtaatttatcaagcataaagacactaagacaagggaaaggggaagccagttgtaaaggaacagccagtctagtaaagctggggaagtcmcagcagtcccagaagagagccaacaatgagggaaaaaagagcccaactggggtctggagtccagttccaaaactaacatcaaaattcagaatttagatct

SEQ ID NO: 14092 - DNA, 201 bp, Homo sapiens
aatttatgaagaaaaagtaatactcatcgttatctagtctgaaaatcatcctagttacccacagtatcatgtgatggagttctcactctccttttctggayattatattttcagtatacgtcattaatagttcattatttattaaagtcattccctcacacttctcattcttgtaataacttccatgtttctctttttgaa

SEQ ID NO: 14093 - DNA, 201 bp, Homo sapiens
tttatatgtacatcatttaaatatgtcttacaatatgggcaggataaaactaatattcaagataaagcatttactaattttgttataaaacatgctgaacrtttgaatacacacaatggttcacacagtattgaattaaatgacagatatctgaacatcatatttgtatggaaaaaatgcatcataacatgggtcatatct

SEQ ID NO: 14094 - DNA, 201 bp, Homo sapiens
ctataaatatttagaagctcattcaactaagaaaactcagtgattattgtttacctgtagccaagggtggctcaaggtcttatccacactgtagcgctttytcatttttacttgcagcaaattgttgataagatcaatggctgaaaaaaattaccagtaaaaatagatgacaaatctgtaacatatgcataattcatttat

SEQ ID NO: 14095 - DNA, 201 bp, Homo sapiens
aagatttctaaatatcaaaatcctataaatatttagaagctcattcaactaagaaaactcagtgattattgtttacctgtagccaagggtggctcaaggtyttatccacactgtagcgctttctcatttttacttgcagcaaattgttgataagatcaatggctgaaaaaaattaccagtaaaaatagatgacaaatctgt

SEQ ID NO: 14096 - DNA, 201 bp, Homo sapiens
gaataatcacactttaaaaattattgcaaaagatttctaaatatcaaaatcctataaatatttagaagctcattcaactaagaaaactcagtgattattgwttacctgtagccaagggtggctcaaggtcttatccacactgtagcgctttctcatttttacttgcagcaaattgttgataagatcaatggctgaaaaaaa

SEQ ID NO: 14097 - DNA, 201 bp, Homo sapiens
aaattgctatttgttgaattcaaccaatttcaatttcatatataaaaaagcaatcccttttactcctctattttctatccatcagacccattacagactakacagcagcgagcctgaaaaaaaaaggaagaaaaaaagaaaagctctcaagagagtagctattcaaacctctcaaggcaaaatacagagaaaaggaacaca

SEQ ID NO: 14098 - DNA, 201 bp, Homo sapiens
gcaattctgggttaaacaatagcatcctccacatgaatgcctgcagatgcacagctgagaccatgtgtgcctgcacacacacacccacacacaacctcctyaagcagacagactccacagtcagagcaaccttttaaacactttgcctttatcacccacagagaccaccagtctagtgcaatcatctaccctctcatagag

SEQ ID NO: 14099 - DNA, 201 bp, Homo sapiens
tttaatatacattccaatggagtgggttttgacgattttcctcccatttcctcccagtaacgacacagcacattcacttttcctttctttttagaccaatyagacctggttggccttacgctttgcttagagcatacagcctctactaagagacctgtagccttctgtatgtcactcctcacgttgcttccttctggaaca

SEQ ID NO: 14100 - DNA, 201 bp, Homo sapiens
tttacatccatttgaaatcaaagcacaacatccattcattatgaatttacctgttctgcaccctgggggaaatcagcattagttgagtgtatgcatgccayctcgcctaatcacaaaattgcacttcagagataatcacttagcacaggaaaacaaagtgaatgctgtaattccatttcatttaagtttaggaatcaaaat

SEQ ID NO: 14101 - DNA, 201 bp, Homo sapiens
cttctgctaccaaactcaaacacttaataggctgttcatattaatgggtggccctcagcatcaaggatgcaatgaggaatggttgagactatagtaatttkgagaggacagcgtcactgtaaaacagatagctacagctcaattagttctaacagctgccatgtgaacatgtgaacccattgttgatggatcttttagttt

SEQ ID NO: 14102 - DNA, 201 bp, Homo sapiens
tacacatgtgtacacacaaataaatggggatattttcttccagtattcaaagttgtaatttaagtgagccaagaattcacttgtcacttatgaacatttgragttctgacagaaatatttgctgtttccttttcatcttacttcttaacataaataaaattatcaaccaatagtgatgtcagaactacactaattgatact

SEQ ID NO: 14103 - DNA, 201 bp, Homo sapiens
cctccttagagaggctttccctgaccatccacaaggaatataacagttcctcttactcatatctgttgtcctgcttccttttaatcagataagtcatcacyacctacacttctatgatatatctatctttttaaaaaagaattctgtctcttaactcaaatatgggtccattagagtggggactttttccatcctagtcac

SEQ ID NO: 14104 - DNA, 201 bp, Homo sapiens
tgctcgtgtcacctccttagagaggctttccctgaccatccacaaggaatataacagttcctcttactcatatctgttgtcctgcttccttttaatcagayaagtcatcaccacctacacttctatgatatatctatctttttaaaaaagaattctgtctcttaactcaaatatgggtccattagagtggggactttttcc

SEQ ID NO: 14105 - DNA, 201 bp, Homo sapiens
gttagtaggtcatagagaaatgtatcatacttccagcaaatctgactaatggtctgttgctgtctctcttaaaggcagatataatttacaaagactaaatmtaaagaacagtaaaaaatagcaagttacacttgaccccatgaaaggctgaaataaaaaatgagatattgaggaaaaaatctatagatgttcatgttcttt

SEQ ID NO: 14106 - DNA, 201 bp, Homo sapiens
ctgacacttatattcattatatctatatatcttgtttttcctcaaaattaacctatattcagtgacaaactgattttttttaaaaaaactccctttctttkattaatattatgacatttttacattaattccatgtattgtgctagaatcaagcaagggccatggatttggatgctggcatggattcagtggaattccatt

SEQ ID NO: 14107 - DNA, 201 bp, Homo sapiens
ttccattttgttaattttactgacacttatattcattatatctatatatcttgtttttcctcaaaattaacctatattcagtgacaaactgattttttttwaaaaaactccctttctttgattaatattatgacatttttacattaattccatgtattgtgctagaatcaagcaagggccatggatttggatgctggcatg

SEQ ID NO: 14108 - DNA, 201 bp, Homo sapiens
caaaatgaaggctatgacagcaactaaaaaagtttaaccaaaagttaagaatcattaactttagagaagaaaaactcattttagagatgagtaagttgatrtccagaacatattaaggaatattttcaaggtgacagtggtaggtagtgccagaataatagctaagagctagtctcttgaattttactgcttgatctttcc

SEQ ID NO: 14109 - DNA, 201 bp, Homo sapiens
tatagcacaatgaagatttttatatttcataaaggctaaatgtttattactttaacaaattaaaaataatagacacaggtactgaacaaaatgaaggctaygacagcaactaaaaaagtttaaccaaaagttaagaatcattaactttagagaagaaaaactcattttagagatgagtaagttgatgtccagaacatatta

SEQ ID NO: 14110 - DNA, 201 bp, Homo sapiens
catattatcttgcattataccttgacagattactagttagtgatagctattagaagtcttagtagacactttgaaattattcacacaacagtaattaggcrtgtggatgtgcagcttggaaatgaaaaaaatgtacttcacacttcacactatttgtctcactctgaataaaactgtcactatagcacaatgaagattttt

SEQ ID NO: 14111 - DNA, 201 bp, Homo sapiens
catataaatatattgatgttgtgtatcaagtattgctaaagaagtctaataagctacaggtttctctttaaggcagatgtgactcagtgagatacttaatrgttggcaaaaaccttcttttattttaatttgaataacatgtcatctattaagataaaagcaataagatatgacttaataaatcattaactctaatgcagc

SEQ ID NO: 14112 - DNA, 201 bp, Homo sapiens
ggaataaagctagactataaatcctccttccttgggcatataaatatattgatgttgtgtatcaagtattgctaaagaagtctaataagctacaggtttcyctttaaggcagatgtgactcagtgagatacttaatggttggcaaaaaccttcttttattttaatttgaataacatgtcatctattaagataaaagcaata

SEQ ID NO: 14113 - DNA, 201 bp, Homo sapiens
gggctagaatctgacccataagctatcttctgcttagacctctctttttttttagccactctcctttctattgagttcaaaatctgattgtttaaaaaackgttttccttcataattttaaatttgtaccttaactttatcccatctatttgaattacagcaaaaataaaataaaataaatgggaaaagatatctaagaca

SEQ ID NO: 14114 - DNA, 201 bp, Homo sapiens
taacttccttttctcattcaagacaagactttaatttactccactctgtttttctaaaggcagggctagaatctgacccataagctatcttctgcttagayctctctttttttttagccactctcctttctattgagttcaaaatctgattgtttaaaaaacggttttccttcataattttaaatttgtaccttaacttta

SEQ ID NO: 14115 - DNA, 201 bp, Homo sapiens
gctgaaggatgttttcagaggtagggtcatggcgaaaaagcaggatcttatcatacattccgtagaaaccacattcagggaactgcaaatacaaataccaygagagtgtaaatgtcaaaatccttccaaatattttgttttaaatatttcagggcacaaatacaagctaattagaaaagttcaaagtatctagatcattaa

SEQ ID NO: 14116 - DNA, 201 bp, Homo sapiens
attgagtatcattgtaaggatctccactctagctgttgttctctggtgctttttaaaaaggttaaatacattcttttttttctgtttggttaggcacagtyctattactaactgctaaatcctaaacaagaaataaaaaatgtgagcagaggcaaatgtagccatttctcagggactgagttaactagcgtcacatggcat

SEQ ID NO: 14117 - DNA, 201 bp, Homo sapiens
ctgaatcaaagcaaagtgaataaaacaaagataaattgaattataatcagtgcatccaagtactgggctctgaacaagttgaggaacttgaggaaataaasttgagactctgtaatgctgctggacttcttttattcaaagagatggtaaacaaagaaggcatgagaggagaaaagagcaaggcaatccaagtttctcaat

SEQ ID NO: 14118 - DNA, 201 bp, Homo sapiens
tcctgctggtagattgttagttaaatataaaaacaaccaggttatgtttacatcaaactacagagtaaaatttaatttgtgataaggaaaaagaaagttcrgataaataaaacttaacagtaaaactacaggcttcagaaggaaaatgcagcacccttcgtgtccccttcagggactaggtcaggaaggagtatgtaatcc

SEQ ID NO: 14119 - DNA, 201 bp, Homo sapiens
gatataagcaaagaaaaaaaaaaatcttgatgttgtctgaagaaataaaattaaccttgaaatttttccctattttttctctcatttttactgcagtcctrtgtcagaaaatgttcctgctggtagattgttagttaaatataaaaacaaccaggttatgtttacatcaaactacagagtaaaatttaatttgtgataagg

SEQ ID NO: 14120 - DNA, 201 bp, Homo sapiens
tttcctcaataacccaatccatctactcatgagcaatcttttcctggcttactgcgtttaaatgtactagctcacactagtcatgtttttcaaaaagaaasggagggagaaaaaaatcagcaaattagccagaagcagcttggttagttttcactcccaaagcagttaaaagatgatgaaaagtctgagcagaaaatgata

SEQ ID NO: 14121 - DNA, 201 bp, Homo sapiens
gagtcatgtaaatgtagtcctgttactaatttgtttgctaaggctgaattatcaggatttgatagaggcccatcatgaagaaggcttcaaatacattccayaaccttgattttacagttcagtaccatacacttgaacttcactctggtaaaaaaaaaaaaatttccatgttcagtgttttcctacttcttaacaatagta

SEQ ID NO: 14122 - DNA, 201 bp, Homo sapiens
ccaatgtattatatctaagacaaattaatataatattatatctaagagaaattaatatataaagtcagtaatttgcactttctataaaagaaaaaagaagyttaataaaatgttgttaccatattttttttcctggtttatgatttaggcattgaatcgtagtaggagtaaaacatgcttataaggatttcttaaatatag

SEQ ID NO: 14123 - DNA, 201 bp, Homo sapiens
tggtaacattccaatctgcttgctgtctgcattctcttctctgagaaaatggtttagtgtggcacaaagaaattaaaaccaggttgatatggttaggcttygtgtccccacccgaatcttatcttgaattgtaatccccacgtgtcgaggcagggaagtggttaaattatggaggtggtttcccccatgctgttctcgtga

SEQ ID NO: 14124 - DNA, 201 bp, Homo sapiens
ctatggtaacattccaatctgcttgctgtctgcattctcttctctgagaaaatggtttagtgtggcacaaagaaattaaaaccaggttgatatggttaggyttcgtgtccccacccgaatcttatcttgaattgtaatccccacgtgtcgaggcagggaagtggttaaattatggaggtggtttcccccatgctgttctcg

SEQ ID NO: 14125 - DNA, 201 bp, Homo sapiens
gcttctccatctcctccctggagaatccattttatcaggagataaataaccaagaaaactatcaaagtgaggaagaagtgcaccaagcacaatatccctaytgaagtcacaagtagggaaaagtgggagtctatggtaacattccaatctgcttgctgtctgcattctcttctctgagaaaatggtttagtgtggcacaaa

SEQ ID NO: 14126 - DNA, 201 bp, Homo sapiens
taaaagcaaagaaccaaccagagtagagatttatacatgagataagcccaagactgctgttgaccttgaaggacaaaatagatgaatctatttgactcaayagataaacattacacatttgtcctaggtggaaaaggtggtatattgaggctatataattaaatatttttcattaaaattttataacaatgttataacatg

SEQ ID NO: 14127 - DNA, 201 bp, Homo sapiens
gacccccaacagagcagaggagactttgaaaatataacaacaaaatgtaatgtgctagagattgagtcccgagcagaaacaggacattaatgaaaaagatyggtaagttcaaatcatataccaatgttaatttcttagttttgacaaatgtaccatgacaatgtaagatgataatattaggggaaaataaatctgggtgag

SEQ ID NO: 14128 - DNA, 201 bp, Homo sapiens
atcataagatggcccctgggatacatctttcaggctaatagattactgacccttccaagacctctcaaaaatatctggctaatgacatatcaatcttcatyaactgcccatctcttctaacagcagctccttgaccatcaaaggtaattttgtcaaccttacatttggaggctcaccttttatctaaaacacaaatgctgc

SEQ ID NO: 14129 - DNA, 201 bp, Homo sapiens
taacttttcactgactcctgactctagattgtgtctgtcggcttcatgaatgttgatgttccatcctggactcattctttattcatcatcataagatggcycctgggatacatctttcaggctaatagattactgacccttccaagacctctcaaaaatatctggctaatgacatatcaatcttcattaactgcccatctc

SEQ ID NO: 14130 - DNA, 201 bp, Homo sapiens
cccttctttcacagagtatcttctactttaaaaccagcaaaagtgtaattataaacaaagtgagatatgttactgaagggaacacctggtagaaaaagttkcctcacccaaatgtggtatttcaggtgagattcttagggaaggatatatgtgctgagtcatgaaagatgaattgaaattagccaggcaaatcaaatgagg

SEQ ID NO: 14131 - DNA, 201 bp, Homo sapiens
ttggataaatgtctattcaaattctttgcccattttataaaattggtttccccatttctttttaagtctttgaatttcaatggaaattcaatccatatgcrttattcttgttcactgatgagtgttttccaggaaatcttgttagatgctgttaaaattatgagttttaaaaacccacactaacatccattaaaacaatgt

SEQ ID NO: 14132 - DNA, 201 bp, Homo sapiens
gttcatccatgatgtaacaagtatctttacttcatttttatagctaaataatattctactgaatgggtataccacattttctttaaccaccccttagttgrtgaacatctgttttttctacttttggctataattaataatgctactatgaatatttgtgtataaacttttgtatgaacatatgttttcaattctttgggg

SEQ ID NO: 14133 - DNA, 201 bp, Homo sapiens
gacgatgatctgaataaccactatccttattttatccctgaaatttatccctgaaataacttattcccaagaaataaatgtatttgagcttcttgacattyttatccttatattccacagaacttaagcaattaaaattatgaatgacctccatgttattttaacatactaggttgctgcaaaagtaattgcggtttttgc

SEQ ID NO: 14134 - DNA, 201 bp, Homo sapiens
tacacacacagacatacacacacaaatagactcacacacaattcggtccatgtgatatttgtcctatcaaggctaaagatgtagtgttattccatcaaaawtaccactgcataaaatgccactttagattgctctgccctgacaagagtggaaaatctctgcttcacagaagcaaagcataactgtacttcaggactgcaa

SEQ ID NO: 14135 - DNA, 201 bp, Homo sapiens
gtatctagtgaagagacagtcatgctccttgccatagctgacagagacccaggggaaaggcctgtttataaaagaagacccatgactcagaaataaaacaygtaattatggcataaccatagaaaggacccaccatgagaaaaatataaaataagggctactcaattcctatggaatggtctctcatctttgtactagtag

SEQ ID NO: 14136 - DNA, 201 bp, Homo sapiens
agattttcaaaggtattgataaaaagttatgcatagtattatctttaatattttgtaattcccttattttattgttctcttaaatgtcctttagcgaagtrattaattcattacttctaaatatttttgtacactaataaatgcatttaagggtattgattttcttcctgagaccattttagcaatatcctaaaagtgcat

SEQ ID NO: 14137 - DNA, 201 bp, Homo sapiens
agtttgtgaggctgcatatttccctgtaccctcatcagtactgtatccaatactgggcttttaatttttgactgtctgctaggtgaaagattaatttgcaytttgtagattacagatgaggttggccattttttttcaattgcgtattcatcttccatttgtattcacatatttttagttcttctgtaaactgtccagacc

SEQ ID NO: 14138 - DNA, 201 bp, Homo sapiens
tcttctccttctggaactaaaatttgagtatttagttggtttatggtgcccaatatattatgtaggctttctttattcttcttttttcttttcttaattgkggctttgttatttcaaaagacctgtcttccaattcagaaattagtttttctgcttcatctagtctattgttgaagctctgaactatatttttattctcct

SEQ ID NO: 14139 - DNA, 201 bp, Homo sapiens
tcccctctgccccttctcattcttcccttccctcccctcttataatcctcccccgtgctccctatgtatatgtatcagtctgtctggtgactaagtcttcrctgctgtattttattttgaattgttttcttgaggaagtctcaaaaatagaagccaaaagatagaatcaaaggtatgatcacagttgtaaccctcccaata

SEQ ID NO: 14140 - DNA, 201 bp, Homo sapiens
gtgacattagcttggcacttaagaaaatgcttccaggtggcaggcacctgctctggctttaaaatgccaacctcaaaacctacagtcaggcaccaaagtgrggaagtgcaacaaactatgtatttcagcacctagtagttttggcagctcatttggaactggttattgccagctgggcagtttgccatttccttgaggcaa

SEQ ID NO: 14141 - DNA, 201 bp, Homo sapiens
attgcaatctatgtaaccaacaatgttaacctcaggcacagatctactttctgtcaccctagtttaccttgtctgacatagaatttcatgtaaatgaaatmataaaatatgttatatgtactcttttctggctggcttttttggcttattataaagtttttgagattcattcatacatacatttgggttctttcacctttt

SEQ ID NO: 14142 - DNA, 201 bp, Homo sapiens
tgaaatcataaaatatgttatatgtactcttttctggctggcttttttggcttattataaagtttttgagattcattcatacatacatttgggttctttcwccttttattacttattagtatttcattaaatggatctagcataattgtttatcagttcacccacaaatggacattgtagtctttttttccagtttgcagc

SEQ ID NO: 14143 - DNA, 201 bp, Homo sapiens
cgcctcggcctcccaaagtgctgggattataggcatcagccacagcgcccggccaagttcagtttttaacctgtttagtacaaggtgcagctgagaaaacygagatattaaggtaggggtggatgaaaagtaggcaaataaatacataggatacacagtgaagtttagatttagagtaggacatggactgtagagttaatt

SEQ ID NO: 14144 - DNA, 201 bp, Homo sapiens
aacctccgcttcccaggttaagtgattctcctgcctcagactcccgaatagctgggattacagacatgtgccagcatgccaagctaatttagtagagatgkgatttcaccatgttggccaggcttgtctcaaactcctggcctcaggtgatccaccagccttggcctcccaaagtgctgggattacaggcttgtgccaccg

SEQ ID NO: 14145 - DNA, 201 bp, Homo sapiens
ggaggggcaggtgggaactgggtacatattaaacaaatttccaatttcaaagtgtttcaaaagtttcaaactcaaatttcaaagagtatgtgtgtgcacayattagggcaaagaggacattccaataacttttcacaatctaaatcataaagtaggtatgtttctaataaaatatatttcaatacttaactaaatttaatt

SEQ ID NO: 14146 - DNA, 201 bp, Homo sapiens
ttaaacaaatttccaatttcaaagtgtttcaaaagtttcaaactcaaatttcaaagagtatgtgtgtgcacatattagggcaaagaggacattccaataamttttcacaatctaaatcataaagtaggtatgtttctaataaaatatatttcaatacttaactaaatttaattgcatctctgataaaaaaatgcattttaa

SEQ ID NO: 14147 - DNA, 201 bp, Homo sapiens
aggtctaaattaataaaccgtgattatttgagtcacaatgtaattagcacacatttaacatgacaatcctaattttaaagcagaaatattattagaaatgrtaagcattaaaataaatactaaaaacaggggacaatgtgtatactaacttccagctttaggtaagtaaaaactttcagccactattaaaagctgcctgtt

SEQ ID NO: 14148 - DNA, 201 bp, Homo sapiens
agtaagaaccccggatggttaaactaagaaagcaacaagaggaatatataagaaagaaaaaaacctacaacgcactattatgaagtacagaaaggcaaatrtgactccgtttgttgtttatcttgcctctttgtttattgttggagttgttttaggttggctgatttttgcatgaaagaaacaaaatactggtactactaa

SEQ ID NO: 14149 - DNA, 201 bp, Homo sapiens
ataagaaagaaaaaaacctacaacgcactattatgaagtacagaaaggcaaatatgactccgtttgttgtttatcttgcctctttgtttattgttggagtwgttttaggttggctgatttttgcatgaaagaaacaaaatactggtactactaacagaaataagaggaacatttgaagggaaagcccaagttttagaccca

SEQ ID NO: 14150 - DNA, 201 bp, Homo sapiens
actggtactactaacagaaataagaggaacatttgaagggaaagcccaagttttagacccacagttgagggaataagacatttaagtgtgaaaactccatyggcagaagcaaatttaaaatgaagccaaggtgaagactaggggttcaagaaacaatttctaaaaactgcctgttgatgaaaatgagacaaacgagtcttt

SEQ ID NO: 14151 - DNA, 201 bp, Homo sapiens
atgagaatatgtggtgagttgaaaagctcaagaagcaaaaggaaaaaaaaaataggagaagttagattactggaaaatttattttgcttctgagtaatcacagttttattacatttatgtgtttccataactgagatgaataatattgtcacatgggatgaagggaagaatgaataagctgtctgtgtcactgttataaag

SEQ ID NO: 14152 - DNA, 201 bp, Homo sapiens
ctttcaaaattgctgagtatagatagcaattctcaattacactaccaatgacattttccctagcaaaaatgtacactgcatccaaagataatgaacaagtrgaaagtgagaactagaaaaatggccatggatgattgcacataatttgatatcgactgaatcataaagtgtatgtgtctgtatgtgctagtattcttgtaa

SEQ ID NO: 14153 - DNA, 201 bp, Homo sapiens
catggatgattgcacataatttgatatcgactgaatcataaagtgtatgtgtctgtatgtgctagtattcttgtaattaagaatttaggtatgcagtttgwttcctggtttttgttatactaggtcatccaaaaatttaaatgccacatctgggaatatcaacgtggcttggtgactatgatgcacttatttacttagcat

SEQ ID NO: 14154 - DNA, 201 bp, Homo sapiens
atggatgattgcacataatttgatatcgactgaatcataaagtgtatgtgtctgtatgtgctagtattcttgtaattaagaatttaggtatgcagtttgtytcctggtttttgttatactaggtcatccaaaaatttaaatgccacatctgggaatatcaacgtggcttggtgactatgatgcacttatttacttagcatc

SEQ ID NO: 14155 - DNA, 201 bp, Homo sapiens
aacgacagaggcatcaagagataagagtcctgaaaaaagttaaaaagacagacatacaggtcatgggagattcatgtatcaccaacaggagaaaaccaaarcacggtagacctatccttcatgggacacactcagagagtaactcctccatatgtaacacactctctctctctcttttcttttttaaataaaagaatccat

SEQ ID NO: 14156 - DNA, 201 bp, Homo sapiens
tgagggtggagccctcatgaatgggattagtgcccttataaaagaagcctgaaggaacctgtttgcctcttccaccattgtgaggatgtggccagaaggcrccacctatgaagcagagaacaagccttcaccacacactgaatctgtcaacacccttgattttggtctctccagtctccagaagtgtaagagaataaatct

SEQ ID NO: 14157 - DNA, 201 bp, Homo sapiens
cagtctaaggtattttgttatagccaactgatgggacaaatacagatattggtaccaagaagtggtgttgctatcacaaatacctaaaagcatggaagaascgctagaaatgggtaatgagtaaaggctgggaaagtcttgaagtgaatgctagaaaaagtctacgctgctataaaaggactagaaaaagtgattctggtg

SEQ ID NO: 14158 - DNA, 201 bp, Homo sapiens
aaccctcaccccagtgtgctgcaaaggcaggacatggaatctaagaagattattcacaagccttaagatttaatgtttgccctgttttgttgtggacttaytgcaacttgtactcttttcttccttcccatttctcccttttgaaagaggaatatctaccccgtgtctgttccaccactgtattttcaaaatgcataattt

SEQ ID NO: 14159 - DNA, 201 bp, Homo sapiens
ctcaccccagtgtgctgcaaaggcaggacatggaatctaagaagattattcacaagccttaagatttaatgtttgccctgttttgttgtggacttattgcracttgtactcttttcttccttcccatttctcccttttgaaagaggaatatctaccccgtgtctgttccaccactgtattttcaaaatgcataatttgttt

SEQ ID NO: 14160 - DNA, 201 bp, Homo sapiens
cccaccaagtgaggatgcagctaggagacaacatctatgaaccagaaagcaagcactcactcaattccgaatctgctggtgctttcatcttggacttgtgmgcaatacatttctgttgtttatcagtcacccagtcaaaggtattttgttatagccgcccaaatggaataaggtaatatcgtatgtactttatattttata

SEQ ID NO: 14161 - DNA, 201 bp, Homo sapiens
ttgcaggtggaaatactaaggcatagtacagcaatttgctggaatacagagttattaagtggtggaactggaatttgggacacaagtagttgacattattstgcattttttcatatcattcaactaaattcccacagcaactatacaatttataagtcattatcttcatttaaagaggaggaaactatgctttggggaaat

SEQ ID NO: 14162 - DNA, 201 bp, Homo sapiens
agagttattaagtggtggaactggaatttgggacacaagtagttgacattattgtgcattttttcatatcattcaactaaattcccacagcaactatacawtttataagtcattatcttcatttaaagaggaggaaactatgctttggggaaatgaagtaccttattcatggtcacacaatctaatatgaagaggataacg

SEQ ID NO: 14163 - DNA, 201 bp, Homo sapiens
atttataagtcattatcttcatttaaagaggaggaaactatgctttggggaaatgaagtaccttattcatggtcacacaatctaatatgaagaggataacrgctcacatttacttcattccaaagcttcaaacagttaggagatactaagaaagtgtgatttgcattcttccacaggaaagcaacatgataatagtggtgc

SEQ ID NO: 14164 - DNA, 201 bp, Homo sapiens
cttcagaagccaaacactgtccttcggcagcactgcactctcttacagagtgtctttgggggagctatttaactacaaatagtttcatcttccaggaagayccaaactgcttatgtagatctgatcctcattatttgccaattcctcatttgcaaattcatctacttgctaaaatgtatttatgacaccaaaataaatact

SEQ ID NO: 14165 - DNA, 201 bp, Homo sapiens
tgaaatccaaattcctaaaatcactactctgcttttcagtgtcttcatatttggtaagtccacatgcaggaaaatatttgacttgctttaccttatgaaamctaaaagtaaaattgtgaacactacagactctacacatagacatgctgatgtcaaatcacaggaaaaaaaatgtgtgttttctgttatttgaattttttg

SEQ ID NO: 14166 - DNA, 201 bp, Homo sapiens
aagttgacacgtgtagctagccatcacagtaccttaaacgataaagttgcctccaatgaacatgaataagcagtagggaaaaagaaccacttgaggcaatygccttgatcttcaatcccagctgtttcactaacagtgtggttttaagaaagtcattttttctttctgaacctcaatatgcttattaaaaaacaaaacaaa

SEQ ID NO: 14167 - DNA, 201 bp, Homo sapiens
aaccagaaactgcatttcaatgagccggacatgagacaggccaggtcaaaagccatgcaagactatcctctatatatccctcccaaatggtagtatttggktcatacctgagtgttcagggctgaaaggacccacaggcttaaggaaaaggattaaggataagaagtatttcagtgggcagaaattatgagtagaccattc

SEQ ID NO: 14168 - DNA, 201 bp, Homo sapiens
ggtattctgtagattaaaaacaaaaacaaaaacaaaacaaaacaatattggctgggcatagtggctcacgcctgggatcccaacactttgggaggccaagrcaggtggatcacctgaggtcagaagtttgagaccagcctggccaacacggtaaaaccctatctctactaaaaatacaaaaattagctgggcatggtggca

SEQ ID NO: 14169 - DNA, 201 bp, Homo sapiens
ttgttgggaagagtataaggaaatggaaactctcatacactattttcagtagagttaaaaatgtaaacttttacacttttgaataactatttttttttttwaaaaagcagtataacctatttggattctaataatgttatctactaactcattcagtaaataatttttatttttactttatttattattattttttgagac

SEQ ID NO: 14170 - DNA, 201 bp, Homo sapiens
tatttgtatttttgctgttggttgagtttgttgtatattctggatattagtcacctgttagatgaatagttagtgaatattttcttccattctacaggtcrtctactcattctattgactgtatcctttgctgtgcctaagctttttagtttgtctacttttgtttttgttggctgtgcttttgcaaccttagccataaaa

SEQ ID NO: 14171 - DNA, 201 bp, Homo sapiens
tatactgatttcctttccattagctacatacccagtagtgggattgctggattatatatatatggtggttccattttaagtttctaagaagcctccatacrtttaccaaaatagctatactaatttacattcccatcaatagtgtacaagagttcccttttctccatttccttgccagcacgctatttttttcataataga

SEQ ID NO: 14172 - DNA, 201 bp, Homo sapiens
acatttgtttctttgtgttaggaacatttcaaatgttctcttctagctattttgaaacataaaataaatcattgttaattatagtcatcctactgtgctaytgaacactagaatgtattccttctctctagctgtgtgtttgtacccgataactaacctgtctttattcccaatcccacccttcctagactctggtaacca

SEQ ID NO: 14173 - DNA, 201 bp, Homo sapiens
aagctctagactgaacttggcaacaagttcaaacacacattagaaagtaggcataaatactgtcatactacctattactatagactcttgaactccactcyctttgtcttcataggcactccagccaccactctgcatgaaagagtcaccattctagaaggaccagctactcttctagtcaaatcagaagacaggatgctt

SEQ ID NO: 14174 - DNA, 201 bp, Homo sapiens
gcccaaattcataagtaacttgggactgtctgagtcttggattgcttatccacaaaatgtgaataagagcacatttctcatttcattgttgagactgttarattactaatagcactcaaatagggtaagtttgtgtcattcatctggaaggctgaggtgttttcagtatctgctgagatagatgagacttccacctctact

SEQ ID NO: 14175 - DNA, 201 bp, Homo sapiens
cttaagtatattttgataaagatagtttaaattttgaacattagcttgaactgatcacaatgaacatcaacaattactggaagcaacacagtagagcattktaagaacaagcatgttaaaagtcctgagttcaatgcccaaattcataagtaacttgggactgtctgagtcttggattgcttatccacaaaatgtgaataa

SEQ ID NO: 14176 - DNA, 201 bp, Homo sapiens
agggcatatttcactcctcttttcacagatgtagtcagttggcaaatatataactagagaagtttaactgaaatatcaggacgtatttatatcttatttgsaaaaggtcaattcttcaattgagctctagagcacaagagaaaaactccacaaagatattatacttagtctatacttcatttttcaaccattatttttaaa

SEQ ID NO: 14177 - DNA, 201 bp, Homo sapiens
tgtaccaggaaatgacagagacaggacatccttcatatctggggtttcatccaccagatcatgttgacattctctaaagctgggactacaggaggaatagyagacataggggaaaacatgaggaacggttctaaggacctatgaaatgcaggacgcaagatttgtttcctgggtgtgtctctttctgattgcactgcatgg

SEQ ID NO: 14178 - DNA, 201 bp, Homo sapiens
cctatgcatacacagatttgtattcagtcaaatactaaaccagatccttacacagatttctggagctctttctttgtataagtccaacctttccattattrttcccccaaaatcctgttggcttggcctccctgagctcttatctctgtcttctttaagcagcaagacaattaggctctgcttgggttctccctttctata

SEQ ID NO: 14179 - DNA, 201 bp, Homo sapiens
ggttctccctttctatactacactctggtcctgctgctaggcaggaagctcaggtgtttgtagtacttaccttgtttgtttcccttttctgagggatcacrttactgcatggtgtgttggccaatgtctaaaacagtattttataaattttgtattgttttcctatttgtttagagcaagagggcatgtctcaaaccagtt

SEQ ID NO: 14180 - DNA, 201 bp, Homo sapiens
ctctatatttcatttctctctgtttctgcactgctgacatttgaacctcacattttgtgtgatgcctctttgtaaaacgatggttaaaatgtaataaatawtttggtgttcgagtaaggcttgaatgcctcaaatcctaattgttattatgtttctttataagggtggctgagaagacattaaaaaaattaggtagaataa

SEQ ID NO: 14181 - DNA, 201 bp, Homo sapiens
ggttaaaatgtaataaataatttggtgttcgagtaaggcttgaatgcctcaaatcctaattgttattatgtttctttataagggtggctgagaagacattwaaaaaattaggtagaataataccaaaatatgctgcacatattaaagctatcatttaaacactatatttttcaatgaagatagtgttataagtgatcataa

SEQ ID NO: 14182 - DNA, 201 bp, Homo sapiens
taaataatttggtgttcgagtaaggcttgaatgcctcaaatcctaattgttattatgtttctttataagggtggctgagaagacattaaaaaaattaggtrgaataataccaaaatatgctgcacatattaaagctatcatttaaacactatatttttcaatgaagatagtgttataagtgatcataaaggtaatctgcaa

SEQ ID NO: 14183 - DNA, 201 bp, Homo sapiens
tcattaaactaaacaggctttcagaaaggctcagaggcttgtaaactcagctggagcttattacaagatcagttctgtgtttctcagaggctttgtggtcstgagtgcaaacatctgagataagtgatttcaagctctctccaagtttgaatctaacaaaactggccactgtgaaaatatggccaacaatccaggcactgg

SEQ ID NO: 14184 - DNA, 201 bp, Homo sapiens
aaggttgctctgaagttaatcagttatttctgagtactcgtaatttggtaaaggaaagctaggcatgcgtgattcgctttaccactcaagcaacaactgaygccctgtgtccaactagctaagatgagttatctgaagataaggtttacaaggcacagtacttgactaacagatatctagtaaattcagacctctagtaca

SEQ ID NO: 14185 - DNA, 201 bp, Homo sapiens
atgtaaccatacgtttttcatccaaaatgcttataaatggacacccttatttgtaacctcctcagagaaaactgaggagaacacgaattagactagttccytttttgcattgagcaaaatgctccagaatgactatttcaatttgaatactattcatttgctttaagtggaactatcctttcattttctatccttttattt

SEQ ID NO: 14186 - DNA, 201 bp, Homo sapiens
gtccacctcctttttcttcatttttaaaatgctgctgacacgtagaagaagcctaatcacttctgctccttgttttttcatttaacttcttcctatttttyctgtatttcatgtaaaagaaagttacctctggaggactaattaaattcaggttcaactttttgggcaagaatgctttatgtttgtgtgacggttaatctt

SEQ ID NO: 14187 - DNA, 201 bp, Homo sapiens
gatgagattccggtagactttgagtaaagcagtttaccctccataatatgggaggacctcgtccaatcagttgaaggcattaacagaaaaaagactgacckcccctgaagaagagggaattctgtcagcagacttgggactccagctgcaagatcaattcttccctgggtctctgctaccctatcctacagattttggact

SEQ ID NO: 14188 - DNA, 201 bp, Homo sapiens
cataggagatatttgcaggtaatttaaaaatatgtatattcccattcaaaagatgtgtttccccatgacggtggacatttattgttgccattttacatccrctcctcttttggggactggcatttcacttttttgtggagagaattactcttccatctgttgtccactgaatgtaaaaacctggaactttgttctctatgg

SEQ ID NO: 14189 - DNA, 201 bp, Homo sapiens
tgtgcgttaactaaaattcatttcacagcaattcactgtgtctggatttggggagacaaactccctttgagttaaagagaaagagaaagagaatactttascatacacgccaacatctctttatggatttgtctgaatcatttgataataagctcctatggaagaacaaagtccgtgacaaacagtaagcagtttcacctg

SEQ ID NO: 14190 - DNA, 201 bp, Homo sapiens
tggcttccacaagtgctataaaatggcaggtagacatctcaggtaatcaaggtcaatgaatttgtttgcctgaaattgctttccacactttttcctaactycgttgcttgctcaactatatctgacacccagagactgtaatgcaccttacctaatcccgtgtcatgcctgtgctgaggtttactctgagtaatgcagaaa

SEQ ID NO: 14191 - DNA, 201 bp, Homo sapiens
ggacttacgaagtataagatagttatcactgttttattctctgcctagaatgcagtgtttcctataaaattctaaattgcagtgaagcattctgaaagcamatactgtggcttccacaagtgctataaaatggcaggtagacatctcaggtaatcaaggtcaatgaatttgtttgcctgaaattgctttccacactttttc

SEQ ID NO: 14192 - DNA, 201 bp, Homo sapiens
aaaagcaatacagtaacagaaatcagtcaattgtcaacttaactttgaaacgtgaatcaagttgttctctcttacgtacgtacacaacctcattcctcaaytattaagaaaatctcagggtacaggattccaatgttcctgaatgggtcagttcttcagggaaaacttagttaaggacttacgaagtataagatagttatc

SEQ ID NO: 14193 - DNA, 201 bp, Homo sapiens
aagttttttttggagttgtgttttactgggtgatatagtatgccacatctgtattacttaatgtagagggacagaataaaaattgctgccatttttttctmtagaggaaagtgctctttgtgaatattgacaagcatggagaaatcatacaatgtttcttcactcctagcagtgtgctagatgcagtggatatcaggagtt

SEQ ID NO: 14194 - DNA, 201 bp, Homo sapiens
ataacaaataaagcaaacatttgacagactgtaaaatatttcataatatgtctgatctacaattttcaaaaactgagctgcaaggatggagttacgtggcrcagatgactagggtgctaaaatgagaacccgtaagattcgatttatgcaactttcttaaagtctccttgatgtgtacaagtgactataagagcatttgca

SEQ ID NO: 14195 - DNA, 201 bp, Homo sapiens
acaaaagggtctgggtcacaggaggaggtagaaaaggccttattactttttggctacttgccatagggataaaatataacaaataaagcaaacatttgacrgactgtaaaatatttcataatatgtctgatctacaattttcaaaaactgagctgcaaggatggagttacgtggcacagatgactagggtgctaaaatgag

SEQ ID NO: 14196 - DNA, 201 bp, Homo sapiens
taagagaagtgttctttaggctttccgataactcaatggccaatccaaaatcttcagtggacaacagtggctgaatagagtggaacaattccacagctatyaggaatttcccaagaggcttatagagtaacttgtatttcctgaaatgtctctggctaaacaaaggcaataggaatctgcagaaaagaaatttctttagga

SEQ ID NO: 14197 - DNA, 201 bp, Homo sapiens
gacaagacaagtaatattaatactattctattattctgatttcaagctacttcatctgttaagagaagtgttctttaggctttccgataactcaatggccratccaaaatcttcagtggacaacagtggctgaatagagtggaacaattccacagctattaggaatttcccaagaggcttatagagtaacttgtatttcct

SEQ ID NO: 14198 - DNA, 201 bp, Homo sapiens
ctcccttattagtcacccacatgcagatgaacccaaagtgacagaagaggaggctgaatcactgtgagtgagctggagaggctgcagaaggatggcaaccyatatgaaattctcatctgtgaagtagctaaactcgtccaatttcatcacttcgggagctaacaagttccaaaagtctaattctttctctttgaaataata

SEQ ID NO: 14199 - DNA, 201 bp, Homo sapiens
tgactctcccagtctgtcttggatgtctctctactctcagagtctttgctataatcccctttcataacacttatcctaccatatttggttgttggtgaacmtatttgtcttatttacaaggctacaagctccataagagctataatttatcattttgtattcccagtcaatataagtctagtgcctgatacatactaaata

SEQ ID NO: 14200 - DNA, 201 bp, Homo sapiens
aagcatcagactcaaggctaagtatacacaactgataaaaagaagtcttagaagtttaaattcatttcacttggcccttgctcttttatgagcatatttayactttacagttttcccaaagtacatattgaatgacagctgaaaaatcttctcagtagcgaagtgattttgctttatctgaatagttgatatacaacaagt

SEQ ID NO: 14201 - DNA, 201 bp, Homo sapiens
gaaaggagcagagcaacagaagtagacaggaagggtaggtgtcctctgtgtgtaggcagacgaaaaactagtaggaacaagagataagcgttaagggagartgacctcgggggcccagggagggcaggggtcacgggagtagtattggagctgcacagcctgctgcttctgctgatcttagattctgaaagttggagaaga

SEQ ID NO: 14202 - DNA, 201 bp, Homo sapiens
atcttcattgattcttttatttttctatttaatataactgtaagcacttaagcagtgttctggggagtctggcttccttaaatggctaagctttgcagtaygggtgggaagcagaagcaatgaatcagaaaggagcagagcaacagaagtagacaggaagggtaggtgtcctctgtgtgtaggcagacgaaaaactagtag

SEQ ID NO: 14203 - DNA, 201 bp, Homo sapiens
tcatctaaaattatgtttaagtgatactgagctgcccttccatagataaagtaaatttaaagcgaatatttaaaaataggtacacaagttctttcaaggawccgagaagggtaacagaatgaatgtgttgacctttaagcctaatccggtatgagataaagttggagatgacagcaagaccatgtctaattactgatgggt

SEQ ID NO: 14204 - DNA, 201 bp, Homo sapiens
ctgtctgggattcacccttatgacataccacacactggaaacatgagggatatcttgatctatttcttgttcttgtttctaaaaatacaatgaaaggaggsccatactggtaaatgataaggtgcaattttccttagttgtacctggtcatctaaaattatgtttaagtgatactgagctgcccttccatagataaagtaa

SEQ ID NO: 14205 - DNA, 201 bp, Homo sapiens
agacacgcttggtttacaggtcatataaaacaaaattaatcagcaatatgtggagtaatttataaacattaactgataaattctaggttataacccatatytcctatagcctgtaaccccatatcttcaaacctatacccaaaggagaatttaagtgttaaagagattctcttttcctacattcctttatttcatttattt

SEQ ID NO: 14206 - DNA, 201 bp, Homo sapiens
gccttgagataccgtgtattctatattgtatagttgaggattgagaccagttggaagaataaattatagctgtgcttatcaggaaaaagaagcacaaataygaccatggaggttgccagggcacacaagtggaagaaactcgcgtcactggttgcatcaccataatctgataattttgcctttagttccttcagtgcacta

SEQ ID NO: 14207 - DNA, 201 bp, Homo sapiens
gccatggattcacaataatgttccctacaaattataaaaaaaatttattttttgaaatctaatgtttcttttgctacaataaatttttggctaacacagtyactctccttctaacttcctgtacagcattttttctccttgccctatcagtttagagacaaaaaaagtcaggaaagcaaagagaaaattttatcaaacatt

SEQ ID NO: 14208 - DNA, 201 bp, Homo sapiens
ctgacacgctcaccgagggctttcatttctgtttcttcagtctcaggagtgtcactgtggctagcacttggattgatcaggtgtgtggggtactgcagccsctgctcgcctgcatacttctcccacctcaggtcatcactttcatgggtgatgtagcgctccccgattttgcattccagctctcgcaaatctaaccaggtc

SEQ ID NO: 14209 - DNA, 201 bp, Homo sapiens
gacagaaaataatggcagttctgcaaggcaaatgttaaacctgaccgtatgtatttattagttccacagtgttttgacagattataggagatggaactcakaggatgctgacacgctcaccgagggctttcatttctgtttcttcagtctcaggagtgtcactgtggctagcacttggattgatcaggtgtgtggggtact

SEQ ID NO: 14210 - DNA, 201 bp, Homo sapiens
ttaaatatactgaggcacaccaggcaggcaaaggattcaaaactatacattaaaacttgttcatgcatttgtgtcttaggattttattccctaccctcctyattcatttttttcccacatgggttttggagttgttcatagaacactggaaataatcgactcttcaagagtttgtttacaatgacaacaccaatgggacac

SEQ ID NO: 14211 - DNA, 201 bp, Homo sapiens
ttactcactatgcttacttttcattgtttatctctatccactagaatgtagcttcaagagagcagggattttgtctgttttgtttacagatacatctatgygcctagaataccatctactttacaataggagcgcaatatatatttgtagaacaaatgagtgaataaataaattaaggactaagtattatccaagtgaatc

SEQ ID NO: 14212 - DNA, 201 bp, Homo sapiens
ggtttctcagtttctgaaacaagccagaacaatactgaatcacccctggactgtgtgctatgtgatcagaagaagcacagaagcaagctttattgagcttsaaacttgattttctcacaagatctttactaaaagcaatttaaactaagatgtcctatttaatttctagacatatgatgtcaaaacatgtacgtttaaata

SEQ ID NO: 14213 - DNA, 201 bp, Homo sapiens
tagatcttgaactccactttctatttaaagcatacacacacatgcatgcatgcgtgttctctctctctctctccccccccaccaacctttcactctctctrggattggcagaagatggtgcagcaagaagcataggaattgtctccccatctagacaacaattacactggcagaataggtcttacataattattttggaac

SEQ ID NO: 14214 - DNA, 201 bp, Homo sapiens
gcaattaaaaaaataataacccccattgtactgtccataccactaaagtaaaggacataccattatctttgaagctgacttgtgatcccctccccaactaygtggattaaacagagaagtgtcagtgtctagtgagtattgtttaggaggatataatgggaggtgcagaaagaatagacacactttagagactagtaagaa

SEQ ID NO: 14215 - DNA, 201 bp, Homo sapiens
gattacaggtatgtgccaccatgcctgactaattagagatggggtttcaccattttggccaggcagaatgtttacagcatttggtctttgagacatagatraacatttagttatatgtcatgtcctatattttgtaccagtaatttaagtctattgttcttttctgaactaaatagctatctccttcagacattgttatca

SEQ ID NO: 14216 - DNA, 201 bp, Homo sapiens
atcaactggaagaaagggtatcagtgattgaagatcaaattaatgaaatgaagcaagaagagaagtttagagaaaaaggagtaaaagaaatgaataaagcstccaagaaatatggaactatgtgaaaagaccaaatctagatctgattgctgtacctgaaagtgatggggagaatggaaccaagttggaaaacactctgta

SEQ ID NO: 14217 - DNA, 201 bp, Homo sapiens
tgttccaagacacaaatcatatccctttgaattccagatgaaaacattttaggcctatttaggatttatttcaatagatatgtatacacatgtaaagcagkttcaatgttatttaaaaatacacttcattggtcttattgtggtgacattagcttggcacttaagaaaatgcttccaggtggcaggcacctgctctggctt

SEQ ID NO: 14218 - DNA, 201 bp, Homo sapiens
ttagtagagatgaggtttcaccaccttggccaggatggtctcgatctcttgaccttgtgacctgcccgcctcagcctcccaaagtgtttataagtgtttaygggattacaagtgtgagccaccacgcccacagtctaattattacttagatttcatcattccagctaaaaaaaagattcataatttattcaataacatagt

SEQ ID NO: 14219 - DNA, 201 bp, Homo sapiens
atagccaaaacacaacctaagtgttgtgtcccaggagtaggtggatgataaggacacatcgtgtgatcaagtgttctaacaagaatgcctaaaaaattgastgataatgtctcttagctcccttggtggagtggttctagcattcagctgtaagggacagtccaaagttgttctgaaagcggtagatcctgaggtctactg

SEQ ID NO: 14220 - DNA, 201 bp, Homo sapiens
tgtgaaatttccaaatactcagagatttttccagataactttatgttcttaattcctcatttaattctgctaaggtccaaatcctactttgcataaatttracacttttacatttcctaagacgttttatggcccaggaggtcaaacttggtgaatattctatgtgcatctgaaaataatgtgtattctgctgttgttggg

SEQ ID NO: 14221 - DNA, 201 bp, Homo sapiens
aatccacaaagggatcgttatttaaaaaaatgtaaagaggatagtgacatggtttcaactgcattttagtcctcttagttagaattgaattttaagacctrgactgtttatcaactgtaactttccaaataggctcaccaatattttgtcaacatagtggtttttgaaagatatttttttcctatccagttatgttaaact

SEQ ID NO: 14222 - DNA, 201 bp, Homo sapiens
ttgttaggctctccaattataaacagtgtgtcaaatgatctttcaaaaatggtacttgaaaaacaaacaatttggctgacatcaacagaatatattcataygcaggaaattcactcactatactgatgaaactattctatcagataccctgttaaatacattctttactgcttaccagtctaggccagtgatttggagata

SEQ ID NO: 14223 - DNA, 201 bp, Homo sapiens
tgatttattaaaaattaccacggctctaaaagcacatctgttagtttcttcaatatgtagtgtgtccagctctgaacatttacccatctcatagctgctaytgagtgcacttttgtgatacttccatttcccataggtgccagctcccagcagagactgccatgtgtaatttatcaagcataaagacactaagacaaggga

SEQ ID NO: 14224 - DNA, 201 bp, Homo sapiens
gtagtgtgtccagctctgaacatttacccatctcatagctgctattgagtgcacttttgtgatacttccatttcccataggtgccagctcccagcagagaytgccatgtgtaatttatcaagcataaagacactaagacaagggaaaggggaagccagttgtaaaggaacagccagtctagtaaagctggggaagtcacag

SEQ ID NO: 14225 - DNA, 201 bp, Homo sapiens
ctataaacccttatctttttcctttgttcttccccctagaaaataactacaagttgtatccatcctgtgattcttcaaagtccccacaggatgagttcaaygctgtctagggacaagacaagtaatattaatactattctattattctgatttcaagctacttcatctgttaagagaagtgttctttaggctttccgataa

SEQ ID NO: 14226 - DNA, 201 bp, Homo sapiens
gcccagactcatagcaaatgctttatatatgttcgttgttgttattataagtagccatgaccttgagaagttcttctaggccactctgttctagttaaaamacgtcagataaggaacgacacagacacatacatcatgcacactcagtggtctgcaatttctgcttgccttctataacttcaatacagctccacatgattt

SEQ ID NO: 14227 - DNA, 201 bp, Homo sapiens
ggattacaggtgtgagccacctgcacccagcccattttttaaaacattaccaaccaaagcaacactggaaacagactaatgatttatcaatggagggttcrggctccttgtatctggagacattttaagaaaatggtatctaactatctataggtttgaacagattatctctcttcctattccaattccacaattaaaaca

SEQ ID NO: 14228 - DNA, 201 bp, Homo sapiens
atggtatctaactatctataggtttgaacagattatctctcttcctattccaattccacaattaaaacatttcaatgacctgtatttactgggacggtccrttcccctttgactcttaaaataaaagcagtatttatttttagaaatcaggatttcctttcctacagaggttacagctcagacacacttgagcactgaaat

SEQ ID NO: 14229 - DNA, 201 bp, Homo sapiens
catttaacaaaaggataataaattattttttccctgacagaatgctgctcaactctataggaaaagaatgacataaccagtggaagtaggttgtaacttcyctataaaactgcagggaaagataaagtaatggctggaggtgaagtcagtaggtggatttccacatacaagcactttttatttgcattcctcctcttgagt

SEQ ID NO: 14230 - DNA, 201 bp, Homo sapiens
tatcttttgtttgtatgagtatgcatttattttgatttacataaataccagtatgcaacataccactttgttcctttttagcttttggaatgtatccaaaytgccataggtacataagtccatagcctctacctgctatatcatatgccttgatgtctagtatattctacttacccactttttcaatgatgtacacctaga

SEQ ID NO: 14231 - DNA, 201 bp, Homo sapiens
acctagatctctactaacttgctgcccaaacaatgtggcaacggatagcctgatgcatgcctccttacgtacctgtgtgagaatttttttgagaacatacrtatgcaaaagggctgagttacagtattcatttatcttaattaaatagtgctagactgttctgtaggatgatggcaacagtttacacttttaccagcagtg

SEQ ID NO: 14232 - DNA, 201 bp, Homo sapiens
tacaattttagctttcatatttaagtttttcatctactagaaatacagctttgtatactgtattaactaggcatcagttttactttttccatatagtaaamcaatttttccaattatctattaatcaatctgttctctattgattatggtttaactctttatcatatataaatttttcctgtttacatcagtttatttcta

SEQ ID NO: 14233 - DNA, 201 bp, Homo sapiens
ctttcccttcttgagactgattcagctatttgtggaattctttcataaaatttttgaagtttagtattttttatccaactgatattgagatcaaggttcayttagggagattgatatttttatgatactaacttatatcatcccaaaagcatgggtagtttcttcttatatacattatctattatatttttattagggttt

SEQ ID NO: 14234 - DNA, 201 bp, Homo sapiens
ttatatactaaatgtcatcctgtcattgaatctaaagagctatagggaaagtttatcttcctctgtattcttacctcaattttgcaagaatgtgttttaartaattcatgttcccattatatgctcacctaattttcacataataaacactatttaacatttatgaaagctctaattaaacattgtcttttcttcaatatg

SEQ ID NO: 14235 - DNA, 201 bp, Homo sapiens
tccctgctttgctaattcagaattcttaagcaaagaaatttgcacatactaagtgttggacaaataaagaattaaaggattggcatcaacctaaaagtatyaaaatagtatgcaagaatcaaagttgtagacttgctaatttcttggcaaatttcaatatgacaaaagtcattaaaaggtgaaaacctcaattaaacaagt

SEQ ID NO: 14236 - DNA, 201 bp, Homo sapiens
acaagacaatcctgtggagggaatagtagaatattttcaacaataaaaaggtaaagaaagggaagggagaaaaggaatagcagttaacatgtaattgccakagtcttcaaatgttatcagagcttgaattgagacaacatcaacaaggaaagaggcacagatgaggtggaatgagttgtactcagcaaacccactgattgt

SEQ ID NO: 14237 - DNA, 201 bp, Homo sapiens
atagaagttagggtaaatataatgaatttttacatgttcacaatagattttagggtaacactgaggataattaaatacatgactgtgttcttgtattctcyaaggtagattgtgtagattgagaagacagctaagatagacatcttaagactgtcagaaagatatcaatctaaaggaaggagaatgaacagcagccagaat

SEQ ID NO: 14238 - DNA, 201 bp, Homo sapiens
gtcagaaagatatcaatctaaaggaaggagaatgaacagcagccagaattccgtggtaactcagagtacacagctcttggtatgtgggttaggtactcagwgaccatggttccactaacattcaattcactaaggtctattagtgaggcactggatgctttgctagatcctgactatgatattagcctgttttctgttcta

SEQ ID NO: 14239 - DNA, 201 bp, Homo sapiens
tgagatatcacgttaattcaaacttgagctcattcagctcaaatatcacctggggaagttgttgcccagagctgatacaggaagatacttgttttacagcyataactttagaaattaaatttaaattactgatataattttaagattccatgtattgcaaatgccttttcacttaataaacatacctatgtgtatttaaac

SEQ ID NO: 14240 - DNA, 201 bp, Homo sapiens
taaataaagatataatgaaaaattaaccaaagtacatgaggaaaatgtgacaaccttctctcccccttggttttcaagcttccttggagcattctacaatyttactctttttcaggtttggataatgtccattatatctggagaactgtgtcatgaaatacacactttttccccaacaaaaatcagtagagcatacagagt

SEQ ID NO: 14241 - DNA, 201 bp, Homo sapiens
aaatcccaaattccacttacctggcttctctccagattacctataacaacaaaccttctgctagtcctgtatgttactgactatccattaacttccatacwtctgggatacaataataattgacaattcaggtttataagatattttttaacctagaaagattgtcttgcactcagtattctttgaatataatttttaaaa

SEQ ID NO: 14242 - DNA, 201 bp, Homo sapiens
taggagaatactggaaataaaactgcacatggtgatgaaatacagaaagtagaggagtcatgcaaaaaaaaccagacacaccacacaaatcagaaattcarctcctcaataatgcagaatttattattactacatcactaagttacttatagctgacctagtttcaaagtcctgagcattaattcatatatattcaccctt

SEQ ID NO: 14243 - DNA, 201 bp, Homo sapiens
aagcctatttcttcataaagttaaattccattcagctctatgaatttgaaacccttagaatgccaaatgcatttcaataacatatctattgactttcttcygaaatggctagtaatggacctttcctaggatacaattcaaacttttctaaatgaatcagtaagacaaaatggacagattagtaaattttcattttattaa

SEQ ID NO: 14244 - DNA, 201 bp, Homo sapiens
cttattgtaagatatttgagttgtttgctatttgtttccttttataaacaactatacaatgggtattaccgcacaaataatcagatattcctgcacatatrataacacatgccaaacacagacaatcctagacactgcactgcaatgatctgttttgtagaactgtgatccagtggaaaagcaagtgttttggagcaaaca

SEQ ID NO: 14245 - DNA, 201 bp, Homo sapiens
tctaaatttatactttaatcaacttacatttgcatctatatcaacagtaatcaatagtacaacagcaacagcaatagtagaaaatgtcatactttgtcagycaataatattaccttctttttatcactatgctgggcccttttcaaaaatactcactcaagccgtatttattttgatccttacaacaaactctgatgttag

SEQ ID NO: 14246 - DNA, 201 bp, Homo sapiens
ggtccatatagtaaaatgaaagcagcaaattaacagttgttaattgtgtagctgatgttataatttcctttagaaggtatttttgaggatgcatcattcaytattttttggttttttattcgcccacagaggcgggaataaacatttctttcctacatggctgctccaagattgagatattattctgaaagtgctcagtat

SEQ ID NO: 14247 - DNA, 201 bp, Homo sapiens
acactctgtatatttaatgatctgtttttctagatgagaccagaaaaagtaagaaacagaacaacgtgaatttctctgctgccaaataacttcaagtggtrctatcacaactggtttttaatggcacaaaaatatttggttgacagtattaaaagaattcctgtgggaaatatctcatattcttatagattaaaaaatgtt

SEQ ID NO: 14248 - DNA, 201 bp, Homo sapiens
taggcagctttgaatccactttttggtgtgcatcaacctgtatggacctgaagatacagactgtcacatgagaccagaggaacaaagactgcttccttcartcagaatccttcccagtgtcaggcaaagaaaagtgacttctacagtcttttggtaattgagaaccatatctctatggagctaatgttacaagtatttgcc

SEQ ID NO: 14249 - DNA, 201 bp, Homo sapiens
tggtaccctgtacctccttctataaaaacagcaaaaggactatatccaaatacctagatttcttggggtaagatatattggaacatagtgcggtctttcartggtttcaggcaataaacagatgccgtttaaatagcagagatggaacaagggccaaagcagtaggggaaatgagaatcctttattctcttgggttccctg

SEQ ID NO: 14250 - DNA, 201 bp, Homo sapiens
aaaatttgtgttactactctagctctatgcctgtgaaagcattttaaaaatttaatgtgacagcatggctaaatacattagaaagataatcaagaggctgkcaatatcctggataagagcatctgccttggagccagcggacaggatttgtaccctggccccacctagacaagctacttaaccatctatgcctgcattacc

SEQ ID NO: 14251 - DNA, 201 bp, Homo sapiens
tgagggtttttgcagagcaaacacacataatcctttttaactaactaaccagccttttgctacctggttggatactatggatgtcaccttataagatggtktttctgtacaactttaattaattaattcaacaaaaatttatttagcagctaatatatgccaggaacaatttctggcagtggggatacattagtaaacaaa

SEQ ID NO: 14252 - DNA, 201 bp, Homo sapiens
gtggtaggtacaaaaatgtagcagtgttaattgaatctgaaaataataaatgaaaatgaatcagaaaatagaaatggaaaatggatctaattactcaaacyttttggtaacatacaaactaacttgaaattccagtcttccaacacttgtaaagctagtgttcactcaccttatatcccactctcactattccttctcttt

SEQ ID NO: 14253 - DNA, 201 bp, Homo sapiens
ggacaggctatgttccaataaaactttactacaaattgggcagcagtccaatttgctctggtggccacattgtgctgactcctgatataaaaagtggggaycatccagtaaccaaaagcataattaaataacagatataaaattgcacatacttctgaaataatatcaagaacagtgaagtgtacacagactatgatattt

SEQ ID NO: 14254 - DNA, 201 bp, Homo sapiens
ggagacaccaagcagctgggaaagtatgacataaacacagtcctaggccacaaaggtgagagcctctcccttcaaaaatggcccataaggataactttatrgtgttgcaggaaataaggggccggagagaccaaataggggtgcaggagagttaatttaaggtgtacactggcttagcagacgtgtcctgaaagactgagc

SEQ ID NO: 14255 - DNA, 201 bp, Homo sapiens
agtggaaggctctgttttgtgtcttgtcaggagtgctgtggaggtcacggtaccttgcctgagagttgcacgggattttcagagctgttactaaaaatccrattgtttttaagacctatatattagtaagtgtgaggcaattggtatatgatgccaccccctcccagcagggttcatgaagaactctccagtagtattcac

SEQ ID NO: 14256 - DNA, 201 bp, Homo sapiens
aggggagatgttctatgaacgtatgcagcctagagctcattttagtacaatccgtgtcttcattacatgtgagtcagtaaacctgtatgaaaataatagcrgtttatggccaattgttatttagaaaatatgcaacctcacataaaaagttaaactgaatattgtccggattgcataaaattaaaggatataaaatggtca

SEQ ID NO: 14257 - DNA, 201 bp, Homo sapiens
tgtgagtcagtaaacctgtatgaaaataatagcagtttatggccaattgttatttagaaaatatgcaacctcacataaaaagttaaactgaatattgtccrgattgcataaaattaaaggatataaaatggtcaaatgcagagaaagcttttagaatgagcgatttatttcctaatgatttctgtaaggtggcctgaatgt

SEQ ID NO: 14258 - DNA, 201 bp, Homo sapiens
gaagcagatgtcttcatcctgtagcttatgaatcagaaatcttgactcatccatcttaattaacccagaacatgttctggttgtgttttcattagcttccyttgttagagttaccgtaacaagaccatcttagaatggatactaataataatatttgaaatttatagtcccatgagggaaaataacagtatgtcaactctc

SEQ ID NO: 14259 - DNA, 201 bp, Homo sapiens
gaaaaagaaactttatagtcaaaataggcaatcatttatggaaaatataactttctcatatttgagagaaaatatacttaccatggcagacttgcaaaatraatggtctagtggccttaatgagcaatgctgtctttacaagggtcaggccatcattctttttggaaatggaaattattctttaatgtatatagaacccaa

SEQ ID NO: 14260 - DNA, 201 bp, Homo sapiens
ataatttcaacctaacatagtttatgttatgtgttattaatatatctagaacctcctaggtaatatagtatatgttgaaaataaaaaaaggactaaggaayggtatctgtagttgagagatcaaagtcaaaatgaggatgacaggcccatgtatatttataataccaaatgcagggatggaacagaagacaaagggtggct

SEQ ID NO: 14261 - DNA, 201 bp, Homo sapiens
tattttgtaccagtaatttaagtctattgttcttttctgaactaaatagctatctccttcagacattgttatcaccttttatatttcttctgtatcctaartagcaaattgttgtcagtgagtgaaacagcatgcccagtgaggaaatatttgttttgaatcaactcatgtcttcagattctaaatgaaatcaaaattgca

SEQ ID NO: 14262 - DNA, 201 bp, Homo sapiens
ttttcacttccgggtttgtcttattccccagttgacctggacagaatttcttccctctgccttgatatttaggggtgcttgaggaaaaatagatggagaarcaatgcactattgtgtcattgcttctccatctcctccctggagaatccattttatcaggagataaataaccaagaaaactatcaaagtgaggaagaagtg

SEQ ID NO: 14263 - DNA, 201 bp, Homo sapiens
aaaagatgtgagaataagggttcccaggtcagaccaactttgttcaagacaggaaacttaaagaaatgaacagaagagaatccatgtaccccctaaatgcstggaagatacttcggggagatactgctacactattgtagagggcacaacataagcagatagctccatcatgcattattttttattttttactatttcatt

SEQ ID NO: 14264 - DNA, 201 bp, Homo sapiens
aacttgtaagtacatagtacactttaccttcacaaccataatactgtagatctagagaaattagttattattttaaaccaactttgactaaaaatttgctycttctcatcgaaagattcctttccccagtttccactgaccagcctcgttgaaatctggtcacctccaggctttgcttttgaacaaattactcttttcttt

SEQ ID NO: 14265 - DNA, 201 bp, Homo sapiens
taatctcatttatcatcaagatactaatagtgagaaaaataaacctattttaggataaagaaggtcaagcttagaaaaggcacagagctattgtgtggagsgcctgggataactgtgtgaaccaagtatttggcagtaaacaaacctggctccagattttctttaagggcaagtgagggaaacttggaagaaaataaataa

SEQ ID NO: 14266 - DNA, 201 bp, Homo sapiens
cctctcacatactaacttgtggagaaggtagatgatcaaggctgaggcatcttttcaggtacacactggcttcagtgtgccaaaatgcagtaactttagamatagtaccttcagaagtggacccatcagactgagatgttatacactgtcctgttggtactttaaaactgattattagaatgaataagaataaatatgaat

SEQ ID NO: 14267 - DNA, 201 bp, Homo sapiens
atctagagtttataatttattccatatatgtagtttccaccttctacctttaggattattctactcaaacatatgagaggtaggaaagaggagaattagaytcaacctatctttgcaataggtctttaggagcagtgcagtcttaatatggggacctctgactaattttctgtcaaagaacaaactgatttagttcataat

SEQ ID NO: 14268 - DNA, 201 bp, Homo sapiens
aatgacatgacttcaacaagaccaaatagaacaatccaccctcttgtgaacaggtgtcactggttgactgttacatcaacgaggtcatgatcaaatataaytcactggactccgaggattcagaaattctcagatcactcctattaagaactgtttgctcataccatccactggaactagagtataattatacttttgttg

SEQ ID NO: 14269 - DNA, 201 bp, Homo sapiens
aagaacttttactaattctcccaacctgttataattaaagcaataaatctctggatggcatctttgaaagtgagcgcttcatcaaataaataatttctatmcccaattcctacccatcactcactcactgtatattcttgagcaagggaatcctcaattcttcatctataaaacaaatgttctgggaggaataacaaacgt

SEQ ID NO: 14270 - DNA, 201 bp, Homo sapiens
attcaatcttcttggcatttaacatttcaaaactgaaaagaatacttcatttgaaaaaaaaaaaaaagaaaagttcacctatgctccagtacaactatttygtttggtttcaatatcaatggaaagtcactaatagttattttatttctccttgcagtatcagaaagagtctagttatttacaaaatattggcatattcaa

SEQ ID NO: 14271 - DNA, 201 bp, Homo sapiens
tcaataatactggaagaaacctctacaaattgtcaaaaatgtgaataattctatccagtctctaggttctagtcctgtttgtccatcttttaaaaaatctktgcccatttctgataaacataaaaatcttctctttataaatgatttaaaatttcaaaatatctcacccacatccattctgagtaaaacattgcatttact

SEQ ID NO: 14272 - DNA, 201 bp, Homo sapiens
tagcgcacacacatgcacgcacacacactcacacacactcacactttttagtatactgaaggatattttgtaaagtgctcttttcttcctgattctattgktctttctgttcctcaacagttgtatgtgtctatcacctaactatttccttattctttgctcacctctctcctttcttaggaccttcctttttgatttttt

SEQ ID NO: 14273 - DNA, 201 bp, Homo sapiens
gctgtaagtgaaatcttagaatcaacaagagaaagtgttgttttcagagtaagctggagtaagctgggatcacaagaggaagcctgggtcattcatctctycatgccgtgatgtcactacttggttggccattaaccactagactgcagaccccgattcaaatataatcacaaaaatttactccaaaatcaagaataaatt

SEQ ID NO: 14274 - DNA, 201 bp, Homo sapiens
accaggaaggcggagcttgcagtgagccaagatcgcgccactggactccagcccgggcgacacagcgagactccgtctcaaaaaaaaaaaaaaaaaaaaaagtatgtgatttcattcaacaaatgcttactaattggcttctatgtgcagggcactattctaggcactaggaatacaataatgaacaaaataaagtccctg

SEQ ID NO: 14275 - DNA, 201 bp, Homo sapiens
ttcttccttccttctttcctccctctctccaaccctccccccttccttcctttcctccctctctctttctcattcaagccatccttctacctcaccctccytagtagccgcagctacaggcacacgtcaccatgcttggctaatttttttaaggttttcgtagacataaagtctcattatattgcccaagcttgtctcaaa

SEQ ID NO: 14276 - DNA, 201 bp, Homo sapiens
aagtttcttggctccctctaggaagatttccctagacgagcttagttagtcctacttgttctcccctaacccccagtacctcccatttcaaatcactcactttttttttttttttgagacagagtcttgctctgtcacccaggctggagtgcagtgatgtgatctcagctcactgcaacctccacctcccgggttcaagtg

SEQ ID NO: 14277 - DNA, 201 bp, Homo sapiens
gaattgatattcagaaccagttaatctctatgtgtggctggaattaaggcatataaaaaccacatatgtggtagtcatctgctgctatgagggctgaggaytagagaaagctgggcttcagatcaagaagaaaggaaaagaaagaagtgcagggaatatactgatgcctaagttacttactgcttctgagccctccagtag

SEQ ID NO: 14278 - DNA, 201 bp, Homo sapiens
agagtcacaaaatcctccctccctctctcccttctatttttttttggcggggggtggggagagcgagggaagaaatgaaaactagggaaaaaattattttwaaaaaaggggcacttaattaagactctaatttttaaaaaagtaccaacagttttcatctattcccctatgctactgatagcaacaaatatgaataccggc

SEQ ID NO: 14279 - DNA, 201 bp, Homo sapiens
agtcatcttttttcggagagtcacaaaatcctccctccctctctcccttctatttttttttggcggggggtggggagagcgagggaagaaatgaaaactasggaaaaaattattttaaaaaaaggggcacttaattaagactctaatttttaaaaaagtaccaacagttttcatctattcccctatgctactgatagcaac

SEQ ID NO: 14280 - DNA, 201 bp, Homo sapiens
aaattcaacataactaatctataattataggtgtatagataaatatcacttatgtttcttttacttagctgagcctaagaaacagtaaaaaaacttttaayatagcttacaaataataaagcaaccaattaaatgggtgataaagctaaattgtcacaaattaaattccctatgctgatatgcaatcttataatatcctac

SEQ ID NO: 14281 - DNA, 201 bp, Homo sapiens
tgggcgacagagtaaggctgtctcgaaaacaacaacaaaaaaaatgtttattccaggccatcttccttttctcacacactctagggattaaacatgtttawttgtgagacagctgacaaatggttaggagactaatctctgataacaaataaagaaattggcccctaagtcattctgttgccagggaattagccctttaac

SEQ ID NO: 14282 - DNA, 201 bp, Homo sapiens
accaacatggagaaaccttgtctctactaaaaatacaaaattagctgggcatggtgacgcatgcctgtaatcccagttacgcctataatcccagttactcrggaggctgaggcagaattgcttgaacccgggaggcagaggttgcagtgagtggagatggcgccattgcactccagcctgggcaacaagagcaaaactcca

SEQ ID NO: 14283 - DNA, 201 bp, Homo sapiens
gatctatgtaaagatagtatttaaaaaccaaacaaaactaagaaatgggaaaaagaaatggcaggtgaagaactcttttcagagaataaaagttgtcatayagcaatggatgctgtgtcagaacatactgccaataaactttaagaaaaaaggaactcaatgaagttactgttatataaaacaggagctcacagcagggat

SEQ ID NO: 14284 - DNA, 201 bp, Homo sapiens
gatgtaccaaattgaaataagtctgggtgtggtagctcatgcttgtaatcccagctctttgggaggcagaagcaggcagatcatttgaggtcaggagttcragaccagccttgccaacatggtgaaaccctgtctctactaaaaacacaaaaatcagctgggtgtggtggtgcatgcctgtaatcccagctagttgggaga

SEQ ID NO: 14285 - DNA, 201 bp, Homo sapiens
cttgggaacaaaattcctctagttgagaactactacactggtttgttttgtatatgtgtgtgtgtgtgtgtgtgtgtatatatatatatatatatatatawtttttttttttttttaaggatcatgtctctaacagtcatagaccttttaaattagtctgaacatgatttatttcctattcctaatatgaagaggtgagta

SEQ ID NO: 14286 - DNA, 201 bp, Homo sapiens
gggattacaggcatgcaccaccatttccagctaattttttgtattttaatagagatggggtttcaccatgttggccaagatggtctcaatctcctgacctygtgatctgcccacctcagcctccaaaagtgctgggattacaggcgtgagccactgcacccggcctcctcattgtttttaaaagcccactgttctccaaac

SEQ ID NO: 14287 - DNA, 201 bp, Homo sapiens
tgattatacaagctaattttatgtataatcgatttaattaaggtatatttgaatttaacaggattagaagagactgaattaaaacgattgcataggctgtrtgcagtggctcatgcctgtaatcccagcactttgggaggctgaggcgggtggattacttgaggtcaggagtttgagaccagcctggccaacagggtgaaa

SEQ ID NO: 14288 - DNA, 201 bp, Homo sapiens
ttttttttttcatcattttttattgtaagaaaatacacagtttgaaagtgtgaataatgcaatatttatgaccaagaaatgggacttaggaaggggaaggragataaagaaaaagatcaagatgatctgattgagagacagtgttgaactccaaatactgaactggaaaaggagggaggtggggaggaacaggaggaggaa

SEQ ID NO: 14289 - DNA, 201 bp, Homo sapiens
attacaaaaattcattttggtgtaattaatgttgaaataataacggttggtatttattaatcgatactatgcgccaggcagcactaaaaccttatatataktatctcctttaatccctacaatagcttcataatataatgactttactgtcttaattttatagaaccaactaagactttgatgggctaaactacttccaca

SEQ ID NO: 14290 - DNA, 201 bp, Homo sapiens
agtgcagtggcacaatcttggctcactgcaagctctgcctcccgagttcacgccattctcctgcctcagcctcccgagtagctaagtagctaagtacaggygtccaccaccatgtccggctaagtttttctatttttcagtagagacggggtttctccgtgttagccaggatagtctcgaactcttgacctcgtgatccgc

SEQ ID NO: 14291 - DNA, 201 bp, Homo sapiens
tttcttacatttataggataatcactgattagaacttaatgcttccactcacttacacatcctaatgtataggcagagacttgaaatttgaaaaacatttycatgttgattattctatagatgtgaactttttagtgcaaatgttaattttgctatagatgtgaatttttatactggctaaaagtcaaaacatgctagata

SEQ ID NO: 14292 - DNA, 201 bp, Homo sapiens
ttttgttaaaaacaaaaatctctaacactgttctggcttttaaactttaacactaaactgtgcttatatggcaatcataaataaaagctgatgtaaattcrgtattacaataaaggttaaagggactatatctgaaaagtagatatttgaggcatcaatatatatagtgcagcttaaggagcctgagaaagatttaggaaa

SEQ ID NO: 14293 - DNA, 201 bp, Homo sapiens
accaagtgacacaccaaagtattaacaaatgttaaatactgataacaaaagttaaatggaacagaaatgaaattagtaattttacagatcaaatagataawagaaaaaaaagaaaaagaaaaaaatgtaatagtaaaagataatagaggtccttcgacttacccaagcagtgtgttctttcaagtaacagcctttgtactc

SEQ ID NO: 14294 - DNA, 201 bp, Homo sapiens
aaacctgcaatgattccgtattgaccacctaccaataaacctcaactacacacataccttttctttcttgcctgtgaccctttctctctgtctttaattgkaactgcaactctaaggcatttgaggtacatgttatatagaaggtgatattttaaaaataactctgtacagtaaaaagaagaccctgaaagatcaaaacaa

SEQ ID NO: 14295 - DNA, 201 bp, Homo sapiens
ccatgcctggcttatttgcataattattttcttccttccttctttcctccctctctccaaccctccccccttccttcctttcctccctctctctttctcaytcaagccatccttctacctcaccctccctagtagccgcagctacaggcacacgtcaccatgcttggctaatttttttaaggttttcgtagacataaagtc

SEQ ID NO: 14296 - DNA, 201 bp, Homo sapiens
ccaaatagttataaaaatgtcatacttttcagcaaggaacactgtatctgaatagataatgtatgctctgtctcaacacatttaagtgtacatatagtttwaaaaaaaaaaagacaactggagaaataatgacatcatagagggccccttatctctgctgagaagtgatatcagctgagatgatcaatacaagaccatcat

SEQ ID NO: 14297 - DNA, 201 bp, Homo sapiens
ttatgcctcaagagttcacgaaacactgtttctgagccctcaagaagtgacattaggctgggcgtggtggctcacatctgtaatcccagcactttggaagrccgaggcaggctgatcacttgaggtcaggagtttgagactagcctggccaacatggtgaaaccccgtctctactaaaaacacaaaaaattagctgggcat

SEQ ID NO: 14298 - DNA, 201 bp, Homo sapiens
tttgtaccatttgactttcatctttccattccccatccctttcaaccacctttcattttgtgttttattctttgtttactttccacatgtaagtgacatcrtatgctatttttttgtgtgtctggtttatctcacttagcataatgtcttctgggttcacatgtattgctgcaaatggcaggcccactttcttaagactat

SEQ ID NO: 14299 - DNA, 201 bp, Homo sapiens
gcactccagcctgggcaacacagtgagactctgtctccaaaaattaaaaaaagaaaagaaaagatatatctgcttgattataacaatcaagggacaaaagmttccttctcccatattcatatattttggtatttattaagcacgttcttattgtgttgggtactcatttaactttcatttaactattatttaactttctca

SEQ ID NO: 14300 - DNA, 201 bp, Homo sapiens
agaggcaaaggacccacccctctattcagcaaaaataataggaaaggccactgaagcaagtgaaaattaaactagaacatcctattccctcaaggacattkcttttttttttttttttttttttatcccgcaaaggtggtgaaagctgttctttttttaaagaggggatgggaaaagaactaacattgactaacaggaagg

SEQ ID NO: 14301 - DNA, 201 bp, Homo sapiens
tctgcttcacatgtaaaaccactgatggtactcggttgctcagagcttgttatcatttccccactcatttcaacatgaacgggtctggataaaggtccaartctcacaagagtcgatggtaagtagtcatagttctctaaagcaccgtatttcttcttttgtcagatatcatggcatgaagacaatgactatttggtaatc

SEQ ID NO: 14302 - DNA, 201 bp, Homo sapiens
gtcattttagtcattttcatttgagctggggtccataaaacacaacagaattcataatatattttttaaaattaaatattttatgatattccagtgtcctsatttatacactactgttggcattaggctttaaaataatatagtgggtagaattgtagtacttggtaatatacattaaaaaatccatacccatagttagat

SEQ ID NO: 14303 - DNA, 201 bp, Homo sapiens
tttcactttcccatgatcttgctcttacttttatgtcattttagtcattttcatttgagctggggtccataaaacacaacagaattcataatatatttttwaaaattaaatattttatgatattccagtgtcctgatttatacactactgttggcattaggctttaaaataatatagtgggtagaattgtagtacttggta

SEQ ID NO: 14304 - DNA, 201 bp, Homo sapiens
tcatgtgaaagtgcctagcagggtgtctgactcctaggaaatgctcaacacatgctggtttccttccttctgatgccaggctctgcgaagcatgtcccttkgccctccacttagtatttctggtgatggagacacagagcacaagtggatccagaagaaggggcacatttaaggaaaaaaaaaaaaactagctgtatccag

SEQ ID NO: 14305 - DNA, 201 bp, Homo sapiens
ctgtaagtactggtaaaaggagaactgaagaaatttgagctttcagatcaaagtgcagttctttgggaagaactcctaagtccactagtggtcttcaaccraatattccagaatcaatcattcatttaccaaatattcatgtgtacagggcacagggatacagttgtgagcaaacaaaaacatggtctgtgctcttatgat

SEQ ID NO: 14306 - DNA, 201 bp, Homo sapiens
agaagcacgatgcagttcttaatggaaagcatctcctaacaggcacccacgtgcacgcgatacacccataggcacacatatgacatgcacacacacatagrcacacacatgaagtgcgcgcgcgcgcacacacacacacacacacacacacacacaggaactacgggaggaccgaggaaggctggctgagtcctgtgatca

SEQ ID NO: 14307 - DNA, 201 bp, Homo sapiens
acccacatcattcctctggctgggaacgttgagggtttcctagcagagcagaagaaagacttaggatgtggggtcagacatgcgtgccttggtgtttcggyctgtagaagggggacaatgcctacctcacaagggtaccagtagcataaagcagataagtgaaaagtgcccagtttaatctctaactaaggaaggctgcat

SEQ ID NO: 14308 - DNA, 201 bp, Homo sapiens
ttttgaggatcctaacaatgataacctttagactactcctgggtcaactgacattaaattatatgaagattcttctagtcactctttaagactttatctaygtaggctcaaaagcaaaaatatcaattattttgatttcttatggagtattattttcttcctcccttaataaaaagaggtttaagataagagacagatggg

SEQ ID NO: 14309 - DNA, 201 bp, Homo sapiens
aaaatatcaattattttgatttcttatggagtattattttcttcctcccttaataaaaagaggtttaagataagagacagatgggaaagtagaggccccaytggatctcttaaatttaacactgaatatcttttatttttaaagacagtctcactctgttgcccaggatggagtacagtgacaccatctcagctcactgca

SEQ ID NO: 14310 - DNA, 201 bp, Homo sapiens
agtgtctggtttaaataggtttatctctctccttagcttgtcctggaattacgcctaaagctcaatcctggcagcttttaggataagaaatctaattggaragagctcttagttttgcgactccaaaacctcttttgaaaatttagtttgaccttccaactatctccaacagatcaaagttaaacagtccagattccaaac

SEQ ID NO: 14311 - DNA, 201 bp, Homo sapiens
tggccaggatggtctccatctcctgaccttgtgatccgcctgcctcggcctcccaaagtgctaggattacaggtgtgagccaccgcgcctggccatgttartggaattttcataaccacatcaagctgcacactctctgaagccatagaagaactgctctgtatcaggtaatgtcaaataaaatccctaaacagtgcttct

SEQ ID NO: 14312 - DNA, 201 bp, Homo sapiens
gtatctgttttcctacttaaactaaattcattttatggactatagtagtcacataaattgttaataaccgaatggccaacatgttttatttttatactttmataagtagctaactctatgtattaaattgatttaaaaagttacaaaacaaaataaatgtgaccaaaccctctgacttttctgtctctaaatttggtatta

SEQ ID NO: 14313 - DNA, 201 bp, Homo sapiens
gtttcccagtataccagtacttctacctggcaagggtgctgcccaaaaatggtcttgggagaatgtagacggtgtagaaaagtctgtaatttggccgggcrcggtggctcacacctgtaatggcagcattttgggaggccgaggcaggtggattacctgaggtcaggagtttgagaccagcctgactaacatggtaaaacc

SEQ ID NO: 14314 - DNA, 201 bp, Homo sapiens
tcttgatcaccacaggtgatctgcctgccttggcctctcagagtgctaggattacaggtgtgagccaccaacagccattctgattggtgtgatatggtatytcattgtggttttgatttgtatttctctaatgattagtgatggtgagcattttttcgtatgcttgttggttgtgtgcatgtcttcttttgaaaagtgtct

SEQ ID NO: 14315 - DNA, 201 bp, Homo sapiens
ttggagtgcagtggcatgatctcggctcactgcaacctctgcctcctgggttcaagcaattcttctgcctcagcctcccgagtagctgggagtacaggcgygcaccaccatgcctggctaatttttgaatttttagtagagacaaggtgtcaccatactggccaggctggtctcaaactcctgatttcgtgatccacccac

SEQ ID NO: 14316 - DNA, 201 bp, Homo sapiens
aaatcaaactcaacaattgctttgacagtacagatgttattattttgttgatacaataacttccaaaacaaatatggcccattctactgtgtttcttattwttcagtatggaatgctcattcaccattagaccacgtttctctacctgtactcctaggaatacttcatttgtataacctggcttgatatcatctggccttc

SEQ ID NO: 14317 - DNA, 201 bp, Homo sapiens
gtttgtgctttacatggttttatattttaaagtagtaaaagttatgatatttatcattatgttttaaaaaacattgattagaaaaggtcttcattatactwgtaaaagtattttagagtaataataataacactaggccgggcctggtggctcacgcctgtaatcccagcactttggaaggctgaggcgggtggatcacaa

SEQ ID NO: 14318 - DNA, 201 bp, Homo sapiens
aaaattgtgtactatcaataaataaaacatgcagtataaaatatctcattgtactctgttttgggacatttgaaaccccagttagaaattaaaaagtcatytgggctctacagctcacacctgaaatcccagcaattttcccggctgaggcaagcagattgcttgagctcaggagttcgagaccagccagggcaacatgga

SEQ ID NO: 14319 - DNA, 201 bp, Homo sapiens
ggctcaagcgatctgcccgccccaacctcccaaagtgctgggattataggcatgagcgaccatgcctggcttatttgcataattattttcttccttccttytttcctccctctctccaaccctccccccttccttcctttcctccctctctctttctcattcaagccatccttctacctcaccctccctagtagccgcagc

SEQ ID NO: 14320 - DNA, 201 bp, Homo sapiens
acaagaagtaaaaacttgtcacctagccaaggtgttcttaaattataaaggcaaacatttttaagctttacaaattgaggcaatacaactcttctgagttyttcttaaaaacgaacaaacagaactgctatacaataaaagccagccattctagagacggaagaaacagaaagggttgaaaaacaaacatgcaaaagaagg

SEQ ID NO: 14321 - DNA, 201 bp, Homo sapiens
gtcttgaacagtaaagggtatcttgcaaaagtaatacttaaggtaaaacttgtaggatgaacggacaggcatggggatgtaatgtgcagagttttctaggkggggtaatagcacatataaggctctgaggcaggaaagagcttagcatacagtggaaatgcacaaagctcaacttcaagctcttaactttttttttttatt

SEQ ID NO: 14322 - DNA, 201 bp, Homo sapiens
tggaacaaaatcctgaatggggcacatcactaagcgcttggctagttaagaagaccagtctggtcaaggcagtgtgtgtgtgtgtgtgtgtgtgtgtgtgwgagagagagagagagagagacagacagacagacacacagacacacacaaacaggctgataggagcctaaaaacaggtttacaggccaggcgcggtggctc

SEQ ID NO: 14323 - DNA, 201 bp, Homo sapiens
cactgtcctgtaaaaatggggcactgaggttagaaaaaaagactgaagataaagagtcaatccattgacaaaagtgtcaagcacactcaattttgcagtgycaagttgcttttctgccaatctgcaaagacaaactttttatgtactggctccactactcctccaccattttcatacatctcatatttgcttcctatgcct

SEQ ID NO: 14324 - DNA, 201 bp, Homo sapiens
acatgccaggtttagtaccacactgcagttgcaaaaaggtaactgaaacatctggaagctaagtgacttgaactggattcgctatgattgacaaagctcayctctgtggagggtaccaagaaacctactttcttatgcacgacggaggagctggaattgattgtgctttcgtcatcgtgcatcatgacaagttcggaactg

SEQ ID NO: 14325 - DNA, 201 bp, Homo sapiens
tataaaatgatgtcaacttttcaccatctctttctgagtgtttatagaatggaatttctaataggctagatatcatttaatcttacagaatatataccaartgacacaccaaagtattaacaaatgttaaatactgataacaaaagttaaatggaacagaaatgaaattagtaattttacagatcaaatagataaaagaaa

SEQ ID NO: 14326 - DNA, 201 bp, Homo sapiens
gtagagcaggctctgctttttgatatcagttagctttatttctcattgacaattttttttggggggtaaatcttcagtacctgtagaaaaataaggtttgycattaaattatttctaacacattttacttggtggcaatacaaatacatacaaatattaaaagcctcttggtctcacaactcaataacaaaaggacaaaaa

SEQ ID NO: 14327 - DNA, 201 bp, Homo sapiens
ggctgggaacgttgagggtttcctagcagagcagaagaaagacttaggatgtggggtcagacatgcgtgccttggtgtttcggcctgtagaagggggacartgcctacctcacaagggtaccagtagcataaagcagataagtgaaaagtgcccagtttaatctctaactaaggaaggctgcatatatggcagttccctca

SEQ ID NO: 14328 - DNA, 201 bp, Homo sapiens
tgatgcttgtgaggcatcagtgtcacttgtaacaacatacagtgaaggaaagaaatgctttctaggtcagatatttaaaatgtaatgtaataaaaatgtcwaatacatacggtgattttcttagagatttaaaatgatagcagagtcttaccattcattagactgtaacgttggggagtcattctgggcaatgtgatataa

SEQ ID NO: 14329 - DNA, 201 bp, Homo sapiens
caggaagactgctaacatcactcagacactttcagtggcattgaagagaggaagtgtgcatggcttatccacaccaccctaaagctcaagccatcattcarttagactgcccaaactacactttagtatggcggtagataacattctgatcaaagtaaaacagaaaggagagtttaattccttctttcttaccttctaata

SEQ ID NO: 14330 - DNA, 201 bp, Homo sapiens
atcagctgcttctggtgctggcgccgcatccgcttataacctgacatctgttcccgcaactcgttctcctgctcatgctcatggatctgtcgtgtaacctraattgggttaggaaacagaactcaggtaaccaggttcatgggagacaagctttcatgcaaagtagaacggccctgtggcataattttatccatcaccttc

SEQ ID NO: 14331 - DNA, 201 bp, Homo sapiens
agtagatgatcagtttcattcctcattttattattttatacagctataccagactgggttacatactttctcacatgacaatttgggaacacattcacctrgatcttctatagaagataataagtgatcagacaacaggaaacccaagtatataaacacaaatgacccttcaaaacaaaaataaaacaaagaaagcctgat

SEQ ID NO: 14332 - DNA, 201 bp, Homo sapiens
ccaaaccagcttgcccaacatctccttttcaggagcttaaatatagactctgtgctttgcaactggagattctgatacaataggtgtggggtgcagaaatwtgtgattctgaaaagttgctcaggtgactctgacacttcaggtagagaaaccactgatctggtccaacactgtccagcagcacaaatcttacctttaagt

SEQ ID NO: 14333 - DNA, 201 bp, Homo sapiens
accagcttgcccaacatctccttttcaggagcttaaatatagactctgtgctttgcaactggagattctgatacaataggtgtggggtgcagaaatttgtrattctgaaaagttgctcaggtgactctgacacttcaggtagagaaaccactgatctggtccaacactgtccagcagcacaaatcttacctttaagttttt

SEQ ID NO: 14334 - DNA, 201 bp, Homo sapiens
gtcgtgtaacctgaattgggttaggaaacagaactcaggtaaccaggttcatgggagacaagctttcatgcaaagtagaacggccctgtggcataattttwtccatcaccttcaccatcaatttacctactgtttagtgaatgctcacccgtagggggcactgtgctagatagatactctttatgtattttatccctagtc

SEQ ID NO: 14335 - DNA, 201 bp, Homo sapiens
cacgtagcatctacagtgtggataggctggataaagggataattcatttccctggctagaaggagtaggtcagcaggagatttcatcacactactcaaaarggtaagcaatttaaaactcatgaatggggccaggcacagtggctcatgcctgtaatcccagcactttgggaggccaaggccagaggatcacttgaggcca

SEQ ID NO: 14336 - DNA, 201 bp, Homo sapiens
cattttagttgctctttttttttttcgagacggggtcttactctgtcgcccaggctggaatgcagtggtgcgatctcggctcactgcaacctccacctccygggttcaagcgattctgcctcagcctcccgagtagctgggactacaggcgcgccaccatgcccagctaatttttgtatttttagtagagacggggtttca

SEQ ID NO: 14337 - DNA, 201 bp, Homo sapiens
taagataaggaatcaacccaagtgtccgtcagtgggtgaatggaaaatgtggcatgtgtacacaatggaatactattcagccttcaaaaagaaggaaatcytgtcatttgcaacaacatggatgaacatagagaacattacactcaatgaaataaggcaggcacagaaagacagaagttgtatgatctcatttatgtgtgg

SEQ ID NO: 14338 - DNA, 201 bp, Homo sapiens
agctaatttttgtattttcagtagagatggggtttcgccatgttggccaggctggtctttaactcctgacctcaggtgatccacctgccttggcctcccaragtgttgggattacaggcgtgagccaccatgcctggtcccatattttaaatactaataaataaagttcaggtaacttctctctttacactcctggtcttg

SEQ ID NO: 14339 - DNA, 201 bp, Homo sapiens
agacggagtcttgctctattgtccaggctggagtgcaatggcacaatcttggctcactaccacctctgcctcctgggttcaagcgattctcctgcctcagmctctcaagtaactgggactataggcatgtgccaccacgcccggctaatttttgtatttttagtagagacggggtttcaccatgttggccaggctgatctt

SEQ ID NO: 14340 - DNA, 201 bp, Homo sapiens
tggtgcgatcttggctcactgcaacctccatctccaagattcaagcgattctcctgactcagtctcctgagtagctgggattacaggcatgcaccaccacrcccagctaatttttttgtatttttcgtagagacagggtttcaccatattaggcaggctggtctcgaactcctgacctcaggtgatccaccctcctgggcc

SEQ ID NO: 14341 - DNA, 201 bp, Homo sapiens
cagtcagtaaacgtctctctccaaatctatctcctaggcaaacactgatccactctctttcactatagattagtttacattttccagaatttcttttcttytcttttttttttctttttttgatagagtctcgctctgtggcccagactggagtgcagtactgcactctcggctcactccaacctctgcctcctgggttca

SEQ ID NO: 14342 - DNA, 201 bp, Homo sapiens
tgattaggctgtccaaagaaggcaatcagatatgcatttacctcagtgagcagaggggtgaccctgaatagaatgggaggcagattggccctaaggagttmccagcttgacttttccctttagcttagtgatttgggggctccaagatttattttcctttcacactctttataatccgaattttagatttagaatgaatct

SEQ ID NO: 14343 - DNA, 201 bp, Homo sapiens
tttttaaatattctcttgtgaacccagaaaatctgagacaggtttcagttaatttagaaagtttatttttccaaggttgaggacgtgcacccatgacacggcctcaggaggtcatgacaacatgtgcccaaggtggtcagagcagtttggttttgtacattctagggagaaatgagacatcaatcaacatatgcaagatga

SEQ ID NO: 14344 - DNA, 201 bp, Homo sapiens
tgaacaaactaaccttttaattgctgaattaatctatatatatctatatatatagattctcatgcctcagcctcctgagtagctgggattacaggtgcacrccaccatacctggctaatttttatattttttgtagagacggggtttctccatattgtccaggctggtcacgaactcctgacttcaagtggtctgcccgca

SEQ ID NO: 14345 - DNA, 201 bp, Homo sapiens
ccgaaactgctgaagttgtttattagatcaaagagcatttgggcagaggctatgcggttttctaggtatagaatcatgttgcctgcaaacagggatagttkgactttctttcttcctatttggataccttttatttctttcttttgcctgacttccctggtcaggacttccagtgctatgttgaataggagtggtgatagg

SEQ ID NO: 14346 - DNA, 201 bp, Homo sapiens
tctgcctctcaggttccagagattctcgtgcctcaatgtcccaagtagctgggactacaggcacgtgcgaccacaccctgttaatttttttttttttttttagtagagacagggtttcaccatgttggccagactggtcttgaactcctggcctcccaaagtgctgggattacaggcgtaagccaccacgcccagcaacac

SEQ ID NO: 14347 - DNA, 201 bp, Homo sapiens
ctctgcctctcaggttccagagattctcgtgcctcaatgtcccaagtagctgggactacaggcacgtgcgaccacaccctgttaatttttttttttttttttagtagagacagggtttcaccatgttggccagactggtcttgaactcctggcctcccaaagtgctgggattacaggcgtaagccaccacgcccagcaaca

SEQ ID NO: 14348 - DNA, 201 bp, Homo sapiens
cctctgcctctcaggttccagagattctcgtgcctcaatgtcccaagtagctgggactacaggcacgtgcgaccacaccctgttaatttttttttttttttttagtagagacagggtttcaccatgttggccagactggtcttgaactcctggcctcccaaagtgctgggattacaggcgtaagccaccacgcccagcaac

SEQ ID NO: 14349 - DNA, 201 bp, Homo sapiens
tagatcacttgacgtcagcagttcaagaccaggctggtcaacatggtaaaacccgtctctactgaaaatagaaaaaaattagctgggcgtggtggcgcatrcctataattccagctactcaggaggctgagacaggagaatagcttgaacccaggaggtggaggttgcagtgagccgagatcgtgccattgcactccagcc

SEQ ID NO: 14350 - DNA, 201 bp, Homo sapiens
acctctgcctcctgggttcaaccaattctcctgcctcagcctccccagtagctgggactacagacatgcgccaccacgcccggctaattttttttttttttgcattttgagtagagacgtggtttctccattttgatcaggctggtctcgaactcctgacctcaggtgatccacctgcctcagcctcccaaagtgctggga

SEQ ID NO: 14351 - DNA, 201 bp, Homo sapiens
ctagagtgcagtggtgcaatctcagctcactgcaacctctgcctcccaggttcaagcacttctcctgcctcagcctcccaagcaggtggaattacaggcaygcgccaccacatccagctaatttttgtatttttagtagagacagggtttcaccatgttggccaggctggtctcaaactcttgaccacaagtgatccaccc

SEQ ID NO: 14352 - DNA, 201 bp, Homo sapiens
aagtaacttaaatccagctatttgtcaatcaggtaaatgaaagcacaaaatgagagttcaaaaactggccgggcgcagtggcttacacctgtaatcccagyactttgggaggccaaggcaggcagatcacaaggtcaagagatcaagaccattctggccaacatggtaaaaccccatctctactaaaaaaatacaaaaatt

SEQ ID NO: 14353 - DNA, 201 bp, Homo sapiens
tcccagctactagggaggctgaggcaggagaatcgcttgaacccgggaggctgaggttgcggtgagccgagattgagccattgcactccagcctgggcaaygagagggaaactctgtctcaaaaaaaaaaaaaagaacagacatatgatttgaatacacatttctccaaaaagatatacaaatgaccattaacatatgaga

SEQ ID NO: 14354 - DNA, 201 bp, Homo sapiens
tttcaccgtgttagccaggatggtctcgatctcctgacctcgtgatctgcccgcctcagcctcccagagtgctgggattacaggcgtgagccactgtgccyggctgaagctcttaactttcttatactactttaataagtgagtcaattgattataaataccactgaattgaataaagcctaggattctggaactggcttt

SEQ ID NO: 14355 - DNA, 201 bp, Homo sapiens
gtgagccgagattgtgccactgcactccagcctgggcgacagagcaagactgtcttaaaacaaacaaacaaacaaacaaaaaaaaaaaacagggcccggtrcagtggctcacgcctgtaatcccaccactttgggaggccgaggtggtcagatcacgaggtcagttcaagaccagcctggccaacatggtgaaacccggtc

SEQ ID NO: 14356 - DNA, 201 bp, Homo sapiens
tttgggccttaaatgatattctgactacacactaacaagggagtgttaactaagaaattagcacccttttttcttttcttttttttttttttgagacagartctcactctgtcccccaggctggagtgcagtggcacaatcttggctcactgcaagctctgcctcccgagttcacgccattctcctgcctcagcctcccga

SEQ ID NO: 14357 - DNA, 201 bp, Homo sapiens
tcccgggttcacgccattctcctgcctcagcctccccagtagctgggactacaggcgcccgccaccatgcctggctaattttttgtatttttagtagagayggggtttcaccatgttagccaggatggtctcgatctcctgacctcgtgatccacccgcctcggcctcccaagtgctgggactacaggcatgagccactgc

SEQ ID NO: 14358 - DNA, 201 bp, Homo sapiens
ctgcttttttttttttttgagacagagtctcactctgtcccccaggctggagtgcagtggcacaatctcagctcactgcaagctccacctcccgggttcaygccattctcctgcctcagcctccccagtagctgggactacaggcgcccgccaccatgcctggctaattttttgtatttttagtagagatggggtttcacc

SEQ ID NO: 14359 - DNA, 201 bp, Homo sapiens
gaacctcttcagatacaatggtttctttatgatttttaaaaacggttaattcaaacaataaacaataatgtagtatgtacaaataatttgaccacagattyttatggaatgtcaaaatgaaaaaaaaaaaaacccacaataacgtactacaggagttttttttaaaaaagcattaaggtaaaagtacctattatatattaa

SEQ ID NO: 14360 - DNA, 201 bp, Homo sapiens
gacctctggaaggagactgtatttaccaagtctccctatcaggaattcactgaccacctcgttaagacccacaccagagtctccgtgcagcggactcaggmtccagctgtggctacaacatagggtttttatacaagaaaaataaagtgaattaagcgtgaaaaaaaaattataaaagaatttataccagaatatatatca

SEQ ID NO: 14361 - DNA, 201 bp, Homo sapiens; identical to SEQ ID NO: 4629

SEQ ID NO: 14362 - DNA, 201 bp, Homo sapiens; identical to SEQ ID NO: 4628

SEQ ID NO: 14363 - DNA, 201 bp, Homo sapiens
aaaacttcaggaacttttattatatgctccacaagaaggaaaaaaaaattgttctaaaaaaaagtttaaagaattttgttaatttcttttttctttttttyttttttttttttgagacagagcctcgctctgtcacccaggctggagtgcagcggcgtgatctcggctcactgcaagctccgcctcccgggttcacgccat

SEQ ID NO: 14364 - DNA, 201 bp, Homo sapiens
gaaaaacttcaggaacttttattatatgctccacaagaaggaaaaaaaaattgttctaaaaaaaagtttaaagaattttgttaatttcttttttctttttyttttttttttttttgagacagagcctcgctctgtcacccaggctggagtgcagcggcgtgatctcggctcactgcaagctccgcctcccgggttcacgcc

SEQ ID NO: 14365 - DNA, 201 bp, Homo sapiens
ctagaacattagcctttttaaaaataattatgaatgttcacacatttgtatgaaaaacttcaggaacttttattatatgctccacaagaaggaaaaaaaaattgttctaaaaaaaagtttaaagaattttgttaatttcttttttcttttttttttttttttttttgagacagagcctcgctctgtcacccaggctggagt

SEQ ID NO: 14366 - DNA, 201 bp, Homo sapiens
gcctcccaagtagctgggactacaggcgtgcaccaccagaccaaactaatttttttgtatttttagtagagacgaggtttctccgtgttggccaggctggkctcgaactcctgacctcaggtgatccgcccaccttggcctcccaaagtgctgggatcacaggcgtgagacactgtgcccggcctaaacatgccatttctt

SEQ ID NO: 14367 - DNA, 201 bp, Homo sapiens
aaaccaggtagccatgcttattagcagtctatataatctaagaataaacaggtggccgggtgcagtggctcatgcctgtaattccagcactttgggaggcmgaggtgggcggatcacctgaggtcgggagttcgagaccagcctgaccaacatggagaaaccccgtctctactaaatacacaaaattagccgggtgtggta

SEQ ID NO: 14368 - DNA, 201 bp, Homo sapiens
gtgtgagccaccgtgcccggcctctttctgtactcttatcctcgatttcttttttttctttgtatttttagtagggacggggtttcaccatgttggccagsctggtcttgatctcctgacctcgtgatccacccacctaggcctcccaaagtcctgggattacaggcataagccactgcacctggcccttcttatcctaga

SEQ ID NO: 14369 - DNA, 201 bp, Homo sapiens
agaagccattgaagcagatccaaaatcagctagttttacctgacctggctctgttagaagaatatttcctgctttaatatccctataggaaaaaaaaaaaagggttagaaaattacttttcaattttgattatggaataggtcagagcatgcaattaataagacaaaaagtttatttaaacgaacaaacaaacaaacaaaa

SEQ ID NO: 14370 - DNA, 201 bp, Homo sapiens
ccaccgcgcctggagtctttttttgttgttgttgttgagagtcttactttgtagcccaggttggggtgcagtggcgccatcttggcttactgcagcctctrcctcctgggttcaagcgattctcatgcctcagcctcccgagtagctgggattacaggcataggccaccacacctggccatattcttttaaaataattaaa

SEQ ID NO: 14371 - DNA, 201 bp, Homo sapiens
gatagcattaggagatatacctaatgttaaatgacgagttaatggatgcagcacaccaacatggcacatgtgtacatatgtaacaaacctgcacattgtgyacatgtaccctaaaacttaaagtgtaataataattaaaaaattaaaataaataaataaatacataaataaataaataaaaataagaacatgaaaatgtag

SEQ ID NO: 14372 - DNA, 201 bp, Homo sapiens
ggaggagaattgcttgaacttaggaggtggaggttgcaatgagccgagattgtgccactgcactccagcctgggtaacagagtaagactctgtctcaaaawaaataaataaataaatcatgctgctataaagacacatgcacacgcatgtttattgtggcactattcacaatagcaaagacttggaaccaacccaaatgtc

SEQ ID NO: 14373 - DNA, 201 bp, Homo sapiens
tgtaggaactgtgtagatagggcaggggtggaagaagatctttcactgtatgtctttttatgttttctgatttacaaaccttgtgattctgctacctaatwgaaaaaaataatattcaaattttcctccaggaattcttttttttttttaattaatacttctttaatgtaaaaaaaaaatccagataaattgtgcatcttt

SEQ ID NO: 14374 - DNA, 201 bp, Homo sapiens
tgggttcaggtgattctcctacctcagcttcacttaatcatattccttacccatttctctactggttgtttggctttttcttttttttccttttttttttkggggggacagagtttcgatcttgttgcccaggctggagtgcagtggcgcaatctcggctcactgcaacctccgcctcccaggttcagatgattctcttgc

SEQ ID NO: 14375 - DNA, 201 bp, Homo sapiens
cttgttaagaaaaaacttggtaagaaaaaactagttaaaaaatgggtaggcactaacagtaaaattcaacacaagtggcacattcttttaaaagatcgtamctgaggtgttgctatgatggtctcagtgttataaggaaaattttggtttatttttataaaatattacttttatattttaatataatataaaattatgtta

SEQ ID NO: 14376 - DNA, 201 bp, Homo sapiens
gttgtaggaacatttaacatcatttactctctcagcaatttcaactttcaatgcattttaccatgttgcttcctagtgttaaagagatgttaaaatgggcyggcatgatggcttgcgcctataatcccaacactttgggaggccgaggtgggtggatcatttgagatcaggagtttgagactagcctggccaacaaggtaa

SEQ ID NO: 14377 - DNA, 201 bp, Homo sapiens
gtctactgggcttaattttactaaggaaaatgaaagagtacgcctatctttagataaacactacctgaaaaggtataagggttcttttctttctttctttytttttttttttttttttttttgagacgcagtctcgcactgtcgcctaggctggagtgcagcggcgtgatctcggctcactgcaagctctgcctcccaggt

SEQ ID NO: 14378 - DNA, 201 bp, Homo sapiens
tgatgttcccatttctgtctcctgagtagctgggattataggcatgtgccattaagtccagctacttttttggctttttttttttttttttttttttttttagagatggggttttgctatgttgcctaggctggtctcaaactcctgggctcaagcgatctgcccgccccaacctcccaaagtgctgggattataggcatg

SEQ ID NO: 14379 - DNA, 201 bp, Homo sapiens
gtgatgttcccatttctgtctcctgagtagctgggattataggcatgtgccattaagtccagctacttttttggctttttttttttttttttttttttttttagagatggggttttgctatgttgcctaggctggtctcaaactcctgggctcaagcgatctgcccgccccaacctcccaaagtgctgggattataggcat

SEQ ID NO: 14380 - DNA, 201 bp, Homo sapiens
actagggaaaaaattattttaaaaaaaggggcacttaattaagactctaatttttaaaaaagtaccaacagttttcatctattcccctatgctactgatakcaacaaatatgaataccggccggcaatgaaaatgtttattcaggttggcttaaacattacaccaaattagatatcaaggtagtctctaagattacaatag

SEQ ID NO: 14381 - DNA, 201 bp, Homo sapiens
tgatatgcaatcttataatatcctacaacttaaaaatatgaattcaaaaactatacattactgaaaagtcatcttttttcggagagtcacaaaatcctccctccctctctcccttctatttttttttggcggggggtggggagagcgagggaagaaatgaaaactagggaaaaaattattttaaaaaaaggggcacttaat

SEQ ID NO: 14382 - DNA, 201 bp, Homo sapiens
ggccaggcacagtggctggtgcctgtaatcccagcacttcgagaggccaaggcaggaggattgctttagcccaggagtttgagaccagcctggccaacacsgtgaaatccccctactaaaaatacaaaaattagccaggcatggtggcgggtgcctgtaatcgcagctactccagaggctgaggcaggagaattgcttgaa

SEQ ID NO: 14383 - DNA, 201 bp, Homo sapiens
atggaacaaaatcctgaatggggcacatcactaagcgcttggctagttaagaagaccagtctggtcaaggcagtgtgtgtgtgtgtgtgtgtgtgtgtgtkagagagagagagagagagagacagacagacagacacacagacacacacaaacaggctgataggagcctaaaaacaggtttacaggccaggcgcggtggct

SEQ ID NO: 14384 - DNA, 201 bp, Homo sapiens
ctaaaaacacaaaacactagctgggtgtagtggcatgcgcctgtaatcccagctacttgggaggctgaggcaggagaattgcttgaacctgggaggcggargtggcagtgagccaggattgcaccactgcactccagcctgggcaacagagaaagactccgtatcaaaaaaaaaaaaaaaaaaaaaaaaagaaaagaaaga

SEQ ID NO: 14385 - DNA, 201 bp, Homo sapiens
ctggagtgcagtggtgtgatctcggcttactgcaacctctgcctcctgtattcaagcaatttgtcctgcctcaacctcctgagtagctgggattacaggcrcccgccatcaagctcagctaattttgtatttttatagagatgtcgttttaccatgttggccaggctggtcttgaactcctgacctcagttgatccaccca

SEQ ID NO: 14386 - DNA, 201 bp, Homo sapiens
cgtggtggctcacgcctgtaatctcagcactttgggaggctgaggtgaaggattacctgaggtcaggagttcaagaccagcctggctaacatggtgaaacyctgtttctactaaaaatacaaaaaattagctgggcatggtggtgcacgcctgtaatctcggctacttgggaggctgaagcaggagagttgcttgaacccg

SEQ ID NO: 14387 - DNA, 201 bp, Homo sapiens
aatgacgagttaatgggtgcagcacaccaacatggcagatgtatacatatgtaacaaacctgcacgttgtgcacatgtaccctagaacttaaagcataatrataataaaaaaagatgatattatgactatctgccttacccttctgttttttttttttttttttcagtcggagtcttgttcttgttgcccaggctggaatg

SEQ ID NO: 14388 - DNA, 201 bp, Homo sapiens
ccgggttcaagtgattctcttgtctcagcctcccgagtagctgggattacaggcacctgccaccatgcccagctaattttttgtatttttagtagagatasggtttcaccatgttggccaggctggtctcaaactcttgacctcaagtgatccacccacctcagcctcccaaagtgctgggattacaggcatgagccacca

SEQ ID NO: 14389 - DNA, 201 bp, Homo sapiens
atttttagtagagacggggtttcaccatgttggccaggctggtctcgaattcctgacctcaggcgatccacccacctcggcctcccaaagtgctgggattrcaggcgtgagccactgtgcctggcctttttttttttgagacagggtctcgctctgtcacccaggctagagtgcagtgacacaatctcggctcactgcaac

SEQ ID NO: 14390 - DNA, 201 bp, Homo sapiens
atttttttttttttttgagaagagacttcctctgttgcccaggctggagtgtaatggcatgatcttggctcactgcaacctctgccttccaggttcaagcrattctcctgcctcagcctcctgagtagctgggattacaggcatgtgccaccatgcccggctaatttttgtatttttagaagagatggagtttcaccatgt

SEQ ID NO: 14391 - DNA, 201 bp, Homo sapiens
atctccagatattgccaaatgttcccttgggaacaaaattcctctagttgagaactactacactggtttgttttgtatatgtgtgtgtgtgtgtgtgtgtrtatatatatatatatatatatatattttttttttttttttaaggatcatgtctctaacagtcatagaccttttaaattagtctgaacatgatttatttcc

SEQ ID NO: 14392 - DNA, 201 bp, Homo sapiens
ggaggccaaagagggtggatcacgaggtcaggagatcgagaccatcccggctaacacggtgaaaccctgtctctactaaaaatacaaaaaattagccaggygtggtggcaggcgcctgtagtcccagctactcaggaggctgatgcaggagaatggcgtgaacgcaggaggcggagcttgcagtgaactgagatcgcgcca

SEQ ID NO: 14393 - DNA, 201 bp, Homo sapiens
gcaggagaatggcgtgaacgcaggaggcggagcttgcagtgaactgagatcgcgccactgcactccagcctgggcgacagcacgagactccatctcaaaawaaataaataaataaataaataaataaataaataaataaataaaaggaagtttggattaggatcccctcagggcctgggaaagaccagagtagaggcaagg

SEQ ID NO: 14394 - DNA, 201 bp, Homo sapiens
gagaatggcgtgaacgcaggaggcggagcttgcagtgaactgagatcgcgccactgcactccagcctgggcgacagcacgagactccatctcaaaataaataaataaataaataaataaataaataaataaataaataaaaggaagtttggattaggatcccctcagggcctgggaaagaccagagtagaggcaaggactg

SEQ ID NO: 14395 - DNA, 201 bp, Homo sapiens
atttctgcttaaatgtcacctcatcaggtaggcttttcttactccctgctagagtaagtcctccttttacccgaggcaagtttctttctttcttcttcttytttttttttttttttttttttgagtctcactctgttgcccaggctggagtgcaatggcgcgatctcggctcactacaacctctgcctcctgggttcaagc

SEQ ID NO: 14396 - DNA, 201 bp, Homo sapiens
gcttgtaccttttaaatctgaaactacataataagcagaagcaatgcatagtatagtctattcttttttttttttttttttttttttgagatggagtctcrctctctcacccaagctggagtgcagtggtgcgatcttggctcactgcaacctccacctcctgggttcaggtaattctcctgactcagcctcccgagtagc

SEQ ID NO: 14397 - DNA, 201 bp, Homo sapiens
aactactttttgtatttttagtagagatggggtttcactatgttggccaggctggtctcaaactcctgaccttaggtgatccacccacctcagcctcccaragtgctgggattacaggcatgagccacagctttcagacccaatctctctctctctcttttttttttttttgccttacttgaagcactaggaagtaaagga

SEQ ID NO: 14398 - DNA, 201 bp, Homo sapiens
ttaatagagatggggtttcaccatgttggccaagatggtctcaatctcctgacctcgtgatctgcccacctcagcctccaaaagtgctgggattacaggcrtgagccactgcacccggcctcctcattgtttttaaaagcccactgttctccaaacccctacaactggaatgccctcggactcttttaaaaggacaatttt

SEQ ID NO: 14399 - DNA, 201 bp, Homo sapiens
ggtagatttttacctcactccttgtaacaaatttttgcataactctccccacctcctttccacaaaacatcagcataaagaatgtcaaaagagaaataggaaaaaaaaatccaagatctactataaattaaaaaggaaatacaaatggcttttcaacttacgagagagatgttcaacatctcccataatgtgaaatagcaa

SEQ ID NO: 14400 - DNA, 201 bp, Homo sapiens
ggctggagtgcagtggcacgatctcggctcactgcaaacttcgccttccgggttcaagtgattctcctgcctcagcttcccgagtagctgggattatcgaygcatgccaccatgcccagctaatttttgtatttttaggagagatggggtttcactattttggccaggctggtcttgaactcctgaccttgtgatctgccc

SEQ ID NO: 14401 - DNA, 201 bp, Homo sapiens
tgaacttctggcctcaggtgatctgcctgctttggcctcctaaagtgctgggattataggtgtgagccattgcacccggctcttcttcttcttcttcttcttttttttttttttgagacagggttttactcccatcacccaggctgaagtgcaatggcaggatctcggctcactgcaacctctgcctcccaggctcaagtg

SEQ ID NO: 14402 - DNA, 201 bp, Homo sapiens
ttggccaggctggtctcgaactggtgacctcctgatcctcccaccttggcctcccaaagtgctgggattacgggcatgagccgccacgcccggcctacttwtttatttcttactccttcttgtaagtttcacaagggcaggcactatgtttttattgtgtactactgtattctctgcgcttagaatagtacttgacaccca

SEQ ID NO: 14403 - DNA, 201 bp, Homo sapiens
ccaggttcaagtgattctccctcctcagcctcccaagtagctgggattacaggcacccaccaccacacttggctaatttttgtatttttagtagagacagrgtttcaccatgttggccaggctggtctcgaactcctgacctcaggtgacccacctgccttggcctcccaaagtgctgggattacaggcgtgagccaccac

SEQ ID NO: 14404 - DNA, 201 bp, Homo sapiens
tgcctcagcctcccgagtagctgggactacagatgcctgccactgcgcccagccaatttttttgaatttttagtagagacggggtttcaccatgttagccrggatggtctccatctcccgacctcgtgatccgcccgcctcggcttcccaaagtgctgggattacaggagtgagccactgcgcccggcctctctcgtatct

SEQ ID NO: 14405 - DNA, 201 bp, Homo sapiens
ttcttaatggaaagcatctcctaacaggcacccacgtgcacgcgatacacccataggcacacatatgacatgcacacacacataggcacacacatgaagtgcgcgcgcgcgcacacacacacacacacacacacacacacaggaactacgggaggaccgaggaaggctggctgagtcctgtgatcaatgcatctaaatcat

SEQ ID NO: 14406 - DNA, 201 bp, Homo sapiens
tcttaatggaaagcatctcctaacaggcacccacgtgcacgcgatacacccataggcacacatatgacatgcacacacacataggcacacacatgaagtgcgcgcgcgcgcacacacacacacacacacacacacacacaggaactacgggaggaccgaggaaggctggctgagtcctgtgatcaatgcatctaaatcatt

SEQ ID NO: 14407 - DNA, 201 bp, Homo sapiens
aagcatctcctaacaggcacccacgtgcacgcgatacacccataggcacacatatgacatgcacacacacataggcacacacatgaagtgcgcgcgcgcgcacacacacacacacacacacacacacacaggaactacgggaggaccgaggaaggctggctgagtcctgtgatcaatgcatctaaatcattatatttaaaa

SEQ ID NO: 14408 - DNA, 201 bp, Homo sapiens
agcatctcctaacaggcacccacgtgcacgcgatacacccataggcacacatatgacatgcacacacacataggcacacacatgaagtgcgcgcgcgcgcacacacacacacacacacacacacacacaggaactacgggaggaccgaggaaggctggctgagtcctgtgatcaatgcatctaaatcattatatttaaaac

SEQ ID NO: 14409 - DNA, 201 bp, Homo sapiens
ctagagtgctgtggtgtgatctcagctcactgcaacctccgactccctggttgaagcgattctcctgcctcagcctcctgagtagctgggattacaggcaygtgccaccatgcctagctaatttttgtatttttagcagagatgaggtttcaccaggttggccaggctggtctcgaactcctgacttccggtgatccaccc

SEQ ID NO: 14410 - DNA, 201 bp, Homo sapiens
ctgggattacaggcacgtgccaccatgcctagctaatttttgtatttttagcagagatgaggtttcaccaggttggccaggctggtctcgaactcctgacytccggtgatccacccgcctcagcctcccaaattgctgggattacaggcatgagccgcttcgcccagccataaataaagttttattggacattgataatac

SEQ ID NO: 14411 - DNA, 201 bp, Homo sapiens
ttttttaccatataggtaaatacaggtagaccatcatctactgctttatttttgttttttttttagatggagtctcactctgtcacccaggctggagtgcmgtggcgtgatctcggctcactgcaacctctgctgcctcctgggtccaagcgattctcccgcctcagtctcccaagtagctgggattacacaagtgtgtgc

SEQ ID NO: 14412 - DNA, 201 bp, Homo sapiens
tataggtaaatacaggtagaccatcatctactgctttatttttgttttttttttagatggagtctcactctgtcacccaggctggagtgcagtggcgtgayctcggctcactgcaacctctgctgcctcctgggtccaagcgattctcccgcctcagtctcccaagtagctgggattacacaagtgtgtgccaccaagccc

SEQ ID NO: 14413 - DNA, 201 bp, Homo sapiens
cactttttttttttttttgagacagagtcttgctctgtcacccaggctggagtgcagtgatgtgatctcagctcactgcaacctccacctcccgggttcawgtgattctcctgcctcagcctcctgagtagctgggactacaggtgcctgcccagctaatttttgtacttttggtagagatggggtttcaccatgttggtc

SEQ ID NO: 14414 - DNA, 201 bp, Homo sapiens
ttttgtacttttggtagagatggggtttcaccatgttggtcagcctggtttcgaactcctgaccttgtgatccacctgcctcggcctcccaaaatgctggrattacaggcgtgagccaccgcgcccggccccacttaccatgttttactattactgcttaattatctgaccacctggcttgactgacaaattgtctgtcta

SEQ ID NO: 14415 - DNA, 201 bp, Homo sapiens
accaggcagacagagaaataagaaactatgagcaaagctttgcggctaaatcaatagctcattactgtcatcatgccacataatccacttattttaatctstaaggttggcccaagatagccattcagaagaagctgccggacattaaatgtacattggcaaagctcctaacagaactcatttcaaaagagtgaaagaaaa

SEQ ID NO: 14416 - DNA, 201 bp, Homo sapiens
cattggttcccacaggtgcaagtgcctatgggtggtggcaattcacccttccttttgtaagagatccactaaaggagatttaagattggcacaagcaatgytaggaactattcgaacagaactaccttgggctaataccgagagacacccaaactaggatgattgtgaattgatgattacctaattcaaaaaagctggaga

SEQ ID NO: 14417 - DNA, 201 bp, Homo sapiens
atacaaagccatgtatacaaatgttcacagtagctttaatagccaaaattggaaacaacccaaatgtatatcaacaaatgaatggacaatctgtgataaawacaatggactgtaactcagcaataaaataaactacagatatacactacaatatgaatgaatctcaaaatatgctgtgtaaaagaagtcagacaaaaaata

SEQ ID NO: 14418 - DNA, 201 bp, Homo sapiens
atttcctttttcatacattagaaagaatagcgcccccattagtaatatccactgcaatgcttcttaaatgaaaacatcctatgcataattataagacttamtttacacatttaacctgcacagtattatgagtttggatatgacagtcacatgttagcctatgcattttatttaaacctcattccaagagactagtgaagt

SEQ ID NO: 14419 - DNA, 201 bp, Homo sapiens
cccccatcttttttctgctaacacgtggctttccacaaaagggtcagtgtgatctttgcagatcagagataaggaatatagccacaataaactagagaagkttaagcacgttttaagtaattcaggagtttaaaacttgtcatctatgtataaaacaagcaaacagttataagtggttaaataaacatgtacaaattaata

SEQ ID NO: 14420 - DNA, 201 bp, Homo sapiens
atccttcccccatcttttttctgctaacacgtggctttccacaaaagggtcagtgtgatctttgcagatcagagataaggaatatagccacaataaactakagaaggttaagcacgttttaagtaattcaggagtttaaaacttgtcatctatgtataaaacaagcaaacagttataagtggttaaataaacatgtacaaa

SEQ ID NO: 14421 - DNA, 201 bp, Homo sapiens
ttatctttaaatctgtgtaatgaatcatatcagagggctttgaaagagagatatttattaagcattttagttgctctttttttttttcgagacggggtctyactctgtcgcccaggctggaatgcagtggtgcgatctcggctcactgcaacctccacctcccgggttcaagcgattctgcctcagcctcccgagtagctg

SEQ ID NO: 14422 - DNA, 201 bp, Homo sapiens
gtggggtctcgctctgtcatccaggctggagtgcagttgtgcaatctcggatcactgcagcatcctaccctcagcctcctgagtagctgggaacacagtcrtgtaccaccctgcctggctagattctctctctttttttttttgattgttaataaagacaagctcttacaattttgtccaggctggtcttgaacttctggc

SEQ ID NO: 14423 - DNA, 201 bp, Homo sapiens
ccccccataggcaactccctcccttctcataattagcttaagaccttaatgttggctgggtgtggtggctcacacctgtaatcacagcattttgggaggcygaggcaggcagatcgcttgagcccaggagtttgaggccacaagatcagcctgaataacatggcaaaacccaatttctacaataaaatataaaaattagct

SEQ ID NO: 14424 - DNA, 201 bp, Homo sapiens
ttgctgacacatctcttgaccaattgtgcaagaagcaatgaggttttgagcacggttttttaccactttatgaatcaaccttcccgcctcctcttcccccscccatctctggagtcctcatagttttctctttaaaatcatttgtaaaacagaaagcaaagctctcagatctaaccagtagtctaactctgaccttaggct

SEQ ID NO: 14425 - DNA, 201 bp, Homo sapiens
agcgattctcctgcctcagcctccccagtagctgggactacaggtgcgtgccaacacacctggctgattttttgtatttttagtgaagacggggtttcacygtgaggatgatcttgatctcctgacctcgtgatctgctggccttggcctcccaaagtgctgggattacaggagtgagccactgcgcccaaccccatgaaa

SEQ ID NO: 14426 - DNA, 201 bp, Homo sapiens
tcatgagttttataagaggtatagtagctgaagcagtgctcaagtattcattcattctttcaacatttattggatacctgctatacttaagatattgtgtyaggtgctgaaagatatataacacataaaatatgtatacagatatgtgttcaccagaaactcattacctagaaccagtgaatgttgcaagtactatgaaag

SEQ ID NO: 14427 - DNA, 201 bp, Homo sapiens
tgcaatctcagctcactgcaacctctgcctcccaggttcaagcacttctcctgcctcagcctcccaagcaggtggaattacaggcacgcgccaccacatcyagctaatttttgtatttttagtagagacagggtttcaccatgttggccaggctggtctcaaactcttgaccacaagtgatccacccaccttggcctccca

SEQ ID NO: 14428 - DNA, 201 bp, Homo sapiens
cgggggcggtgtttcactgtgttgcccagcctggtcttgaactcctgggctcaagaaatcctccctcctccctcattagcctcccaaagtgctgggattayaggtgtgcccattgtctctttagtaccttttagatatatgtattttaaaaagcactcaatgagggtaagaaacaaagtgtggacataaatataatctact

SEQ ID NO: 14429 - DNA, 201 bp, Homo sapiens
gaaatacccttccttttcctaattcttcaaaataagggcaataatctctgcccttagaaaattataaaaattatacaattgtaataaaaagttacaatgckaaagttttctcaggatttcatctggtatcaaagtttatagtccttccttatcctttgttacaaatccaactgtgcagcagtgcataatacaaaaatctca

SEQ ID NO: 14430 - DNA, 201 bp, Homo sapiens
tcattcccagaagcaagtgtagcctgcacatttcaaggatgagaaagaaaggaagaaagtattatcattttcctcctctagtgcttacaattataaagagytaatcggtttttagtaaacttaaagctatgacttaacatcatagaattttagaacgggaatgcctcttagaaaactttctgtttcaaggctgggcatggt

SEQ ID NO: 14431 - DNA, 201 bp, Homo sapiens
tattcacagattgaaagactcaacatagaaaagacgtcaattatccccaaattgtatatagttttaatacaattcctatcaaaatcccagcacggattttygtagacataggcaagctaaatctgacgtttacatggacaggcaaaagagctagaatgactaaacaatcttgaaaaggaagaatatgaggaatcactttac

SEQ ID NO: 14432 - DNA, 201 bp, Homo sapiens
caggtgtgagccgctgcgcctggccacaactcttaaatatagggacaaatctgcatgaccatggatttggcaatgatttcttaattaaaaccacaaggagmtaccacctcacacctgtaagaatagtttttagcaaaaagacaaaagactgagtgttggtgagcatgtagagaaaagggaacccttgtacactgttagtgg

SEQ ID NO: 14433 - DNA, 201 bp, Homo sapiens
ttttttctttttttttgagaacgggtctcactcttgttgcccgggtctcactcttgttgcccgggtctcactcttgttgcccaggctggagtgcagtggcrcgttcttggcccactgcaacctctgcctcccaggcggttcaagcaattctcttgcctcaggctcttgagtagctgggattacaggtgctcaccaccacac

SEQ ID NO: 14434 - DNA, 201 bp, Homo sapiens
gaaaaagtgttaggaatttgagtaaaccatccaatacaaacttcatgaataatttttatttctattgtttttaaagataacatattttaaagctcaggtayaagaactaaatggatttcatgaaaagataccatatcttaagttttcatatatattctattttttgagctcacttacattttaaaggtaactcatccaaag

SEQ ID NO: 14435 - DNA, 201 bp, Homo sapiens
gtgaagtgttttttttttttttttttttttttttttgagacagagtcttgctctgtcacccaggctggagtgcagtggtgcgatctctcactgcaagctcygcctcccaggttcacaccgttctcctgcctcagcctcccgagtagctgggactacaggcacccaccaccacacctggctaatttttttgtatttttagta

SEQ ID NO: 14436 - DNA, 201 bp, Homo sapiens
gtagctgggataacaggcatctgccaccatgcccagctaatttttttttgtcgttttagcagagacagggttttaccatgttggccaggctggtcttgaastcctgaccttaggtgattcgcccgcctcggcctcccaaagtgctgggattacaggtgtgagccaccgtgcccagcggggtttttactttttaaaaggaat

SEQ ID NO: 14437 - DNA, 201 bp, Homo sapiens
tgcagtggcttgatcattgctcatgcaacctccatctcccaggttcaagtgatcctcccaccttagcctcctgaggagctgggattagaggcgtgcaaacmcacgcccagctaatttttgtattttttgtagagatgggcgggggcgggggcggtgtttcactgtgttgcccagcctggtcttgaactcctgggctcaaga

SEQ ID NO: 14438 - DNA, 201 bp, Homo sapiens
ctgtcgcccaggctggaatgcagtggtgcgatctcggctcactgcaacctccacctcccgggttcaagcgattctgcctcagcctcccgagtagctgggaytacaggcgcgccaccatgcccagctaatttttgtatttttagtagagacggggtttcaccatgttggccaggatagtcccgcctcggcttcccaaagcgc

SEQ ID NO: 14439 - DNA, 201 bp, Homo sapiens
acggggtcttactctgtcgcccaggctggaatgcagtggtgcgatctcggctcactgcaacctccacctcccgggttcaagcgattctgcctcagcctccygagtagctgggactacaggcgcgccaccatgcccagctaatttttgtatttttagtagagacggggtttcaccatgttggccaggatagtcccgcctcgg

SEQ ID NO: 14440 - DNA, 201 bp, Homo sapiens
atgcagtggcttgatcattgctcatgcaacctccatctcccaggttcaagtgatcctcccaccttagcctcctgaggagctgggattagaggcgtgcaaamacacgcccagctaatttttgtattttttgtagagatgggcgggggcgggggcggtgtttcactgtgttgcccagcctggtcttgaactcctgggctcaag

SEQ ID NO: 14441 - DNA, 201 bp, Homo sapiens
cctgcattcctaacaagcttccaggtaatgccattgctgctggtccacggactatactgaattgcaaggctcaagatgaagctgtaaataacctttagaaratcactgagagcaaaacagtaagtgttatattgtcaagatcacaaataaacactcatatagacaaaaaactaacaaataaaaccccacacctgtcctaat

SEQ ID NO: 14442 - DNA, 201 bp, Homo sapiens
aaccgcagaaatgaactaaaaattactgtgatcactgctttgaagaggacgtacttggccctagaagaatttaatagaaaatatttaatcttggtagtaaytaagaaaaattattcagagttaaccagcggaaaaggaaagggaagaatactctcagtagagaaaacagcatgtgcaaaaccctaggggttggagaggaaa

SEQ ID NO: 14443 - DNA, 201 bp, Homo sapiens
actaagaatccaaaagaactagtatctattcagataataatatttacactgaatattagtagtactcccagtcactcaggaggctgaagcgatccttccgrtatgttatgggggaaaaatagtaacaataatgaagactataagcacgcaccaccacaaccagctaatttttaaattttttgtagagatgggctctcactg

SEQ ID NO: 14444 - DNA, 201 bp, Homo sapiens
cactgaagctctctgaaaagggagtgacatgctagaagtagcatttaaagaagattcatcatgatgagttgggaaaaagagactgaaatgaaggcaggccmctgtggtagtccaggaacgaggcaacaagggtctgaatgggaaaggtgcacgaggtgcagtgcattttaccagcgatgtaatgagccttgagactattat

SEQ ID NO: 14445 - DNA, 201 bp, Homo sapiens
tagaaaagacgtcaattatccccaaattgtatatagttttaatacaattcctatcaaaatcccagcacggattttcgtagacataggcaagctaaatctgwcgtttacatggacaggcaaaagagctagaatgactaaacaatcttgaaaaggaagaatatgaggaatcactttactcaatattaagtcttcctatgtagc

SEQ ID NO: 14446 - DNA, 201 bp, Homo sapiens
agtgtatgtgcgtgtctggctgcagttgatagttgggcaaagaggaaactatcacaaagaggaagtatactgaatggcagctcctttaggttacaaaagargatagctgctaataaaactttaaatgtgttgattgataaaaaacgagaagaaaaagaaaccaagaaaaaaaaattcaaaaaaagaggtaaagaggaaagg

SEQ ID NO: 14447 - DNA, 201 bp, Homo sapiens
tgatttggcagaagtcaagagagatgtggggagaaaaataaaaccactaatgaaatgaagctggcaagaagcagcacaaagaactggcaatggtggagacrtggtaagggacatgggtggagaattgaggaaagtagcaaaacaacagcaccttgaataaagtttttaaaaactagagtaaattatagatttgaaagataa

SEQ ID NO: 14448 - DNA, 201 bp, Homo sapiens
ttcactctctaagaagcaggggatggagatgggtaggtgcttaatgctttaatggaagagacagtattttgattgttctgtaaagaacaggcacaattggycgagcacagtggctcatgcctgtaatcccaacactttgggaggctgaggtgggcggatcacaaggttaagagatcgagaccaacctgaccaacatggtga

SEQ ID NO: 14449 - DNA, 201 bp, Homo sapiens
gataagaatttagataatctaaaattgttttattagaaacctgataataatctacaacatataaagaactgctataacttaacaacaaaaagacaaacgayccaattttgaaatgagaactagaaaacttaatattgtcaaggacttgaatagccatttactcaaagaagatgtacaaatggccaataaacacatgaaaaa

SEQ ID NO: 14450 - DNA, 201 bp, Homo sapiens
tctcaatttcacaaaaaacattcaacaaactcatataaccttttgccatttatagctatcttgagttcaaatatagtactttaaaaaaatcaataaattayaccctttgaaggcataaaatgtgttttgagatgttttttatgggtctacggtacttaaggtttctgataattttgtgaattattaacagagttctatttg

SEQ ID NO: 14451 - DNA, 201 bp, Homo sapiens
gtggctaataaactttaaaaaataatcttgttatgaaaagttgaggttatccttgtacttgtgatcaccttatattcaggcagatgcgctttgttgttctracctaaatctatgccagagcccataatctatatcctggaaggtactacttccctagctttcatatttgttagaaagaaagccatttgtatttcatattgc

SEQ ID NO: 14452 - DNA, 201 bp, Homo sapiens
ttattagactttaatgcctaaaagccatgtcatcaagcttccactagacttcgttacagtgaacagagttttcttaggttttagccacaatgagatacagmcatcgtggatgtatggtgtggtagtaggaatggctttcatttgtattcaatgaaataaaaatatagtaaattcaaggctgctccaagaaaaatgtaaaac

SEQ ID NO: 14453 - DNA, 201 bp, Homo sapiens
attgttaataaccgaatggccaacatgttttatttttatactttcataagtagctaactctatgtattaaattgatttaaaaagttacaaaacaaaataartgtgaccaaaccctctgacttttctgtctctaaatttggtattacattcaagaaacagctctgctttctatactattttccctttctgtgaatgaagaaa

SEQ ID NO: 14454 - DNA, 201 bp, Homo sapiens
taactttttaacatacaaatgatgacatgtcaaaaaaaaagtatctgttttcctacttaaactaaattcattttatggactatagtagtcacataaattgktaataaccgaatggccaacatgttttatttttatactttcataagtagctaactctatgtattaaattgatttaaaaagttacaaaacaaaataaatgtg

SEQ ID NO: 14455 - DNA, 201 bp, Homo sapiens
gcattaactttttaacatacaaatgatgacatgtcaaaaaaaaagtatctgttttcctacttaaactaaattcattttatggactatagtagtcacataarttgttaataaccgaatggccaacatgttttatttttatactttcataagtagctaactctatgtattaaattgatttaaaaagttacaaaacaaaataaa

SEQ ID NO: 14456 - DNA, 201 bp, Homo sapiens
gtcatccttcccccatcttttttctgctaacacgtggctttccacaaaagggtcagtgtgatctttgcagatcagagataaggaatatagccacaataaaytagagaaggttaagcacgttttaagtaattcaggagtttaaaacttgtcatctatgtataaaacaagcaaacagttataagtggttaaataaacatgtac

SEQ ID NO: 14457 - DNA, 201 bp, Homo sapiens
caagactccctctttacaaaaaaaaagaaactttaaaaaattagccaggcatggtggcacatgcctgtagtctcggctactggggaggctgaggcaggagratcacttgagctcaggagttcaaggcagcagtgagctatgactgtgccactgcacaccaacctgggtgacagggtgagactctgtctctaaataaacaag

SEQ ID NO: 14458 - DNA, 201 bp, Homo sapiens
acaggcgtcagcaacaatgcccggcctcaatttggtcacattaaaaaaaaatgatatggccacgtgcagtggctcacacctgtaatcccagagttttgggwggcagaggcaggaggatctcttgaggccaggattttgagaccaacctaggcaacacagcaagactccctctttacaaaaaaaaagaaactttaaaaaatt

SEQ ID NO: 14459 - DNA, 201 bp, Homo sapiens
cctcagatgtctttattagcagcgtgaaaacagactaatacatcctgtctctgcaatttttttttttaattagctatctgggaggccaaggcaggagggtsccttgagtctaggagtttgaggctgaggctgtggtgagctatgatcgcaccactgcactccagactaggtggcaaagtgagactctgtcccaaaataaat

SEQ ID NO: 14460 - DNA, 201 bp, Homo sapiens
tgtggaactgtgagtccattaaacctctttcctgtataaattacccagcctcagatgtctttattagcagcgtgaaaacagactaatacatcctgtctctrcaatttttttttttaattagctatctgggaggccaaggcaggagggtcccttgagtctaggagtttgaggctgaggctgtggtgagctatgatcgcacca

SEQ ID NO: 14461 - DNA, 201 bp, Homo sapiens
ccccacccaaatctcatcttgaattgtagctcccacaattcccaagcattgtgggaggaactcggtgggaggtgagtgaatcatggggtgggtctttcccrtgctgttcttgtgatacagtctcatgagatctgatggttttatcagggggagtttctctgcacaagctctcttttttgcctgctgccatccatgtaagac

SEQ ID NO: 14462 - DNA, 201 bp, Homo sapiens
ggataattcatttccctggctagaaggagtaggtcagcaggagatttcatcacactactcaaaagggtaagcaatttaaaactcatgaatggggccaggcmcagtggctcatgcctgtaatcccagcactttgggaggccaaggccagaggatcacttgaggccagaccggatttggctatgtccccacccaaatctcatc

SEQ ID NO: 14463 - DNA, 201 bp, Homo sapiens
taaaaatcacccgagaatttgcaggaaaatagtaggagtaggaaaagcatctaacaggtagtacacttcacacaggatcttgaaggaatggtaaaatctgmgtaggcagcgagaagctccaagcaagggctttttgggtgaagtaaaaggcagagacttgaatgagtttggtgtgtttgagagaccgacttcaatagaaca

SEQ ID NO: 14464 - DNA, 201 bp, Homo sapiens
atgctaggaactgtgaaagatttagctaaaagatatggtgtttgtattcaaaatgtttacattagtgaagatacaagagtgtgtgatagaagacactacayagatttttgttcattggtttgctaaattaaaaatcacccgagaatttgcaggaaaatagtaggagtaggaaaagcatctaacaggtagtacacttcacac

SEQ ID NO: 14465 - DNA, 201 bp, Homo sapiens
gttacttaaataattggataaaaatgcttcttggttgtgtaaaattaaatgattatatttaatctatagttcttttttttttttttttttttttttttagkggcggagtctccctctttcacccaggccagactgcagtggcgctatcttggctcactccaagctccgcctcccgggttcatgccattctcctgcctcagc

SEQ ID NO: 14466 - DNA, 201 bp, Homo sapiens
attcatctggaattaaagactacttgtccagcctctgagctaaagtctaagtctgcttctgccttatttctttctttctttcttttttttttttttgagayggagtctcgctctgtcacccaggctggagtgcagtggcacaatcttggctcactgcaagctctgcctcccgggctcacgccattctcctgcctcaactac

SEQ ID NO: 14467 - DNA, 201 bp, Homo sapiens
catagtgccttcaatggaggaggcagtgttaaacacagactattcatctggaattaaagactacttgtccagcctctgagctaaagtctaagtctgcttckgccttatttctttctttctttcttttttttttttttgagacggagtctcgctctgtcacccaggctggagtgcagtggcacaatcttggctcactgcaag

SEQ ID NO: 14468 - DNA, 201 bp, Homo sapiens
gcttttcctgacaggaagatgctctggcaactcactagctccagcctcctcatttccaagtccaacaggagtcctctcaggtcatatccttccataacctytatgccgcatctccttacaaggttgtttcttggtttgtgtggcactgtcctctaggagtttctttccaacccacctcttctggcttatcctacttctctc

SEQ ID NO: 14469 - DNA, 201 bp, Homo sapiens
cactttgtaagaataaagactaagaaaaaaaatccactttgaaaaatccatgcaacaatgcatgcaggcttgaaaatgaagtggaagttatatttagagayagatgaatattgatacggtaatgatatactgttaaagtaaaagaaataaagcagcatagaaaacaatatatgtactataactgtcctaattactattcct

SEQ ID NO: 14470 - DNA, 201 bp, Homo sapiens
aaaccctgtctctactaaaaatacaaaaaattagccgggcatggtggcagatgcctgtagtcccagctactcaggaggctgaggcaggagaatggcatgamcctaggaggtggagcttgcagtgagctgagatggtgccactgcactccagcctgggggacagagcgagactgtctaaaaaaaaaaaaaatccactagaat

SEQ ID NO: 14471 - DNA, 201 bp, Homo sapiens
ctattggcaaattctagatagcatttcattgtggagtaaatttattaatcaaaacataaatttttaatagaaattcgtggccaggtgcggtggctcatgcytgcaatcccagcactttgggaggctgagatgggcagatcaccagaggtcaggagttcaagaccagcctggccaacatggtgaaaccctgtctctacaaaa

SEQ ID NO: 14472 - DNA, 201 bp, Homo sapiens
aaaaaagagagagagagagagagagaaatgaagaagtcttgcaatatttgcatatcaacttcagatactgtttcttaggcttaaaaaaaaaaactatcagkggttcctgctacatctattggcaaattctagatagcatttcattgtggagtaaatttattaatcaaaacataaatttttaatagaaattcgtggccaggt

SEQ ID NO: 14473 - DNA, 201 bp, Homo sapiens
aaccctgtctttacaaaaaatacaaaaattagccaggcaaggtagcaggtgcctgtagtcccaggtactggggaggctgaggcaggaggatcacttgcatytgggaggccaaggttacagtgagtggcgatcctgccattgcactccagcctgggccacagagtaagcctctgtctgctaaaaaaaaaaaaaaaaaaaaaa

SEQ ID NO: 14474 - DNA, 201 bp, Homo sapiens
attttcccggctgaggcaagcagattgcttgagctcaggagttcgagaccagccagggcaacatggagaaaccctgtctttacaaaaaatacaaaaattakccaggcaaggtagcaggtgcctgtagtcccaggtactggggaggctgaggcaggaggatcacttgcatctgggaggccaaggttacagtgagtggcgatc

SEQ ID NO: 14475 - DNA, 201 bp, Homo sapiens
cttttattccatttttttctatatgagtccaaattaggtccatctgtccaaattttgttttaatggcaataatgcaatgcattttaaaaattaaacttagwagttttaataaataattaaatctaatataaaaaccagattaagttgccctagcagggcaacgttgactatgtgtactacaaatgtatggacacatgatca

SEQ ID NO: 14476 - DNA, 201 bp, Homo sapiens
ctgggcagcaagtgagaccctgtctcaaaagaacaaaaagaaacaaaaaacattaactctaccattaatatatctaattttttttttttttttgagacagrgtctcactctgttgcccaggctggagtgcagtggcgccatctcagctgactgcaacctctgctgccctgccccaggttcaaggtattcttgttcgtcctc

SEQ ID NO: 14477 - DNA, 201 bp, Homo sapiens
aacagagaccccaccttcacagatgtcacaattgtgattatatggatgtttttgtgattctttaacatatgtgtccttcactaacagagggaagagacagygactgttttaataactctatttccagtaccaaacagtgtctggaacatagtaccttttagattaatacctccaaatgaatgaatgattgcatcaatcaat

SEQ ID NO: 14478 - DNA, 201 bp, Homo sapiens
ttcagcagtccagttctgggtattttataaaaaaaaaaaaaaattgaggctgggtgtggaggctcacgcctgtaatcccagcactttgggaggccgaggcrggcagaccacctgaggtcaggagttcgagaccagcctgaccaacatggagaaaccccatctctactaaaaatacaaaattagccaggcgtggtggtgcat

SEQ ID NO: 14479 - DNA, 201 bp, Homo sapiens
gggaggtggaggttgcagtgatccaagaacataccactgcactccagcctgggcaacagaacgagactcttatctcaaaaaaaaaaaaaaaaaaaaaaagrataatatctgactttacagtagtcttaaggatgaaatttaaaaatgcatgtaaaagtgctttataaattgctataaatatattattagtattaataaata

SEQ ID NO: 14480 - DNA, 201 bp, Homo sapiens
gaaatgaaactctggtataaccaaaaacataaggtagagcattggttatttgccttttaagtttcaaaaataatgacaagagaatgataatataccatcartctttccattcagtcagaactctgtatcaacaacaaccccaaaaatatgtggatatcttcaatattttggaggaaaaatacatcaggggttcaatgatgc

SEQ ID NO: 14481 - DNA, 201 bp, Homo sapiens
tgtgccaggcttcatgacaggtagcaaagatattatcttgaacatgttaaggtctctgtcctcaaagagattgcatctagtgagaaagcaagcctgaaatrcaggcaataacagaataatgtagcacacttaaagggtatttaacccagtctcttagggaaaggaagtaaagaagtactagagaagccaaaagatatttga

SEQ ID NO: 14482 - DNA, 201 bp, Homo sapiens
gcagaactaagatctccaccgtgtttcccctttcacgagtttattcaacaggtacttttttttttttttgagacagaatctcactctgttgcccaggctgkagtgcagtggtgcgattttggctcactgcaacctgcaacctctgcctcctgggttcaagtgattctcctacctcagcctcccgagtagctgggattacag

SEQ ID NO: 14483 - DNA, 201 bp, Homo sapiens
tggttttaataataaaagccactactaactccaccctatcaccaccatctacaatatgcttactttgtgctggaggctttatgtatattatatcaagtaaytcccacaagaatcccaagatgtaggcactattatcctacttttacagatgaagaagctgaagttctgaaaatgttaagaactagaattagtgaaagttca

SEQ ID NO: 14484 - DNA, 201 bp, Homo sapiens
cgccattctcctgcctcagcctcccgagtagctgggactacaggcgcccgccaccaggcccagctaattttttttgtatttttagtagagacggggtttcwccgtgttagccaggatggtctcgatctcctgaccttgtgatccgcccgcctcggcctcccaaagtgctgggattacaggcgtgagccaccgcgcccggcc

SEQ ID NO: 14485 - DNA, 201 bp, Homo sapiens
aaaaaatccaggagtaaatttaaaagcaatgtgtaagaactgggatggaagaaaattataaaatgtcacaaaagatataatagaaaatttgggccggtgcrgtggctcatgcctgtaatcccagcactttgggaggcagaggcaggcggatcacttgaggccaggagttagagaccagcccagccaacatggcgaaaccac

SEQ ID NO: 14486 - DNA, 201 bp, Homo sapiens
aaacaagaaaactagtcattttgccttcgactcataattaaaatatatgcttcagcaatccagttagattacaagacatttcaaaaaaagagaacctaaamtttcagaaaaataatttttctaccatcacctatatttttaccaagtacataatttccatttcctttgttgtttcacttatctgagatggcaatgttgcta

SEQ ID NO: 14487 - DNA, 201 bp, Homo sapiens
tctcctgcctcagcctccagagtagctgggactacaggcgcctgccaccacgccaagctaattttttgtatttttagtagagacgggtttcaccgtgttasccaggatggtctcgatctcctgacctcgtgatccacctgcctcggcctcccaaagtgctaggattacaggtgtgggattactgcacccagccagaaattt

SEQ ID NO: 14488 - DNA, 201 bp, Homo sapiens
cattgctggggctgggcacggtggctcacgcctgtaatctcagcatttgggaggccaaggtgggtggattgcttgagctcaggagttcgagaccagcctgsccaacatggcgaagccccgtctctattaaaaatacaaaaattagctgggtgtggtggtgcacgcctgtaactccagctacttgggaggctgaggcaggag

SEQ ID NO: 14489 - DNA, 201 bp, Homo sapiens
taagctggctgcaacctccgcctcccacatacaagcaattctcctgtctcagcctcccgactagctgggattacaggcatgtgccaccacccctggctaayttttatacttttagtagagatggggtttcaccatgttggtcatggtgaactcctgacctcaagtgatctgcccgccttggactcccaaagtgctgggatt

SEQ ID NO: 14490 - DNA, 201 bp, Homo sapiens
gacaactaaaataaattaagatttttcttggtctggggaagtagacggtagcaagggatgtttcttgaaattacttattaaaggcttattactaatatctrattcaataagcatcacaacctacaaatgttttataatagaattattcacaaaatccacaaaacagcttatgttagcctgattttacacatgaagaaatga

SEQ ID NO: 14491 - DNA, 201 bp, Homo sapiens
tacaattaatgaactgtgtccagcaaaggtttatactggcctttccttcaaaattaatgaaataaaactgtacattgttgtctcagtaaaaataaaggcayaaagaattcacaaataggggccgggcatggtggctcatgcctgtaatcccaccaccttgggagaccgaggcaggtggatcacctgaggtcaggagttcga

SEQ ID NO: 14492 - DNA, 201 bp, Homo sapiens
tggagtcaagaatgtgtaaaccgtgtagtgtagatagccttaatatattctggacttagagttttagggcagtgggaaaactaatcacattcataagacaytttgcaactacattattcccccacaaataatagttattttaatctatatccacaaataatagttactggctatatctacaaagtttgtgtagatatctac

SEQ ID NO: 14493 - DNA, 201 bp, Homo sapiens
gggtttcaccatgttggccaggctggtctcaaactcctgacctcaggtgatctgcccgcctcagcctcccaaagtgctgagattacaggcctgagtcatcrggccccgccacatggtggttttctttatcttcctcctggctatgtgctgggtagcagattatccacaattattattgtagctcaaaaacctgagttttcc

SEQ ID NO: 14494 - DNA, 201 bp, Homo sapiens
gaaggttaaggcattctaagtcacaggatgggataggaggtaggcacaagatacaggtcataaagaccttgctgataaaacaggttgcagtaaagaagccrgccaaaacccaccaaaaccaagatggcaatgagaatgacctctggtcgtcctcactgctatactcccaccaatgccatgacagtttacagatgccacggc

SEQ ID NO: 14495 - DNA, 201 bp, Homo sapiens
tgcctgtaatcccagctatttgggaggctgaggaaggagcattgcttgaacctgggaggcagagtttgcatgagctgagatcacgccactgcactccagcytgggcaacagcaaacgagactccgtctcaaaaaaaaaaaaaaaaaaaaaagttggctcaattgccattcgattttctcctctgctgctttggagaggtta

SEQ ID NO: 14496 - DNA, 201 bp, Homo sapiens
tagcctgaccatcatggtgaaaccccatctctactaaaaatacaaaaattagcagggtgtggtggcgggtgcctgtaatcccagctatttgggaggctgargaaggagcattgcttgaacctgggaggcagagtttgcatgagctgagatcacgccactgcactccagcctgggcaacagcaaacgagactccgtctcaaa

SEQ ID NO: 14497 - DNA, 201 bp, Homo sapiens
atagggatgccaataatttcattagatattataaaattacagttattccctcattttccgttgctatgaaaggcaaatggcaaagagaaacaacacgacayctggagtgaaaaagatttatgtttaaatcctctgcttaagagtgtagtcttcagcctgctatctggaaaagcaaccatggttaagaacacgggttatgat

SEQ ID NO: 14498 - DNA, 201 bp, Homo sapiens
ttggcctcccaaagtgttgggattacaggcgtgagccaccatgcctggtcccatattttaaatactaataaataaagttcaggtaacttctctctttacastcctggtcttgcccttccttttgcctccctcatgccaacaacactttgctgaagagagtctggcactgtttcagtgaagtcattatctatactacttggt

SEQ ID NO: 14499 - DNA, 201 bp, Homo sapiens
cctctctcctttcttaggaccttcctttttgatttttttttaaattttaattttatttatttttttgagacggagtcttgctctattgtccaggctggagwgcaatggcacaatcttggctcactaccacctctgcctcctgggttcaagcgattctcctgcctcagactctcaagtaactgggactataggcatgtgcca

SEQ ID NO: 14500 - DNA, 201 bp, Homo sapiens
cttatgtagagtgccttttctcccttgtagtgaccagcaccagactgttttcatcatagcacctgaaattatctgaaattattttattcatatgttccttmtatgtttattgtttctctcctgtctgtcctattcactgctatatcccctcatatatcatacatcataggaaatcacaaatatttgttaaaagaataaaag

SEQ ID NO: 14501 - DNA, 201 bp, Homo sapiens
accgggttcaagcgattctcctgcctcagcctcctgagtagctggggttacaggtgtgcaccaccccgcccagctaatttttgtatttttaatagagatgrggtcttaccatgttggccgggatggtctcaatctcttgacctcgtgatccgtctgcctcagcctcccaaagtgctgggattacaggcgtgagccaccgtg

SEQ ID NO: 14502 - DNA, 201 bp, Homo sapiens
gtcttgaactcctgacctcaggtgatctgcctgcctcggcctcccaaagtgttgggattacctgcacccagcctagaatttcatatgaatacaattacacmgcatacactatataaacttttttgtatctggctttttgtcattcagtattaagattctgagattcacacacattgttgtaccatagatactggatttgtg

SEQ ID NO: 14503 - DNA, 201 bp, Homo sapiens
agttgctcggactacaggtgtgcaccaccatgcccagctaatttttgtatttttagtagagatggggtttcaccatgttgaccaggctggtcttgaactcmtgacctcaggtgatctgcctgcctcggcctcccaaagtgttgggattacctgcacccagcctagaatttcatatgaatacaattacacagcatacactat

SEQ ID NO: 14504 - DNA, 201 bp, Homo sapiens
acaaggtcaggagttcgagaccagcctgaccaacattagaaacccagtttctaaaaaaaataaaaaattagctgggcgtggtggcacgcacctgtaatgcyagctaccaggaggctgaggcaggagaatcccttgaacccgggaggcagaggttgcagtgagccgagatcacaccattgcactccagcctgggtgatagag

SEQ ID NO: 14505 - DNA, 201 bp, Homo sapiens
cgatacacagtcaagttttatgcttaaggtgtttattacatagaaggagagacaagccacttggctgggtgtggtggctcacgcctgtaatcccagcactytgggaggctgaggtgggtggatcacaaggtcaggagttcgagaccagcctgaccaacattagaaacccagtttctaaaaaaaataaaaaattagctgggc

SEQ ID NO: 14506 - DNA, 201 bp, Homo sapiens
ctgttcaatgaagaggagtgtaccaattcaagacaagggaagcctaagtatttattccaaaatcttttcaagtaatcctgtaatgggacttttggggatgsctttataccctagaaagcatttaaaacttgaaactcttgcctaatttctaatgtcgaaaggacaattcagcattcttactcacttttaattttgctttgc

SEQ ID NO: 14507 - DNA, 201 bp, Homo sapiens
agggttttaccatgttggccaggctggtcttgaagtcctgaccttaggtgattcgcccgcctcggcctcccaaagtgctgggattacaggtgtgagccacygtgcccagcggggtttttactttttaaaaggaattatagtaaatgtttttgtaaagcaagtaaccattactacttcatgtgctttttttgaatgactatt

SEQ ID NO: 14508 - DNA, 201 bp, Homo sapiens
agagtatacatccttcttaagtataaaatcttgacctaaaatatgtttccaaagactctttaaatttatttgatctttcaacaatactatctctaaatacraacacagatgtttacattcctcaagatgtaagtaattacaagtacttccctgtttagatatttaaagcagtttctttatccttcaaagatttatttaaaa

SEQ ID NO: 14509 - DNA, 201 bp, Homo sapiens
gttgctcagtttaaaaatcttttattcagatacacacatacacacagacacacaacatactctgagttcaatatataagtaaaattcccagcattcttaaytgttccaaaaccaaataaaagaaaaatccaagatgtaaacacctttagcctctgcaaattttacctgccactgatcaccaaatacacaacagcactgtga

SEQ ID NO: 14510 - DNA, 201 bp, Homo sapiens
caacatgtgcccaaggtggtcagagcagtttggttttgtacattctagggagaaatgagacatcaatcaacatatgcaagatgaatattggtttggcctgraaaggtgggacaactcgaggcaaaaggcggaaggactccaagcgggaaggtggcttccaggtcacaggtaggtaagagactaatggttgcattcttttga

SEQ ID NO: 14511 - DNA, 201 bp, Homo sapiens
atgtagaatttattttttgtaatgaaaaaataaattaaaaatattttttgaagactgaattggaatagaaggagactagagcagggaggtcaggttatggytaccaaacaacaaagaacgataatcttattccagaatgttggcaataaaattgaaagcagaaggcagttaccataccatggttccatgagtgtggaggtc

SEQ ID NO: 14512 - DNA, 201 bp, Homo sapiens
cctgaccaacatggtgaaactctgtctctcctaaaaatacaaaaattagctgggcatggtggcacgcacctgtagtcccagctcctcgggaggctgaggcyggagaattgcttgaacctgggaggcagaggttgcagtcagccaaaatcatgccactgcactccagcctggtgacagagcaagacttcatcaacaaaacaa

SEQ ID NO: 14513 - DNA, 201 bp, Homo sapiens
tgcttaggatgctgttgatgccatcatcattcgattctgctctactggactcttatcatcttcacaactgccacaatcatctctgctgtgccctgagcttrcaagattcaaagttctgggtgggagtatctgattgaccaaagtcacatgcccgcctgaaagctgccaggcaactgaagatggaatatcgacctgtactcc

SEQ ID NO: 14514 - DNA, 201 bp, Homo sapiens
aaactgctgaagttgtttattagatcaaagagcatttgggcagaggctatgcggttttctaggtatagaatcatgttgcctgcaaacagggatagtttgamtttctttcttcctatttggataccttttatttctttcttttgcctgacttccctggtcaggacttccagtgctatgttgaataggagtggtgatagggtc

SEQ ID NO: 14515 - DNA, 201 bp, Homo sapiens
gagccaccgcgccccacctttttttttttttttttagatggagtctcgctctgtcgacaggctggggtgcagtggcgccatcttagctcactgcaacctcygcctcccgggttcaagtgattctcctgcctcagcctccaagtagctgggactacaggcgtgcgccactacgcccagctaatttttgtatttttagtagag

SEQ ID NO: 14516 - DNA, 201 bp, Homo sapiens
tccaccgctgatgggcatttaggttgattccatgtctttgttattgtgaaaagtgctgcaatgagcatatgggtacatgagtctttatagtagaatgattyatattcctttaggtaaataaccagtaatgggattgctaagtcaaatggtaattctgctttaagttgagaaatcgccaaactgctttccacaatgactgaa

SEQ ID NO: 14517 - DNA, 201 bp, Homo sapiens
agtaggccctggtgtctgtgattcccttctttgtatccaaatgtactcagtatttagctctcacttaaaagtgagaacatgcagtatttggttttctgttmctgtgttagttcatttactaaatgactcccagctccatccatgttgctgtaaaggacatgatctcattcttttttcatggctgcatagtattccatggtg

SEQ ID NO: 14518 - DNA, 201 bp, Homo sapiens
gtgaaggagtaagccctgaaggtcctggcaaggaagagtggtacaggcgagggaatagcaagattgttttgtgtactccagaaaacgccagaaggccagcrtgggtaagggaaagtgaacaatggggatgtagtaggagaagagatagggcctttcataatgtgatggagattttggattttattataagtgagatgggaa

SEQ ID NO: 14519 - DNA, 201 bp, Homo sapiens
ccagcctgggcgacagagcaagactttgtctctaaataaataaataaattctcacttaaaattaagtatagagtcttagatgaagctggtataagaagctytgaaacacgcttcacagtaaaccagcctttgaaaattcctaatatttcattcattatcttgctcccagagggtagactgaggcaggtaaaatcttaactt

SEQ ID NO: 14520 - DNA, 201 bp, Homo sapiens
gctgggccctacggcttctttaagtagcagatattccataaaaatctgatgaaatcaccttccctgttccatttcaatcttataattaaaatgaccattcraattaatcctttccccaaaagataaacaagaatattttttcttctaagaggataagatgaaataacaggcataaaataagtttttccctcttccttaacc

SEQ ID NO: 14521 - DNA, 201 bp, Homo sapiens
gccattctcctgtctcagcctccccagtagctgggactacaggcgcccgccaccacgcccagctaatttttttttgtatttttagtagagatggggtttcmccatgttagccaggatgatctcgatcttctgacctcgtgatccgcccgcctcagcctcccaaagtgctgggattacaggtgtgagccaccacgcccggct

SEQ ID NO: 14522 - DNA, 201 bp, Homo sapiens
atcaggaaaaaataaattccattcagttacatttgtatatatactttgtatttcacttctcacttggtctttgtctaagttgtgtcctctgcttataaggsccaaatctcagctattcttacagtccagctaaatgtcacttttttttttttttttttttttgagacaaagtcttgctctgtctcccacgctggagcgcag

SEQ ID NO: 14523 - DNA, 201 bp, Homo sapiens
gtggtggcgcattcctgtaatcccagctactcgggcagctgaggcaggagaatcgcttgaacctgggaggcggaagatggggtgagccgagatcatgccaytgcactccggcctggcaacaagagcaaaactctgtctcagaagaaagaaaagaaaagaaaacaaaagaaaagaaaaaagaaaagaaagagagtttcaaat

SEQ ID NO: 14524 - DNA, 201 bp, Homo sapiens
ttacaggaaaaaactagaaaaaaactatggacttccattttcacatttttcttgctgagaatatcccactcttgtctcatgcctatagttataaactgaaygttttcattatttctgttactccttccgattctgtctgtggctgtggaatgcttcagattaactggtagctaaaacttgcctgaattcagcatcacattt

SEQ ID NO: 14525 - DNA, 201 bp, Homo sapiens
aggagttcgagaccagccttgccaacatggtgaaaccctgtctctactaaaaacacaaaaatcagctgggtgtggtggtgcatgcctgtaatcccagctasttgggagactaaagtgagagaattcttttaatctcggaggcagaggttgcagtgagcagacattgtgccacttcactctggcctgggcaacagagcgaga

SEQ ID NO: 14526 - DNA, 201 bp, Homo sapiens
cagcaataaaataaactacagatatacactacaatatgaatgaatctcaaaatatgctgtgtaaaagaagtcagacaaaaaatagcacatactttatgatktcatttatatggaattctagaaaatgcaaactaatttaaagagatagaaatcatatcagtggttacctgggggaagggggtggtgatggcaggtaaaaag

SEQ ID NO: 14527 - DNA, 201 bp, Homo sapiens
ttcacagtagctttaatagccaaaattggaaacaacccaaatgtatatcaacaaatgaatggacaatctgtgataaatacaatggactgtaactcagcaawaaaataaactacagatatacactacaatatgaatgaatctcaaaatatgctgtgtaaaagaagtcagacaaaaaatagcacatactttatgatttcattt

SEQ ID NO: 14528 - DNA, 201 bp, Homo sapiens
agcactctaccaagtgagatggatgaatggcaaaagaaagatgcatactatcactactcattagggagatgcaaatgaaaacccatgagaggccgggcacrgtggctcacacctgtaatcccagcactttgggaggcggaggtgggtggatcacctgaggtcaggagttcaagaccagcctggccaacatggtgaaacctc

SEQ ID NO: 14529 - DNA, 201 bp, Homo sapiens
gaggggaaatccagttagagcctggtggactccctgagttgaggagacaaagatgacagtccaggttgaccaaggtgagtagagttggcagggcagagtgycaaatagaagagagcagcagagaaacaagatatggagatttgcaaagggttcccctcaagtcttcagctgagcactgattagtgcatgcatatgagaaaa

SEQ ID NO: 14530 - DNA, 201 bp, Homo sapiens
gacaatggatatcaggcaaagaaagacaatgatccctgacagaagataggcaaatgatgtaagccattaaatgtttgagcttaatgccctgggagaatttytaggccatgctgcagagaggggaaatccagttagagcctggtggactccctgagttgaggagacaaagatgacagtccaggttgaccaaggtgagtagag

SEQ ID NO: 14531 - DNA, 201 bp, Homo sapiens
atacaaaaaattagccaggcgtggtggcacatgcctgtaatcccagctactagggaggctgaggcaggagaatcgcttgaacccgggaggctgaggttgcrgtgagccgagattgagccattgcactccagcctgggcaacgagagggaaactctgtctcaaaaaaaaaaaaaagaacagacatatgatttgaatacacat

SEQ ID NO: 14532 - DNA, 201 bp, Homo sapiens
ctgagcgtggtggcacatgcctgtaatcccagctatgtggaaggctgacgcaggagaattgcttgaactgggatccaggaggcggaggttgcagtgagccragatcgtgccactgtactccagcctgggctacagagcgaggctctgtctcaaaaaacaaacaaaagaacaaacaaactgtattttatgtaatgaatttca

SEQ ID NO: 14533 - DNA, 201 bp, Homo sapiens
attctgactacacactaacaagggagtgttaactaagaaattagcacccttttttcttttcttttttttttttttgagacagaatctcactctgtcccccrggctggagtgcagtggcacaatcttggctcactgcaagctctgcctcccgagttcacgccattctcctgcctcagcctcccgagtagctaagtagctaag

SEQ ID NO: 14534 - DNA, 201 bp, Homo sapiens
ttccatttttaaaaagttcaaaactaagcaaaaccaatttacatttttaggagtacagattaagtgggttataactataaagaaaagtaagaaaataatcmccataaaaatcagaatggtggatactcttaaggggacggagagggttctgactgagggagacataaagaggggcttttgggatgctggcagtattgtatt

SEQ ID NO: 14535 - DNA, 201 bp, Homo sapiens
attcataatcattttcttaaatacaactaatttaaaatgaacctcttcagatacaatggtttctttatgatttttaaaaacggttaattcaaacaataaamaataatgtagtatgtacaaataatttgaccacagattcttatggaatgtcaaaatgaaaaaaaaaaaaacccacaataacgtactacaggagtttttttt

SEQ ID NO: 14536 - DNA, 201 bp, Homo sapiens
gaccaataaagctatcgcagtggttctgaagtaaaagattggaattcattcactgataaagtcaggttaacaattttagagaaaaattcataatcattttyttaaatacaactaatttaaaatgaacctcttcagatacaatggtttctttatgatttttaaaaacggttaattcaaacaataaacaataatgtagtatgt

SEQ ID NO: 14537 - DNA, 201 bp, Homo sapiens
agattacctctgcatcagtgccatacccctaatgtaagtaagctattttgcttctgtcacattattatcattgtggaccaataaagctatcgcagtggttytgaagtaaaagattggaattcattcactgataaagtcaggttaacaattttagagaaaaattcataatcattttcttaaatacaactaatttaaaatgaa

SEQ ID NO: 14538 - DNA, 201 bp, Homo sapiens
tattagttttcttaaaattttcataaaaataaatacaagacattaaaagattacctctgcatcagtgccatacccctaatgtaagtaagctattttgcttytgtcacattattatcattgtggaccaataaagctatcgcagtggttctgaagtaaaagattggaattcattcactgataaagtcaggttaacaattttag

SEQ ID NO: 14539 - DNA, 201 bp, Homo sapiens
ttatttaaaatatttaaaactattagttttcttaaaattttcataaaaataaatacaagacattaaaagattacctctgcatcagtgccatacccctaatrtaagtaagctattttgcttctgtcacattattatcattgtggaccaataaagctatcgcagtggttctgaagtaaaagattggaattcattcactgataa

SEQ ID NO: 14540 - DNA, 201 bp, Homo sapiens
tgagctactgctcccagcctcaacttatttaaaatatttaaaactattagttttcttaaaattttcataaaaataaatacaagacattaaaagattacctytgcatcagtgccatacccctaatgtaagtaagctattttgcttctgtcacattattatcattgtggaccaataaagctatcgcagtggttctgaagtaaa

SEQ ID NO: 14541 - DNA, 201 bp, Homo sapiens
ggcgtgatctcggctcactgcaagctccgcctcccgggttcacgccattctcctgcctcagtctcctgagtagctgggactacaggcgcccgccaccacgsccggctaattttttgtatttttagtagagatggggtttcatcatgttagccaggatggtctcaatctcccgacctcgtgagccgcccacctcggcctcgc

SEQ ID NO: 14542 - DNA, 201 bp, Homo sapiens
aaaaacttcaggaacttttattatatgctccacaagaaggaaaaaaaaattgttctaaaaaaaagtttaaagaattttgttaatttcttttttcttttttytttttttttttttgagacagagcctcgctctgtcacccaggctggagtgcagcggcgtgatctcggctcactgcaagctccgcctcccgggttcacgcca

SEQ ID NO: 14543 - DNA, 201 bp, Homo sapiens
ggaaaggagttggtacatggtaaacaataaatgctagttaaattggagtttaagtaggaatgtgcaatttgaaaaagtagaaagcataacattttcacatsctaaatgtgcctaatgtgccaacctaaaaccagaaatacaatcatataaaaatatactaagggccgagcacaatggctcatgcctgtaatcccagcactt

SEQ ID NO: 14544 - DNA, 201 bp, Homo sapiens
aattaaccagtcccttccaacatttcaatgtctggagtgttctaggttacattttcctcctctgccacaaagccatctttaattaccccttcaaactacargttttcattatttgtgaaagaagctaataagcaatttctattcagagatcaacagtgatttaattttttttttttttttgagacaggggtctcactctgt

SEQ ID NO: 14545 - DNA, 201 bp, Homo sapiens
taaatgagagcaggcaaaataatcacaagcaagttggcagtagtattaacaccttggtaccaaagacatatatttacaaaaagttgtcagatccatagacrttatgataattttatttaatcagtatttattaacatgattaggttcactctttgtccttaattcccagcaggatttcggtctgcctatctttaggaagtt

SEQ ID NO: 14546 - DNA, 201 bp, Homo sapiens
tgggattacaggcataggccaccacacctggccatattcttttaaaataattaaacaacatgaaaaatactttatggagccatataaagcaatataatcarctgttccaaagatactaaaacctacaaaaaccctaggttgtagtaatggatgttactttacttgtttgtccataatgcatcttcattaggagggcagggg

SEQ ID NO: 14547 - DNA, 201 bp, Homo sapiens
ttcactgtatgtctttttatgttttctgatttacaaaccttgtgattctgctacctaattgaaaaaaataatattcaaattttcctccaggaattcttttktttttttaattaatacttctttaatgtaaaaaaaaaatccagataaattgtgcatctttatcatatgttgttttgtcggaaggggtcaatgaaacattgg

SEQ ID NO: 14548 - DNA, 201 bp, Homo sapiens
tatggattctggggcagtgattcttctgttcaaattctatttctccaaagttgttttagctaattttggtcctatgacttctgggattaccctgtgaagtkttttttttttttttttttttttttttttgagacagagtcttgctctgtcacccaggctggagtgcagtggtgcgatctctcactgcaagctccgcctccc

SEQ ID NO: 14549 - DNA, 201 bp, Homo sapiens
ggttttatattttaaagtagtaaaagttatgatatttatcattatgttttaaaaaacattgattagaaaaggtcttcattatacttgtaaaagtattttakagtaataataataacactaggccgggcctggtggctcacgcctgtaatcccagcactttggaaggctgaggcgggtggatcacaaggtcaggagattgag

SEQ ID NO: 14550 - DNA, 201 bp, Homo sapiens
aagagatgttaaaatgggccggcatgatggcttgcgcctataatcccaacactttgggaggccgaggtgggtggatcatttgagatcaggagtttgagacyagcctggccaacaaggtaaaactccgtctctactaaaaatacaaaaattaggccgggtgcggtggctcacgcctgtaatcccagcactttgggaggccga

SEQ ID NO: 14551 - DNA, 201 bp, Homo sapiens
aacacttaggagctgtaaagtttgatctttaggaaagaaggacagtgtcagtaacactatcatcatcctgctttttgatgccatcccagcaattcaacttytagattagggtgtttttaaaaaaatatatactattatagaagagacagacaccataaagaaaggggataacaagctattatggaagagagagatatcaga

SEQ ID NO: 14552 - DNA, 201 bp, Homo sapiens
ctacctgaaaaggtataagggttcttttctttctttctttctttttttttttttttttttttgagacgcagtctcgcactgtcgcctaggctggagtgcarcggcgtgatctcggctcactgcaagctctgcctcccaggttcacgccattctcctgcctcagcctctccgagtagctgggactacaggtgcccgccacca

SEQ ID NO: 14553 - DNA, 201 bp, Homo sapiens
tttagataaacactacctgaaaaggtataagggttcttttctttctttctttctttttttttttttttttttttgagacgcagtctcgcactgtcgcctargctggagtgcagcggcgtgatctcggctcactgcaagctctgcctcccaggttcacgccattctcctgcctcagcctctccgagtagctgggactacagg

SEQ ID NO: 14554 - DNA, 201 bp, Homo sapiens
cattatgtgtttataatcacttcctcagggaaaccttccctgacctctcagactaggtctcctattagattttgtcattgcaaattatattttttgctttyttccacatatcacagccctagttatttgtgtaatttttttgagacagggtcttactctgtcacccaggctggagggagtgcatctcagctcactgcagcc

SEQ ID NO: 14555 - DNA, 201 bp, Homo sapiens
ttgctctgttgcccaggctggagtgcagtggcgtgatcagctcattgcaacctcaaactcatgggctcaagtgatcctcctcccttagcctcccaaagtgytagtattacaggctaattctcgacaatcctttcaggtttcatctcaaatataatttcatttctacatgaatttaataagtatgtattcaggattcattat

SEQ ID NO: 14556 - DNA, 201 bp, Homo sapiens
ttttcttggtctggacacccctctcccttttgctccctaaactttatctgggtacatctttttgtgtatgtgtgtgtgtgtcggggtcttgctctgttgcscaggctggagtgcagtggcgtgatcagctcattgcaacctcaaactcatgggctcaagtgatcctcctcccttagcctcccaaagtgctagtattacagg

SEQ ID NO: 14557 - DNA, 201 bp, Homo sapiens
gtctcataaataaataactaaataaataaaaccacgtggaactaggaactcatcacgtaaccatcaatggcttcccatcattcttaggccaaagtccaaayccttaaacatagtctcttggacttcattatcatgggactggctacttccagagcccgattctgagaagtaacctatttttccctctctcatgctttacgt

SEQ ID NO: 14558 - DNA, 201 bp, Homo sapiens
atatgtatgtatgtatgtgtgtgtgtgtgtgtgtgtatatatatatatatatatatatatatatatatatatatatatacacttttttttttttttgagayggagtctcgctctgtcaccagggtggagtgcagtggcgtgatctaggctcactgcaacctctgcctccaggttcaagtgattcttctgcctcagcctccc

SEQ ID NO: 14559 - DNA, 201 bp, Homo sapiens
tggtggcatgcgcctgtaatcccagctacttgggaggctgagaggaaaatcacttgaacccgggaggcggaggttgcaatgagctgagatcatgccactgyactccagcctgagtgatggagtgagactccatctcaaaaataaaaaataaattaaaaaaaatgaaatatagtagtctctctctatatatagacagttaat

SEQ ID NO: 14560 - DNA, 201 bp, Homo sapiens
gaagctgaggtgggtggatcatttgaggtcaggagttctagatcagcctggccaccgtggtgaaaaaccgcttctaataaaaatacaaacattagccgggygtggtggcgcacgcctgtaatcccagctacccgggaggctgaggcaggagaatcgctggaaccagggaggcggaggttgcagtgagccgaaatcgtgccc

SEQ ID NO: 14561 - DNA, 201 bp, Homo sapiens
gattttaaatataattcaatatccctaacaaatctcaattcagacaggaaaaaaatgtattatgttgatttataaagcaggtaactttaataacgtatgtytggaacaaaatttatcaatttaattctatcagttattactaaaatttgaaatagtttttttttttttttaatttggtgcttgtagcttggaaatgaggga

SEQ ID NO: 14562 - DNA, 201 bp, Homo sapiens
ttagccctttaacttgcaaattagaaataacttagaaagattttaaatataattcaatatccctaacaaatctcaattcagacaggaaaaaaatgtattawgttgatttataaagcaggtaactttaataacgtatgtctggaacaaaatttatcaatttaattctatcagttattactaaaatttgaaatagtttttttt

SEQ ID NO: 14563 - DNA, 201 bp, Homo sapiens
aaattggccatgggctgggcgcagtggctcacacctgtaatcccagcactttgggaggctgaagcaggcgatcacctgaggtcaggaattcgagaccagcytagtcaatatggcgaaaccccgtctctactaaaaatacaaaaattagccaggcgtggtggttggcgcctgtaatcccagctactctggaggctgaggcag

SEQ ID NO: 14564 - DNA, 201 bp, Homo sapiens
ttaaaataagaggccaggcacagtggctggtgcctgtaatcccagcacttcgagaggccaaggcaggaggattgctttagcccaggagtttgagaccagcstggccaacacggtgaaatccccctactaaaaatacaaaaattagccaggcatggtggcgggtgcctgtaatcgcagctactccagaggctgaggcaggag

SEQ ID NO: 14565 - DNA, 201 bp, Homo sapiens
agctatgagattcagcaaatgattagatactaggagtagaacacacacacaatatgaaattgtttcaagtgattaaaataagaggccaggcacagtggctsgtgcctgtaatcccagcacttcgagaggccaaggcaggaggattgctttagcccaggagtttgagaccagcctggccaacacggtgaaatccccctacta

SEQ ID NO: 14566 - DNA, 201 bp, Homo sapiens
cagacacacacaaacaggctgataggagcctaaaaacaggtttacaggccaggcgcggtggctcatgcctgtaatcccaacagtttgggaggctgaggtgrgcggatcacctgagtttgggagtttgagaccagcctgaccaacatggagaaaccttgtctctactaaaaatacaaaattagctgggcatggtgacgcatg

SEQ ID NO: 14567 - DNA, 201 bp, Homo sapiens
aatggaacaaaatcctgaatggggcacatcactaagcgcttggctagttaagaagaccagtctggtcaaggcagtgtgtgtgtgtgtgtgtgtgtgtgtgwgagagagagagagagagagagacagacagacagacacacagacacacacaaacaggctgataggagcctaaaaacaggtttacaggccaggcgcggtggc

SEQ ID NO: 14568 - DNA, 201 bp, Homo sapiens
tgaggcaggagaattgcttgaacctgggaggcggaagtggcagtgagccaggattgcaccactgcactccagcctgggcaacagagaaagactccgtatcmaaaaaaaaaaaaaaaaaaaaaaaagaaaagaaagaaagagacaggaaaacaaactttcaaataccaatctgataaaaataccacttaaggaaataaaata

SEQ ID NO: 14569 - DNA, 201 bp, Homo sapiens
agaatgaaggaggcaagaacatatgaagatagctgggaggctactggaaaggtccaggcaagagagatggtagtagcttggacaaaggaagtagtgacaasactgagagaagcagacagattccaaagagaagaggtgactatgcaaatgtcactagtttgaattttaggaaaaaacattcttcacttgggattatagagt

SEQ ID NO: 14570 - DNA, 201 bp, Homo sapiens
gaaagtgacatttaagttaagatcctaataaccaatcccgcattgcacaaggaggagaagtaggaattaaccgagcaaaattgtggtcagggagggcttgkgggtagggagaacatcttggtggaagaaacagtatgtggaaagaccttggggaagggtggagcttgataaatttgaggaactgaaaggtgaccatggtgg

SEQ ID NO: 14571 - DNA, 201 bp, Homo sapiens
ggactacaggcgtgagccaccatgccccagcctcagctgtactttaaattagaacaatagagggcctctcttctctgatggcatccactataggagaaaaygcaaattatttattttaatagatatcatcgataacatttttatactggcgtggttggaaatatcttgcacacttgggctccctattgattgaagagaaat

SEQ ID NO: 14572 - DNA, 201 bp, Homo sapiens
cccagcctcagctgtactttaaattagaacaatagagggcctctcttctctgatggcatccactataggagaaaatgcaaattatttattttaatagatawcatcgataacatttttatactggcgtggttggaaatatcttgcacacttgggctccctattgattgaagagaaatccttttaatagcacagcatctagta

SEQ ID NO: 14573 - DNA, 201 bp, Homo sapiens
ctaaaagtacaaaattagctgggcgtggtcgtgcatgcctgtaatcccagctactctggaggctgaggcaggagaatcgcttgaacccaggaggcagaggwtgcagtgagctgagatcacaccactgcactccagcctgggcaacaagagcagaactctgtctcaaaaaaagaaaaaaaagaaaaagaaaaagaaaaatac

SEQ ID NO: 14574 - DNA, 201 bp, Homo sapiens
atttttgtatttttagaagagatggagtttcaccatgttggccaggctggtctcgaactcctgacctcaggtgatctgcctgcctcggcctcccaaagtgytgggattacaggcgtgagccaccacgcctggcctcagaatatatttgaatggacaagaatgtaacatatattttcagttgctattttagctctgaacgac

SEQ ID NO: 14575 - DNA, 201 bp, Homo sapiens
ctcctcccgtgttttcctttgttttatttttcttctttacctagaccatcaaatttcttttttacaaagcagtaactggcccgtaggtggcaccaaaggayggagagcccttcccacagacgaaagctctcccaggccaaggaaagccctttaaatgaggactttaattgaggtccaggagtcccaacaccaggcatttat

SEQ ID NO: 14576 - DNA, 201 bp, Homo sapiens
tgggaacaaaattcctctagttgagaactactacactggtttgttttgtatatgtgtgtgtgtgtgtgtgtgtgtatatatatatatatatatatatattwtttttttttttttaaggatcatgtctctaacagtcatagaccttttaaattagtctgaacatgatttatttcctattcctaatatgaagaggtgagtatg

SEQ ID NO: 14577 - DNA, 201 bp, Homo sapiens
aaatatacaaaaaatatgatatttacagttatatgtgcctgtgtgtcttaagtgtacactatgagttttaagaatacaccttttggtcaataaaataaaamataatagctgataactttttcatgcatatggtttaaaaagtgctttcacatataatttacctctttaatttttagaaggccttggattcctatggttctt

SEQ ID NO: 14578 - DNA, 201 bp, Homo sapiens
gagtgtccctactgtgtacaaaacactgcactagaagggtaataagcaacttcctgaacataaaacaagagcatggtggctgatgatgttaccctcttaaragatcaaagccaacttacaagattaataatatgtaggaatcaaaatgatgcatatgataaaagtggccacctcagcacttagaacaaatgaaatttatag

SEQ ID NO: 14579 - DNA, 201 bp, Homo sapiens
agggtgtgagtcagtttcagctcctctataagtcttatgtatggcttggggcaagtctcttaatctgtatttcaggtgtaaaatgaggatagcagtacacmttgtgaactatcgtagttgtaaagataaaatgaaagaccataagaaagtgcttcagaatacataaatgtcattatttttctctattcagaagggaataca

SEQ ID NO: 14580 - DNA, 201 bp, Homo sapiens
tagcattatttatttcaatgaaaagacaaatagcttttaaaaaattggacaggctagcaacttcatctcaaaggccttatattttgcacatacagcatatmcaaacacacacagacacagacacacacacacacacacacacacacacacacacacacacacaaaggttttttttttttttccatgccatacacaatgcta

SEQ ID NO: 14581 - DNA, 201 bp, Homo sapiens
tatttatttcaatgaaaagacaaatagcttttaaaaaattggacaggctagcaacttcatctcaaaggccttatattttgcacatacagcatatacaaacmcacacagacacagacacacacacacacacacacacacacacacacacacacacacaaaggttttttttttttttccatgccatacacaatgctaaaatat

SEQ ID NO: 14582 - DNA, 201 bp, Homo sapiens
tttatttcaatgaaaagacaaatagcttttaaaaaattggacaggctagcaacttcatctcaaaggccttatattttgcacatacagcatatacaaacacmcacagacacagacacacacacacacacacacacacacacacacacacacacacaaaggttttttttttttttccatgccatacacaatgctaaaatatct

SEQ ID NO: 14583 - DNA, 201 bp, Homo sapiens
ggcgtacaattttaaccaaatgatacgttcacaaattcttcttcaactcagcatcggtatggtcaccagagtgagtaaagctggaatttaatgtccttgaytgatttaatcaagcccatgcttcttgataggcaaagataattaatcttgttctaacgtccagtgaaaaaatagcattccctggaaggataataatggatg

SEQ ID NO: 14584 - DNA, 201 bp, Homo sapiens
aaggaagtcgtaaaatagtgacacacacataagcacacctttacacagcggggtgcggggggatgtatctaaaaatggctcttatccggtgatgagaaacstttgtatagactcccacactttctacgctgtggagaagggatcagcagacccaccactctcctttgttttgttcatttcaaaattattaaattattgtcg

SEQ ID NO: 14585 - DNA, 201 bp, Homo sapiens
tcacccaggttgaagtgcactggcaccatcttggctcactgcaacctctgtcctccccaggtttaagcaattctcctgccttagcctccagagtagctgarattacaggcgcgtgccaccacgcccagctaatttttgtatttttagtagagacagattttcaccatattggccaggctcgtctcgaactcctgaactctt

SEQ ID NO: 14586 - DNA, 201 bp, Homo sapiens
tccctttcttctatcttcggtgcctctgactctgccctggctccatctctactgcatttaaagatgaagaagcctgccttatatttatggatctctctacrtgctgcccactcttacttttccttcttaacccaatttctgaatcttaacataattattttttcctgtctccctcttatcaactcccatgaattatacaac

SEQ ID NO: 14587 - DNA, 201 bp, Homo sapiens
tgaggacacgtagtggccggtctcgtcgaacaaagtcatgctgattgagggaggaggaaaaaataaactgataatgaagaaatgtccttaggtgcaaggtmcagatataaaaggaaatagagaatcataaaatagttctatggatattacagaaataacaaaatatgattttcatgtcatgtgtccttccatattttgtaa

SEQ ID NO: 14588 - DNA, 201 bp, Homo sapiens
ggttcacatgtattgctgcaaatggcaggcccactttcttaagactatatataaaataaatattataaataaacaaatatataataaatatatataataawatattcagtcatatatattattgagtcttaaatatctatatcacatataccataatttcttttatcctttcatccactgatgaacacataggatgtttcc

SEQ ID NO: 14589 - DNA, 201 bp, Homo sapiens
tttttctttttcaaagtgagaaaatttgggccctgagaagttaggtgatttccatagctaattagtagaagagctacggctgcaactcaggctttaaaaawttttttctgccaggggtgtgggtggtggtggttattttctggtgtcctactaccataattatctttctaaaatacaggtatgatcattcattgcaacaga

SEQ ID NO: 14590 - DNA, 201 bp, Homo sapiens
gcctgtaatcccagctactagggagggcgaggcaggagaatcgcttgaaccagggaggcagaggttgccatgagccgagatcgtgccattgcactccagcmtgggcaacaagagcgaaactccgtctcaggaaaaaaaaaaaaaaaagaaagaaaatcacccgaaattctaccatctcgaaataaatacataaatattaag

SEQ ID NO: 14591 - DNA, 201 bp, Homo sapiens
taccttctactgtatttttccttttggaaatttgtgagacctatttaaaatgaagaacatacagcttctttagccatgcaaaataaataaataagtatttkgggaggggcctctttaaattcaatatttaccatcagcccttttaccagtttctccagtccctcattcattcttcctgcttgccttcctccctctttttct

SEQ ID NO: 14592 - DNA, 201 bp, Homo sapiens
aagcagtaatcaacaaatctcctaaaggagtctgtcctgtgtgtgcaaatacacaaaagaaaataaactcagggtctgtagagcacactgattacttaaarcaattttcattcaagggaaaattttgcatttaaggagattttaaaaaaatgttttggaatatcaggataactggagcattttcaagttacgatatctaaa

SEQ ID NO: 14593 - DNA, 201 bp, Homo sapiens
gcctttttcattttgattttttgacttctgacaaactcaaaatgtgcagtactgaatcagcttgcttgctttccttccttccttccttccttccttccttytctttctttctttctttctatttttttgagacagagtttcactcttgttgcccaggctggagtggaatggcgcgatctcggctcactgcaacctctgcct

SEQ ID NO: 14594 - DNA, 201 bp, Homo sapiens
tagttacgagcgtaataaatacctcccgaatgttctgctgctccacctcgtgccgcttgatcattattttccgcttgaagaaacgacaatttttgtcgtartacagtctctgttgagtgagaaggtgggcttcctcttcagcctgtgtgtgctgcaagttctctttatgtttggagatccgctcttgcttctctttcttgg

SEQ ID NO: 14595 - DNA, 201 bp, Homo sapiens
tgtgaccttcccccttatccccccaagccagtggttggcacactacagcccatgggccaaatctagcctggtgcctggttttgtaaatatatatatatatwtttttttgagatggagtctcactctgtcaccaggctagagtgctgtggtgtgatctcagctcactgcaacctccgactccctggttgaagcgattctcct

SEQ ID NO: 14596 - DNA, 201 bp, Homo sapiens
tcagcaattgttattgttgttgtccatcctatggagtaacaagtttaaatgacgggtcttcagctacaagacaaatttgaggccaggcatggtgactcacrcctgtaatcccagcactttgggaggctgaggcaggtggatcaccttaggtcaggagttcgagaccagcttggccaacatggtgaaactctgtctctacta

SEQ ID NO: 14597 - DNA, 201 bp, Homo sapiens
gaggctgaggcaggagaatggcatgaacctaggaggtggagcttgcagtgagctgagatggtgccactgcactccagcctgggggacagagcgagactgtytaaaaaaaaaaaaaatccactagaatttatttgttccaagctctacaagattaagaaaagaaacaaaaccctgtgtggattttacaaatttagaacattg

SEQ ID NO: 14598 - DNA, 201 bp, Homo sapiens
gggaggctgaggcaggaggatcacttgcatctgggaggccaaggttacagtgagtggcgatcctgccattgcactccagcctgggccacagagtaagcctytgtctgctaaaaaaaaaaaaaaaaaaaaaaagagagagagagagagagagaaatgaagaagtcttgcaatatttgcatatcaacttcagatactgtttct

SEQ ID NO: 14599 - DNA, 201 bp, Homo sapiens
ccaagagcaaaaaaatttttaatcaggttggaaagggaagaaaagtaaaggtgttatataaaattcattgtaggcacagtaaagtgactccttctcccccytgttttcttttgacatcatgtgacaattttaagagctcttttctcacagcagagaataaggaatatggattatgagaagaaaaattttttatgaaaagaa

SEQ ID NO: 14600 - DNA, 201 bp, Homo sapiens
tgaatgaatgattgcatcaatcaatcaatagaagggatgattaccaccaaatggttacaatacagtacaaaaggtgtttatgaaaacagaggaagtgggcygggcttggtggctcaggcctgtaatcccagcactttgggaggccgaggtgggcggatcacaaggtcaggagctcgagaccagcctggccaatgtggtgaa

SEQ ID NO: 14601 - DNA, 201 bp, Homo sapiens
gctgaggcaggagactcgtttgaacccaggaggcggaggttgcagtgacctgagatcgcaccactgcactccagcctggggaacagcagcgaaactctgtytccaaaaaaaaaaaaaaaaaaaaaaaaaaaagcctgtatggttgtaattaattgagcactcaaatttagttcttaaaacattttctttcccctctttgaa

SEQ ID NO: 14602 - DNA, 201 bp, Homo sapiens
ggaggctgaggcaggagactcgtttgaacccaggaggcggaggttgcagtgacctgagatcgcaccactgcactccagcctggggaacagcagcgaaactytgtctccaaaaaaaaaaaaaaaaaaaaaaaaaaaagcctgtatggttgtaattaattgagcactcaaatttagttcttaaaacattttctttcccctctt

SEQ ID NO: 14603 - DNA, 201 bp, Homo sapiens
tataaacccccttgcagtcggagtctagtctatgttatttttaaaaattgaaataaaatgtatactacatatgaaatgaaaaaaaattttttttttgagayggagtctcgctctgttgcccaggttggagtgcagtggcatgatctcagctcactgcaagctccacctccgggttcaagcgattctcctgcctcagcctcc

SEQ ID NO: 14604 - DNA, 201 bp, Homo sapiens
aggaggcagaggttgcagtgagccgagatcggcaccactgcactccagcctgggtgacagagcgagactccgtctcaaaaagaaaaaaaagaaaaagaaaraaataggtcgggcatagtggctcatgcctataatctcagcactttgggaggctgaggcaggtagatcacttgacgtcagcagttcaagaccaggctggtc

SEQ ID NO: 14605 - DNA, 201 bp, Homo sapiens
agggcgagactccatctcaaagagaaagaaaaagaaaatcaaatttaaaaatatcatggtagcataaaaaatgtgaaatatggccgggtgcggtggctcaygcctataatcccagtactttgggaggctgaggtgggtggatcacttgaggtgaggcgttcaagaccagcctggccaacatggtgaaaccctgtctctact

SEQ ID NO: 14606 - DNA, 201 bp, Homo sapiens
gatatatgtgttatttacatttagatcttaaaatatttccagaataatattattataatactattgataggctaggtgcagcggctcacgcctgtaatccsagcactttgggaggctgaggcaggtggatcacctgaggccaggagttcaagaccagcctagtcaacatggtgaaaccccatctctactaaaaatacaaaa

SEQ ID NO: 14607 - DNA, 201 bp, Homo sapiens
caggagtttgagaccagcctggccaacacggtgaaatccccctactaaaaatacaaaaattagccaggcatggtggcgggtgcctgtaatcgcagctactycagaggctgaggcaggagaattgcttgaatctgggaggcggatgttgcagtgagccaagatcgcaccactgcactccagcctgggtgacagagcaaaact

SEQ ID NO: 14608 - DNA, 201 bp, Homo sapiens
tataacctcaaaatcctgggctcacgtgatcctcctgcctcagcctcctgagatgctgggattataggcgtgagccaccatacccagctccacattttttycccttttatggtagtaatttttatgtcttggttttttgtttgtttgtttttaagatctttgtgtacttcaaggtaataaagatattattgtgtgtttctg

SEQ ID NO: 14609 - DNA, 201 bp, Homo sapiens
cttcttcctatccccttggaatgggtagtacacaatgtggtaagaggaagggcataaataagatcggtggatttcatccctgtgttccctggtactttctraatacttctattattataacgctgattttattatctatacataatgccatgtgttgttgtatctctttccatgatcactttctggtgaagctatgaatga

SEQ ID NO: 14610 - DNA, 201 bp, Homo sapiens
tgtactatcaataaataaaacatgcagtataaaatatctcattgtactctgttttgggacatttgaaaccccagttagaaattaaaaagtcatctgggctytacagctcacacctgaaatcccagcaattttcccggctgaggcaagcagattgcttgagctcaggagttcgagaccagccagggcaacatggagaaaccc

SEQ ID NO: 14611 - DNA, 201 bp, Homo sapiens
gcagtgagccgagatcgtgccactgcattcaagcctggtgatgacagagcaagactctgtcataaaaaaaaaaaaagctcaaaaagcattttgattttatkgcttatgtctgagaacaacaaaaaaagaatcaatggattaaatcaaagatatacctttttggagactatacgtaaaagggaaattatgagactatcttta

SEQ ID NO: 14612 - DNA, 201 bp, Homo sapiens
aaaaaagctcaaaaagcattttgattttattgcttatgtctgagaacaacaaaaaaagaatcaatggattaaatcaaagatatacctttttggagactatmcgtaaaagggaaattatgagactatctttaagaaaatcaaaaagacctatgaactaaacttatgataattaaaatattttcaatcaccaaaacacattat

SEQ ID NO: 14613 - DNA, 201 bp, Homo sapiens
gtaaagatgcaattcataaaataatctcatttggaaggacaactaaagataagccctatccagatggcagaacataaaggaccacttaaaatggaagagtmagtaatgtttgattacaaagaaattatttgattacaagtttggagaagtaggtaataattagtacttaatttattatttgctttaatggactattatgct

SEQ ID NO: 14614 - DNA, 201 bp, Homo sapiens
tactaacttgtttatttcagtttaggtatacaactgtctctatctcacctcatgggtctgcttcccactataggacatcttcttaattgccaccacctcaytggtgtgagcatttgtagcctgtgttaagagggtagaagaaaaagaaaaagaattagtgatgtttcagccaatttaacttaaatatttgactagagacta

SEQ ID NO: 14615 - DNA, 201 bp, Homo sapiens
gaaaagattggtaacatgtttctctagaagttaatggagggagggaggttgcagggaggagagtgtggttgtggtagagaaaatacaaggcagagaaaagycctagaataggagtcaagaaacttgagtttcaatccttaacatattacttaaattctgtgaaactctgggcaagttaagtctttctgagccctggtctct

SEQ ID NO: 14616 - DNA, 201 bp, Homo sapiens
tgtacttttgcaattttatttgttcaccaaatattcaatgttatgattttgagatttatccatgatgatacatgtagatccagttcattcttaactatgayacagtattccataatttatacattctcctttggataagaatttaggctagttctaccttttctggctactataaaaacagttgcacccttgtacacattt

SEQ ID NO: 14617 - DNA, 201 bp, Homo sapiens
acaaaagaaaataaactcagggtctgtagagcacactgattacttaaaacaattttcattcaagggaaaattttgcatttaaggagattttaaaaaaatgytttggaatatcaggataactggagcattttcaagttacgatatctaaaattcttttggataatgagtgaggacaagtttcaagttagtcaacatattaat

SEQ ID NO: 14618 - DNA, 201 bp, Homo sapiens
tactctatatagttatcatacaccttcactgcctgaggatttggcaacaacctaactgaaaatcccagagttggtgtttgaaccaccggccagctctgtcytgagaccactggattaatgtttatgcagatgttaggcccaggaacatcacaatgatgactagagcaaggaggagaaatattatttgttataaggcaaaaa

SEQ ID NO: 14619 - DNA, 201 bp, Homo sapiens
ctatgtaaatgtctactctatatagttatcatacaccttcactgcctgaggatttggcaacaacctaactgaaaatcccagagttggtgtttgaaccaccrgccagctctgtcttgagaccactggattaatgtttatgcagatgttaggcccaggaacatcacaatgatgactagagcaaggaggagaaatattatttgt

SEQ ID NO: 14620 - DNA, 201 bp, Homo sapiens
aggttcctgaagaactaccagtctagagatgtggtgatgttcttgttattgaaaaaagtagtgtggcaacactagccagggggaaaaataagtacctaaartttattttgtcagaatatgcctttagccttatcaaatcattcttgctcaaaaagaagactggattgggccagtcgcagtgcctcatgcctgtaatcccag

SEQ ID NO: 14621 - DNA, 201 bp, Homo sapiens
gcctctgcataaggctgtgggctttttgaaggcagagtaaatgtcgtttgaaaaatcttagtctccctagcacctggcatagtgcttgatacttagtaggyattcagtaaatgtttgctgaataaacaaacacaagaatataggtctgaggagattttgagaaaatgacattttcttttggattatttaacagaattcaaa

SEQ ID NO: 14622 - DNA, 201 bp, Homo sapiens
ggtggcttataaaacttgtaagtttttaaaacttataagaaaatatttgaaaggtcagttaaaattattctacatgatttctcgcgaaatttgaactcctrttttacagggaagagcgagaacgtgtgtaattgggattcattcactaggcttaaggttctaaagaggaaggcactgggacctgctaccatttacattact

SEQ ID NO: 14623 - DNA, 201 bp, Homo sapiens
agaggtcaggccgcgcaggtctcttgatcattccaagatctttgtcctgcagccagccccaccagcccctccagctcctccagcccatgcgtttcacttcrgagatgtttcatgacataatccggctccggagtccccccggagtcccgggggctcacactccaccctcagggaggtcgctgatgccagaccctgggagca

SEQ ID NO: 14624 - DNA, 201 bp, Homo sapiens
ctgtcccccaactcccaccccctattgcttcccactatttgtttcaaccttttaatagatacacttgcctcccaccaggacacacagtgtctggtttaaawaggtttatctctctccttagcttgtcctggaattacgcctaaagctcaatcctggcagcttttaggataagaaatctaattggagagagctcttagtttt

SEQ ID NO: 14625 - DNA, 201 bp, Homo sapiens
tccctaaacagtgcttctcctctacttattattaccctgataaaaataacttcagtaatttttgtcttggatttacatagcagttatatgtaaggcatctrcattatatatttaggaaataatacaacattcctttattcctcttagttgaaactgcctatattgaacactggcaaaagacttctaataaaacacattcta

SEQ ID NO: 14626 - DNA, 201 bp, Homo sapiens
ttatttctgaagaaaagatatgggataagaattagctaaatacacaatattatgtgtgtttttgtgaggggggagaaaaaaaataatttcttttttttttytttttttttgagaacgggtctcactcttgttgcccgggtctcactcttgttgcccgggtctcactcttgttgcccaggctggagtgcagtggcgcgttct

SEQ ID NO: 14627 - DNA, 201 bp, Homo sapiens
aaatggcctcagattaataacctaagtttctaccataagaatcctagaacaggaagagcaacataacccaaagtaagcagaaagaaagaaaaaataaagamcagaaatctattaaattgaaaacaggagaaaacatgagaaaaatcaatgaaatcaaaactagttatttgaaaaaaaaatcaataaaatttgtaaacctgc

SEQ ID NO: 14628 - DNA, 201 bp, Homo sapiens
gagatatgggaacagacagattttccttaactatgatgacctctcaaaatatttggaaaacacagcattttttttctacaagtgaaaattccaatatcacractaccattttgtaaacttcataaatgcacacagatctcaggggaagatgagtggaaccgtgcactattctatcttcagtaccaccactccattttgact

SEQ ID NO: 14629 - DNA, 201 bp, Homo sapiens
tagtgcagaatattagtcactcaagacatgttggataaatgaataaaaaatggaggaacaactattcaatgctgataactgataaacttggtattaaaaaragatatgggaacagacagattttccttaactatgatgacctctcaaaatatttggaaaacacagcattttttttctacaagtgaaaattccaatatcaca

SEQ ID NO: 14630 - DNA, 201 bp, Homo sapiens
taagaatccaaaagaactagtatctattcagataataatatttacactgaatattagtagtactcccagtcactcaggaggctgaagcgatccttccggtwtgttatgggggaaaaatagtaacaataatgaagactataagcacgcaccaccacaaccagctaatttttaaattttttgtagagatgggctctcactgtg

SEQ ID NO: 14631 - DNA, 201 bp, Homo sapiens
cattgttgtaccatagatactggatttgtggacggactagatttagagtttgaaaaaacgtaactgaggatgattcctcaaggcttttggtcagagtgacyggaaaaatggaactaacatcaagtaagatagagaatgatccaggtgaagaggctggggaaagattaggaattaagcttttgatatattgaggatccaagt

SEQ ID NO: 14632 - DNA, 201 bp, Homo sapiens
agaaaaatccaagatgtaaacacctttagcctctgcaaattttacctgccactgatcaccaaatacacaacagcactgtgagagctctgtatttataactkttgactccctcctacaggattacaatgccaggcactggagataacagaacatgcagaaataaaagcttagaaaataaaccttcatacagctaatgaagga

SEQ ID NO: 14633 - DNA, 201 bp, Homo sapiens; identical to SEQ ID NO: 4631

SEQ ID NO: 14634 - DNA, 201 bp, Homo sapiens
gctcacaattcctggcttatattttatttcccttagaactctgcaaacactgttctattgttttctggctttgactgttcctgaagaggtaggtctggagycagttggtttttccaccccaaaataaactttttcagtctgcttgtatgaatctttctttattcctagagttcagggacttcaccaggatatgatttactg

SEQ ID NO: 14635 - DNA, 201 bp, Homo sapiens
ttatttaccaaatgagccatcatttccccattgatctgtaacggcttttgtgtcttataccaaaatctgactcatactagagtttcctagtctgttctacyggatactagtctttccctgcaacaataccatatggatttaattaatatggtatggattctggggcagtgattcttctgttcaaattctatttctccaaag

SEQ ID NO: 14636 - DNA, 201 bp, Homo sapiens
aggctggagggagtgcatctcagctcactgcagccttgacctcctgggctcaggtgatgttcccatttctgtctcctgagtagctgggattataggcatgwgccattaagtccagctacttttttggctttttttttttttttttttttttttttagagatggggttttgctatgttgcctaggctggtctcaaactcctg

SEQ ID NO: 14637 - DNA, 201 bp, Homo sapiens
agtgcatgcaaaagaagtaaagcctttttttttttcatcattttttattgtaagaaaatacacagtttgaaagtgtgaataatgcaatatttatgaccaaraaatgggacttaggaaggggaagggagataaagaaaaagatcaagatgatctgattgagagacagtgttgaactccaaatactgaactggaaaaggaggg

SEQ ID NO: 14638 - DNA, 201 bp, Homo sapiens
aaagcatctcctaacaggcacccacgtgcacgcgatacacccataggcacacatatgacatgcacacacacataggcacacacatgaagtgcgcgcgcgcrcacacacacacacacacacacacacacacaggaactacgggaggaccgaggaaggctggctgagtcctgtgatcaatgcatctaaatcattatatttaaa

SEQ ID NO: 14639 - DNA, 201 bp, Homo sapiens
tggaggtaggctcctgggcttgaattacagctacaccatccactttgtgtgtgtcacaccttggcacattacctacctctctagatctcatgtgtttcatyctcaagaaaataacaagaatagttcctattgcctgagattggtgggaggattaaatgaaagaattaatataaaatcctaggcacagttctcaatgcatta

SEQ ID NO: 14640 - DNA, 201 bp, Homo sapiens
cggtttcaactgatcatgtccttatttcaagttctttaaccctaaaatcatttagatatgcttagctctaaaaaattgattccaatttccataaaacttgrggaatataccacagtactgttatgctccaagtagtaatgttggcacctattgttggctataaaagttacattgctagccagccaatccaaaactccaaat

SEQ ID NO: 14641 - DNA, 201 bp, Homo sapiens
tatctgtcttcctcacttgactgtgggctccctaagggcagggactcttattcatttgtgcctgatattagttgcggggagggcagtcagtaaaatctttsataaatgaacacatggtatcatatgtggtatctatcacatttgccctcaaagtccctatgtgccacaggtctgatgtggcatgtcactccttgagttcca

SEQ ID NO: 14642 - DNA, 201 bp, Homo sapiens
agagaaggtagagtatattattttgagcccagaaggcattccatcaggttgccccacagtcatgtgtgcacttcacgaacactctgaggacttatggtgayagaaatcattgcttagcttaggatttgactgaagagacgcatagccagtgtgatccaggttggcctcatatctgtggcaacactgacaacgtcctcccgg

SEQ ID NO: 14643 - DNA, 201 bp, Homo sapiens
ttgagcccagaaggcattccatcaggttgccccacagtcatgtgtgcacttcacgaacactctgaggacttatggtgatagaaatcattgcttagcttagratttgactgaagagacgcatagccagtgtgatccaggttggcctcatatctgtggcaacactgacaacgtcctcccggatatatagcaatggcttagtac

SEQ ID NO: 14644 - DNA, 201 bp, Homo sapiens
tataatataaatttatatataaaatataaatatataaaatataaaatatctgtgttataagtaaaatataaaataagtaatattttataagaataaaccamaattttacttataacactgagaccattgtagcaactcctcagttatgaccctaaaggtactatgacctctaaaagtagcataattttatatggcctaaaa

SEQ ID NO: 14645 - DNA, 201 bp, Homo sapiens
aaatctgatgtgatgatgatcttgaatcatcataaaagggtatatgtagtttgtacaattgaagaagattggaaagggaagaatccatgtcaaatttcggmaagattttggtaagaaaaaaacttgttaagaaaaaacttggtaagaaaaaactagttaaaaaatgggtaggcactaacagtaaaattcaacacaagtggc

SEQ ID NO: 14646 - DNA, 201 bp, Homo sapiens
gctcttttttttttttttcctttttttgcaaaatgactcccccttatctggaatcagagagagtgttgaataaggcataagcacatgacccaatcaagttmtatctctcctaggaattttaatctcgaacagaaacgatacaaagacaaaaagtggttggaggaggtacactgaaatggcagtgcctggagaactgcacat

SEQ ID NO: 14647 - DNA, 201 bp, Homo sapiens
acatatgtatatagaaaaaaacctagaaatatacatgccaaattaatggagactgtttgagggtagagattgggtggaatgggattgtcgaaaaggtgaaratgggctgatgctggtcaaatggtagaaagttccagttatgcaagacgaataattactggagctctaatgcactcactgcatggtgatgatagttaacaa

SEQ ID NO: 14648 - DNA, 201 bp, Homo sapiens
aaaacctcatctatctcttactatataattgaccttgggcaaattacttaacctcttaaagtctctcagtttcttaatgtgtaaagagagaggaactaccmctgtcttcctcagggtcggaggactttctcatgtgaaagtgcctagcagggtgtctgactcctaggaaatgctcaacacatgctggtttccttccttctg

SEQ ID NO: 14649 - DNA, 201 bp, Homo sapiens
tactatataattgaccttgggcaaattacttaacctcttaaagtctctcagtttcttaatgtgtaaagagagaggaactaccactgtcttcctcagggtcrgaggactttctcatgtgaaagtgcctagcagggtgtctgactcctaggaaatgctcaacacatgctggtttccttccttctgatgccaggctctgcgaag

SEQ ID NO: 14650 - DNA, 201 bp, Homo sapiens
ttatacaattgtaataaaaagttacaatgctaaagttttctcaggatttcatctggtatcaaagtttatagtccttccttatcctttgttacaaatccaastgtgcagcagtgcataatacaaaaatctcagttataaggtgccaaaataataaagacatgtagcaatacagacccaatgcccatgggcttcttcatatac

SEQ ID NO: 14651 - DNA, 201 bp, Homo sapiens
aattcaacttaatattacagtgccagaaaagcaagcagctcttaaatgccagtaatcaaaagagatatgctaggtagaggcctgtgattttataggaggcyttaacaagtcgtagttttggtgaatattaattggctaacttaccaagtacattgatagagggggagacctcaaatacatgggcaacagttcagtttcaca

SEQ ID NO: 14652 - DNA, 201 bp, Homo sapiens
taggtagaggcctgtgattttataggaggccttaacaagtcgtagttttggtgaatattaattggctaacttaccaagtacattgatagagggggagaccycaaatacatgggcaacagttcagtttcacattgtaataacttgatttataaggataaccaatgacactagaatccacattctccacagggcagaccaaaa

SEQ ID NO: 14653 - DNA, 201 bp, Homo sapiens
aaaaagaaaaaaagaaaaaaaagaattttttaaaaactgattttttaaaaagtttaacatttttgatttaaaatttatgaaaatatgtagataaaggcagyattatgctgtagctagcacatactggctttggaaggcccattgtgcacatctttccccattttcacatttagtgaatagcattggctatagtaagagtat

SEQ ID NO: 14654 - DNA, 201 bp, Homo sapiens
ataatgaaagttaatttaaaaactgctgaaaccaactaaacaaccaatcaaggaactaagaatactaggtgaataaatattctgatctacccgaacttggrctgaatttttgtcatctggcactaattgatttttataattttcatcatctcagtttttattatttcttgtttgaaattggcctaaagattattgggggac

SEQ ID NO: 14655 - DNA, 201 bp, Homo sapiens
tttaaaataatatctccatactgcagtatcacagttcaaagatgcttcactttttgataggctaaatagacatctccactcccattttaatgtatagtttmtctatattcttttctggatacatgtaaagattgtaatataaaaaatgattagggtttaatatatcaaaccaaacaaaaaatgtcatattcccaaatgacc

SEQ ID NO: 14656 - DNA, 201 bp, Homo sapiens
tttcaccatattggccaggctggtctcgaactcctggcctcaagtaatccgcccgcatcagcctcccaaagtactggaattataggcgtgagctactgctsccagcctcaacttatttaaaatatttaaaactattagttttcttaaaattttcataaaaataaatacaagacattaaaagattacctctgcatcagtgcc

SEQ ID NO: 14657 - DNA, 201 bp, Homo sapiens
ctcgaactcttgacctcgtgatccgcctgcctcagcctcctaaagtgctgggattacaggcgtgagccactgcgcccagccgaaattagcacccttttcakccagaaaaatcttttattgtatttaatgacaaaatatacttcagtgggagccaagttattgatggtagtgagggaagcagaagtaatggtagggctgagc

SEQ ID NO: 14658 - DNA, 201 bp, Homo sapiens
cgaactcttgacctcgtgatccgcctgcctcagcctcctaaagtgctgggattacaggcgtgagccactgcgcccagccgaaattagcacccttttcagcmagaaaaatcttttattgtatttaatgacaaaatatacttcagtgggagccaagttattgatggtagtgagggaagcagaagtaatggtagggctgagcat

SEQ ID NO: 14659 - DNA, 201 bp, Homo sapiens
aaaaaacgagaagaaaaagaaaccaagaaaaaaaaattcaaaaaaagaggtaaagaggaaagggaaaagaaaaagaaagaaggaaagaagaaagaggaggrcaaaaaaaaaaaaaggtagaaagagccagaaaggggcagaaggttaaaaaggcaatctcagtgaacgatgatcctttggtttgacagtacccatttatct

SEQ ID NO: 14660 - DNA, 201 bp, Homo sapiens
gttttgaatctactgctctgacagccactaccaccagccttgtccatatcctatttcctgctactagtctcttctctctaatcctgtgtttctcaagcagtttttttttttcatcattgcccctataaggaggctttctaggctttttctcccttaattatccccatcactgaaatattaataccacaggtaaactgtgta

SEQ ID NO: 14661 - DNA, 201 bp, Homo sapiens
tttttgtttttattgttgttttttttttttttgagacagagtcttgcactgtcaaccaggctggagtgcagtggctttgatctccgcttactgcaatctcygtctcctgggttcaagcgattttcctgcctcagcctcccaagtagctgggattataggcgcccgccaccacgtccagctaattttttgtatttttagtag

SEQ ID NO: 14662 - DNA, 201 bp, Homo sapiens; identical to SEQ ID NO: 4626

SEQ ID NO: 14663 - DNA, 201 bp, Homo sapiens
atggattctggggcagtgattcttctgttcaaattctatttctccaaagttgttttagctaattttggtcctatgacttctgggattaccctgtgaagtgkttttttttttttttttttttttttttttgagacagagtcttgctctgtcacccaggctggagtgcagtggtgcgatctctcactgcaagctctgcctccc

SEQ ID NO: 14664 - DNA, 201 bp, Homo sapiens
tgaccctgactatcctcccgctttccctcaacaagcatcctatactcttgccatagcaattactcattgtttctcaaatgtgccatcctctttcacgtctytaagtctttgcatatactgtatcctctgtcaggaacaactttttcttttatgcctatttggtaaactattactctttaagactcatctccttgggaaagc

SEQ ID NO: 14665 - DNA, 201 bp, Homo sapiens
ttccatcaggttgccccacagtcatgtgtgcacttcacgaacactctgaggacttatggtgatagaaatcattgcttagcttagaatttgactgaagagaygcatagccagtgtgatccaggttggcctcatatctgtggcaacactgacaacgtcctcccggatatatagcaatggcttagtacacagagcttgttaatt

SEQ ID NO: 14666 - DNA, 201 bp, Homo sapiens
ataggagaaaatgcaaattatttattttaatagatatcatcgataacatttttatactggcgtggttggaaatatcttgcacacttgggctccctattgaytgaagagaaatccttttaatagcacagcatctagtactagagtacagtcactaatcattcacttattcattcaacaagtagttattgagcacctactatg

SEQ ID NO: 14667 - DNA, 201 bp, Homo sapiens
gaaagctctcccaggccaaggaaagccctttaaatgaggactttaattgaggtccaggagtcccaacaccaggcatttattcatcccacactttcctaaaytgagaaatgcaaactgagcctgagttgctaagagccctgaaactcatgggctcttgacacaaagcaaaacacacaaagcaagcaaacaccttcagaagaa

SEQ ID NO: 14668 - DNA, 201 bp, Homo sapiens
tccaactgtgcagcagtgcataatacaaaaatctcagttataaggtgccaaaataataaagacatgtagcaatacagacccaatgcccatgggcttcttcmtatacttgtcagtaacctcattcaaaagcacaatgttgaaagtgatactaagggggaaaagcacaaagccaggcctcttttaggcttatgttgaagaagt

SEQ ID NO: 14669 - DNA, 201 bp, Homo sapiens
gaaatgaattttaatattcagttccactgcataaaacaggttcaaaactccaaagacagcttatgaagctatttaaaaatgggagaatgtaacttgagaartaagctcaaagaaattaaagtatcaactttactggaaatattttctgttggttatactgcccctttaagtaacagtgcctctgtaagagaccactatacc

SEQ ID NO: 14670 - DNA, 201 bp, Homo sapiens
gctattttcccctaaagaaacatggaattgttgctaagtagttcatgtttaaaacatgtaagggctccacaacaaaggagaacaagatcaagctctttgtyctgttgcttctcttaccatactcctgtggcctaccgctcacaagaagtaaaaacttgtcacctagccaaggtgttcttaaattataaaggcaaacatttt

SEQ ID NO: 14671 - DNA, 201 bp, Homo sapiens
tttatctgactgcagagtctatgctctttagcacaatttgacactatcacttatcaatttgcagaaatagctgtcatagaggattagacaatttgggagarggctactttgtcctttagttcagtaaatcattttataaaatgcaatcaaaggctgatacagagagcatgtagttatacatatttcaattcatttttataa

SEQ ID NO: 14672 - DNA, 201 bp, Homo sapiens
agattggaaagggaagaatccatgtcaaatttcggaaagattttggtaagaaaaaaacttgttaagaaaaaacttggtaagaaaaaactagttaaaaaatrggtaggcactaacagtaaaattcaacacaagtggcacattcttttaaaagatcgtaactgaggtgttgctatgatggtctcagtgttataaggaaaattt

SEQ ID NO: 14673 - DNA, 201 bp, Homo sapiens
aaccttaactacacaatttaaagtcattgtaaattttatacaaagccagagtgtttctttttatgccagtgggctttctatccttctcaaatgaaacctcrttttgaggcatattggtaagacactgtcacaaaaccaagccaaaccagcaccatagttgagttcatgtatgcagattttaaaactatgtcatatagccta

SEQ ID NO: 14674 - DNA, 201 bp, Homo sapiens
tcatcagcaacaaataatatatatttagtgcctactgtaaatgagatcgtgccagcctttagagttgtaaacaaatattagaaatagtcctcaccttcaamaacgcacacactctagctaaatagacagggcttagcccaaaaagcaaataaaccactaggtcttctgcagcctagtacaacgtaggtctcattttgccac

SEQ ID NO: 14675 - DNA, 201 bp, Homo sapiens
gaagctggtgttgagccaaggaaaattgcaaaagaccctttaaaccatattaagaagtttagactttatcctgagggaaaggggaaccactgaaggtttayatgggaaaaaggatccctccgccaacaatgcacctataatcctaggcagtcatcctgccaatccatggatgccaataatcaagtataaagttactacatc

SEQ ID NO: 14676 - DNA, 201 bp, Homo sapiens
aattaaagaatcaataattgctcatgtggtagttttacatatttacaaatgtaatattacaaagttaaaattttatcttcatctgtttgtggatggcaaasttaaaaggtaagatgctcaaaacaaagatgcaagctactctttcacaggcaatatctgggaaacaaatgtgtcgttagatttaagaatctatactgaagc

SEQ ID NO: 14677 - DNA, 201 bp, Homo sapiens
ccgattctgtctgtggctgtggaatgcttcagattaactggtagctaaaacttgcctgaattcagcatcacattttacctaaccactaaccaatcaataaytgcaatgtttgcatgtctactctgctaatgtagtctgactatagctccaataaactaaaatattccttatgacatcatatgaacactagttgctaaattt

SEQ ID NO: 14678 - DNA, 201 bp, Homo sapiens
cagagtgagagactccgtctcaaacaaacaaaactgtaataaacctcttatggcttttatacaacttatatgaaacaaattcacaatgtctctccaaatcraactcaacaattgctttgacagtacagatgttattattttgttgatacaataacttccaaaacaaatatggcccattctactgtgtttcttattattcag

SEQ ID NO: 14679 - DNA, 201 bp, Homo sapiens
accttggcatttcccactgtgattccactgaacagctatcactcctatgccttttggcattggtagttcccttactgtagaatttcatcttatgttgtggragttcattgaaatgtattgatgaggctgttccactgtaagtactaatgaaaatcatcactgttagggtttttagttgcaaataatagaaaccaactctgg

SEQ ID NO: 14680 - DNA, 201 bp, Homo sapiens
ataattatacaaaaaaagttaaaatgtaggatccctcaaatacacaaaatattaaaatcttccaaacttttgaataatattcacttgtttcaacagttttytcttccctatataaacttctctcaatttcacaaaaaacattcaacaaactcatataaccttttgccatttatagctatcttgagttcaaatatagtactt

SEQ ID NO: 14681 - DNA, 201 bp, Homo sapiens
ctgtttgaactaggccgactacaaaatatataatattaaccaaaaagaagccttcaccaattggtgctgaattattaattacctcttcctagacttcttcrtatgataacttgattatttcttcataccccagtttagaaaaattaccataatttatgcttacactaaggaaatccctaaatattcttcaacaactttgca

SEQ ID NO: 14682 - DNA, 201 bp, Homo sapiens
tttaagactactttaaagcctatagaaaaaatatggctaaattatataagcaagtgtaattctgaaaataaacaatgctaagattttagataatagttacycataatgttcctataacctgtaactaaccataccttggacaactaaaataaattaagatttttcttggtctggggaagtagacggtagcaagggatgttt

SEQ ID NO: 14683 - DNA, 201 bp, Homo sapiens
aaaggctgtttcttataacttcaactaagactgggaccctctaatatttaaaagggttttattttgtcaaaagtaacctcatggtaaggttgtatcagacmcttgaatagtaagcttttacattacagaaatgactaaactgtccagtaatctaaggctaaaatttagggaaaagaaaatcaaatctatattaaagaataa

SEQ ID NO: 14684 - DNA, 201 bp, Homo sapiens
tataaatttatcaatatagacacatttccaaaacacaataaaggaaaaaccaagttgaagaatcatatgcaggatatattcaaatttatgcaaatgttaamacccacaaaaatgtattgtttgtagcacacataaataagagtacaaatggtaaaaagaataatatgcaccaccttcaggagagtagatggatttggggtg

SEQ ID NO: 14685 - DNA, 201 bp, Homo sapiens
caagttgaagaatcatatgcaggatatattcaaatttatgcaaatgttaaaacccacaaaaatgtattgtttgtagcacacataaataagagtacaaatgrtaaaaagaataatatgcaccaccttcaggagagtagatggatttggggtggatggaaaagaatggaattggaaagaagtacaaaggagactccaaatata

SEQ ID NO: 14686 - DNA, 201 bp, Homo sapiens
cagaaatgtggactcaacaggcctaactggtagtctatataattacatcacatagctatgttttggcaggcaaatgcatttaaaagcataggcaaagatakgttcaatgcatagctaaaagaatgaaacatttatacagaatggaaagtttaatctttctacatgtgcctgagataatgcaaggtattttctaaatctaac

SEQ ID NO: 14687 - DNA, 201 bp, Homo sapiens
attagtgaagatacaagagtgtgtgatagaagacactacacagatttttgttcattggtttgctaaattaaaaatcacccgagaatttgcaggaaaatagyaggagtaggaaaagcatctaacaggtagtacacttcacacaggatcttgaaggaatggtaaaatctgcgtaggcagcgagaagctccaagcaagggcttt

SEQ ID NO: 14688 - DNA, 201 bp, Homo sapiens
tgtgtttgagagaccgacttcaatagaacagaaagaataggcccaagatcataggaaatgaagctggataaatagtgtacaggcaaatcagaaagggtgtygaaagtcaagcagaagaagttagatttaacatagtggaaaacagggaaccactgaagctctctgaaaagggagtgacatgctagaagtagcatttaaaga

SEQ ID NO: 14689 - DNA, 201 bp, Homo sapiens
ttttttttttcaagtatcctataaggagtttccttgtttggtttagtgaattgactgcgggtgtcccctaaatttcacatctgttttgctaacacatcccyatgaaaatctgcttatgtaagaattagttttaatattttcaatacgtcaacaaagttaactgacccaatacaagatatgaaccctagagtctcagattgt

SEQ ID NO: 14690 - DNA, 201 bp, Homo sapiens
actgtcctaattactattcctaaaaatactttacctaaaaaaaattctgaaaggctgtcaaaatatatctaggtatagaatataaattttattttgttctractactcacatgtattttttatttattaaagcaaaaaacatgtattacttgtatagctattaaaaatatatgaaaagaactatcttaggtcagggacttc

SEQ ID NO: 14691 - DNA, 201 bp, Homo sapiens
cacaaatctgatccagttatgctttccttcttaaaacacggttcaacagctctccattgcttacaaaataacattcaaactcctggcttctgaggctctgrccctgactatcctcccgctttccctcaacaagcatcctatactcttgccatagcaattactcattgtttctcaaatgtgccatcctctttcacgtctcta

SEQ ID NO: 14692 - DNA, 201 bp, Homo sapiens
aagctgggcttcagatcaagaagaaaggaaaagaaagaagtgcagggaatatactgatgcctaagttacttactgcttctgagccctccagtaggtctagytgtattactgctattcgattttataagacattcctgtatttctatagtaatttccctggttttggcttaagctagctgaaataaatttcagttaacatgc

SEQ ID NO: 14693 - DNA, 201 bp, Homo sapiens
taaaaactcaaggaaggcacatctcaaaggcccaagaagtcagattagtgattctgcagaactatataaacaacttttttccagataacacatgagcccartatgaacttccttacagaagaaggaaaagaaaggttaaaataaagatgccatgaaatacccttccttttcctaattcttcaaaataagggcaataatctc

SEQ ID NO: 14694 - DNA, 201 bp, Homo sapiens
cctctgtatgaggtcaatgaggacacgtagtggccggtctcgtcgaacaaagtcatgctgattgagggaggaggaaaaaataaactgataatgaagaaatrtccttaggtgcaaggtacagatataaaaggaaatagagaatcataaaatagttctatggatattacagaaataacaaaatatgattttcatgtcatgtgt

SEQ ID NO: 14695 - DNA, 201 bp, Homo sapiens
taaataaatgaacaaataaataagacagaccttaatgttttctaacaaggtggttttgatatttggtgagctatgtatagactcttctgaaatgtgaaatmtgtatgtcttcaaacatataaacaaggtaagttcttcacacactatgaagcttcataaaaggttccatttaaatttgtatcttggcaaaattattgaact

SEQ ID NO: 14696 - DNA, 201 bp, Homo sapiens
acatcatgcacatgtgacttagagactgcctctaattatttgatttcttacatctcccttcaatttattcctaataatgggtgtttctgccttcttaaatraatttatgtgcagtgtctggtttaaaaatgttcaagaaaaggaatctaaaaaatggcctaatgatcatggatttgttaatgtaaatcttaccttttaact

SEQ ID NO: 14697 - DNA, 201 bp, Homo sapiens
agcctgcgggctatgggttggacaagtttgcacgtaggaatataagacaaacaagcaaaaaattcggcatgtgaggtggtaagtgctatggagaaggatayggtaggaaagatggaacaataagtttatttgttcacagtcgcaaattgcctagatcacacagtaagaaaaattgctttggaagaccagagtgctaagcct

SEQ ID NO: 14698 - DNA, 201 bp, Homo sapiens
gtgcattttaaaaactccaaatgaagactctctatgagcttttctatcgaatctggcaaagcgaagtaaaagactctatatttgcatgaatagaacaatamtacttttctcctacatgcctccttgggaattcccctatcacacccttctccctgacatgtgttctaacataaattcgcctctgtaatgcagtcacaggtg

SEQ ID NO: 14699 - DNA, 201 bp, Homo sapiens
aaacttgaaatgacattgattttagttgacacatatgtaattaagtaactcaagtatatttttaaaataatgctatttttatagtccaaagaataggttcraaattttaacccactttaaatataataatgctaatagtataattctttgcttccccctacatttttttccttttataaaattattcttagttttccagat

SEQ ID NO: 14700 - DNA, 201 bp, Homo sapiens
cacacacataagcacacctttacacagcggggtgcggggggatgtatctaaaaatggctcttatccggtgatgagaaacctttgtatagactcccacactktctacgctgtggagaagggatcagcagacccaccactctcctttgttttgttcatttcaaaattattaaattattgtcgaagcaggggtagctatcaaaa

SEQ ID NO: 14701 - DNA, 201 bp, Homo sapiens
ctctgcgatctgctccttgtctactcttggatcttgtccttagtaactccaaggcctcacactggatgcctcagctatctcagactacttccctgagataycaagtaacatcggttggcaagaaagcaagaaaagttatctgccttcctagctaaccagaatctgttcaagaatctgctttccttcagggaaatcttcctg

SEQ ID NO: 14702 - DNA, 201 bp, Homo sapiens
gctggatgcaaatctaagctgtctaatctcaagcccagtctttttaacaactatggtatagctttcagttaaatcatgacatgaaggatttcagaattagyggcttgataaattataaagaactacaagactgctgaatactaagcccctccatctaaaactttcttttcattttgtgctttaataaaaggcaacgtcatc

SEQ ID NO: 14703 - DNA, 201 bp, Homo sapiens
ttaaaataagggcttgacattaaaaaaaaatctagtcccttaatttaagactactttaaagcctatagaaaaaatatggctaaattatataagcaagtgtmattctgaaaataaacaatgctaagattttagataatagttacccataatgttcctataacctgtaactaaccataccttggacaactaaaataaattaag

SEQ ID NO: 14704 - DNA, 201 bp, Homo sapiens
catttccaaaacacaataaaggaaaaaccaagttgaagaatcatatgcaggatatattcaaatttatgcaaatgttaaaacccacaaaaatgtattgtttrtagcacacataaataagagtacaaatggtaaaaagaataatatgcaccaccttcaggagagtagatggatttggggtggatggaaaagaatggaattgga

SEQ ID NO: 14705 - DNA, 201 bp, Homo sapiens
aatagcccataacttcactgaatagtccacaactttttattgttgccatgttatctaaccagcttttgtattgtcatatatgaatgacatcttggggccaygtagcacttatcctgtaggcactaatagaacagtacagagttatttaattccaatcttcacaatgaggggtacatggcccaacagttataaacacaggca

SEQ ID NO: 14706 - DNA, 201 bp, Homo sapiens
aatctgcttatgtaagaattagttttaatattttcaatacgtcaacaaagttaactgacccaatacaagatatgaaccctagagtctcagattgtgagaamggaaaacattctttatgcagtagttgtccttatgtgtggggaatatgttctagaacatccagtggatttatgaaaccatagatagtatggaactctatat

SEQ ID NO: 14707 - DNA, 201 bp, Homo sapiens
gagagacacccaaactaggatgattgtgaattgatgattacctaattcaaaaaagctggagaaaatttatttcaatactttcattatttttctaagatgcrcgattattaagaatgtatgtggtcaggcgtggtggctcacacctgtaatcccagcactttgggaggccgaggcaggcggatcacctgaggttaggagttc

SEQ ID NO: 14708 - DNA, 201 bp, Homo sapiens
tattattttggtcttattagactttaatgcctaaaagccatgtcatcaagcttccactagacttcgttacagtgaacagagttttcttaggttttagccasaatgagatacagccatcgtggatgtatggtgtggtagtaggaatggctttcatttgtattcaatgaaataaaaatatagtaaattcaaggctgctccaag

SEQ ID NO: 14709 - DNA, 201 bp, Homo sapiens
cttacctcacagagctgctgtgaaccttagttaggtgatgtgctatgcataggtctacataaatgtttcttcagtgaagctagtggtcctacaccctgackgcccataaaaatcatgtgaggaaacttttcaaacataagatgcttgaatctcacagggtgaaattcttataactgtctggggtgggagcctgatgtcagt

SEQ ID NO: 14710 - DNA, 201 bp, Homo sapiens
gacattttagtcatttacatgtacacggtacaaaatctgatgtgatgatgatcttgaatcatcataaaagggtatatgtagtttgtacaattgaagaagaytggaaagggaagaatccatgtcaaatttcggaaagattttggtaagaaaaaaacttgttaagaaaaaacttggtaagaaaaaactagttaaaaaatgggt

SEQ ID NO: 14711 - DNA, 201 bp, Homo sapiens
tttgatattttctacattgaacatgtagaatttattttttgtaatgaaaaaataaattaaaaatattttttgaagactgaattggaatagaaggagactasagcagggaggtcaggttatggctaccaaacaacaaagaacgataatcttattccagaatgttggcaataaaattgaaagcagaaggcagttaccatacca

SEQ ID NO: 14712 - DNA, 201 bp, Homo sapiens
agttctccaggtggtgccaataagcaatcaagattgagaattaaactgataatatctgcaatgttcttagctttctgggaaatactctgtttttgcatgartcagaggtaggccaattgtctattttttaaaatctcagagttcaaggcatgttggggaaaaaaaaacagatgagatctctcccctttcatcttctgcatt

SEQ ID NO: 14713 - DNA, 201 bp, Homo sapiens
attcatttttcattatggtaatttagaatgagaaggtgtggatgtactccttattctttttaaaaaaggcatgaggtgtaatgagcactagaaaccatgawttggaagttgatggtcagtgaaaagataaaacagagaagatgaggaaatttatgtcaagctgaaaatgataaggttcaaatgcttcaaaataacttttat

SEQ ID NO: 14714 - DNA, 201 bp, Homo sapiens
taaatactctatgaatttgtttcaataatactggaagaaacctctacaaattgtcaaaaatgtgaataattctatccagtctctaggttctagtcctgttygtccatcttttaaaaaatctgtgcccatttctgataaacataaaaatcttctctttataaatgatttaaaatttcaaaatatctcacccacatccattct

SEQ ID NO: 14715 - DNA, 201 bp, Homo sapiens
aaatcagttattattattctgatttttatgagtgtcatctgactcctaggatagcagcatgtttcccagtataccagtacttctacctggcaagggtgctrcccaaaaatggtcttgggagaatgtagacggtgtagaaaagtctgtaatttggccgggcgcggtggctcacacctgtaatggcagcattttgggaggccg

SEQ ID NO: 14716 - DNA, 201 bp, Homo sapiens
tctgagaacaacaaaaaaagaatcaatggattaaatcaaagatatacctttttggagactatacgtaaaagggaaattatgagactatctttaagaaaatmaaaaagacctatgaactaaacttatgataattaaaatattttcaatcaccaaaacacattataaactttagaatattttggcttccatgtgaataaagct

SEQ ID NO: 14717 - DNA, 201 bp, Homo sapiens
aaatgaaatctttaaaaactgaaaatttaaaaatcatatataaagagacagctatccaactagagataatgctagatcctagtaggacagtcaggcaagayattacagaagacagacattttcagctctattacaaggaaagagaatggctgtttcttttcttttctcttcttttttattttttattttattttatctttt

SEQ ID NO: 14718 - DNA, 201 bp, Homo sapiens
aaaatcttaactttacagcagtgaaaaatgaagtataaatatatagtatctttttcgaagtcacatagttaggactagtcgagtatttggtttcttccccygtttccttccacacgacttcccataagacttgaagagaactgtctaaaaaaaacaaaccaaaaaaacaaaaaaaaaactagcaaattttgttgtaattgc

SEQ ID NO: 14719 - DNA, 201 bp, Homo sapiens
cacatacacacagacacacaacatactctgagttcaatatataagtaaaattcccagcattcttaattgttccaaaaccaaataaaagaaaaatccaagakgtaaacacctttagcctctgcaaattttacctgccactgatcaccaaatacacaacagcactgtgagagctctgtatttataacttttgactccctccta

SEQ ID NO: 14720 - DNA, 201 bp, Homo sapiens
ctcaaaaaaaaaaaaaaaaagaaagaaagaaagaaagaaagaacacttgatagagagtagaaatatatatttttaaaataattttccctttcccagaaacytcaagaaagatgattcattgaagatcttagttgtgtttcaatgtttttttcaacaataatgttcttctcaacaatgtttttctctggcagcactatcctg

SEQ ID NO: 14721 - DNA, 201 bp, Homo sapiens
tttttttccatttcttaggagaaagctaagttgtatggacaatacctttttgtgtgtggcacaaaatattccatattgctcagattcattttagcagcaawcttctcttttctcttttataacttcagtcctttgtatttatgatgcaacctatagaaaaagaagaacaaaatacataattatcagccaaattaaagaatc

SEQ ID NO: 14722 - DNA, 201 bp, Homo sapiens
gttagattagatcagcggctcttaacttttgaggggtcgtgggccctagagtcctgggaacgctatgcagtttcctcagcaaaatgcttgcatccacaacmtgcaagactgcagcagctgctgggctggggctgcgagaccagcgaaaagccctgacttgggggggtctcgggagtctctgcagtctccccacccacaccc

SEQ ID NO: 14723 - DNA, 201 bp, Homo sapiens
agagggggctgccgtcctgctcgcagcctctgccgccctctcctgggtaaggtgacacatgggcgcttccaggtgggtgggctgagagcctgggggagagracagggatgtccacctctctaagtttccaggttcaagaaaccccagaacgttagagaaagatgggctcccacaattgcccaaccccatcccataggatgc

SEQ ID NO: 14724 - DNA, 201 bp, Homo sapiens
agtgagtataattcaagtgtgggtgtgtgggtaagtgatcagaccggggttgctcagtgatcagactggggctgctcagagagaagagggctgcctcagtyttcagcctcccagtacccgcctcccatctccattaaaatcctggaaaatcctggctattttcgtcccttttgcaaaggggagctattttttttttttttt

SEQ ID NO: 14725 - DNA, 201 bp, Homo sapiens
agtgagactctgttaaaaaaaaaaaaaaaaaaaaagaagaagaagaagattttcccaacattgtccccatttcccagaaaagaaaactgaggcccatccaraagttaaggattccagtggtagaaccagcaccaggtgtcacgatccagctctgtcacatcatgagtccctagagagcagaaattttgtgctgacttcagg

SEQ ID NO: 14726 - DNA, 201 bp, Homo sapiens
cacgatccagctctgtcacatcatgagtccctagagagcagaaattttgtgctgacttcaggatctcccatgaacagctcctcacctgaattccagaaatyagtggggtgaaccgcacacaggtaggaaccaggtctgtctccttcacctcttaattccagagcctaacatagcacttggcacaaagtagtagcacttgta

SEQ ID NO: 14727 - DNA, 201 bp, Homo sapiens
aagttgcttgagcaccctcatgacatggcatctggcttcctccactgtgaatcatccaagaaattgctgggggaggccgaaatttcacttatgacctaatmtcagaggtcacacaccatccctctccaccacattctattctccaagagcaagtcaaaaagtccagcccacactcaaggagaggggaatgaatcattgcct

SEQ ID NO: 14728 - DNA, 201 bp, Homo sapiens
agaacttcgtgtgagaggtgctattgttattcccactgtaaaaaggagtatgctgaggcccagagaagttaagaaaggtcacacacctacctgtgaatccrgagctcaggtgtgcattcaagcaggccagcctcaaaggcaacagtgctgatgtattccagagggaatgctgcaaggaacatacagagacattggggtgaa

SEQ ID NO: 14729 - DNA, 201 bp, Homo sapiens
gtattccagagggaatgctgcaaggaacatacagagacattggggtgaaaatgcttctgaagggaaaataggtggagaaagagagagaaacagaagacgtkgaactgagatgccaagagatacaatgacagagaaagacagcaagggagacagaggaggattaagcatcagaaatctttaggcaggcagacacaaggaggt

SEQ ID NO: 14730 - DNA, 201 bp, Homo sapiens
ttgccactgcaccactccagcctggcgatagagtgagactctgttaaaaaaaaaaaaaaaaaaaaagaagaagaagaagattttcccaacattgtccccayttcccagaaaagaaaactgaggcccatccagaagttaaggattccagtggtagaaccagcaccaggtgtcacgatccagctctgtcacatcatgagtccc

SEQ ID NO: 14731 - DNA, 201 bp, Homo sapiens
ccttcacctcttaattccagagcctaacatagcacttggcacaaagtagtagcacttgtaaatactcgggggtctgaatagaactgaaagcttagtaaatwaataaattaaaatacttaataaatagacacatggttaagtgaataaattcattaattaacataaaggcattagggtgttcggattaaatgaaaagtatat

SEQ ID NO: 14732 - DNA, 201 bp, Homo sapiens
agacctggttggagtaaggcaggaggggggctgtggtgaccaaggtatgcagtgtggattctagcccactgcagattttatggagtgcttgcctgtgccartttttcgactccctccagaacttcgtgtgagaggtgctattgttattcccactgtaaaaaggagtatgctgaggcccagagaagttaagaaaggtcacac

SEQ ID NO: 14733 - DNA, 201 bp, Homo sapiens
aagagacagagacctggagacaggggaggcatgggatggaggatgtgagccagcatgtgcatggcgtgcgtgagtgcagtgcctttgcgctgggtggtgcygggaccccgctaactcagaccatccatcgctcctgtctctcatcagcaggagggccgggggagggagagaaagctgacaggagacagtgtgattccagta

SEQ ID NO: 14734 - DNA, 201 bp, Homo sapiens
cagacacaaggaggtggagagaaaaataaagtaagagacagagacctggagacaggggaggcatgggatggaggatgtgagccagcatgtgcatggcgtgygtgagtgcagtgcctttgcgctgggtggtgccgggaccccgctaactcagaccatccatcgctcctgtctctcatcagcaggagggccgggggagggaga

SEQ ID NO: 14735 - DNA, 201 bp, Homo sapiens
tattccagagggaatgctgcaaggaacatacagagacattggggtgaaaatgcttctgaagggaaaataggtggagaaagagagagaaacagaagacgtgkaactgagatgccaagagatacaatgacagagaaagacagcaagggagacagaggaggattaagcatcagaaatctttaggcaggcagacacaaggaggtg

SEQ ID NO: 14736 - DNA, 201 bp, Homo sapiens
tgaggcaagagaatggcttgaaccctggaggtggagactgtagtgagccgagatcttgccactgcaccactccagcctggcgatagagtgagactctgttaaaaaaaaaaaaaaaaaaaaagaagaagaagaagattttcccaacattgtccccatttcccagaaaagaaaactgaggcccatccagaagttaaggattcc

SEQ ID NO: 14737 - DNA, 201 bp, Homo sapiens
tgaaccctggaggtggagactgtagtgagccgagatcttgccactgcaccactccagcctggcgatagagtgagactctgttaaaaaaaaaaaaaaaaaaraagaagaagaagaagattttcccaacattgtccccatttcccagaaaagaaaactgaggcccatccagaagttaaggattccagtggtagaaccagcacc

SEQ ID NO: 14738 - DNA, 201 bp, Homo sapiens
ataagtggatgagtggatggatggatggatgcatggatggatggatagatagatggatgacaaatggatggtggatgaatgggtgaatggatggatgatgkatatgtggatagatgggtagatggatgggttggtggatggatagatggatgcatgaaagaatgggtggatgaatggaaagatgggtggatggtgggtgaa

SEQ ID NO: 14739 - DNA, 201 bp, Homo sapiens
gctgcctcagtcttcagcctcccagtacccgcctcccatctccattaaaatcctggaaaatcctggctattttcgtcccttttgcaaaggggagctattttttttttttttttttttttagacacagcttattaaaggagaaagcacacagagcccttcctcccacaggtgcctctttatctgcataaacccaccctctgt

SEQ ID NO: 14740 - DNA, 201 bp, Homo sapiens
ctgcctcagtcttcagcctcccagtacccgcctcccatctccattaaaatcctggaaaatcctggctattttcgtcccttttgcaaaggggagctattttttttttttttttttttttagacacagcttattaaaggagaaagcacacagagcccttcctcccacaggtgcctctttatctgcataaacccaccctctgtc

SEQ ID NO: 14741 - DNA, 201 bp, Homo sapiens
aaccctggaggtggagactgtagtgagccgagatcttgccactgcaccactccagcctggcgatagagtgagactctgttaaaaaaaaaaaaaaaaaaaargaagaagaagaagattttcccaacattgtccccatttcccagaaaagaaaactgaggcccatccagaagttaaggattccagtggtagaaccagcaccag

SEQ ID NO: 14742 - DNA, 201 bp, Homo sapiens
aaagaaatagtgagtgtattggtaatctatggctgcataataaatttcccaaaatgtagtggcacaatttctgggggccaagaatccatctgcatggctcyggcttaggagctcttgtgaagttgcagtccagatggtggccaggactgcagtctcatctgaaggcttaactggggctgaaggctccacttcccaggtggc

SEQ ID NO: 14743 - DNA, 201 bp, Homo sapiens
gaatggatgatggataagtggatagatgggtggatggaaggataggtggataaatgggtgaatgaatggatgatggataagtggatagatgagtggataartggatgagtggatggatggatggatgcatggatggatggatagatagatggatgacaaatggatggtggatgaatgggtgaatggatggatgatggatat

SEQ ID NO: 14744 - DNA, 201 bp, Homo sapiens
tcattgccttttgaagggaggagtgtcaaagaatgtaatgacatattttaaaaccaccacaaagagtgccagaaggccagaatgatgtgacaagtagatgytgtcaaagtctttggaaagagcctcccagggagaagatctgcaaggacaaaggcctagaggtgggagtgagcttgtcatgtttggaaacaagaaggtgtg

SEQ ID NO: 14745 - DNA, 201 bp, Homo sapiens
aaaaaagaagaagaagaagattttcccaacattgtccccatttcccagaaaagaaaactgaggcccatccagaagttaaggattccagtggtagaaccagyaccaggtgtcacgatccagctctgtcacatcatgagtccctagagagcagaaattttgtgctgacttcaggatctcccatgaacagctcctcacctgaat

SEQ ID NO: 14746 - DNA, 201 bp, Homo sapiens
taagcatcagaaatctttaggcaggcagacacaaggaggtggagagaaaaataaagtaagagacagagacctggagacaggggaggcatgggatggaggakgtgagccagcatgtgcatggcgtgcgtgagtgcagtgcctttgcgctgggtggtgccgggaccccgctaactcagaccatccatcgctcctgtctctcat

SEQ ID NO: 14747 - DNA, 201 bp, Homo sapiens
gtggagagaaaaataaagtaagagacagagacctggagacaggggaggcatgggatggaggatgtgagccagcatgtgcatggcgtgcgtgagtgcagtgyctttgcgctgggtggtgccgggaccccgctaactcagaccatccatcgctcctgtctctcatcagcaggagggccgggggagggagagaaagctgacagg

SEQ ID NO: 14748 - DNA, 201 bp, Homo sapiens
ttttgcaaaggggagctattttttttttttttttttttttagacacagcttattaaaggagaaagcacacagagcccttcctcccacaggtgcctctttakctgcataaacccaccctctgtcaggcagccaggaataaaactaagcagaaagccacagaaagtgtaagaaatcaaatacagaaagacagaaaaagaagtt

SEQ ID NO: 14749 - DNA, 201 bp, Homo sapiens
gggaattaattaacaattgacttggtggaaagatggataaatgaataagtgagtataattcaagtgtgggtgtgtgggtaagtgatcagaccggggttgcycagtgatcagactggggctgctcagagagaagagggctgcctcagtcttcagcctcccagtacccgcctcccatctccattaaaatcctggaaaatcctg

SEQ ID NO: 14750 - DNA, 201 bp, Homo sapiens
ggttggtggatggatagatggatgcatgaaagaatgggtggatgaatggaaagatgggtggatggtgggtgaatggatcagtgatggataaatgtatagakgggtggatagatggagagtggatggatggatgaatagctgagtgcatggatggataaatggattaattcataagtaaaaaatataggatagataatgaat

SEQ ID NO: 14751 - DNA, 201 bp, Homo sapiens
tggagtacagtggcgcgatctgagctcactgcaacctctgcctcccaggttcaagcaattctcctgcctcagcctcccaatagctgggattacaggtgcaygctaccatgcccggctgatttttgtatttttagtagaggtggggttttgctgtattggccaggccagtctcaaactcctgacctcaagaaatccgcccac

SEQ ID NO: 14752 - DNA, 201 bp, Homo sapiens
ttttttttttttgccaagcaccctgcctttttgcttgtctgtttcgtctttatctctccttccagtaaagttcttggcccagaggttctgctgccactcartgacatttgtgaaatgcaagggagcttgcaccatgggttcaagctcctgcagatccctgagcctgctacccttgtgcttctctgtccacgcaaagccaag

SEQ ID NO: 14753 - DNA, 201 bp, Homo sapiens
tggagatttcaaggatcatcagggaagctagtgtggctggagatgaatggagtgggtaggagaggtgctgttgggggatgggtatctggtagactctgagrtagcggtgaggaagacattagagggtttgagctagagagtgatgcgagctgtttgatttttgaaacatcgctggatttcagaatgaagtccagactgcat

SEQ ID NO: 14754 - DNA, 201 bp, Homo sapiens
gctacaaaacctggcattttacttctctcattttccccaaatgatctaggtgtcttttgctcactggtgataaggggtgacattggtatcacaggtaaaartgagtaaatttgagattattgtcgtcttgctttaaaggttggagatacagcttcaaaaaccttttactacccacacacccaaggggagtcaaatggattt

SEQ ID NO: 14755 - DNA, 201 bp, Homo sapiens
cattcagccctcgggttaccattggtagcacatctaggagcaagttttaattttttagtcatagtgactgtgctggatttggtaggtcgtacgaattgggkaagaggcataggacaccaaggattttgcaaaaagcaggcaactaacatttgttttccacctactatgattatgttaggctctcaatatatgtttaccact

SEQ ID NO: 14756 - DNA, 201 bp, Homo sapiens
tgactcactgtgttgatgttatgttttctaacattgactttcctttaaaccatagggttcgaaaccgccaagtcttttgccctccatggtgcacatgtgaycttggcctgcaggaacatggcaagggcgagtgaagcagtgtcacgcattttagaagaatgggtaagcgcttgactgttgttgttttttttaattgtcaaa

SEQ ID NO: 14757 - DNA, 201 bp, Homo sapiens
ttcagtggagtgtgtaaagtttattgctcttggaatcatgtctttatttttaaagtcatcttcactttgtttgtcttatgaatgaaagcatgagcaagtcmattattattcacgcatttgtttgtagttcattgtcagtgtcatctgctttattagtcaggggtttgagaatgtttcttcctttaactcatttattaagaa

SEQ ID NO: 14758 - DNA, 201 bp, Homo sapiens
cagtattttgtcctattcatgcaatataatttatataacctaattgataaaacattttggttgattgcagtctgtcgtagataatgccgtactgaatattmctcccacatatttgcaagtctatttgtaggataaatttctggttgtggctgggtcaaagagcatgtccacttcaaatttgatagctatgtcccaactgcc

SEQ ID NO: 14759 - DNA, 201 bp, Homo sapiens
aagaaaaataaaacgtggtgaacgcccatgattgcaactaggagactgttatgcttatggttgttaagattagaaagaaggaagctttaaccctatctctratttcttacttttctctgtctatgtagaagttgatgttgatacgtgtctacataaatatttactaagggcttgcattagtcttgggaccaaggatatagt

SEQ ID NO: 14760 - DNA, 201 bp, Homo sapiens
agaaggaagctttaaccctatctctgatttcttacttttctctgtctatgtagaagttgatgttgatacgtgtctacataaatatttactaagggcttgcmttagtcttgggaccaaggatatagtattaaacgaaacagaatccctgccctcataggcttaccttctaggtaggaaaaatagaccataatcaagtttaat

SEQ ID NO: 14761 - DNA, 201 bp, Homo sapiens
tccaatttttcaagctgctggccagcttgagcgtattcatatgttacctacgatgaatcacatcagtgtcggggccgggaaggtactgcaacatattggcrcctcacgggaggctctcaaaatgatccaaagttttttgttgcagcaaaagctcattcagaagtctttgggccatttggctcagcggaggctgtcatgtgc

SEQ ID NO: 14762 - DNA, 201 bp, Homo sapiens
atggcctgggaggcaagtgtgatcattcaggtaatcaaagtaactacagaaacagaggtatggattagctagtcattgcagatgtggcattgagcatatargcgtggtgtacatcttagaacttcatctggaaatgcctgtgggggagttggatttcaagatcatcgtcaatgtcatgtcactgtaatttcatttacatta

SEQ ID NO: 14763 - DNA, 201 bp, Homo sapiens
taagttcttaagatttggcagctgtggatcgtgtttagtaagcacgatctctaactctttggaactcagaactatgtaattgaaatggcctgggaggcaartgtgatcattcaggtaatcaaagtaactacagaaacagaggtatggattagctagtcattgcagatgtggcattgagcatataagcgtggtgtacatctt

SEQ ID NO: 14764 - DNA, 201 bp, Homo sapiens
agatttccccttttcataaggacaccagtcctattggattagggctcccccattatgacctcatttatccttaattatgaccataaaggccccatctccaratgcagtcatgttgggggttagggcttcagtgtatgagtttgggatggcaggggagcagttcagctcgtgagaatcgtaagattcctgatctgtttctct

SEQ ID NO: 14765 - DNA, 201 bp, Homo sapiens
atgttaacctcctttggaaacacccgcacagacacacccaggaacagcaccttgcatccttcaatccaatcacattgacactcaatattaaccatctcagyaggcttcttcgtgttcacatagtctcctcaccgtgtgctgtgtccagatttccccttttcataaggacaccagtcctattggattagggctcccccatta

SEQ ID NO: 14766 - DNA, 201 bp, Homo sapiens
ccgctgacttaaatgttaacctcctttggaaacacccgcacagacacacccaggaacagcaccttgcatccttcaatccaatcacattgacactcaatatyaaccatctcagtaggcttcttcgtgttcacatagtctcctcaccgtgtgctgtgtccagatttccccttttcataaggacaccagtcctattggattagg

SEQ ID NO: 14767 - DNA, 201 bp, Homo sapiens
aacttgttgtaacatgtaagaaattacatctgggctaaaaggttcaataatgattactcttataatggaatcttctacaaagcaagggatttcatgatatscctatgcttttaaaaaattattgtgatacagtgaaacaaggaagaacgtgtagctggaaaaatagtatttgcttgtaatatacattcagattcataacag

SEQ ID NO: 14768 - DNA, 201 bp, Homo sapiens
actaggaattgaaatggcctgaagctgagtttccactcttgtgaaggctggactgtctcttgttattacagcgagggtataactctttaggatcccgaccmaaggtttggtgtgtttaccgtggccctttcctggtgggtcctgagctcaaatttatgtctttttccttgttataaaattgccaaaagctcagcccatctt

SEQ ID NO: 14769 - DNA, 201 bp, Homo sapiens
gaagcagtgtcacgcattttagaagaatgggtaagcgcttgactgttgttgttttttttaattgtcaaatacacatgccgggctaaccatatggagatttyagtggagtgtgtaaagtttattgctcttggaatcatgtctttatttttaaagtcatcttcactttgtttgtcttatgaatgaaagcatgagcaagtccat

SEQ ID NO: 14770 - DNA, 201 bp, Homo sapiens
aatgtctccagacatttgcttctgtcccctggggatcaaaatcacccctggttgagaacttggggtaatttaagtggtgctccggtaaaggccattcaacwtgactcactgtgttgatgttatgttttctaacattgactttcctttaaaccatagggttcgaaaccgccaagtcttttgccctccatggtgcacatgtga

SEQ ID NO: 14771 - DNA, 201 bp, Homo sapiens
agccaagggatggctcagaagggtgaaggaactcacccgaattgcacagctggtgagctcagagtcaggctccttgcttggtccatctggcttccaaactscaagtctgtctgctccaccccatggcccatctttttaccatgtttagtatcaatgttcatactttgcagattttgctttcaaactctctagctgcggttt

SEQ ID NO: 14772 - DNA, 201 bp, Homo sapiens
tcaggcactttatatccctcatccaggaggatgcaaaaacctggtgtttttcttttttttttttttgcattttccagacgagccaagggatggctcagaarggtgaaggaactcacccgaattgcacagctggtgagctcagagtcaggctccttgcttggtccatctggcttccaaactccaagtctgtctgctccaccc

SEQ ID NO: 14773 - DNA, 201 bp, Homo sapiens
gtcatatgctgtgtcaggcactttatatccctcatccaggaggatgcaaaaacctggtgtttttcttttttttttttttgcattttccagacgagccaagrgatggctcagaagggtgaaggaactcacccgaattgcacagctggtgagctcagagtcaggctccttgcttggtccatctggcttccaaactccaagtct

SEQ ID NO: 14774 - DNA, 201 bp, Homo sapiens
tgccttcactgcacattccgggatcgccatgttctagaacattcatgtctgccttttagccagcagaatgctattctcacatccacaatgggacagctaayagcccccatttatcaaatccctgtcatatgctgtgtcaggcactttatatccctcatccaggaggatgcaaaaacctggtgtttttcttttttttttttt

SEQ ID NO: 14775 - DNA, 201 bp, Homo sapiens
tgaacccgggaggcggagcttgaagtgagccgagatcgcgccactgcactccagcctgggcgacagagcgagactccgtctcaagagaaaaaaaaaaaaaattataacatggaaatgtttccttgcatctccgtatcatttctcctcattctttttaggtgtaacacagtattttgtcctattcatgcaatataatttata

SEQ ID NO: 14776 - DNA, 201 bp, Homo sapiens
ctactaaaaatacaaaaaattagccgggtgtggtggcgggcgcctgtagtcccagctactcgggaggctgaggcaggagagtggcgtgaacccgggaggcrgagcttgaagtgagccgagatcgcgccactgcactccagcctgggcgacagagcgagactccgtctcaagagaaaaaaaaaaaaaattataacatggaaa

SEQ ID NO: 14777 - DNA, 201 bp, Homo sapiens
cctccaacttctgggctcaagtgatcctcccacctcagcctcttgagtaactgggactgcaggtgcatggcactgtgctccacaattttttttttttttttagagatgggatctcactgtgttgtccaggctggtctcaaacccttgggtttaagtgatcctcttgcctcagcttcccaatgtgctaggattacaggcatg

SEQ ID NO: 14778 - DNA, 201 bp, Homo sapiens
aagccactgttagattttacaaaactttaaaaagtaattatcttaaagatatctaagatagtgatctggttacatagattatcagagatacttttttttttgattatcagagatacttttaaaaaagcaactacaaggtaaggattatcctttaatttagtgtttttctattaaactcaatttgctttaaagttttttaca

SEQ ID NO: 14779 - DNA, 201 bp, Homo sapiens
gctaggggcaaaatacatatattctatgtagtttccatttctagaccctggatttctaaattcttccttataaaattttaaatttctttttttttttttttaaagatggtgctccctaactgatttccttcattttattatctcataacagatttgattttcacaatgaaggtaattattaaaatgcttcctttggtagtc

SEQ ID NO: 14780 - DNA, 201 bp, Homo sapiens
gttctagaggctagaagtctgaaatcaaggtgttggtagggccatactccctttaaaatgtgtagggaaggacccttccttgcctctttcagcttctggtrgccctagatgttcattggcctgtggcagggtaattccagtctctgcctccatctgcacaagccattctccctgtatcttttcacatcatcttccctctat

SEQ ID NO: 14781 - DNA, 201 bp, Homo sapiens
tcagagaatctctaggatggaaatggggggatccatattgtagccccaggtgaggccatctggttgcatttgtgtcaagttggttgaaaactgcatggtgrgcgtaaaaatggtttgagtaaaatggagctgtgagaatttgaaggggtgcatgagaggtgcccgatacagtccaccccctgcaccatgctcaggtctctt

SEQ ID NO: 14782 - DNA, 201 bp, Homo sapiens
cttacctctttttagtttaattaaaattatttctcagattaagagccatgctatgatgcttgccaacggatatttaaaacatgtaactgatttgttttttrtaatgcttcaggagaactcagttgagcagtaaagatgtgctcgtgatgtggttagctcagaataaggatgtgaaaaccaaaagggaaaggaggacaggag

SEQ ID NO: 14783 - DNA, 201 bp, Homo sapiens
ttcctcatctgtaaaatgggaaccatgacgtcagcatcacagagttgtgagaattcgacaaggtggaatgaaagcaactagtgtggtgtctgaccgcttgygttagtccatgaggaatttccttacgtattgttttgtgtctaggaccaagttcttattttcttcttatggatgacttcatatatatgccgccacagaggg

SEQ ID NO: 14784 - DNA, 201 bp, Homo sapiens
gcccctcttctcttagttgcctttagcctttgtttttattatgacaattggtatgaaatttttccttttcattacttcttttattcagagcacacctctgkcttatctcttcattctctgtttagtttcatattttactttaatttctgtacatcaatatctgccattatagtatttaagctcttggaaacatcaggcatt

SEQ ID NO: 14785 - DNA, 201 bp, Homo sapiens
tttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctactataatggaccaccacaaactcggtg

SEQ ID NO: 14786 - DNA, 201 bp, Homo sapiens
atttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctactataatggaccaccacaaactcggt

SEQ ID NO: 14787 - DNA, 201 bp, Homo sapiens
agactcctaaagggaagattagggttggaagaagatggaggaagagagtaatttaattccttaatggaaagaataaaataagagctcttgacttttttttkttgttgttgttaggatatggggagaggtttctgcaaatatcttcttcagggtttacgaagtgaaccggatgtccggtaacagggttgcatgtcatgcaat

SEQ ID NO: 14788 - DNA, 201 bp, Homo sapiens
cactcacatatatatttctgtttgcggctcacacagacataaatatatatatatatatacaaacgtacatttctgcttgtagcttgcacatatatatatayacacacacacatacatgtagacacacacatttatacatatacatgtcaacacatacacatacatatttctgcttatggctcaggatacttctttttttgg

SEQ ID NO: 14789 - DNA, 201 bp, Homo sapiens
tacagatacacactcacatatatatttctgtttgcggctcacacagacataaatatatatatatatatacaaacgtacatttctgcttgtagcttgcacayatatatatacacacacacacatacatgtagacacacacatttatacatatacatgtcaacacatacacatacatatttctgcttatggctcaggatactt

SEQ ID NO: 14790 - DNA, 201 bp, Homo sapiens
atacagatacacactcacatatatatttctgtttgcggctcacacagacataaatatatatatatatatacaaacgtacatttctgcttgtagcttgcacmtatatatatacacacacacacatacatgtagacacacacatttatacatatacatgtcaacacatacacatacatatttctgcttatggctcaggatact

SEQ ID NO: 14791 - DNA, 201 bp, Homo sapiens
acaaaaagcagctttcgtttgcttaaaatttttgttctctgcctttatttttcaaaaatattttcactaggtatagaattctaagatgaaagttttatttkttttcagctgtggcttccatcattttcctgagaggtataactatcagtcttgtagctactggtctctaactacttctaaaactatctgcagtttttagca

SEQ ID NO: 14792 - DNA, 201 bp, Homo sapiens
tctggtaataaaaagtcctttgccgtgggttattttgtcaagtgagatagcaggacttaacaggtttgtttgggaaaataaaatttgatagaaaaacggcrtgcttttcccccacagatttcttggtagcatcattcaaaactacagtgagcagtatctttgcaggattttaatatttattcattattataaaggaaggaa

SEQ ID NO: 14793 - DNA, 201 bp, Homo sapiens
ggggtggggttggcgagagggtgttgcttttctaatgattcacattgtataaaaagcagacagtaggtctggcactgttggctcatgcctgtaatcccagyactttgggaggccaaggcaggtgaatcatgaggtcaagggttcaagaccagcctggccaacatggtgaaaccccttctctactaaaaatacaaaaaatta

SEQ ID NO: 14794 - DNA, 201 bp, Homo sapiens
taaatgtctctgggtttaatgcaactttactaaggaatgaaagtccgataagaatccatatcttttgaaagaagattttttaaattccttatttttccttyctgcatggtcataaaacacactggggacagcccaccctgagaagtcaccaggcatctgcctgccttcagtagcaatcacccaactgctgtagaccgtaat

SEQ ID NO: 14795 - DNA, 201 bp, Homo sapiens
ggggttggcgagagggtgttgcttttctaatgattcacattgtataaaaagcagacagtaggtctggcactgttggctcatgcctgtaatcccagtacttygggaggccaaggcaggtgaatcatgaggtcaagggttcaagaccagcctggccaacatggtgaaaccccttctctactaaaaatacaaaaaattagttgg

SEQ ID NO: 14796 - DNA, 201 bp, Homo sapiens
ggtagaagaaaagatttatgtaaattagttctctcagtagctatctaggagagagataatcctagctttcttcaagggacagaaccaggaccaatggacaraatctgcaaggaggcagcatttaactgattagaattgtcgggggtggggttggcgagagggtgttgcttttctaatgattcacattgtataaaaagcaga

SEQ ID NO: 14797 - DNA, 201 bp, Homo sapiens
tctttaaggaaaaaggttggatggatgatgtcaaagacccactgttcagtctttctttcttatattttgagccttaattgggtccctgtgagtcaatttcmgatgatagaatttgctgttttatagttttactctaacatgtagtaccttgagatagaccagtgatcccagactaagaattattcagaatcattcaccgtc

SEQ ID NO: 14798 - DNA, 201 bp, Homo sapiens
ctagtgtgggtctatacgtgacactaggtgtagtgtaggtgacaaacaaaaagcagctttcgtttgcttaaaatttttgttctctgcctttatttttcaaraatattttcactaggtatagaattctaagatgaaagttttattttttttcagctgtggcttccatcattttcctgagaggtataactatcagtcttgtag

SEQ ID NO: 14799 - DNA, 201 bp, Homo sapiens
ttccattactcacctcctaggttaagcattgttattattattgatatagtaatttttgctatatattttaaaactcacagatttcactcttaccatttggrtcttaacatgtcgttaccctttatgttgctctttgttactttctgcatctctgggtttatagctaaggtcattttcctcctgcctgaagagcatccttta

SEQ ID NO: 14800 - DNA, 201 bp, Homo sapiens
ctctctctctttctttctctttcctttctttcttccatttaaattgagacagggccttgctctgtcactctggctggagtgcagtggcataatcatagctsactgtgcccttgaactcttggactcaggcaatccctcgacatcagccttctgagtagctgggactaccggtacctgccaccacacctggctatttctttt

SEQ ID NO: 14801 - DNA, 201 bp, Homo sapiens
ttattttcagtttatcaattaagttgttcaagtcttctatatactttgtgtttgtctgcttattttatctgttactaagagggatatgttaaaatcttccrttataattgtgaatttgtctatttattgtcctaattctgtcaatttttgacatatatgagaggctctattattaagtacatataaatttagaattgtcat

SEQ ID NO: 14802 - DNA, 201 bp, Homo sapiens
tgatcatcctcctgagtagctgggaccacaggtgtgcaccaccacgcccaactaattttttgtagagatggaattttgccatgttgcccaggctggtctcraactcttgggctcaagcgatccacccgcctcggccaccccgattcctgggattacagccatgagccactgtgcctggtcttctttttaatatatgtagtt

SEQ ID NO: 14803 - DNA, 201 bp, Homo sapiens
cttagggttcataggatctgtagtccttttctttatttttcatttttaaaaacaactttattgaggtatgattgacgtacaaaaagcctcacgtatttgaygtatagaacttgataagtttggagataagtatatacctgtgaaaccattatattttataagtacatgatacaatatgagcacagtactatatggtagatc

SEQ ID NO: 14804 - DNA, 201 bp, Homo sapiens
cttaagatcttcttagggttcataggatctgtagtccttttctttatttttcatttttaaaaacaactttattgaggtatgattgacgtacaaaaagcctyacgtatttgatgtatagaacttgataagtttggagataagtatatacctgtgaaaccattatattttataagtacatgatacaatatgagcacagtacta

SEQ ID NO: 14805 - DNA, 201 bp, Homo sapiens
gttgttcaccatatcttaagatcttcttagggttcataggatctgtagtccttttctttatttttcatttttaaaaacaactttattgaggtatgattgaygtacaaaaagcctcacgtatttgatgtatagaacttgataagtttggagataagtatatacctgtgaaaccattatattttataagtacatgatacaata

SEQ ID NO: 14806 - DNA, 201 bp, Homo sapiens
aacctgcctggccttgtgttatatcgatgctttctcaatctgttaaaaacgtagctgctattgaatgactaagaattgtttactctcatttccactctctkacatcttttttttttcttttaataccctgtgatgaaactgtgaagaaagatattcctgatcattgctttgacctggaaatttcaaagggacccacagtcc

SEQ ID NO: 14807 - DNA, 201 bp, Homo sapiens
tgtcagatgtgccctttctggtaataaaaagtcctttgccgtgggttattttgtcaagtgagatagcaggacttaacaggtttgtttgggaaaataaaatytgatagaaaaacggcatgcttttcccccacagatttcttggtagcatcattcaaaactacagtgagcagtatctttgcaggattttaatatttattcatt

SEQ ID NO: 14808 - DNA, 201 bp, Homo sapiens
aagtatgggccacacaaaacaggtctgtgggcttgacttgtcctctgatcatcagtttgtgacctctgttctaaagagtgaaaactatgtaagatagtatmagataagtaggtatttaaattactttgcaccttttccatttcatagaacttgaatgtttgtgttcaaagcttaaaacccaagacagtgagctattaagcc

SEQ ID NO: 14809 - DNA, 201 bp, Homo sapiens
gtaatgccagcagcacgggtgatgatcatggtcaacatgaccaactagaaagcccaaaccccacctctagctgacagtggcttctcagctaacctgtcacyacgtgggattgggcccccagtggtgtaagctttttcagagaagctacacatctagcttttggacctgtgatctccccaatgttttaatgctggcaactaa

SEQ ID NO: 14810 - DNA, 201 bp, Homo sapiens
ggagatgttctttgagattcggtgattgagttgtgaacatatggactgagggtgttttgtggtaaggcttgagtcatgtctgtagcaaggatgtttcctgrataatgtgcactgagcatcaagtgcctgcagtggcctggcgggtaatgccagcagcacgggtgatgatcatggtcaacatgaccaactagaaagcccaaa

SEQ ID NO: 14811 - DNA, 201 bp, Homo sapiens
agtctcacacttgacatagtagggtttgacatggtttaaataaaatctcaaccagatcagtgggagatgttctttgagattcggtgattgagttgtgaacrtatggactgagggtgttttgtggtaaggcttgagtcatgtctgtagcaaggatgtttcctgaataatgtgcactgagcatcaagtgcctgcagtggcctg

SEQ ID NO: 14812 - DNA, 201 bp, Homo sapiens
tgagcctgctacccttgtgcttctctgtccacgcaaagccaagtgctactgcggggttttccaaggcatagctagcatcctaatagtctcacacttgacakagtagggtttgacatggtttaaataaaatctcaaccagatcagtgggagatgttctttgagattcggtgattgagttgtgaacatatggactgagggtgt

SEQ ID NO: 14813 - DNA, 201 bp, Homo sapiens
aaacttaaaccagaaggaaccttcctggcatcggggaaagaagctgcctttttcttagctcctacctctgtgggagctttgtcagtatttgaggggacagrgttcccaccttcatgttttttgtgcctgaggattctgtgggcgactgtccccacctgtccagcctaccagtgagtctcatggtgtgcggctgcctgctcc

SEQ ID NO: 14814 - DNA, 201 bp, Homo sapiens
ttaggcctatcttcttgctttatgcataatggcagatctccagggagggagaggatgtgtgctggaagattctacaacttgttgattggttcctaaagatsgttttagtgctatgtttgtggggcggggctggagggggctggaaatcaccatctctgtggccttttaattgtgcccagttacaagtaacatttgtcccca

SEQ ID NO: 14815 - DNA, 201 bp, Homo sapiens
tttaggagctctgtgccaggaacctggatgaagacccagtatgtatttcttattatatcacaatatcacaaatccacagtcacatggtgattgtggtagtktggggggcctgatggtggggtacacctgcttgaagtcaggctaccatgcccattggggtcctcccccttttttgccctctgatcttgtgagttccttaac

SEQ ID NO: 14816 - DNA, 201 bp, Homo sapiens
accccatgcctggccaatttcaaggattttaggagctctgtgccaggaacctggatgaagacccagtatgtatttcttattatatcacaatatcacaaatscacagtcacatggtgattgtggtagtgtggggggcctgatggtggggtacacctgcttgaagtcaggctaccatgcccattggggtcctccccctttttt

SEQ ID NO: 14817 - DNA, 201 bp, Homo sapiens
tcagcttcccaatgtgctaggattacaggcatgagaccccatgcctggccaatttcaaggattttaggagctctgtgccaggaacctggatgaagacccartatgtatttcttattatatcacaatatcacaaatccacagtcacatggtgattgtggtagtgtggggggcctgatggtggggtacacctgcttgaagtca

SEQ ID NO: 14818 - DNA, 201 bp, Homo sapiens
ctcagcctcttgagtaactgggactgcaggtgcatggcactgtgctccacaattttttttttttttttagagatgggatctcactgtgttgtccaggctgrtctcaaacccttgggtttaagtgatcctcttgcctcagcttcccaatgtgctaggattacaggcatgagaccccatgcctggccaatttcaaggatttta

SEQ ID NO: 14819 - DNA, 201 bp, Homo sapiens
ttctcctgcctcaaggagctgcttctagtgtgtgctcttaaccctaaaggaaggaaacactgtgtcttcctcttctctcatacagagcccttcccatgacmaatgtgtggagtgttccctccttttacgtaattctccaattttctggaccccagcttggtgtcctacaattcagttttgacactaacgacccagagtcag

SEQ ID NO: 14820 - DNA, 201 bp, Homo sapiens
agaatagatggcaaatcccatgatttgtatttgactgacagtcaagaccctgtggggtgtgagcctggtgggggcattccaggctggtttctcctgcctcmaggagctgcttctagtgtgtgctcttaaccctaaaggaaggaaacactgtgtcttcctcttctctcatacagagcccttcccatgacaaatgtgtggagt

SEQ ID NO: 14821 - DNA, 201 bp, Homo sapiens
tatttggaccacttctccctctttccggacagctgcttagtaggtttagcttaaattatacacatgccaagcatgtacacatatgagaagcctatatctcrtaatatccacagagaatagatggcaaatcccatgatttgtatttgactgacagtcaagaccctgtggggtgtgagcctggtgggggcattccaggctggt

SEQ ID NO: 14822 - DNA, 201 bp, Homo sapiens
gaagagacctcaattctgtgccttgatgggattacaccgaagggagcactggtaggctgttgatgaaacaggtggtatttggaccacttctccctctttcmggacagctgcttagtaggtttagcttaaattatacacatgccaagcatgtacacatatgagaagcctatatctcgtaatatccacagagaatagatggca

SEQ ID NO: 14823 - DNA, 201 bp, Homo sapiens
ttggttgtcttagtagataggagtgtgagtacagaattatacgaagtgagaccatgggtgtgtgtgtgcacgtgtgtgcgcatgcctgtgtgtgtcattgsttagttaacaaaaggattgccctctgaagaacatgaacttgggccagacagcacgtgtagggggtggaattatggagcaattgttactttcttgtattaa

SEQ ID NO: 14824 - DNA, 201 bp, Homo sapiens
ctaaatcataaagaaccctgtctcgagcagacgagaaagagtaacggaggcctcaatggtgaaaggaaatcctgtaccagctgtgaaaacaatgagacacrttcagtaatagaatatagtgtgcttacaaattcagagttgggttcccttcttctcttgaagtggctataaattaattcatcaaaataaaaaaggccaaac

SEQ ID NO: 14825 - DNA, 201 bp, Homo sapiens
agagccaaggtcaatctgaatttttctttttctttcttcctttttttttttttttttttttttaaaaaaaaaaaggtgcttgaattagaaaggtagcacaytgtccacatggacagtgcaggatggggctggctttttcatttctgagagctggcaatggaatgaaggtctttttttttttcttaatttttcttttttaaa

SEQ ID NO: 14826 - DNA, 201 bp, Homo sapiens
aaagtaatataccacttttcgcttttttaatggtgagagccaaggtcaatctgaatttttctttttctttcttcctttttttttttttttttttttttaawaaaaaaaaggtgcttgaattagaaaggtagcacattgtccacatggacagtgcaggatggggctggctttttcatttctgagagctggcaatggaatgaa

SEQ ID NO: 14827 - DNA, 201 bp, Homo sapiens
caaagtaatataccacttttcgcttttttaatggtgagagccaaggtcaatctgaatttttctttttctttcttcctttttttttttttttttttttttawaaaaaaaaaggtgcttgaattagaaaggtagcacattgtccacatggacagtgcaggatggggctggctttttcatttctgagagctggcaatggaatga

SEQ ID NO: 14828 - DNA, 201 bp, Homo sapiens
gcaaagtaatataccacttttcgcttttttaatggtgagagccaaggtcaatctgaatttttctttttctttcttcctttttttttttttttttttttttwaaaaaaaaaaggtgcttgaattagaaaggtagcacattgtccacatggacagtgcaggatggggctggctttttcatttctgagagctggcaatggaatg

SEQ ID NO: 14829 - DNA, 201 bp, Homo sapiens
aatgtccggtttggagttggaggagtcattgattttaggcaaggtgatggtgagcccacagagcacagagttaatggaactctggccgttgatgtagcttygaagcctgaatttaagtcatatttttgaaaagttgcgtcttaaaaagttactagcgatggagaatgaaaagtcaatttggacactttaaaagtgagcctc

SEQ ID NO: 14830 - DNA, 201 bp, Homo sapiens
atctaagatagtgatctggttacatagattatcagagatacttttttttttgattatcagagatacttttaaaaaagcaactacaaggtaaggattatcckttaatttagtgtttttctattaaactcaatttgctttaaagttttttacattttgcctcttttttgtatgtttgagtaccacttcctaaccaatcacaat

SEQ ID NO: 14831 - DNA, 201 bp, Homo sapiens
aagaaaactcacagaagcagaaacttagggcttgctttaaatgttatcagtgtgaattgagatggtgtcagcattatttttttaaagaccaaaacaacaakagtaacaaacacacacaagccactgttagattttacaaaactttaaaaagtaattatcttaaagatatctaagatagtgatctggttacatagattatca

SEQ ID NO: 14832 - DNA, 201 bp, Homo sapiens
tcgcaatgattcggtgtgttttgttccgtgcatcctggcatgtgaaagaagtgaggtaaagagtataatttacttccttgttttaaagctagcattgcccrtgccttccacgcgggactgttgtggatatttgaccactgcaagaaaactcacagaagcagaaacttagggcttgctttaaatgttatcagtgtgaattga

SEQ ID NO: 14833 - DNA, 201 bp, Homo sapiens
aatcactgaatatgttataaccaaaaaggtcaaactcgcaatgattcggtgtgttttgttccgtgcatcctggcatgtgaaagaagtgaggtaaagagtayaatttacttccttgttttaaagctagcattgcccgtgccttccacgcgggactgttgtggatatttgaccactgcaagaaaactcacagaagcagaaact

SEQ ID NO: 14834 - DNA, 201 bp, Homo sapiens
tggtatccccaaacaaaatgttatcaaatgaagaactccttcccagctctcccttctgagtgtctgattttattcaagctcagatggcttctcagatagcktaaaaagtgatggagaatttcttttaccaattgtatgccctgtgggaacctgggtgctgtaatcactgaatatgttataaccaaaaaggtcaaactcgca

SEQ ID NO: 14835 - DNA, 201 bp, Homo sapiens
tggttagattacacgtttcctgagaggtatagatttcaaaattggtgtatttcacccgtccctcatcatggtatccccaaacaaaatgttatcaaatgaaraactccttcccagctctcccttctgagtgtctgattttattcaagctcagatggcttctcagatagcgtaaaaagtgatggagaatttcttttaccaatt

SEQ ID NO: 14836 - DNA, 201 bp, Homo sapiens
tactctaggaaggagaatctctgttgggatcttttggggagtacttgcctcccaagtgcttaggctcccgctgctgacaagaccctctgcctggcaagccstgcaggttggaatcctctgttagggttccaaagccttcaccaactcagagctctttctctctctgtttctcttttttgaatttaaattgatcctagtcac

SEQ ID NO: 14837 - DNA, 201 bp, Homo sapiens
gctgtttactctaggaaggagaatctctgttgggatcttttggggagtacttgcctcccaagtgcttaggctcccgctgctgacaagaccctctgcctggsaagccgtgcaggttggaatcctctgttagggttccaaagccttcaccaactcagagctctttctctctctgtttctcttttttgaatttaaattgatcct

SEQ ID NO: 14838 - DNA, 201 bp, Homo sapiens
ttaattatgaccataaaggccccatctccaaatgcagtcatgttgggggttagggcttcagtgtatgagtttgggatggcaggggagcagttcagctcgtragaatcgtaagattcctgatctgtttctcttccaagaaattgtttggtttcatgttgattttatctccttttccctatctgtctcaaagcactgaagaaa

SEQ ID NO: 14839 - DNA, 201 bp, Homo sapiens
tgtaaattgtctaaaattaaattttctgtggttgtcatccacatgggttctgaacttgctgttataattattcacattttcttgcagtgaaaatctacagrtcaaggtcatcttcacgtctttagttcttgttttgcttcaggtcagtttagaaccgaatgttaaaaggatattgtctattcgaagggtcagattgtggca

SEQ ID NO: 14840 - DNA, 201 bp, Homo sapiens
ttcttcctaccttccatatgagagaatagggaaaattaaagaataaatgtctctgggtttaatgcaactttactaaggaatgaaagtccgataagaatccrtatcttttgaaagaagattttttaaattccttatttttccttcctgcatggtcataaaacacactggggacagcccaccctgagaagtcaccaggcatct

SEQ ID NO: 14841 - DNA, 201 bp, Homo sapiens
ccctctgataatcctgcaagagccagcccagttttgctgacagcacagtctgctgtttaattattgtgtgttcaatgacttacctctttttagtttaattraaattatttctcagattaagagccatgctatgatgcttgccaacggatatttaaaacatgtaactgatttgttttttataatgcttcaggagaactcagt

SEQ ID NO: 14842 - DNA, 201 bp, Homo sapiens
gacgtctatgctttccagcttgccaattctggggcctggcacagtatctttcaccccggagtctcagtttcctcatctgtaaaatgggaaccatgacgtcrgcatcacagagttgtgagaattcgacaaggtggaatgaaagcaactagtgtggtgtctgaccgcttgtgttagtccatgaggaatttccttacgtattgt

SEQ ID NO: 14843 - DNA, 201 bp, Homo sapiens
atgcctatgcttttaaaaaattattgtgatacagtgaaacaaggaagaacgtgtagctggaaaaatagtatttgcttgtaatatacattcagattcataayaggcttatttgattcccaggacagggtgagcaaaggatgctgtttcctgggtgtctgctttggtgttcattgagtcatgtctctctctttagaccttact

SEQ ID NO: 14844 - DNA, 201 bp, Homo sapiens
attactgaaaaaaaaacaaaacaacaacaacaaacaacaaaaaaaacaccttccactaaaactgactcaaaaagataatagcagggaaaatgacatgtcgrtctgtgattccttttttacttgtcagtccttttgggagttgaacatataagcacatgtacctctatgtgacttttgagacgtctagaatagagaattcac

SEQ ID NO: 14845 - DNA, 201 bp, Homo sapiens
gcctgaaataatttcaaattaacccctgaggaacaaatgctcatgactttcaatgaatagaaaaatcagactgctagaacctccagactgcatgtcatgcrtagaagtagaatcctggggaagctagctcacaaaagcaagggagatacctgcaaggctgagctgagcttgcaagggaagaaaaatattagagagttgtca
